United States Patent 9,518,277 (GENETICALLY ENGINEERED MICROBIAL STRAINS INCLUDING CHLORELLA PROTOTHECOIDES LIPID PATHWAY GENES) - sequence listing, part 8

SEQ ID NO: 27078 - DNA, 61 bp, Chlorella protothecoides
gaaggagacggtgacgccgccgccgttggtgtagatgtcgggcagcgcgacgatgccgcgg

SEQ ID NO: 27079 - DNA, 250 bp, Chlorella protothecoides
tgccggagtcggtgctggagggcgccagccagccctggcgcggggaaagagggggggggttcatgggagcgctatttgcggagggggtgaaggtcactggttggtgagaatgagaatgtcgtggggaagggtcagccccccgcgacccatcacgtgcttggcccccctctttcccatgcaatcaccccctgccatccgccccctcacaaaagaaaaatcatttgccttgaggtagagcagggtgcagagg

SEQ ID NO: 27080 - DNA, 125 bp, Chlorella protothecoides
ccagagggtgtgagagaccgaggagggggggtgggtgtgcaaaaacgggccggcgaagtgaagttgtacagtttggcgtgcggagcggtgccggatgggaccatgagtagacagcagcagcaaaa

SEQ ID NO: 27081 - DNA, 75 bp, Chlorella protothecoides
ggctcactctgataaacaaactcgccagagcttacataacaatctgcatgtcggccattgttcctgcacaactgt

SEQ ID NO: 27082 - DNA, 127 bp, Chlorella protothecoides
agccgacaccttgccgacgaccacctggttgcaaaggagggaaggaggtcgtatttgtttgagggtgcgaatagggccggggcgcacggtggccactctggcgctgccggcgtgccaggatccagcc

SEQ ID NO: 27083 - DNA, 73 bp, Chlorella protothecoides
cagccgtagtagagggaggggacatccgtggtgtgggtacagtgctgcatggacctgaacatggtgtccaacc

SEQ ID NO: 27084 - DNA, 61 bp, Chlorella protothecoides
tccggcatgctcgcctgcgggaggggcgggtttgggcggcgagggggtgaaagggagacat

SEQ ID NO: 27085 - DNA, 61 bp, Chlorella protothecoides
ccagggaacccacctggtgggtggcatctccaggggatggacccccgtccgcccgatccat

SEQ ID NO: 27086 - DNA, 464 bp, Chlorella protothecoides
caaaccccctcccccgccccccacataaaacgacacatgacagacctggtccagatactgcttgcagttccagaggtaggagaacttggtgtcgtccttggccgggggcaggtccccatcgcgcacgcgcgccggcgcgccgtccggcaccgacaccacgttgcccaggcccgcgctctccatggccagcttgtccatctcgccctccacgatgaccacgtcgccgccggccgggccgtcgaagaccagctggtccaggccgtacagcaccttctccgccccgcgcacctgccagaagcgcttgtccagcgtgcggtacttgacgttgaccagccggcccgcgcggtggtaggggaaggcgatgacggcggcctcgccggcgccgccggggacgtgcagcgtctccgccgccacgccgttgcgctccagggcctcgcgcgagatgccgcgcgcgtcgaagaacg

SEQ ID NO: 27087 - DNA, 76 bp, Chlorella protothecoides
gatcttcagcaactccaacgccagcacctattttttagtgtgtgtgtgaaggggtggcgggggtggtgggtgttgt

SEQ ID NO: 27088 - DNA, 140 bp, Chlorella protothecoides
atccctaccatctggaaattcagtggcgtgtccgctgccagatgtccaagcccgtgtgaggggccacaccaagagcgacctctttgaggtggctgatttctgatatccagcccttcaactccctcacttccagggagcgt

SEQ ID NO: 27089 - DNA, 77 bp, Chlorella protothecoides
cgacccaccggctcgtcaccacgactcaaatcggtacatctgtaatacaacatctctgatccagcaaccaggagtgt

SEQ ID NO: 27090 - DNA, 99 bp, Chlorella protothecoides
cactacctagacctgactgccacaagctctcgcccccccatcatgccgtgcaagagagcagtacagaacacccccaccaaccgtgccaagatatacgcc

SEQ ID NO: 27091 - DNA, 131 bp, Chlorella protothecoides
cctggcttgattgcagcctccactatctggtttgttgcccttcccaatgcgtttgtgtatgctgtgcaactctccaagctgaggcctgagtgaggctgccacttcagcttatcgtcagattgctgcgctgg

SEQ ID NO: 27092 - DNA, 107 bp, Chlorella protothecoides
gcacaggccttggttgcgagagcgcgacgtcgtcgccgaaaggtcctggaagcaccgcatgatcactcttactgtatcagatggttcataaatggtgcattacagct

SEQ ID NO: 27093 - DNA, 161 bp, Chlorella protothecoides
gtactaaattgcaagtgtccttggtcctcccctgctatggggccgtgtccatttgacctgcacctcactgccacttctacacccatgctcttgcaggacacctgccggaaacggacccagctcctgggaagagcttgcaccacagaggtgagccacaacgc

SEQ ID NO: 27094 - DNA, 118 bp, Chlorella protothecoides
ggcctctttggggccctctttggcttcatcctcggcttcttcatcttcctcattgtgctcgtgatcggcgggcccacgggggtcgccatcaaccccgcccgtgacctggggccccgca

SEQ ID NO: 27095 - DNA, 61 bp, Chlorella protothecoides
tctcgattccaaacatgtcgggattatctcacctccgagccccagatctgggtggcagaag

SEQ ID NO: 27096 - DNA, 66 bp, Chlorella protothecoides
cagggcaaagaactctggggcgagggcccaatgcacctcagtccagctatgagacgcttctccacg

SEQ ID NO: 27097 - DNA, 61 bp, Chlorella protothecoides
cagcccgattgtcgatgagatccgggattgcattgctgtcctcagagacacggtgagcggc

SEQ ID NO: 27098 - DNA, 71 bp, Chlorella protothecoides
tggtcgaggagtccaacggtgagcgctgtggtccaacgatgaaggagcatgtggagtctcttgttgaggca

SEQ ID NO: 27099 - DNA, 61 bp, Chlorella protothecoides
ctcatacacaccatcaaaatgttatggctttagggcgtctcagcctccctccatattgttg

SEQ ID NO: 27100 - DNA, 61 bp, Chlorella protothecoides
ccccaggacactattcccgtcatttcaagaaactttcttcagggtgtctttacatttcctg

SEQ ID NO: 27101 - DNA, 61 bp, Chlorella protothecoides
agtcttgcgatgacccacagactcgtacccaggagttgggatcactgttcgcatcgctcct

SEQ ID NO: 27102 - DNA, 74 bp, Chlorella protothecoides
agatgtggcacaagtcctcaaggtgtaggaacaaagtcctgtcgtgatacatcatgctgtgtacaactcatgca

SEQ ID NO: 27103 - DNA, 74 bp, Chlorella protothecoides
gacgagagctcaaatccgatggaccacaccttgctccccatgatcaggaaagcctcccttcacacccagccatg

SEQ ID NO: 27104 - DNA, 158 bp, Chlorella protothecoides
gaggtgggctggacttctgatgaggtgggggtgaggatactagcgggggagtgaaaaccggggcacttgggggagcaggaggaagatgcgggactgtcttgattggcaccctgggtgacactacaggcgacttggtgattggatccgtgtagaacgct

SEQ ID NO: 27105 - DNA, 139 bp, Chlorella protothecoides
gcctggcatgaagcatcctagacgatgcttgccagaatgcaggatggtgtgcctggccctccaagaatatagcagctgaacgccttgcaaccagcagcagacaggcccatgttatgcagacacgaaagccagtccagat

SEQ ID NO: 27106 - DNA, 61 bp, Chlorella protothecoides
caatggacacccccagcaggcggtggagtacctgagtgacagctaccagggtgggcacctg

SEQ ID NO: 27107 - DNA, 148 bp, Chlorella protothecoides
acaggacccatgttcatctgtcgttccatgctgaagacggggtactcatggtgggccatctattcgctcatgctggcctggtctggagcagtcgtcttgtataactcctacttctacatcctggcctgagcaccacttgggagggctc

SEQ ID NO: 27108 - DNA, 80 bp, Chlorella protothecoides
catcccatgcacttgtattctgcaagaatttgagatctagaattgcttttgtaaagcgcgttaccgagccccggggcagc

SEQ ID NO: 27109 - DNA, 86 bp, Chlorella protothecoides
attctctgacctcatgccgcacatgctcgcctccttgcagtctgggagcccatgtgtacctcatgacagttgacgacgccgacgcc

SEQ ID NO: 27110 - DNA, 68 bp, Chlorella protothecoides
tcagaaactgattgtgcctcacccaatcccaagaacttaggcctgctcgggctggtgtcctctgacga

SEQ ID NO: 27111 - DNA, 79 bp, Chlorella protothecoides
agcctcgagctgaactagacagaggttgttgattgtcactgcgtgacccctcacaaaggcagcagatggtcctgaagag

SEQ ID NO: 27112 - DNA, 76 bp, Chlorella protothecoides
ggacagtacgagcctctcagtttgaagccatgtgcgttccaggcgggcaccgcccgcggtcccgctctgggctccc

SEQ ID NO: 27113 - DNA, 183 bp, Chlorella protothecoides
tgccccggcccggggagtgagagtggcgggcgagcctgtgggctcgggggacccagcaaacgcgtgatcgtctctcagaggggtgggagcgtaccgaggacgcaccaacggtcattggggaccgatccctgtactcttcagcgctctcgatggcttgcgggcggggcgtgccagcgaaggagc

SEQ ID NO: 27114 - DNA, 67 bp, Chlorella protothecoides
agcaccgcatgatgcgcgaggcgccccccttcacgccccaccatacctcacttgatattccagatcc

SEQ ID NO: 27115 - DNA, 4308 bp, Chlorella protothecoides
gggggggggaggcgcatgggagggacagggtagcccaagaggaccatcccccagctgtgccagagggtggttagcactgcccaggcagtacatccccgcccaccccacctctgacccagaagccagccacccagtcgctcaccgtcggtcaggctggcctcgttcgcgggcacggcaggccctggggcggccgggggctctggggcagggacagggcctccaaagccgggtgggggagcgaccaccttcttctcaggagtcctgtcctcctcctcctcctcgtggcgaggtctgtgacacagggggttggggttggtggggggcctggggtgagagcgcgtggatcaagggcgggagatgagaagcggtctcatgaaggggcatggccgaagctcagagttgaacagcaagcaagcaaccccacagcgcaccctcccaggtggcactgaaaggcattcctccctcacacccgcgcaggctcccgctcacagggtgacattcgcgaggctgttatttgaagcgggaggggtggctccctggcagatggcctgaatagcctcgttagtggccgcaaggatcagctcctcagatgcagcagggtcaccagcagcgtcaacagcctccacagcggccgcagagatcagctctttggaggtaacgggattgctagctgcagtgatagccttggcaacaaccttggcgatcggaccctgaggagggatgttgttgacagcattgatgacagcctcggtgacgaccgcagggatcagctcctgggaggaggaagcgccagccaaaacggcaagcccggccgtctcggaggtcggcatctcactaatagccttcgttttgcgcaggatggcgtcaggagccttggaggccagcccggccttctgggtggaggcgtcgggggtggttggcaccagcttgtccgaggcgacaaccgtggaagccacatccccggcttcagaaacgggcatctgcggcaggagttgaccaaaagctttgtgagatcgagtctaggggacggaagaggcctggagactgtgcggtaatgaggcgcacaattcgtatctccaacctacctcagcgacaggtgtgctcttcgagcccttcttcggcatacgcggctccttgctgagcttcctccgcgccttcacgacctgtaaatgagtgtcggtgtgcacagattgagaagctgcaagcagtttggagtggttgttgcaacacgggcaggttcccagacgtatactcacgtggatggcccacgcggacttggtgcccaaagacatattgaatgctttatcaagaagatttgtgtgaatctttatgtgtgaaaaatggcaggtgagcattggggacatgcgactgtgattgcatctcccgtgcactactctaacgacgcagaaggatgacatatcccagagacaaaccagggccagtaacggaatcctcgcgggccccccatgctaggcacggcagcatcatgacaccaggctgatcatgcagtgaaacttcgttttcattggtatgcgcatgccgatgcatcatatcaaggctcgcagcagaagagtcagcgggctctgcacatgtctgatgacgatgggttcgggcagaggagcgcgagccgattaccggaccaaaaagccaacggcgttcacattagagccacaccctagatttcagaagctggaactggtattcccgctggagacttagagttatgtgcaaggagacgtccgcccagcatcggatgtctgtccccatcgcgtttgcgaaggacaccggaggcgcggagctgtagtgtgatgcccccctaacgttgaaagcgtggctttgtgttgattccgcctcctgatgaagtgcagtttccgggatatgcactctggccaagttctgatgggccagatctacgtgcaggagatcaatgtccatgcagcgccctgcagtgcctcccaatgccagccctccgattgtgctcgaagtcacttgctggtgtgcaccgatcagcagggcaattatcttgcacaacgccaggtgagggccgccttgcatgccccgacgctcttgacatggacgatgtggaaggggttcgccggcatcctttgtggccccctccgtaggggcgacgctttcgatcttgcttccatccctgtccacagccagcgggcctccagggctccctctaggtattccaactagggtcaatgggtgaaaagcacccactcccaccttctcgactgtctctactggcgacaaagccatagtgaagcttggcaagcatctaccatgggtatccaggtccctccaccgtctccagcatgtgtatttccatgtctcaataatcaatcaccactgttatgctcatccactgagcatcaagtgcacggaggctagttttagttcttccatgctggcatgtaacgactcccaagctgcacgagaactgggctgcatccatcgatcgccatgcgctcaggcaaggacatggatgccgccaaacttgtttgaaggtctatcttgcacactcatgtggctgagcgctgcagctcaatgctcaggcaaggcacgatgtactaatatctgtctttttctcagtcaacagacatggctgcccacaaagtgcacccctgagcccgatcccaggtccttgactgcaaggtgcctaccaccttgcagcgtttcatacccttgcattgtcatctctgccgcgagccatgctgtgaaccgctgcgggaccctttctacaacctgggaggtgtaccgccaccacagcccaacgtccagcccggccacagggcgggtcatgccatccgccaggtgtgttacgtcagccatgccacagtggttgtcacagctgtgctgctcccaataataggaggtcatcgtgcatccccatggggcgtattggaacggccaccctcccgataagaagcctgaataaaaccaactcgaggcctctcccctggtctttgaggaacttgttaggtgagcctgattagagagttgccctcccaccccaagaaggtgaacatggaaatggcatctgcggtgtcgtgctgcacgggcatgcgagcttggcgaggtgtccctgctcattgtgcaggtggtgcaggaggatggcgaggcccagacggtgggcctggaggacccccgcatcgcccagctggtggacgagtacgccgacctcttcctagcagagctcccgacggagctgccgcccccgcgcggcatcgaacacaccatcgagttgaaggaggggacgcaccccatcgcgcgcgcgccctacaggaccgcgccgccggcggcgcataccatccgggcgcaagtggaggaggtgacgcgacaggggctgatccggccgtccacgtacccctgggcgtcgccggtgctgctggtgggcaagaaggatgggtcgcagcggatgtgggtcgactaccgcgccctcaacaaggcgaccatcaagtatcggtacccgctgccgcgggccgatgacctgatggacaggctttccggcgcccgcgtcttctcaaagctggacctgcgcagcggctaccaccaggtccgggtcgcggagcaggacatccccaagacggccttcaccactcggtacggcctcttcgagttcgctgtgctcccgttcgggctgtgcaacgcaccgaccaccttcatgcgcgtcatcaacgacgccatgcgggagtacaccgacaagttcgttgttgcctacctggacgacatcctcatctactccccggacatggagacccatctgatccacctgcgcgtggtgctggacgcgcttcggcggcacaagcgctacgccaaccccaagaagtgtgtcttcgcgcagcccagcgtcagcttcctgggacatgtcatcagcgccgatggcatccgcatggaggaggacaagctgcccgccgtccgggactggcccgcgtcctgcaacattaaggagctgcgcggcttcctgaggcttatcaactgctaccgccgcttcgtcaaggactacgcgcgtttggcgcatcccctgaccgagctgctcaaggccgacgttccctgggcttggggccagccgcagcaggacgccttcacgcgcctgcgcgaccgcctgctgtccgcgcccgtcgtcgcctgcccagacttgaccagaaaccttgtcagctggtgcgacgcctccgactttgccctcggcgcggcactggtccagcacgacgacgccggcgtccccagggtcatcgcctacaagtccaggaaactgcagcctatggattccaagtaccccgcgcacgagaaggagctgttggg

SEQ ID NO: 27116 - DNA, 95 bp, Chlorella protothecoides
cccccaacacactagatgtcagggtgtgagcaaggggggcgagggcaatgatgcacccacgaccgccatggcggcggcgatagtgccacgaaaca

SEQ ID NO: 27117 - DNA, 65 bp, Chlorella protothecoides
ccactgccggctcagcaggcatccaagggacatgaaacagccagtctgtctacgaacaggcatcg

SEQ ID NO: 27118 - DNA, 61 bp, Chlorella protothecoides
aacagccagtctgtctacgaacaggcatcggcgaggttaattttgtatgatgcgcagatga

SEQ ID NO: 27119 - DNA, 118 bp, Chlorella protothecoides
gcatccatgtctgtgcagggcatggactggcttagacacgggcgccaagtaaggtagatgcaggaacacacacagccatccgccagcgtgtacatgcctcagcatgcatagcagcgat

SEQ ID NO: 27120 - DNA, 69 bp, Chlorella protothecoides
gttgttttctagctcagtttccagtatgatctgtccagacgggtcgacaccaggcagtgatgctcttcc

SEQ ID NO: 27121 - DNA, 64 bp, Chlorella protothecoides
cgctgggttcctgccgattcccctcttaggatggtgccccgaagcccgctgacacgacgcaggc

SEQ ID NO: 27122 - DNA, 85 bp, Chlorella protothecoides
ttcaggtcatatacagcggtccaccgttgtaggggccagcccgcccccacaacggttggtttcggaaacatggtttcccgatctt

SEQ ID NO: 27123 - DNA, 102 bp, Chlorella protothecoides
gttcccaagcaggacagctaagcttgcagcggtaatgctctgctgctcaggggcaacattgtctctgagaccccagcacctgccactccctcagcccacctc

SEQ ID NO: 27124 - DNA, 111 bp, Chlorella protothecoides
cggccgcgggatgaggcacttgcatggtcagtgatcagagctcattccagaattccctcactccccctttgtcaggccgtccgcgagctgggcctgctctcctcccccgct

SEQ ID NO: 27125 - DNA, 157 bp, Chlorella protothecoides
actaccaacttgagcacctgttgtctgccgcgccaggctcctcagcgcggcaaagctgttggctctctcggtgacgcccaccttttgacacgggcaaggtgcttgcaacaatgagtcaatatcccatgcttggccaggccgcaatcttgacatgcac

SEQ ID NO: 27126 - DNA, 61 bp, Chlorella protothecoides
tgcaggttattctggagcacacttggcgtcggacttctgtgtaaaggtcttctcacaccac

SEQ ID NO: 27127 - DNA, 404 bp, Chlorella protothecoides
agcaggctcgcctctgggtacacaaacggtagggggggcatagaggggccgcagtgctgggggatacttggggccgggactggggtgggtgctaggtagctctgctgtctgcctcgacgagcagccctgccacctgagggcctggcctcccagcgccacttgccagctcagtcctgcagtactcagattatgccctgacccagcgctggtccctggtcctggcaatggaacggcggcgcccctttttactccgcccgcacatcgactctcccgccccttccctccctcccccagcccccggggatgcatactcactgcgcaccccacccacacgtaaccacaggctggtggcgcttgtgtcgtgcctgggccctgaccccgcctccagcctggcccgcaacgtg

SEQ ID NO: 27128 - DNA, 68 bp, Chlorella protothecoides
tcctgagagcgatggcctggacagctgcttacgtcaggcagctctcccttgagcacccctcaactcag

SEQ ID NO: 27129 - DNA, 111 bp, Chlorella protothecoides
atccttgcccctgtctcgggacctgcgaggggcccatgcggcttgagatgcgatggctagcgatgggatggtccatgcccgaacctatgcaaacgcttgatcttggaggga

SEQ ID NO: 27130 - DNA, 145 bp, Chlorella protothecoides
gtgactctggtgttcatctgaactgatgatgtctccatccagggctcacagatgccgccggcaaatctgtgagtatacaagtacaacgagcctgttccaacgtgccgaaatccctaaagggaaaggacatacacatcacttggcc

SEQ ID NO: 27131 - DNA, 81 bp, Chlorella protothecoides
catcctcacgagctgacagcgtctgccgccttaacattgccccactcccgcaccctccccagcggtcggggcatacaatac

SEQ ID NO: 27132 - DNA, 67 bp, Chlorella protothecoides
tgagtaaatcgcacatgtcttccatttcaataccatgcacctgcattcgtggcggagttcgaagtgg

SEQ ID NO: 27133 - DNA, 62 bp, Chlorella protothecoides
ggattgtccagcatcaggccctgacaacgtcattctgaggtgtcttgcactcagtttcgcaa

SEQ ID NO: 27134 - DNA, 65 bp, Chlorella protothecoides
actgcgcgttggaggtacattctttgccttcgtttcacaatggcgcccgtgactctcattgacca

SEQ ID NO: 27135 - DNA, 145 bp, Chlorella protothecoides
ggccttgcatgccacctggaagctgcccagaaagaaggaggccctcgcggcctgggcgcacgccacgtggaacgaactgtggcaggaggccaagcggcatcccagggacgccccacgcttgccgcagtgggcacatcgcagggct

SEQ ID NO: 27136 - DNA, 61 bp, Chlorella protothecoides
ctgggtgagacaatggcttatggttaggggtgaaaggacttccatcatactgttgagagtg

SEQ ID NO: 27137 - DNA, 122 bp, Chlorella protothecoides
gtccagcgccttttgcttcttggcctgcttctcggctgccttggcggcctgttggtgcgatgattgaaggggtggatgggttggtggggctaaaggtgccatactatacaacctatactaaa

SEQ ID NO: 27138 - DNA, 170 bp, Chlorella protothecoides
ctcctcgccacctaccccctgtgaaatggtacctccaccctgcatgatgatgatgctgcgattttgtgcaatgagatgcagcacatgacatctgacctcctgcatgtctatcaacccacactttggaggtggttggatgagagtgagggaagcattgggaggctgggaga

SEQ ID NO: 27139 - DNA, 139 bp, Chlorella protothecoides
cggggcaggcctgcagcgcgcgcgccagcaccgcctcggcggccttggcgttgccggcgcgcgcctcggtgcgcgcggccgccagccacagcgccggctgcccggggttcttcagccgcgcctgctccagcagagcgcg

SEQ ID NO: 27140 - DNA, 97 bp, Chlorella protothecoides
cgacgccgctctgcgccgctctgcgtccgacgccaccgctgtcgcgggcctgtcccagggcagggtggacgcctccgccttccgcaccagctacgtg

SEQ ID NO: 27141 - DNA, 1732 bp, Chlorella protothecoides
  modified_base (641)..(650): a, c, t, g, unknown or other
  modified_base (1023)..(1032): a, c, t, g, unknown or other
aaaaggggggggggaggaccgcgcgcgggggcagcggggggcggggcgccagagggctcgctggggcgccgggcgcagggctgctctcgcgccgggggcgatgctgggggagggggggtgatgaagaaggaggaggcttaaatgatgagggcctttgggaatggtaaagagtcccaggaggggtccaacgcatgtgatgcggggcccactccccggcccctgccgtgccctggccggaagctggtggccagcaacttgcggctgggacccttacctgggcgttgcaagattcatggcgagaccataacctcctgcgcccatcaagccaccgggtatggaacgggggggtggggcgccggtgtactcccagcccttgccaccccagtgggagcgggcgggggaggggaggagcgcgagggggacccgatgccaggagacgctcccgtgtctcggatctgatccgtacagcaacgcctctgctcgtcccgatcaatcgagccggtctatcggcaagggtcggaggggccagggttaaaatcctcagctcgaacagggttgtgccgagctcagcaggcaacgcactgcggagatcggttcctgtatgaacaacacacgcacatgcatgcatgcttccgtcatgnnnnnnnnnncgtgccgagctcagcaggcgacgcactacggagatcgggttcctgtatgaacaaaacacgcacatgcatgcatgcttccgtcatgaagggtatgcaatcgatcagtgattggatatgaacttttagactaaagctctcacaccctgtactcgatcatgtcggggcgtgggggtgggaggggtgcctactacaggtccaagtacggtggtggcgggcgtggcggaccccgaccccctgcaggtgccacgccgcggagagagcgaagtaaagcggccttctgattggccaatccccttgtcatgtgcatgttgtaacctcctgaacagtgaaacccatgccccacccgtagatcagtcaggggggacccctcggnnnnnnnnnncgcatgttgtaacctcctgagcggtgaaatccatgccccccccgtagatcagtcaggggggacccctcggtacaccggccacatccgcaaggcggaggacgatgcggcaggctggtcccccggtccacggcgcggcagccccgctcagctggcctccgagctggaacgcatcgacggcaaggggtacggcgcctatcacgacatcgcaggcggctgggacttccccggcttcaccctctgggtggaccgggtgcagggagacccctacgccagccccagccggtgccgagtggtggtggcggctggcacggccggcctcccctcccacctgctccggacccgcccgcgccgcctggcctgcgccgacttcctggcgcggcgcttcggcgaggcagtggcggccgctggcggcgacgtgcgcgccgcggcggggggctgggccggggccaagggcggcgagatgggcgtggacgtacccggacagtacgtgctggagcgtaccgccgtccaggtgggccacgaaggccacgtggaggcgcgcttcaccgtggccctgcccgccgcggggcggtccgtgctggggcgctgggcgcgcagcgtgctgaccgaggcgctgccgcgctacgtcagcgccgcgctgcgccatgccagcctggacgccgccgcgctggcggcgcacgcagacgcggccgaggacccc

SEQ ID NO: 27142 - DNA, 66 bp, Chlorella protothecoides
caccctctggaaaactcccctttccgcggcaggcagcaccaccaccatgcctcaccatggcgttct

SEQ ID NO: 27143 - DNA, 185 bp, Chlorella protothecoides
actgtggaggcaggtggccccgggactccttacggggccgggcgctgctgctggcatggctgcagataaggtacagcctgagatgtagaaatgggatacacgcccgttatgcatctgcggggggcccggcagcccgagtgcgcgccgcctccctcagctccacggtgtacagcttttgcttctgt

SEQ ID NO: 27144 - DNA, 61 bp, Chlorella protothecoides
aatcacaaagaccgcctcatgtgcccgtgccccgtgccctatctgcaggtggatgtgcagc

SEQ ID NO: 27145 - DNA, 61 bp, Chlorella protothecoides
tcacaaaggatcccccccccccatccttcttacgccacccaccgctcttgtggcaggagct

SEQ ID NO: 27146 - DNA, 127 bp, Chlorella protothecoides
tgtggagacggcctcgctcctagtcgcactcaaggttgttgtgtgggatggggtgtcggcggtagctggcaataggcgccagctcctgcccttggcatggggagcctatccatcatctagggcttgg

SEQ ID NO: 27147 - DNA, 107 bp, Chlorella protothecoides
tacagcacctacctcctaacccccccccccaaaaaaaaacaaaggacccctacgtgctggccaagctggaggaccttgcccgcagccacgcggagctgcaggccggc

SEQ ID NO: 27148 - DNA, 67 bp, Chlorella protothecoides
ctgctcaaggggtagctgatgtcttaggctattgtgagggttccccttgaccgggccctttccccac

SEQ ID NO: 27149 - DNA, 71 bp, Chlorella protothecoides
gagcggtgaccgtgtcctgagcaggggcccggatcaagagtggggcgaaggcagtcagagcatgtgcatga

SEQ ID NO: 27150 - DNA, 74 bp, Chlorella protothecoides
ctgggactggtcaatcccaacagtctcatttctctggggtgcagggggatcagatggtggatgagtatcatcat

SEQ ID NO: 27151 - DNA, 61 bp, Chlorella protothecoides
aaactgggtagaggatgcaccctagactgcaaaattgggccggcacatgccattataagac

SEQ ID NO: 27152 - DNA, 83 bp, Chlorella protothecoides
gcaacagatttcctggacaccatactcgtactgcctgcaggtcttacattctgcaagaccattcgctcttggtcaatatgatc

SEQ ID NO: 27153 - DNA, 130 bp, Chlorella protothecoides
gggcacgaggggaggccatcagcctccggactccatggtggtagcggatgcagcaccgagccgagcgctgtgtactagacctcgaggcaggccgtgacatagcaatccagctgcactctcgctcaccgga

SEQ ID NO: 27154 - DNA, 715 bp, Chlorella protothecoides
caggggagggagggggggaggggagggggggcagacgtcgccgtggcgcaaagtgcttccaggggcctttgggtgcggggtaggttgatccggcgcgcgtcaacgagtgacgcagcggccgacaaggctgcaggaggggggtaggcatccggccaggaggggcgggtggcgagccggttgacatttccagacgcggcagtatcatggcctcgccctccgtccaggctcttccccgacgatcaccacgtctccctgccctcaggccggctgcgccgccgcgctctgcgcggcaacctcgccgccgcccggcgcggaggccgtggtgagggtggcctcgccctcatggctggctgcggccgtgggtgccgcggaggagcgcacaaactgccccttcacgcgcgggcggctgtcggccagcaccttgcgcgcggcgtagcggatggtcttgcggaagctcaggccctcgcgcttgtcgcggtagcggcgcagcgcggcggcgcgcgcctcccggcgctggcgctgcagcaccgaccccgtgctgagcacggagggcgtgccgtcgggccggtcgaaggtggccacgccgaggccggggccgggacccaggcgcgtcgcgtcggaggagcccgaggcataggcgccagagccgcccagcagcaccgtgctggcgccgctgctgcccgccgtggcgccgctgccggaccctgggccgccc

SEQ ID NO: 27155 - DNA, 78 bp, Chlorella protothecoides
aggctggagcggcgaggggtacctgttgacaaagaggcttcggcaaatgcccgtccaggcatgcaggccgctgccctt

SEQ ID NO: 27156 - DNA, 146 bp, Chlorella protothecoides
ggcttcagaggaagcagaggaggcaggggtgagtgccccgtgctgagaagagctgtggtgcagaagggagcgccctgttgtttggcaggaataggagtcagcaacagcagtaatgactatcccatacaggtcccctcactgctaat

SEQ ID NO: 27157 - DNA, 61 bp, Chlorella protothecoides
ctccttggcagagatcatgccgtactctgggcggccacccgaccgactcggctggacgtgc

SEQ ID NO: 27158 - DNA, 73 bp, Chlorella protothecoides
cgcatccaggacggggcacatgtgggatgaccaaaggcaaaagcttccttggacaagagtgctgatgagatac

SEQ ID NO: 27159 - DNA, 70 bp, Chlorella protothecoides
ttcggcatgcggcctggctcccatgaggtgcatggtggcctgacaccttcccctgtctcacagggtggtg

SEQ ID NO: 27160 - DNA, 61 bp, Chlorella protothecoides
ccccagaacaacttcctggtgcggcttgggttggtgcagtaagaggggctggggatcgatg

SEQ ID NO: 27161 - DNA, 80 bp, Chlorella protothecoides
gggacttgcatcccttccttgcaagatgtattccagaaacaaacatacagacctgagtggcttcgctgtagtagtaaaag

SEQ ID NO: 27162 - DNA, 61 bp, Chlorella protothecoides
atgggcaaaagcacaaaaacagttcgtcactgggacttcccacgtggtcacccaccgcagt

SEQ ID NO: 27163 - DNA, 61 bp, Chlorella protothecoides
agttggttgcctcgatcggcgaaccaggggcgggggggtgggaggaaaggaaggggaagca

SEQ ID NO: 27164 - DNA, 2427 bp, Chlorella protothecoides
gggggaggtgttgggggagggaggggggggtgaggggaggcaagggatgtgcggagacaggcagtggatgggtggttccccggcgccgggtgaccagccggggcggggcaggggcacccgccagaccggaaccctggaagagctcacctctggcgcgtgccagcgcgggttgttggcgaccatggaggaggccacggagacggtgtccgacaggcgggagaggttgaagtcggtgaccttgacgcgccagtgcttgtccaccagcaggttgggcgacttgaggtcgcggtggatgatgggcccgcggtgggagtggaggtgcagcatgccctttgccgcgtccagggccatgttcaggcgcttgccccagtccagcacgcgcgccgaggcgtcggggttggcggccgcgaccttcagcaggtcgtacagcgacccgcgcgcgcagaactcggtgacgatgcaggccgggtccaggcacacgcccatgaagaggatgatgttggggtggcggatggccaccatgatgcccacctcccgctccagggtgcgcaggacctccgggtccagccgcacctcgccgtcgggcccggccacggtggcccccgccgcgccgatgccgaaagcctgcaggctggtcagcaccttgatggccacatccgtctcctgccaccgccccaggtacaccttgccaaaggcgccctccccgatcacccggctcagcaccaggtcccggaagtccagcagccagggcgtggcgtccccgccctcaaacaggcccgcggccgggctggaggccgcgcgcgcggcggccgaggccgtcgccgggttggcggctgccctctgggaggcccccgaccccgcgccgcgcagcaggtcgtcgtcgctggcgtcccccgggccggcggccaggcccaggccggcgctggcctcggccatggcgtaggccagcacggcggagttgtagcagaagaggggccaggcctcgcgcggcgacagctcccccatcagcgccaggccgcgctgcgaggcggcggcgcgcagcgcggcgtcgccccacagcgagatggtgccgttcatggaggaggtgaccacgcccgcgcccgcgccctgcacgtgggccagccccgtcttgctggcctggatctcgccgtagggcatgcgcgcctggcccacgctccccgccacgtagttgatggtcagcccgccggggctcttggggtgcggcagcggccgcaccagcagccgcccatccaggtggctggtgcacacggcgcccaggctctcgcacaccgccagccccttggcgggggaggggcgctcgccgatgcgcaggatggggcgcagcaggcccgccaccatggtccagacctggaccatgcccgagtcgtgcacggtgagcagctgccagacctgctgcagctcggtggccagcgcagcgccgcccgggccggtgcccccggaccgcggcgccagcgagatgaccgaggcggtggcggcggggtgggccccgcgctccgccggcaggaggacgcgcaccagcgggctggtgatggccatggcgttcacggtgcccatggagcgcaggtcgttggaggccagcagctcgccgcgctggctccactcgcgcaggcagacgaaggcggaggagccgcccgccgtccacacccggcccaccgccgcggccagcgccgacacggggccgtagtgggcctgctcgcgcagcagctcgctgttcaccatgccatcctcgggcacgccctccagcgccgcggcgtcggcgggcgcggcggagccggaccagcgcagcgaccccaccaggctcaggcggcagccgacgggcgcgccgccgcgcaggacctcgcccaggcgcaggcagcgcacgttgccgcggctggaggcggcccagcacgcgccgcgctcgtcgcaggtcagcgccgtgaccgaggagtggaaggcgcggagggggtcgcagacgggcgcgcgcgagctgtgctcccaggcgcgcaccgtgccgttgcggtgccccgcccagaccaggcccgccgcatccaggtgcagcgcggtcaccacgccctccgcccgcacctcgctgtgcacctgggaggagaggtgcaccacgtgcagcgtgcccccgcccagagtgcgcgtgacgtagtaccaggcgtgccccagcgacccgcgcggctcgtcctcgccgggcgggatcaggagcagcgccgtcacgctctgccccgccttgccgcggtgcaggcgctcgggcggcgggatggccgtcggcgtcgcgacagccggcgcccccatgctgccgcccaggccgggcgaggaggggacggtggaggtgcgggtcggggcctcgcggtccgcccacgtgctgcgggacaggccgctgtccgccgccgccagcacgccatcgggcggcgtggaggg

SEQ ID NO: 27165 - DNA, 61 bp, Chlorella protothecoides
atgcacacacgcccacaggtccacggcaagtgagccagctgctcctgtcgagatcagctgc

SEQ ID NO: 27166 - DNA, 183 bp, Chlorella protothecoides
tgacctcacccatgcagctgccagcgacatcttgcgagctacaccacgcctacgaaagcgtgaccataaaattgagtcgtttgtgctgttatagattgggagactttgcttcgtgcggacctttgcattgtttccccgtttcgtcgccctcgctcctgtgtgtgtgtagtcatcattcaaatc

SEQ ID NO: 27167 - DNA, 77 bp, Chlorella protothecoides
gtgattgaggatgccgggttgtgcacaaggatggcctcagccaggacagtgtttggtggatgcatgatggctgaaac

SEQ ID NO: 27168 - DNA, 73 bp, Chlorella protothecoides
gagcagacgcgtttcagggtcacccggccgtcctcccacggcggcagccgcgacggcccgggtggaaagaagg

SEQ ID NO: 27169 - DNA, 61 bp, Chlorella protothecoides
gctgatgtagcgccagtacccgatcttctccgacagataggtggcatagatgatgaactgc

SEQ ID NO: 27170 - DNA, 80 bp, Chlorella protothecoides
agggacagcacttgctccagcagtactgtgcgggaggaggggacgaggacttggattgccgagatggtgatagggaggat

SEQ ID NO: 27171 - DNA, 61 bp, Chlorella protothecoides
gtcacgggcgaccgtgggctgtgcggcgggtacaacgccatcgtcatcaaggtgggtggag

SEQ ID NO: 27172 - DNA, 716 bp, Chlorella protothecoides
  modified_base (144)..(153): a, c, t, g, unknown or other
cgcggaccccttcccgtcccagacgcggtgtgtgggtggggtgtggaatgggccggccggtgtgagtcgacgcgggccaggtgcgcgcggtgcggtgctcgcggccgcacgcgcgcgcgcgcgcgcacgcggacggggggtgannnnnnnnnncgtgggtggggtgtggagcgggccggccggtgtgagtcgatgcgggccaggtgcgcgccgtgcggcgctcgcggccgcacgcgcgcgcgcgcacgcggacggggggtgatgacacgcactgggcactgagccgcccgggcgacacgtcgctcgggtgcacgtgatcgatgcgcactctgcgggcctagaaaacccctgactgacccctccgcgtgcgcgtgcgccttgagtctgtctgttggtggtgcggcgtgccgctgcaccccacgccgaccacgtgcctgccttgactggggaagggcaggtcctcggtccttgccggcccagcgtaccgacacctccccatcaagctcatccggtccccaacccctctgccccttctgcaggtcccggctgctggcacgcgtggcgtccctcggcacgcccgtgccgatcgggcggcgggccaagcgcgccgcggaggacgcgcgcctcctcaacacactgcaccggcggcggcggcgggcgggccagggcacgccgctgcagggcggctcgcctgcgccgcccgaggcggcgcaggc

SEQ ID NO: 27173 - DNA, 3822 bp, Chlorella protothecoides
  modified_base (239)..(248): a, c, t, g, unknown or other
  modified_base (324)..(333): a, c, t, g, unknown or other
  modified_base (399)..(408): a, c, t, g, unknown or other
  modified_base (3615)..(3669): a, c, t, g, unknown or other
tctggggagggggggagggggggggatgcagggagggggttctggcaccggggcttgcacacacagaacagtgggcacctttccaccagtgcccaggccctggcgtacccacgcgagaggggggcacgcgctggacctcctggttggagtgcgcgcgctccagtgtcttcccctcaggcatgcccggcacgcttgggaccctctctatgcaggccatggcccgggggcctgaaggagannnnnnnnnncgttttcccctcaggcatgcccggcacgctggggaccctctctaggcaggccatggcccgggggcctgaaggagannnnnnnnnnaaggcccaggcccaggcacttccggggtggggtattcaacggctgagctgcttcaggacggctcannnnnnnnnngccggccaggcgctcgcaggtgccgggcgcgatgcgagcgtgtcggacggaggctgatcaagaatggaaaaatgacatgtgggcgcgcgggttggccccagatggatccggcaccgagaggcccaggcccaggcacttccgggggtggatgctcaacggctgagctgcttcaggacggctcagagcagcagaaacaggacatcgtgcatgtacatgccgcgcgacgggggtaccatgcagctcgatggcaggttgaggggcccagcccatgacgcatcaagagtgcccagatcgcggggaggggctcgcagagctggatcctggtagaaaggacgtctcggccccgagccggccttactgcgcctgccgggcctggaaccccctcttccaggcttacgcatcttgacacaggtgaggcgtgcgaagcgagaggagcaaaggcgcggcgccgattctgcagccgtgccccggtcactgacggctgctccccgcctgcaggtacccgggcgacaagatggtgcgccacaacaacgtggtgcccaaccagcacttcaggaagaaatggcagaccaacgtgcggacctggttcaaccagcccgcccgcaagctgcgccggaggcagggtgagcgccctcgggacggggacaggaggccctcgaatgcgctccagctcgcgttctgcgctggagacgggcggggaagctgaagtggcttggctgtttgccgcttgtatccctgcgcatgtcggccgcgcagcgtccgggcgtgacggggtggacatcgcacccaccctcatgccccgccacccaccctcccaccctccgcagcccgtgctgagaaggccaagaccgtcttcccccgccccaccgccggtcccctgcgccccatcgtgcactcccagaccgtgaaatacaaccgcaagaagcgcaccggccgtggcttcaccctcgaggagctgaaggtgcgtttgatcatggctccggggctgggacaggaccccagcccgccacctgggtgacctcagcaaggctgtgttggggccctcaccggcaagggtcaaacgttctggctgccagggcagtgcaatgcgtcccgcgtgctgtggtttttagcctgcgcgctcgaatgccccacatggccaacccagtccttttcacagattgccctcccccttccacttccctccgcaggaggccggcatctccgccaagctcgcccccaccgtgggcatcgccgtggaccaccgccgccgcaatcggtccctggagggcctgcaggagaacgtggcgaggctgaaggcgtacaaggccaacctggtgctgttcccgcgccgcgccggcaagccccgcgcgggcgaggcctccgccgaggagctggccgccgtggcccagctgacgggacccgtgctgcccctgacacacaccaagcccaagctggagctggtcaagctgactgccgagcagaaggccgccaccgcctacgccacgctgcgcctggagcgcatgaacgtgcgcatggccggcgtgcgcgccaagcgcgccgcggaggccgccgccgcggagaaggatgcctgagcgtgtgctgtaaggatggacctggaccgaaagagctgggttcagggggcccagggaaggagggaaggagggaggtcggtcgtcatgcaggtgcgcagcatggcttgaacaacgcaggaggcccaatttccgtccaaacggagcgaacgacgctctgcgggtcgtgatcagcacacgcagaaattgcattcccaggattgaaatcgatgattggtaatacattcgcgtggaggatacatgacttgaagacgagagtacacgcttcaggctgacgaccatggcgccccggtaagctgggttggtggcgagtcaatgtgcagcgcacctgcaatgcactgatattatcaatcgaatgtctcgcgttgcaacgttcccgcttgcagaaagttcatggatgcgttggaggcgctgagcggatcctcctccgacagtgaggccgaggccgagccagagccccagcctgcagcaaaaaagagcgctgccaccaagatcagcctggaggacttgcagcaacatggatactctggcggccccagtgtgctctatgtgccgcccccagctgacgcggatcccaactggacatggtgggtcttagggctctggctgggtgagcgatctctggctatgccgtgagacagagatgtggccctggaatgggcactcggaagtatgctttcctcataatgtagatgtattctgccctcctttgccaccctccaggtcctcgggggcagatcgcaagggagtcgagcctgtgcaggagtctcgagaggtgggaagtgtgacggctgcgggtgccagtgggtgatgctgtggcacccccggcaccagcagcttgagtggtgcatcccacacacctctcagcctccacacacctgcccgggcaggagagggagcgtaacagggaggccgtgacctccggcctggatgaagaggcgcggctggcccgcgccgccgtctcgcatgcccagcagctcaaggctggcaggagggctgaggcccaggcgcagaaagaggcagccaatctgagctggaagcagaaggtaagggcgtgggagcaggggtgctgtggattggcgagcttgttgtctggtggggaacggcattcttgcagttcgcaaacacagcccagtcgaggaggtggttatcttggagcgagagggagcctcctgctaacaggatctgtcatgtgtgttgatgattctcctgccaggacatgcaaagcattgaatggcaaggtttgtgtggagtccggaaccccccacacatccctcgctgcaggaaaagagaaaacgagagcgaggacagcaagcttcctccaaaaactacattgaagaggagaaacggcgagcgaggcaatatggcatggtcagcggctttgacacctgaggtgtcctaggtgcacaggatcctcccaaggacaacccctcatgggggggattttatgtaaaaggcatttcggccacgccgactctcctcaccgcacccgtatcgggcttgcgccgcttgcacagctacgtccgcaagaatcaggctggcgcagttggttgccacggacggcgaaccgttttttgtgtagagggtgcagggggtgtgggggcagcgaacaagggggcccgccaaaggccgtggnnnnnnnnnnnnnnnnnnnnnnnnnnnnnnnnnnnnnnnnnnnnnnnnnnnnnnnacgcttgaccagcatgagcatgttggcagctccgttcacgtcgtggttgacaacgttgaccttgcaggccttgttgacgcaccgcttggtgtctcacacgtccaccagcttctccttgcctcggcggacccgcacgtactggtgggtgtgcag

SEQ ID NO: 27174 - DNA, 80 bp, Chlorella protothecoides
ccgcagctcctcgatgtcgtgcacctgcagcggtttgatgagcagcatgcgaagagggccggatgaagtgtggtgggtgg

SEQ ID NO: 27175 - DNA, 76 bp, Chlorella protothecoides
tgcgctgagcaagccgtccatcgaggaggcctgcgatgagctgctgaaggagggtcaggtgcgaaccggggtgcag

SEQ ID NO: 27176 - DNA, 63 bp, Chlorella protothecoides
cacctcgaattcctccagtttgctgtggaggcaggtttcgatcgccctgcgtttcttggtggt

SEQ ID NO: 27177 - DNA, 96 bp, Chlorella protothecoides
gagcaggtactacaagcagcgggcgtaccccgcacagtacccggcgctgcacgcacagcctccccaacacccctgcggcctcacctgctggaagac

SEQ ID NO: 27178 - DNA, 69 bp, Chlorella protothecoides
caggtatggaggacgttgatgccgaagatgcacgttctgaattcacctccttgtcgggaccatgaccga

SEQ ID NO: 27179 - DNA, 77 bp, Chlorella protothecoides
agcgagggagagatgagggcaaacgcacagaggcacctgcaacgacactgcatcggggggccggtgtggccatccag

SEQ ID NO: 27180 - DNA, 1951 bp, Chlorella protothecoides
  modified_base (377)..(386): a, c, t, g, unknown or other
  modified_base (535)..(544): a, c, t, g, unknown or other
  modified_base (663)..(672): a, c, t, g, unknown or other
  modified_base (1296)..(1305): a, c, t, g, unknown or other
gacctgcagcgcggccaggcccacgccgcccgcggcggcgtgcaccagcacccgctcgccggggcgcagggccgccgcggagtgcagcgccaggaccaccgtgatgaagacggtgggcgtggtggccgcctgctcgtaggagagctgggctgggagggggtgcagcgtcgcggcgggggacaccacggcggtgcccaaacagccatgcgccagcccaaacaccgcttcgcctgttgattgttttgagagtggagggaatggaggcgggagtgttgggtatggggatgaggaggggcagggtaagtcctatacacacacacacacacacacactcgaatacacaaagagcacctaccaggtttgaggtgggtcacggnnnnnnnnnnatagattgttttgaaagtggagggaagggaggcgggcgtgttgggtatggggatgaggaggggcagggtaagtcccatacacacacacacacacacacactctctcgaatacaaaaatagcacctaccaggtttgaggtgggtcacggnnnnnnnnnncgggtctcggtggggaatgcgggaccaggttcccacaagatgcattgccatgcggccacatcctgtcacttcgccgctccccggggagccccacctgaagttgatgcccacggccttcnnnnnnnnnnagggtctcccgggtacatgcccagcacatttagcacgtccctgtgggatgagagggtgggggtgggtctcagtggggaatgcgggaccaggttcccataagatgcattgccatgcggccacatcttgtcacttcgccgctccccggggcaccccacctgaagttgatgcccacggccttcacggacaccagcacctcgtggggcttcagcaccactcggtcggcatccaagggcacggcggtgaggctggccagggacccccggggttggggctggacctgcaccagctcgcgcgagggcgccggcgccgcgctgcgcagcaggcggggcaggcgcgtcagcgcggccccgtgccgcgtggtgttcaggatgccacggctcagcagattctctgctgggatgtcgagggcgggagcctcggcgccgacgtccagcgagaaggcgcagccggcgtgctcgctggccgcgacgcgcagcaggccctcgcccgccgcgctcagcgcctgggtcttcaacgttgagcccggggccccgacagggacggactctggcgccgaggcgtacacggcgccgtgatcgttcccggcaaacgtctgcagggcctccagcacggccggcagcgcnnnnnnnnnnagctcagcgcctgggtcttcgacgtcgagcccggggccccgacggggacggactctggcgccgaggcgtgtacagcgccgtggtcgttcccggcaaacgcctgcagggcctccagcacggccggcagcgcaacgctggggtcgcgtgcggcgggcacggcgatgccgcccagatgagtagaaatggacaggcgctcaggcacaccaacctcaacccgcccctttgctggctggaccacctgctcccactcgacggcgtacaggaagtcggccggctgcagcgcgcggtccgcggcggtcttggcgcgcgggcgcacgaccttggtctccaggccggccaggcgcgcggcaccgcgccccaagttcagcctgaacccggcgaccgtgagctcctcgtccgggacgccgtgcacgccgtcggtactcgccgccagggcctgcacctcggggcggggcgcgcgcgcgtcggcgccgtaggccgccagggccacgggcacctttgcacctgtgcccggcgcggcaacgcccaggtgcagcgcggagtccatggccgggggcgggacgatgtagccgtccgatgcgcggccgggcggcagcgccacagagccgagcgcggtgccgggcgcggcgcggcacagcgcgaccag

SEQ ID NO: 27181 - DNA, 72 bp, Chlorella protothecoides
cgttgtcaaccgcgacgtcaacggggcggtgaacatgctcatgctggtcaagcgctttttcgcccgggaggc

SEQ ID NO: 27182 - DNA, 61 bp, Chlorella protothecoides
gctggtcaagcgctttttcgcccgggaggcacgtcccacggcctttggcgggcccccttgt

SEQ ID NO: 27183 - DNA, 74 bp, Chlorella protothecoides
cgcagcacagcacagcagtactgtccctgccagcagatcagccgacacgttctcccctgtccgcaccctgagcg

SEQ ID NO: 27184 - DNA, 163 bp, Chlorella protothecoides
aaccaccagaattgggcacgattccaatcagcgcagaggtggggtaaagaaaacggccaggaaaattccgaaggttggttccaattgtgcatcactgatctgaatcatatcccttcaaaaaccagaaacaatacccagaaaaggtggaggctcaccttgtaaa

SEQ ID NO: 27185 - DNA, 118 bp, Chlorella protothecoides
gtcgggattgtactgagagggcaagttgggagaggtggcagcggtgagcacggaaacctgtgaaaatccttcccttagatgagccagcattcgaccgcatcacagccaggcaggtgct

SEQ ID NO: 27186 - DNA, 74 bp, Chlorella protothecoides
ttcctttttcttcctgtgcgtagagtgcttttatctctttttgctccatcctgcaggtggcccccccgtgctgc

SEQ ID NO: 27187 - DNA, 61 bp, Chlorella protothecoides
gcccccctacgagtccatcatcatgggcacggccagggtgagaggcatggtttggaggggc

SEQ ID NO: 27188 - DNA, 69 bp, Chlorella protothecoides
tggaggggagtgggagtgatagatgcatctacagcttgcaagaggaaacatcagcacagcttggcacag

SEQ ID NO: 27189 - DNA, 69 bp, Chlorella protothecoides
ccacctgccacagccccagcgacgcaggccgtcaactcccacagctcatgggatggaaacacagctgcg

SEQ ID NO: 27190 - DNA, 156 bp, Chlorella protothecoides
tcacgcagggatgtaggagtaatgactcaagggagctcgtttctgccgcagacctgcctcgccatcgagcagcgcttccccctgaggatcatgcaggagcctctcggattgaaattcccgacgggggcgcgcccgggggatctggcgggaggtctg

SEQ ID NO: 27191 - DNA, 78 bp, Chlorella protothecoides
gcgttccgggttaacttcagcattaacgcttagaaccgacaccagcgagactcttaccctcgtcgtatgttcgcactt

SEQ ID NO: 27192 - DNA, 346 bp, Chlorella protothecoides
  modified_base (99)..(285): a, c, t, g, unknown or other
tgggcggcggttgcaggaccaggtgaagggcgatgtgtgtgtttgtgtgtgaccactcgatcaaatctctcgccacacaccatcgcaagtgtcactgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctggtgagcggggggggtccagggtggggggtgcagctcaccaggtgcagggagcatga

SEQ ID NO: 27193 - DNA, 69 bp, Chlorella protothecoides
agtgtgttcctgaagtgatcgggacatggttaagagtttaggggagacctgctacgaacaagtgtcctg

SEQ ID NO: 27194 - DNA, 71 bp, Chlorella protothecoides
tcgcccaacacgcagggtcagccctcgcagccctcgcagtgctcgcaatgccgcctacaagaaggtttcaa

SEQ ID NO: 27195 - DNA, 61 bp, Chlorella protothecoides
actgctgagcagctggggccctatgctccaaacaacagggaggaagagttggtgtgcagag

SEQ ID NO: 27196 - DNA, 123 bp, Chlorella protothecoides
tgagcgccttggggttgggattattgcgttgagggctccctccagaccattcttgagacggcagcaagcatagggcataccttcgtagtgaatgccagtctccttgaggaccggggcgtagag

SEQ ID NO: 27197 - DNA, 67 bp, Chlorella protothecoides
acacctggcagccggcaggggtgcgagcatcacgcggcaggcacccccaacccgcatcgcctgcctc

SEQ ID NO: 27198 - DNA, 72 bp, Chlorella protothecoides
taagatcctttgtaacgccgctgtatggactgaacgacaacactgcgaaaactgcggtggctgagctcgagt

SEQ ID NO: 27199 - DNA, 74 bp, Chlorella protothecoides
ctgtactgcttgcggtgcgcccacacgtcaaggtggcctgctcggtgccggacaccttccgagttggtatacgc

SEQ ID NO: 27200 - DNA, 66 bp, Chlorella protothecoides
tggacgtcgaggaggtgaaaggaaggggggaggggaggggggggctcggtaagtggcatggcttct

SEQ ID NO: 27201 - DNA, 185 bp, Chlorella protothecoides
cagcaaggtgggcaggaggaaggcgggaatagggggaggcagggggaagtgtgaggcggaatgtcacatgttggagcgaagggcaggttcagtgcacgcgcctatggtttgtgaaggagcgtcaaggcctgggtcatgcatcacattccacaaccaaggtccaacctcacaaaagccaccctgtc

SEQ ID NO: 27202 - DNA, 61 bp, Chlorella protothecoides
gagtgaccgtgaaatgcgcgctggtcactcggaagggaggagaagggcatcttccgtagca

SEQ ID NO: 27203 - DNA, 61 bp, Chlorella protothecoides
gctgtcctcgcacttccaggaggtggggcgtgtgtgggctggcagcaggggggcctcaaac

SEQ ID NO: 27204 - DNA, 159 bp, Chlorella protothecoides
tttgagttttacaagtagacggggcacgcgccggtggtcacgagattgtcttgtgcaccactctgctgcctggttgatgcttgtggcaagcttcgcacgagccaaagatatgccactaccgggcttgcaccggttgcacagctgcttcccgcaagcggg

SEQ ID NO: 27205 - DNA, 68 bp, Chlorella protothecoides
tcacttctggtaatgccctattcccgatgttgacctggcatctttcctaatcaggggatggtttcgga

SEQ ID NO: 27206 - DNA, 61 bp, Chlorella protothecoides
cagaaacccctcagacctacccgatgactccccagacctcagtctggtgatggcgttcgtc

SEQ ID NO: 27207 - DNA, 61 bp, Chlorella protothecoides
caccaaacagacgacagcccaactccgcgggagtcctatattacgacttcccagcgttctc

SEQ ID NO: 27208 - DNA, 78 bp, Chlorella protothecoides
aaggctgcaagggcattgtcggtgaaagggcgcacagcttttgtacaggagctcagaggtggtttgcaggttgataaa

SEQ ID NO: 27209 - DNA, 65 bp, Chlorella protothecoides
cattcgatgctcattccacgagaagtttgtcaggccatcaagccgccaacccttgctgcctccgc

SEQ ID NO: 27210 - DNA, 61 bp, Chlorella protothecoides
ggaattttggagcctcagtggttcacgatcgcagccgattgccgtagccgacccagtctgg

SEQ ID NO: 27211 - DNA, 61 bp, Chlorella protothecoides
gagtcaatgacctgtgagccacccatcgaacaagccgtcaactggccgccctgactcacct

SEQ ID NO: 27212 - DNA, 61 bp, Chlorella protothecoides
ttgtatctgcacgcgctcgtgtctgagtgagcagtgcatggaaagtccacttccgtaattg

SEQ ID NO: 27213 - DNA, 61 bp, Chlorella protothecoides
ggatccttggcgaccccctccccagctcacaccccccgccgggagatcctgcgtgccgata

SEQ ID NO: 27214 - DNA, 74 bp, Chlorella protothecoides
agtacgaagagaggttctcagtacacctggtccagccgctgaacggcattccaaccacaagtgcctcacccaag

SEQ ID NO: 27215 - DNA, 75 bp, Chlorella protothecoides
cttgcccttgttgtcggagccaatgttgccgttgctgtccgccgtgcacgccttctggcccaccgcaaggcactc

SEQ ID NO: 27216 - DNA, 112 bp, Chlorella protothecoides
caccccccccccccacacacacaactagcatagaacggcgagctgatatctgcattctctaagctcgctccttgaggccaaagataagcgctcgccgcttcctcatgcaatc

SEQ ID NO: 27217 - DNA, 142 bp, Chlorella protothecoides
aggcgcgttacaccagtgcccgatctgacacgacgcaatgctgtctggatttgcctttcatgcttaaacataaggacagtccattgcaagagttgagcatggtgtctggcgtgcgaggcgcaggccgatgagacttcgtcag

SEQ ID NO: 27218 - DNA, 61 bp, Chlorella protothecoides
aggggccgaggccgagtcagctggagggagagcgcgggatatacggtcctcgacacctgca

SEQ ID NO: 27219 - DNA, 151 bp, Chlorella protothecoides
ttcgtccccctacatccagagcaaggatagcatggtggaatccggtatggattgctgcggtgtgtccctcgaggggtagcgcccatcgttgttagctgtcgtgggtacgaacgttcaactcatccattggcaacctcgcaacgactactca

SEQ ID NO: 27220 - DNA, 69 bp, Chlorella protothecoides
acaacggtggaccgctgtatatgacctgaaataggaattgtacaggtggaccccgaatgcagtgtgatg

SEQ ID NO: 27221 - DNA, 456 bp, Chlorella protothecoides
atcatggtacaaacttttaagagccagttaaatggagatggatttaaaaagagttattgtaaagtctccccaggtgtgtcattaaatatcccaacagattgccctggcctgaccccctaaatgcaattttgggattcccttttagttgctttcattaaaatgtaccagcgcagtaaaaaaagcacaaagtatattgtttatgtaactcactatctcatttgcactggttacatggcagcttcagactgactaaaactacacttttcccaccatggttcaaagatcaacagaactgggccaacaaaagcaattttttcatgtggtctaactaccaacttattatgagttaagttacttttaggtttaaaatcacagcagtttttccctccacacctcccagagatactttcagggtggctaaacttggctaaaggcttccggaccaacccttgtttc

SEQ ID NO: 27222 - DNA, 61 bp, Chlorella protothecoides
agcaggcttggccttcttcacagccttttccgcagcaggcttggccttcttcacagccttt

SEQ ID NO: 27223 - DNA, 67 bp, Chlorella protothecoides
ccaaggccctctatgcagggatttgggacaacagataagatactttaagcaacattaactccactca

SEQ ID NO: 27224 - DNA, 79 bp, Chlorella protothecoides
ccaggcggagggcaggcccccttccaggtcattgtcctgcaggtacagttcctgcagccccgcaaactgccagctcgac

SEQ ID NO: 27225 - DNA, 103 bp, Chlorella protothecoides
atttccattttccattttcgataaccctgcagaggactagctacacgtggacggaaacctcgcagcgtctctataaatcatgatgatgtttgctagtgcgccg

SEQ ID NO: 27226 - DNA, 120 bp, Chlorella protothecoides
cctttcgtctctcgttcaggaggacaggtggccagagctgccagccccatattctgccgctgcgccgcgctcccccacctcccttcccctcatctccaagctcatcgtccctcgcaggtg

SEQ ID NO: 27227 - DNA, 111 bp, Chlorella protothecoides
gggggggggaggcttaaggctttgcacggggtgatgtcgacccattcaaggccacgggagcatgttacaatgcatacctacgggttggaagacggactggctcatcgcagc

SEQ ID NO: 27228 - DNA, 62 bp, Chlorella protothecoides
tgccctgtgccacatgcacgataagcatgcataacaaaccccgggtatcccaagccctttcc

SEQ ID NO: 27229 - DNA, 4207 bp, Chlorella protothecoides
  modified_base (1110)..(1164): a, c, t, g, unknown or other
cggcggcgggggaggcgccgcggcgctgcgcagggagcacacgctcgcgccgccggtcccctgctccgccctgcccgcctgggccccccctgcgccgggcgccgccgtccccgggaaccggtactacctgcccaaggtcctggcggcgggggaggggccgggcgggcgccgcagcgccgctgccacggcataccgcaagcccccctgccggtgggaccgcgatccccccgacctccccgcccccacacccggctgccggtcgagctgggcgggcagcgcgctgcgagccgtgctggcgggcgcgggcccctgggagatcccgctgactgtgagcggcagcgacgaaggcccgcatgcctgcttccacaagccgctgccgcggcggggggccaacgcgcgccagcgccagcagcgcctgcagcgcgcggcggcgctgagcctgggcggcgccgacggggccaggcgcgcggaggccgtggccgtgtttgccctgggcacgcaccgcctggccgtgcacagccgtgccggcctctgcgtgctcggcggcgcctgggcccaggcggccgggtgctcggcggcggccgagcgcggggagcggggggatggggccgccgagcgtgagggaccgggggatggggccgcggagcgggaggccgacgataggattggcgctgagcgtactgtgggagagcctgcagcagtccctgcctcggcgctccccagccctgacccaggctccacctcagaccccgtcccagaccatacctcggccctcagcgcagccccctccacgtccgccaccccctcccccgagccctgccgcgtggtgctgggggtgcgggtcgagtacctgccctccccggcgcgcgaggcggcgacgctggacgagctggcctggctggcggccgggctggcgctggacccggaggcacgcggcgcgctggtcgccgccgtgcacgtccccacggcgcgcttcctgggcacgcaggcgctgacacgcgaggcgctggagcgggcgggcggcgacgcgctggcggcccggcgccacgccgcgctgcgcacgctggagggcctgctggcggcggtggaggggctggggggggcgggggnnnnnnnnnnnnnnnnnnnnnnnnnnnnnnnnnnnnnnnnnnnnnnnnnnnnnnnaccttgtcactggcggtagggggccggtggtgatttatgccgccctggctccagagctccaagcagaggtgggctgtgttgctgtgtcaataacacaaggatgcgacagggggagaggagtcatgaggggccgcatgcaccttgcgcatgccagggcatccgccgccgtggcacgacgccatctccgccagcacatgcgctacccagggccaagatgtggaggagggcacgcggtgtgcggcgcgcctacccctcagcggcgtggggctgccggacccacacaccgtgtacgacgtgcacgctgcgcatgctgcgggcgctgcggtgggggccggtgaccccatggacgaccccgctgtggcccccttgtggcagccggccgacccgggggtgccccagatcgcagacaccctgcccccgaagtgaggcgggggcctgcattggagggtgctgggcggaccgggtctgtgtgtgaccacggtggctcagctatcctccccccccctcccccaggatcgtggccgggggccgccgcggcggacctggtcggggcgcaagggggcgcaagcgcaagctcagccagccgtatgcctggaaggtaggtggggccgagggaaatccatggcagggtgcattaagctggctgcctcgcgcctgccatcctccctgccccgcacagagggggccactccatggcgccatgtgggttgagtttcggcatgcatctttccctcgctgagcgtcacaggtgctggggcagggaggggactttgacgccgtggctggagggacccagatctccagggcagagtatgcggctgccctgggggaggagctgtgacggggcgaggtggtgcaggggcgagcaggggctcagtcctcccaaccaggattctgagcttcgaatgcccagtcacccgaatccgaccttctgggccaggcaggttgcggcgctgcccaatagagattttgtaccaaggtatggtgctctgactgacactgtgtgacaatgctacctggcatgcggaaaacccaccatcgacaggaatatcatcactgtgccggggaatgcctgtcgagaatgcttggatggcggtatatgtagcatacaaggattttaaatgggtaaatcaatcgccctgtgaagtaaagtttaccgtcggaagttttgaaaaggcttcgccgcgtacgcagacctccgcgattcgggcgcattcttcccctcagacaggtcggccgaagagcttcgggggcggattcattaatgccgggcgtatcaggagaggctgtgcagaaacggagccctgcgggccccgcctcacctccccctttttacctgaccgtccacgtttacaggacagtcaccataaaaaagtgcgtgcacgtcgtcagcaagcctgtgaaacgagtactcagacggtaccgccgaagtcgagccgtaagaatgcgccttcgctctgcatggaaggccagctcgcgtctcgcggaaaggacgtgtccgacatagaagttctggtcatagaccggaacccttcgcgacgccaaagtaccgtcgatttggtgggatcgtgcggatatcaggtgagcgtatctcccgtggtaggatacgtggctcagattgccctgccctcccggcctgcttacctgtgatgcgaaggctgacagtcggcaatcgtcaccgtcttcctgcccccaggtcatcaccgcggagtcggggaatgatgccctcgagcttctcaccgtgcgggcccggggcggaaccgagggtcagccgggcaaggggctgccatccatcatcctgaaaaaccacggtcaaccttacggcaacgcccctaagttcctcaacaggcttcgcgccgccttgttgcaagccattcctgtcataggtgtgtgtatgggagggctggagtggggctttgatgcaggagtgcaggaatgggagttcggtacggggtttgagacttgatgatgtgttgcgtgtggcgtgtgcagtgccctgaagtgtgtgcagggcccgtggcgaccaggtagtgtgtcaagggggcttagattctcgaatctgacggactcatatttcatcttggcctccttgcccatggtggtgcacccttggagatatgtggcacgccacaccaccagccccccaagcgcctctgtatggtcggaaagaattattttggccttctgtgacccccccctccacttctcctccctttcccctgcagtcctcgggagcggggacgatgcagcgatcctgcagtgcctctccctgggcgccgtcgacttctgggtgtaccccctgcgccagaatgaggtggcggggctgtggaccagggtgtggtggcgcaagaccgcgccgcagggcactctgcccctgggcaaccacgtggggcccgggcccggcggcccggccatcgacagctccggcgacagctccgagtctgagccggccaggtgtgtggtgcggtcatgtcggcgagggtccgcttgctgcgcgacggatgcctggttgtgagtcggcgtcgcaccatgcccctcaatcgtgaccagctcccgtgcctgccccacccccgtgccgtcgcccccacccgcaggtcgaagacgagctcgccgctcgcagcgtcgctgggcgcggaggcccccgcccgcgcccgagcccccgggtcctccacctctgccgcccccggcgctgccgggcgggaagaggggggcggcgcggggcctgggccccgcacgaccccggaccctgccccgcccggatcgtgtgaggggtccaagcagggcctctgcgcagccgccgccggcggcctgaaggcctcctcgagcgcgcccggccgcctgccccgccccgactcctccgacggcagcgtggccacggagagcatggccggctccggcggcgagggccagctggcggaggtggcgcagacgctgaccacgctgcgcgactccggcgggtccagcctgggcaccggcgaggcgctgggacgcgcggccggcggcctggccgcgccccagggcaagccccgggcgctggagccgc

SEQ ID NO: 27230 - DNA, 61 bp, Chlorella protothecoides
catcggcatgagggtacaggggctgggaggtgaggtgtgagggcggggttgcaggacaggc

SEQ ID NO: 27231 - DNA, 78 bp, Chlorella protothecoides
tgaatcgagtgcgatgtggtgcctgagtggccacaccggcacagcgagtggactgtgcgccctagcgcatgctgaatg

SEQ ID NO: 27232 - DNA, 704 bp, Chlorella protothecoides
  modified_base (275)..(478): a, c, t, g, unknown or other
aagacaatgaacctgtcgcgcctgggagcactgctcctctgagccggctggctgccctcccacccaccacccctgcagagcgagaagaacggccccactctgacggcaaaggccagagggcggctggtgggcgtggtgggggagcctgatgtcatcgatgacaccgtcttcgagctgaactcctactcaagcgacgacgactggatcatcgacaagtgcgtgtctggagggccctttcatgcagtgccactggcactgccggcctgtagacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacggcctgctgtctgcacggcttcctgatggtgtcgctgcacagaaccctattggggacaccaacctccagcacaaaaagtaccagagcgagttccgagtgattcagagctgggtgtgcactcaggcccagagctgccactcagatccagggaaaatggcggtggatcaatcccggcgcccccacaggcaacttgtttcggggaagggcatggtttcaacacc

SEQ ID NO: 27233 - DNA, 107 bp, Chlorella protothecoides
ctcgtagttgcccagatccaggtcggcctgtttggaaaatggggaacagtatcaccatctgcacagtgctgcgaggaaagggagcaggccagccttggaaaatgccc

SEQ ID NO: 27234 - DNA, 92 bp, Chlorella protothecoides
acacaggcatcacatgcggcaacgaggaagttcggcacgctggccacggggggggaccccgccctcctgcgcccacacacctgcatcgtcgg

SEQ ID NO: 27235 - DNA, 124 bp, Chlorella protothecoides
aagcctgagcaggtttgctgacgcgctgtcaaaaatgtatgttttgacgtgacttggatactgcaaatccattctgtcccctcgcctgacatcttctgcagcgggtgcagctgtggcaggaagg

SEQ ID NO: 27236 - DNA, 684 bp, Chlorella protothecoides
ggttgggacgaccctccgacgacatgatgagagagttcgagagagtgttacgagaaggttatgctctgcaatggtgtaatggaaggattctagatattgtgacgggggttaagtgattgtatcttcttggggggccgtgcttgttggtgagtgatcgcagctagacagaagttgggtagctgagacacgcagacaatctccccacttgacacacaggagctcaactcgatttcaacttcctagagaccgagtatacgatgcacaggacatgaaaatcttgcaacttttatctgcactatcacagacagacagttcttagcacgtttattagattatgtggatataatggcaatatcttatttttagctaccaggctgtcggctgatcaggagatggcgagcaaataaatatgctgttgtatccatattgtgagcatgctcacatgaattcctaaaaaacgcattgggaacctgcctctgcgagaatgctgaagggattcccacatgaggcaacccccttcacccgtacaccaatctttgccatgccatgcataacgcaaaggagatgggcgatgctcagtgagaaaggaatcgatgatggaaagcaggtgggtgggaacgggcaccgggcgtccagcgaaggagaccccttcctcactatccccttgtagcagttgcccgctca

SEQ ID NO: 27237 - DNA, 95 bp, Chlorella protothecoides
atggggcagcatacaagtgtcccagcaagtgaagcggcgcagctcgatgcagagagcacaacgtcaccattatcctggcagcagtgcagcgccgc

SEQ ID NO: 27238 - DNA, 61 bp, Chlorella protothecoides
ctggcagccgtgcccaccatcacatcacaattctgtctacggtgaggatccaggccagcac

SEQ ID NO: 27239 - DNA, 61 bp, Chlorella protothecoides
aggagtccaggtcactgccatgtgctgcttgtcatccttggtatgcacagtgcagaggcag

SEQ ID NO: 27240 - DNA, 64 bp, Chlorella protothecoides
cgcctgtgtaaaggaacagaggccaggcctcacggctggggcaggagcggctccctcgcggcat

SEQ ID NO: 27241 - DNA, 74 bp, Chlorella protothecoides
atcagaccagctcagccgccaacaatgccacccaagaccaacaccaccccacccctcagacacacctgaggttg

SEQ ID NO: 27242 - DNA, 66 bp, Chlorella protothecoides
aataggagcacggcagtgggtgcattctggggttcaccggtcgaggcagtaggtgtgtgaccaggc

SEQ ID NO: 27243 - DNA, 65 bp, Chlorella protothecoides
ggaatcgatgccgcccgaaagacacttgcttttccccctcgtcagctgatgaggccctcgcgtgg

SEQ ID NO: 27244 - DNA, 68 bp, Chlorella protothecoides
ccagccagtaccggcaggtggtggagggccagaggatctgaattgcggttttctaagcctcagcagca

SEQ ID NO: 27245 - DNA, 61 bp, Chlorella protothecoides
caccagaccatggcagacgtcgatggcaggggtctcgcgcgtgtcgccagtgtccttcttg

SEQ ID NO: 27246 - DNA, 179 bp, Chlorella protothecoides
aaaacgaaactgctccacgtggccgcggcggttccgttccggtgtacggagaagttgtaacctgagcctgtacataatcactacaagagaccatcgttgtagccggaggcagcctgaatatggaggatgctttacaggaatgctttcattgagggtggatcacgaactcagattgcatt

SEQ ID NO: 27247 - DNA, 74 bp, Chlorella protothecoides
tgcagcctggcacaggccagccaccgtgtgaggagagcgtagtcgtgcggcagccggtgcaggtggcgacgacg

SEQ ID NO: 27248 - DNA, 61 bp, Chlorella protothecoides
tgatactttctctgcagccatgaggaccgaaccctctcgtcaactgcatgcaggagaatga

SEQ ID NO: 27249 - DNA, 61 bp, Chlorella protothecoides
acacggtaccaattctgagagagatcccacgattgattgctgaccaacgtacctacagctt

SEQ ID NO: 27250 - DNA, 75 bp, Chlorella protothecoides
gcgcgaccaggcatggagaccccggggatgtcatgggggccgatcccccagatgcgggcctgccctccccctttg

SEQ ID NO: 27251 - DNA, 145 bp, Chlorella protothecoides
atgccgcgacaagcatctccgccgtcttccttgatacctttacaaacatgaatgatgggagtaaaggacaaaataggtagaaaacaaccttcgaactctattatcgacctaggttttgcaaaggaaaggggtcctaactcaaagg

SEQ ID NO: 27252 - DNA, 82 bp, Chlorella protothecoides
agggtctgggaagggaggatgggaagccaaatgggtgacttaacgatgcaacatgtccaggagagccccagctcaatgtggc

SEQ ID NO: 27253 - DNA, 61 bp, Chlorella protothecoides
cgggacatggagggagttgcaaggaagaggtgagccactcactcagatgcccctgccccgg

SEQ ID NO: 27254 - DNA, 73 bp, Chlorella protothecoides
ccaccacaaccctgccaaacacacacacaatcacacacacgcgcacagaggtcggggctgtctgggaatgccg

SEQ ID NO: 27255 - DNA, 61 bp, Chlorella protothecoides
gcacctttccaagcccacagcagtgtggcatccatgctggcacccttctcccctgggacat

SEQ ID NO: 27256 - DNA, 74 bp, Chlorella protothecoides
ctgggggcaagcccgcctgccgcaggctgttctgctgcacgagcctcaccaggctgctggtctgggcgaggggg

SEQ ID NO: 27257 - DNA, 196 bp, Chlorella protothecoides
gcgtggaggggcggcgcgaggacagcggcgccccccccgagcgggcggggttgaggtgcggggaggagtcgaggaccagccccgggcgggcgaggtccagggacgtgccggacctctcccgcgccgaggggctcggcgcgtgaccctccccctcggcatccgcccagtgcagcgggcagggggtcccacctgccag

SEQ ID NO: 27258 - DNA, 97 bp, Chlorella protothecoides
tgcgcaccgaccacccagtcccacgggccgccgcacccacggccccctccacctcccctgtgtccctcctcagcttcgcgctcttcctgaaccagct

SEQ ID NO: 27259 - DNA, 127 bp, Chlorella protothecoides
gccctctcttacacacctttgccccttgaacatgcagcccagctggcatcacctcttcatctcgggctcctgggacttgatgggtccggcaggattcaatcacgcatgtccgctgccctagcgtgcc

SEQ ID NO: 27260 - DNA, 62 bp, Chlorella protothecoides
ggcccagaggctacggtgaggacctgcgccgacctccgggagaggttcttccggcaccacgg

SEQ ID NO: 27261 - DNA, 279 bp, Chlorella protothecoides
agttgcgtcaactttgcatggaagggaggttttagcataaagtcctctgtacggttacgcacagaccagcatataaatctttgctgacgaatatattgaagcacctccgttcacacagaattccgtattcatttctttcattccattttcgccaaccaaccgttgagcttaagcaatccgggcaagtagatgaggatggcatgattggaagttgttgatatattcaagattcagttacaggccttgattccattcgatggttcctgcgacgaaaaccga

SEQ ID NO: 27262 - DNA, 3328 bp, Chlorella protothecoides
  modified_base (1020)..(1029): a, c, t, g, unknown or other
  modified_base (1649)..(1658): a, c, t, g, unknown or other
ggggggaggtggaggggggccggagaggggggatgcggccttcctgggctcgagtctcgaggttcagccagagcagacagcatcaaagtggcccagaccctccatccttgaatgtcaacacgtccaggcagaaacaacgctgataggcacacccccagcctacaagacccaccgcccgcgccgcacccgggtacaccatctctagcggcgtgccgccaaaggcggtggccgggttgcgccccgcctcgtccaggctctcgaagaagggcgggttgcacatgcagaaggcaaaggcctcgccggcgcgcagggcggcgctgaggatgccaccgcccgcggcgtctcccgcaggcatttcctcccacgcgccgccgctggcggcgccccgctcccctcccccgtcatcccccccctcctccctcgggccctctggcgcggcctccgtcccacggaagaaagcgcgctgctccggctgcatgggcacccggcgcagcgtcacccgccgtgccacgcccgtgttggcgtccagcagacgccgcgccgcgcgcagcgcggcgcgcgacacgtccacgcccacaaaccgccagccggccagcgccgcgccgagcagcgggtagatcaggttggcccctgtgccgacgtccaggccgcacacctccccgccctccggcgcgctcagcgccagcaggtcctgcacccagtgcacgtagttggctcgcccggtgaccggcggcgccaggtggccgggcggcaggtcccagcgcaggccgtggtcgcgcgccagcagcgcccgcgtcagcgccacgcaggcgcgcgggtcacggaaattgagcgagggacggcctgtgccctggcgtgggggttcattgggggggggggatggggcgcctggatgaaggcagggtgcagtggggcaggcgcagagcgtgccgcacaagccgccaccgagccaaggcaccgtgtgccacggggcgcaggtcagaacggctgccggagagcgtcgacgggacggcccccccnnnnnnnnnnggtgggggtattttggggggggtaatggggcgcctggatgaaggcaggatgcagtggggcaggcgcggagcatgccggacaagccgccacggagccaaggcaccgtacgccacggggcgcaggtcagaacggccgccggagagcgtcgacgggacggcccccccgcgtccctgttccccctttccgcaaatgcgcacacaccctggggaccaggaacggtctgaggtaagggtaggcctgcgccaggtcgccaaagtcaggctcctcctgtgcgtaccggctgcgggggttgatgcgggcgttgttgggcgcgccacggcccgccacgcgcggggcgtgaggcagcggggcgggcgggggcgtcgctgcctggggtagactgggcgaggcggagcgggagccatctttttggatcagcgtcccatcgtccggtatgcccgcatcctcctgagcgccctccagggactcctccaggagctgcttggcctgggcatcaggtgtgaaagggcgtcctggatgcgtactgagtgcaggggccgaatcgaagggatcaggaggactggcgcacagcgcacctttggcctgcgcatccccttctcacctccaggagctcagggtcnnnnnnnnnncccaggatgcgtactgagtgcaggggccgaatcaaagggatccaggaggactggagcgcagcgcacctttggcctgcgcgtccccttctcacctccaggagctcagggtcgtctgggcaggccagcagggcctccttcacggcctcgaggtccgcgacacactgcgccatgtgatgctgaagggtttcaacctcagtaccgaggcagctggtcagaggaatctcctggggtgcgggggcagcctccagggggtgctccatcctgccagagtggctgagtgggccgaggtctatggcccccacgaccagagcgccatgagccacaatatgattatatcatcattcaaatgattgacaggcttgctgacgggccagcgacccgggcgacgccgggccgacctcaactgcagatcactgtgggttttccccttgaccgtgcgctttccccacttgccacctgttcccgctctgccccgagtccacgcctccttgcgacgcctatgaaacccgaccatcacactgcattcggggtctcgtctgtaacgttcctacttcaggtcatatacagcggtccaccgttgtgggggccagcccgcccccacaacaatttggtttcggaaacatggtttcccgatcttgctaggaacaggaggacaacgccgcagcggaacctgcgggcgacgacgaggaggttcatcatgagaaggactacgagatatcacccgcgctgctacagtctactgcgccacgtctacgccgcatggcaccgtgcttaaaacccaagcccctcaccgtattcggggtcttgttctgtaacattcctacttaggtcaaatacagcagtccacgttgtagggactaacccgccccacaacaatccgatgccagcagtggagtcctagagtccagggtcacaccttttcagcctaggtggtcttagactttataccatgtctttcctaatatgacttcgcttcagccgggatggtcgcgtcgtccatagatatggggaataccacgtttgaatcaggcaagcatacgagaccacacccggacgatgttccttagttgtcatccccatgtccgtgcagacacccactacatagctctaaataggcccagtaccaacttcaatatcatcttcggatcccggtacatctcttgtaatagcagtgggtttttgggggcgaggcaccatgcaagggacgtctaccttgcggactgcgtgggacgagacggatcccaccgtgccaatttgcaagctcaagtaaaaccttacgagtaaggccattgcagtaggggtgtctggtatgcagatccgcaagggtgagatgcctggggtagcgctctgtacatgctacgcatgtgttatcccgcattttcccgatattgacgggtcctctgggggggtaacatcaataaccgggcgactaccccacgttcagccagatccttcccacaccgaggctttggagtgtcgatatattaaacgcattgcgcgggacggagtttctctgggagggagatgtcgcgttccatagacagcatgacccctgaagactggcgcaaagtgtaagttatatacattgatcaaaggtccctttcttgttttagtcgtgtatactctattcagaagctcatgctcatgcagtcggcgcgtacccgactgac

SEQ ID NO: 27263 - DNA, 114 bp, Chlorella protothecoides
tgctgcgtggaagttggaagttaccgaccgtaatactactgagccttacattacatcagcagagttcgcttccggtttccgactaatcaccaactccgcagcgagcggtccctt

SEQ ID NO: 27264 - DNA, 80 bp, Chlorella protothecoides
ccgctggatgcctcgtggagctggcacacccctcgcatcagaccacctcccatgctcccctcccaggctgccctccggtt

SEQ ID NO: 27265 - DNA, 141 bp, Chlorella protothecoides
cacgcccgccagcgccccgactgcccgctcaagtctggtccggtgagctggatctgtgccatccctcctgcaccgactgcacattccgctcccggcaggaacctcccacgcggaggtcaggcgtgcgggcaggcgggtggg

SEQ ID NO: 27266 - DNA, 62 bp, Chlorella protothecoides
ttgtgtcactcaagtgtcgaatcagcctgaccgtcggagaggagacgacgaggcgaagtgcg

SEQ ID NO: 27267 - DNA, 61 bp, Chlorella protothecoides
ggcaatgaaaggcaatcaccccagcggatatcagcacgcgcaatccgctgagagccgcgga

SEQ ID NO: 27268 - DNA, 61 bp, Chlorella protothecoides
tgcggccacgaggtagtccagggtgcccaggttgtgctccgccaggcccgccaggtcggcg

SEQ ID NO: 27269 - DNA, 132 bp, Chlorella protothecoides
caacaggcgtcgctgcagaggaggggccagagcatgggatggatggatgtcggcacgttggtatgcggtgcatgaaagttggaatcgtgtgtggcgcatgcaagtggagcaacaatcgagagagaaacccac

SEQ ID NO: 27270 - DNA, 71 bp, Chlorella protothecoides
gagtgtgagccggtcaacagccatctgtgaccactgattagcatatggtgagaggaggatccccgctcccg

SEQ ID NO: 27271 - DNA, 61 bp, Chlorella protothecoides
acaccctgtggacagtagcagcgcacctgcgccgccgctgagcaccccaggcaaccccggc

SEQ ID NO: 27272 - DNA, 76 bp, Chlorella protothecoides
gggggcttcagagcggtggccgttcgagcgatgggctcgtgcgttcctgcctctgcatgcagcccagctcaccccc

SEQ ID NO: 27273 - DNA, 61 bp, Chlorella protothecoides
gggggtctacgaggagaacaaggcatacacattcaagtacccgcgcccggaccggtgcgtc

SEQ ID NO: 27274 - DNA, 132 bp, Chlorella protothecoides
tcatcacccgcaggtgaagcccaccttggatgtggatgtggaacagctgatccgttgtagctctgcacaatggtatcagtgtagaatatgtgagttgtgcacaagagtcaacaaaaggactcgtgtatctgc

SEQ ID NO: 27275 - DNA, 77 bp, Chlorella protothecoides
tcccagatcgcgcgggatctaaatttgtaagaccccacgacagatccccgacccccaacccagactgtttattcgca

SEQ ID NO: 27276 - DNA, 518 bp, Chlorella protothecoides
  modified_base (114)..(298): a, c, t, g, unknown or other
aagcctctcccctgacacacattccccctgtcctcgccatacacatgcgcagtgctggtactgctgctgcgacctttccaaaacgagctggtgtgtccctcgcacgggggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagatggcagcgtgtctctggagctggccacgtcagcctctaccacccgcctccgctcagagcttgctgcgcgtgggcctactgccatggcgatgagtgcgctgcgcgctctgcaggcggcaaggagcgtcgatgccaacgcggccttgaccagcgctctgctgtgtgccgggccgacactgagtgcctttttgtcgtctggcctagatggaggtgag

SEQ ID NO: 27277 - DNA, 62 bp, Chlorella protothecoides
ggaagccaggcgagtctgcagcgcgaggtgagtgcccgccgggcgaccaaccccacgattca

SEQ ID NO: 27278 - DNA, 1367 bp, Chlorella protothecoides
  modified_base (933)..(942): a, c, t, g, unknown or other
gaccgagggggtggtggtgaccgaggagggggtgaggggtttggagggaagggaggaggggggggagatggcggaggggagggcgggggagaggtcgctaccaaggtgagcagtacgaagtcggagtgctgatcaggcggtccaacgaccgtggcactcacctttgcatacgcgaagagcttagcgacaacggtggtcgccatgtttgtatcttgagtcacggcagacgtggggtttgcagcgtatgatgccagcacagtgttgtcggatgcaaacatcaccagtgtcagagaactagctgtgtagctcccagtgtcgatggtgtagtggaactcgatgtcagaccaagcaagggtgcccgtggggggagacagggctgggctgggtggtgatggcgggggagggggtgggggtcgagcgctgggggcagccacgcacaccgccatgaccgtgtcggtgatacggtctgcgcagagcgtgaggacactggtgctcgggaagctggtgcacttgccgcagatggggaacacctggctcttgcaggtgaggagcgtggggctggggccagaggcgcagtaggccgtgagggagtcgtcgtagcagattgttgggacggcggtgctgtcgtcgcacactcccttgctgttcacgggtgtgtagccagccgcacatgcatggatggcgggggtcggaggcgttggcagcctggtgagcatgaccaccgtctgttgggcaaggtccgctgacatggtcgttgcggtcgcaaaattgaagtcggactcgtaggtcaagtctgtgtttgcaatggcagtcgtgtaggagaatgagtcatcgtctggagacataaaggtaccgaaatatggtatgtagtatgcatcatacagctggaaggatatcatgaaagggcggaagttggtggtcacactgaaggtnnnnnnnnnntgctgacatggtcgttgcagttgcaaaactgaagtcggactcgtaggtcaggtctgtgtttgcaatggcagttgtgtaggagaatgagtcatcatctggagacataaaattaccgaaatatggtaagtagtatgcatcatacagctggaaggctatcatgacagggcggaagttggtggtcacactgaaggtgacaatcactggcacaacgcttgaagaactgaacatgactgtgccctgagctgtgtatgcaggtggcggaggggggttgggcggaggtggagacggtgaggggggaggcggcgaccgccagggcgggggaggggactgcctaggtgcgggaggggatagtcccgatgggggagaggagcgcattggaggtgggggagactgtctgggtggaggcggagccctccggggtggag

SEQ ID NO: 27279 - DNA, 80 bp, Chlorella protothecoides
ctgttgcaatgcgcacttacagcatggcgggttgtccatgggctatggttgggagcagtggccaggccagaggatggctg

SEQ ID NO: 27280 - DNA, 61 bp, Chlorella protothecoides
agggtttgaccccggctcgggcgcgcttactgcgcaggcgggcgccgtgctggcgaccctg

SEQ ID NO: 27281 - DNA, 74 bp, Chlorella protothecoides
tccaaccaccagcgtcccagaccggcgcaaaggtgcaggtgtaatcctagccgctgcaccaactcagcatggca

SEQ ID NO: 27282 - DNA, 76 bp, Chlorella protothecoides
ccagggaagcatgctccagcccaccgtgcgaataagggttgccggcgccacactgggcaggctgtctagtttggca

SEQ ID NO: 27283 - DNA, 61 bp, Chlorella protothecoides
cggtaggctttcggtgacgtgatgttgggagtgctccacgaaagggcttacatattccgga

SEQ ID NO: 27284 - DNA, 74 bp, Chlorella protothecoides
ggtgtcggagtgcatgtgtggccaaccaaagaatgctgtaatgttcatgcatgtttgcatatggatgaatgttg

SEQ ID NO: 27285 - DNA, 99 bp, Chlorella protothecoides
tcaacataagatgcctgcatccgaacctccccactcaccaatgttgtcgtctcctacattgttggtgccaaagttgcgcttgcccctgttgccggatcc

SEQ ID NO: 27286 - DNA, 73 bp, Chlorella protothecoides
aagccctgaacaaggtcccagttcaagcattcccccctttccaccaaccccccaggccatgcacgccggcgag

SEQ ID NO: 27287 - DNA, 61 bp, Chlorella protothecoides
gttgtgagcaaccgcaccctttcaacacactcaggccgcgatccgaaagagctatttgaag

SEQ ID NO: 27288 - DNA, 77 bp, Chlorella protothecoides
caccagtaccgcatggtaaggcgagagggcctgatcctcggaagcccacaacagagggcacaaggcgttattcagta

SEQ ID NO: 27289 - DNA, 61 bp, Chlorella protothecoides
ttcgggtgtccttctgcgctcccaggttttggacgctaccagcctggtcacatctggccat

SEQ ID NO: 27290 - DNA, 111 bp, Chlorella protothecoides
gcagatacacctatcccacaaccagctcacgatggtgggggcccgggcgctcatggacagcgtgcagagcacgacgccgctcccagccaagcccctgtggctgcgcctgga

SEQ ID NO: 27291 - DNA, 78 bp, Chlorella protothecoides
tcaaacctgcttttcacggggagggtgtgtgtcggaggcggaggtgcggtgggtgtcagggagagtgatgggagtggt

SEQ ID NO: 27292 - DNA, 61 bp, Chlorella protothecoides
aaaaccaccacaggtcgagctgaagactggcgagatcttccgaggggagctccacgacgcg

SEQ ID NO: 27293 - DNA, 87 bp, Chlorella protothecoides
agcctgggggacgatggattggttgtgccgtggtaggccggctgcgtccggacaccggcagctgcatgctccaccctgccacacact

SEQ ID NO: 27294 - DNA, 202 bp, Chlorella protothecoides
caggtgggggtggggggttgctgggtgggggtgggggttgggtccttgctctgcgcattgcatggatgggtgcagaccgggaggggtgtgtgttggctggtggggtgccatcacatgctactccctgacgagcaggatgtcgggcgcagcatggcgggggaggctggcaccccacccacgcgccgcatggccgtcggtcgtc

SEQ ID NO: 27295 - DNA, 61 bp, Chlorella protothecoides
aaggtcatcctggctttcatctgcctgctggagcagtctgtcgcctcttgacactctccct

SEQ ID NO: 27296 - DNA, 113 bp, Chlorella protothecoides
catcagttgatgagggataggatttggacaatacatggattcttcatataataatcccaagtccctagagcctacacctcacgcgccagcctactttttggggatctcgctgt

SEQ ID NO: 27297 - DNA, 62 bp, Chlorella protothecoides
ggtcatcgtgttcatgggcaagagtgaccccagcgcggcgccccaccgccagcagagcatgg

SEQ ID NO: 27298 - DNA, 78 bp, Chlorella protothecoides
cagccccatgcgccagtagatgcccgcaaagaccgccgcggaggacagctgggagccggcgcgcgacaccagggtggg

SEQ ID NO: 27299 - DNA, 79 bp, Chlorella protothecoides
atggctggattcaccctttttgttcccctttctcttgaatcttctccatttccctgatggctgctccctggcaaggggc

SEQ ID NO: 27300 - DNA, 61 bp, Chlorella protothecoides
ccagaccgggctgtcgtgggactcacccagcccccaggtggccatcaaggccctcattgtc

SEQ ID NO: 27301 - DNA, 61 bp, Chlorella protothecoides
ttcaagcgcatcgtacctccttccacgttgtactctggtctctcggcatggggagcactgt

SEQ ID NO: 27302 - DNA, 125 bp, Chlorella protothecoides
atcatgaaggtgtgggcagcggactggagacggtgtggcgcgactggggtgggggccgactggtgggagggtcacctcccaaatccctcggtgcgtctgtcgctgagccggctcgccataccacc

SEQ ID NO: 27303 - DNA, 77 bp, Chlorella protothecoides
ggcgcacagcatgaacggctcagcctcccgcctgtgggtatccgtgttttttgctggccgccaggccacagggtggc

SEQ ID NO: 27304 - DNA, 61 bp, Chlorella protothecoides
gcagtggggatggcaggggccaggcttggccctcctggcaggaaggccggctctggcccca

SEQ ID NO: 27305 - DNA, 11658 bp, Chlorella protothecoides
  modified_base (3059)..(3068): a, c, t, g, unknown or other
  modified_base (3593)..(3602): a, c, t, g, unknown or other
  modified_base (5235)..(5244): a, c, t, g, unknown or other
  modified_base (5780)..(5789): a, c, t, g, unknown or other
  modified_base (6510)..(6519): a, c, t, g, unknown or other
  modified_base (7102)..(7111): a, c, t, g, unknown or other
  modified_base (7971)..(7980): a, c, t, g, unknown or other
  modified_base (10493)..(10502): a, c, t, g, unknown or other
  modified_base (10894)..(10903): a, c, t, g, unknown or other
gcgcgacgcacagcgccgccgcgcgcgccgcgtccagacggaacaggtccggcaccgcctcgcccgcggcggccaggagcgcatgccgctccgcgtagtcaaaggcgtcggggtcgcggagcttgagcagcagggccagcgcgggcgcgtgctggccgcgtcgcgcgtgcagctccaccgcagcgcgcatcaggtcggcgcggcgcgggtctggggcggcccccggggtcaggacgtcgtcgagcgcgcaggggcctgtgcccgcggcggccaggcgggaaagcacggcgcgctgcacatcgcgcaccgagtaggtggaggccggccagcgccgcaccaggtccagtagcaagccgtggtctgcgaggcgacggcggccgattgaggagcggcatgggggtacgggggagaattacctgaaagggcgccagtgcccgtacggcatgcagtaatcgagccgcccgaaacagtccttcaaccaatgtttcggtgccctgccatgtattcattcatcacattccccccaccacttgggatccttgcaatcatctgagtactcggacgaccatccagcctccttcacacaccgttgggagacaccagcagggcctgcagtaccatgtcgtaggtacgggtgcgcagctgcggctccgagacggggaggtggggcgccaggcgccgcagctcccgcgcacccgcgaagacgtgcacccaccgctcccacgccagggcccgaccctgtccagtgaggagcttgggttttcaaaaggtgttaatgcacgtgtgcgtgcaggagaaacattgttgcaagggggtatactgctgtcgagcgaaaggttggcgacaccactgctgccaggcgtatagatcttccaggtcccaccctaggcaacacccacaccaaacactgtcatcctccctccaccttcacatggatagaccccccatacaacaccgctgctcacctgcaggaggcggggcgcggcggcggcggtggccgcccattcatcgcggtctacgaggtactgcaggtactgctcgcccaccgcctcgcgcacggggcgtgtgactgtcgcatccgactccgccacggccagggcctccgcgatgcgcccccgctccatcatccaggccacgcggtcgttgccgtcgcgtgggcgccccaccacggtgcccgagccggaagttagaaagtacagcggctcgtccccgtcccgccaccacttgtacggctgcgacagagccggtgggggggtggcaggcggggctggatgtggggtgggtagcgcatggacggggctggccgtgtccaccgtggtggcagcagggctggcattggctgacgcggcaggatgggagctgcccctgtccgacggactgtcatgcgatgcgttttcgtcaggcgctccaggaagggcactcgcgtcgctggaaggttcgctggatgcagtccccgcgtcggccgcccccgcgcctgcgactctgctgtcgccgcccttcggcagcgcctccaggacgagcgtcggcgccaagccggtgcccttctccacggcctcactggccctgtgcgcgctttccgtgtagaacactgccagcgtggcgccggggcccacgtccagctcgtcgctggagaggatgcggccgctccggtccaggacatgcaggaagcggggggcgggggggacagggcctcgtcgggcatgctgctccggtggtgggacacctttgtcgggggtggcatccgaggccgatggcgcctgctcaccgccgctcctcctcctctccgtcttggggttcgggctgggcggcggcgaccccaaggctgacacctcaggggacagtgaagcaggacctgcaccagccctggctcctgggccattggcatcaggtgaggtgccaccagcagcagaaccaagagcctctgtctgggcaccaggaggctgtggtgcctccaccgctctggccattgcctccgcttcctggccctctccggtctccaaaccgtcagccggcttgctgcccttcgccccgcctgcttcgcctttgcccagcaggctctcgaccgccgtccccaggacggccagctccacgccaaagggcgccaggcccgcgacggagaagggcacttggatggaaaccacggtctccatgcgcagcgcgggcacgctgtaggcagacgccgcgctggagctggcagaggggaccagggaatccctcaccactcgcagcacctgggggtgaggttgggggagggcaagggtggcgtcggactctgcgacggggacgtctgtgcattgctggcagactccagcgtgggatggcctgcgcgtctgacacatgcatgagacaggcctggtcggacgagcgtcctttgccagaatgaggaacgacctcgggagcatgccggaccgcggctttcacaaaagatgttggtccagaggcaggaattgcagtgctcgttcccttggccaaaaactcaaaacttgctcccacacctatccgccctttccaccccacctcaccaggaccgtgcggccccagcccacatagagctcccggatgcccaaccagaggagggaggctggggccgcggcctcgcccgcgggcgtcttcggggccgggatcttggccagccgcgtgtgtgtggcggtgtcgtagacccggaggcctgtggccgtgacccaggcgaggagggtgccggccatgcgagccacctggacggcaccccgccccctgaacaggggggtctcgctgctccccagccagccctgtggagggagaccgtggaggcgaagggagttgaggttaggcatggtggcagcacagcacagtatttgtgccatggtctgcagcgagactctatgctgccaaagatacatgccacatgcgcatcatgcgggaccacctgaggtaagcggcagccttgatactcggcttgagactcccatctgacagtgccacccctgcacacatcgcgccattgtgaagatatcggacaatcaccttcgagatgagggtgagggtgccagactggctgccatggacaaactcgcgagtcnnnnnnnnnngagcggcagccttgatacccggcttgagactgccatctgacggtgccacccctgcacacatcgcgcctttgtaaagatatcggacaatcacctttgagatgagggtgagggtgccggactggctgccatggacaaactcgcgagtcttgcgctcggagtagcggggatccagggcaacggtctgcgtggccagcaggtcagcaggtggtgtgaggactgtggcacgccaacagcaacttttgaaattgcccagcttgtgccagcggcccggcacaacagatcactatccggcaaaccctgctcaccgtgagtggctgatggcagttatgccgccggatgtcccccgtgtacagtccatatatctgcgaatcgagagtggattgcaggctttggacgcttggaacgcagctctcaagagggaggctgctactgcattccctgtgagtcctcgtgtgtcaatatctggatgtagcatcaggttggcatgcaggcataccacccatgcaccaggcataccacgacccnnnnnnnnnnttggagagggaggctgctactgcattccctgtaagtcctcgtgtgtcaatctctcgatgaagcattaggtgggcatgcaggcacaccacccatgcaccaggcataccacgacccagccgtcagccgagcaggaggccaggtactctgcctcggcatcaaatgacaggtctgttacagcggcatgatgctccttgaaggcctggacctggtgcaggggtggggaggggggtcgtttgatcggcactgctcaccaatgtgctggagtgactcaagtagcggggtgaatagcctgcccatcacacgctccaacccaccggatacctccacccagtcgcgggacacgcctgttcatcaccaacagtggcaaatgaaaacagcgggctcgcaatgcacagtcctaatgcagaccacaccaccatcacaagtacctggttgccattgtagtccaggacaaggacagctccagtactggtcccgagcgccaagaccttatccgagacagccaggagcagtgcagttccagggattgaggcgtctggggacaaggcggagtacttgaggcggggctcgtcgctgctatcgaccgcctgcgccatggccggcaggccctcagaggggcgatcgacttgatgtaagagagcctatcgattccgcacctccgatctcatcatttgaatttacacgtgcagcctctgtcgtgagagactttgcaggcgacgatgcagccctatagtcgttcgggctctttggtgaacaccgacgggggtgccccacctacacgccctgctggctggcgatgacaagcgtcagcagaacacaccatcccacaccgtcatttggtgtatcgtaagagcatcgcacaccaggagccgatctcgcgaagtgcaatgttctcgcgcccgatcagatcgcattgtcgacatccctgtatgtggccgagattggggaccgaccatcgacgccatgtcgcgtctttgaatataaacaattgtatttagataacacaagattccataaagctattaccacatcgccatgcaccagatcactcccgcagcgcggctctgcttgttataccctgtgcgaataccctccagccgtgtgttccgctgtgcgacggtgcaccgcaagcatgcctttgtgagaaggctgcgcgctgggtatgctcgagccgaggcctcgccgggcccaaaccaaacgccggcgagcgaagacctcaatctcctgcacacggagctccacgccgctgtggcttcccaggatttctcgagggccagtcagctgcgcgatcggatagccgcgaccacaggaacccctcctcctggctcctgggaggagctggggctacccccctggctcgcagaccgcgcccggcagctggggttcaccctcccaaccaccacccaggcccgcgccattcctgctctgctgtccggcaccgacgcctgcgtcaccgcccagacagggtccggcaagaccctggccttcgtgctccccgcgttggcggcactggatgcgtctccagctctgtaccccgaggacctcgaggcgagtttatgaggcgcctgggtgcacatggagggggggcggtgtgggtaggggccgcggctgcccgggctttggcatgggatcnnnnnnnnnnttggatgcgcctccagctctgtaccctgaggacctcgaggcgagtttatgaggcgcccgggtgcacatggagggggggcaggtgtgggtagggaccgcggctgcccgggctttggcatgggatcagaagacactgctacctcatggggcatggcagggagcacagggcctctgttcacatgagcacagctccctcctccctcaatgcatccacaggggccacaggtcgtgatcatcgtcccaacccgggacctgggggtccaggtaacaatgctcatgtaccagcttctgggcgggtcgctaaaccggggtcacgtaccggggacgcctggcaacatgttcaactacagtgggccgcgcggcatcaaggtgagcttgccccagcctcatgtgagggtgcagggtgggcctgaatgtgcacttgatttcatagtcacccaagctttattcctccctgccatgctgcaatgaggctgatgtacgtgccctcagacgctatcaagcaccctaacacggtaaaaggtccggggccagctnnnnnnnnnncctgaaccggggtcacgtaccggggacacccggcaacatgttcaactacagcgggccgcgcggcatcaaggtgagcatgccccagcctcatgtgagggtgtagggtgggcctgaatgtgcacttgattttatggtcacccaagctttgttcctccctgccatgctgcaatgaggctgatgtgcgtgccctcgacgctgttaagcacctaacacggtaaaaggtccggggccagctgctgccggaagaggtggaggcggcccggggtgacggctaccttgatgcagtgcatgccgtggtggggactccggagctcatcgctgcggcaatgcaggtgggcgcaggagacggcccagaggatcatcaaggactcgagaccctgcttgcgtgggaatgctgaaccccactgcaatgatgccccattgtagagggtgaccgtcagcttgagtctggtttggcccatgcctgtgcctctgtccccagcgcatgtgcatcgccatgatcgtccgataagctgggtcccttccttcaacccatgcgctctcccatcgaactcagatgccgggcggggtggagatcgtgcagcatgccaagctgctggtcatcgatgaggcggacgcatgcgccgaggtgaggggcttgcacacgatgggcctgtgccggaatgaggtcatcaggactcgcacaaccttgatcacctcctggccccactcaggccctccnnnnnnnnnntggaatgaggtcatcaggattcgcacaccctggatcacctcctggccccactcaggccctcctgcttccccctccacattcactcattctcatgcaggcagcgaccaaggccctggactctgtgctcagcgccgccctgggacctgccatcagcccacgccctgcggtcgtgctggtgggcgcctcgctggccgccagcgccacgccccagctcttccggacccggggctggctcagggacgagcagtcggtgatcgtccccggcagcgggacgacgccactgggcccgcccgcctccgtgcgccaccgctacatcgcgatcgagcggaaagagcaggccctggctaccctctgccgccagctgcaggccgactaccaggggtgcgggggggggattcctgtcgctgttgttttttatgcaggacaagcgggttccagggggaggcagtcggcagagggaccaacacatcgtgcctgggcctgacgcctctgcatcggcacgtcaagtcagagggtcccgcccccctctccccaccactcgcccacaggtctggccccgacgaggcgccgccccgcaccatcnnnnnnnnnnaggatggctgtcgctgttgttgttttatggaggacaagcgggtcccagggggaggcagtcggcggaggggacaacacatcatgcctgggcctgacacctctgcatcggcacgtcgagtcagagggtcccgcccccctctcctcaccactcgcccgcaggtccggccccgacgaggcgccgccccgcaccatcgtcttcgcgcccagcgaggcgcaggcggcggccatcgcggacccactgcgccgtgtgctctggggcgcggcccggctgtcggtgctgctgcccggcggcgccgacgcgctgcgcacgctgagcgccttccgcgacggctccgccacgctgctcgtcaccacgcccgccgcggcgcgcggcctggacctgcccgcggtgcaggcggtgtactgcctgggcccgccggccgacgcggcgcagcatgcgcacgtggtggggcgcctggggcggatcggcggcggcccggggaccgcgaccagcctcgtgacccctggggccgagctggagcagctgcatgccgtggcggcggagctgggggtccaggtggagcccctggcggcgccggaggcggtgccgctggatcccgaggcgggggtgcagcgcctgcgcaagggcctggacgatctgttcagcatgtactgaggtggtggccgccgggtgtgtgtgtgtgtgtgtgtgtggaagttcggcgcctgcgctcagagcaggatggactcgatcacccaatctctcgctgtaaggcttgcacacgggtcctgaggccgtgagcctgtggcgtcgtctctgaaggtgtccgcagcaagccagctgatgctgcgcgccctggcatcttgctcgcgagcaatccnnnnnnnnnngcgggtcctgaggatgtgagcctgtggcgccgtctctgaaggtgtccgcagcaagccagttgatgctgcgccctggcatcttgctcgcgagcaatccacggacgggcgcgcgcgaactctcttgcgatacagatgtcccttgtttaaaacaaatcgcagcaacgaggatgtaatgagattggattgccctagtttaggataggagcaggacaagatcggtggttgggaacgcaggggcggccggcctgcagggtcacactgcacgccagtgcccatgcgcgaaggccgatctggatggcccagccaggcatgatcgatgagatcggaggtcaatgacctgcaataggacgaccatctcctgttaaagatcagtgcgccagccgaagtgctgatgatggaccttgcgaacaaccctgagcccgacgaggcggacgaggaggtcgggtgaggtggccgccaggagtggtaatgcgccgaacacgtcggcctccggacagccaaaggaatcccaccgtccctgtacagggcccaggagcagcaggccgagcagctggcgtacgagagggagtacgaggacgactactcctgggagcagctgcaggaggacgatcagggcaacctccggggcccggtgcgtggtgaatcaggcatcagcctgaggtcaggagcaggcatgctcgcaagtgatgctcagccggggctgtccaactctggcgctgcacccagcggcacaggcatgcccctcccttggcggggtctgtgctactccacctctcacaccggctcgccggaccccccaaacgtccactccaggactcggcggcggagcgcagggcccgacgcacccggaccctgaacgcggcgcacgcggcgcgtgtccagcgaggcctcatccgctacctgcaggtggtggtggacctgtcccgcgcagcggccgccaccgacatgcgacccctgcgcgccgcggtcatggccggctgcctggcccgcttcatccgcgccttcttcgacgagaacccgctgagccagctgggcctggtcgccatgcgcgagggcaccgcgcgcgtgctcagccccctcgcctccagcccggtgggtgtgtacgcggggacctgggcgtgggggggggctctcgcgcgcgcagagcgcgctgccacatgcaccggcaagccggccgtgttggcgacccacgcaggcttgtcagcccccccccccacacactcgtcgttcgtcgtgcaggaggcgcacatcgccaggctgaagtccagcctggacacggggggcgatgcctcgctccagaatgcactggacctggcggtggggggtctgcgcagcgtgccgccctacgcgcagcgtgaggtgctgatcctctttgccggactctccagctgcgacccaggtgcgaggcatgggggttggggtcgctgctggggcgtccacggggggcgggggtggcatcgcttcccacttccctccgcgaatgcagcccacatgcgagctctgctgcacaccactccccacaccccctccctgccgaccatcctaccccaatccaaccacactcacccatcgctctgctgcccctccaggcgacatcatggccagcgtgcaggccgcgcgcgccgcgcgggtgcaggtgtcggtggtcggcctctccgccgaggtgtacgtctgccgggagatgacgcgggtgacgggggggaggtacggcgtggccctgggggagagccacctgtccgacctggtactggagcatgcggtgccgccccccatggcgccggggtcgagcaactacagcctggtgaggatggggtttcccaggagggagccccaggccccgggcgccgccgtcttcacaggtggggcttcgatagatggaaggtggcaggcaggggaggggaagggggcccacaggtgcgacgggatgaagcatgagtgcagtgtggctttttgtattcttggtgttattgaggcaaggggaagatgcaaacctgtggtaaggaaatcctgccatcatggagcgcacaggagagcctgcactgtctctagagacagggacgggatgtcagctcgcactgtaattcaattgccatcccgcaggtccggaggctgtgctcctgtccggtgggtacacatgtccacaatgcgcggcgcgtgtggcggagctgccctcccaatgccacgtgtgtggactgacactggtgtccgcaccgcatctctcgcggtcctaccatcacctcttcccagctcccgtttttgtggagactggggccgaagatgaggcacgtgcgagggtgttgtctgccaggatgggtttgtgggggatccacggatggcatgctgctgtcctgcactgctgtaggccaccgcactcggggatagtgcaggcagccccttgaaacaaaccgctcacggatgttaatactcttatcttagcggcacgagctcacaccttcccctctaatccccacaggcgaagcggtgcgccggatgtgggcacgattttgcatccnnnnnnnnnnttcggggatagtgcaggcagccccttgaacaaaccgctcagggatgttcatactcttatcaaagcgtcacgggctcacaccttcccctctaatccctacaggcgaagcgctgcgccggatgtgggcacgattttgcatccggggacctgacctttcaatgtccagagtgccgccagacctattgtttggactgcgacgcctatattcatgaagtgctgcataactgcccgacctgcgaactgacgtgtcggtaatacttctccagggttgaatgctgttggggataggatatgcccgccgggcgcctcgctgactcatgcgggcgaccggcagagccaatccagatcccgatccggtggcactgtcgtcgatgatggcagccggacagatannnnnnnnnnattgaatgctgttagggataggatatgcccaccaggcgcctcactgactcatgcgggcgaccggcagagccatccagatcccgatccggtggccctgtcgtcgatgatggcagccggacagatatgcaccgctatatgtatgggtaagacatccccagacccttctcaaccttgctgtggagtcgtacaccgcccttcccgaggatcgcaaactccgtttgggatccagcttgcttgtaagccagccctcgtgaccgaccacctcccttgcaccgtggcctcagcatcgagcacgactccgaggaaacaacctgtaatgagctgtagcacagtcctgaagcgatggcatgaaacttcggtgtcgttcagaggtcatcatggggtgttggcgagtgatcaccctcctcgtcatcattgcgaccggagcccatggacgcagacttctgtctggggaaccacccgaggacagggctcaccctcatggtcgaagtttgagagagaccagtgcccaggcattccaaccacccccggacatgttggaggccccggatcgtgtaaagcttctggcgactgttctgcctcctccatcacctgtcttcagacagttcccacccccaaggtcccctccacccagcccaccgtctcccaacccccctccacccagcccattgcctcccaacccccctccacctcctccagtcttgccgcctccttccccaccaccaccctccccgcctccttttccaccacctcca

SEQ ID NO: 27306 - DNA, 61 bp, Chlorella protothecoides
gaaggggttgtggttgggaaactcataaagaccctgccaatacaatgacctcatcgtaagg

SEQ ID NO: 27307 - DNA, 78 bp, Chlorella protothecoides
cagccatggacaaagggtgaagggtcgtggaatgaggcccccccagggaatctgggcggaacaggtgtctcagcgggg

SEQ ID NO: 27308 - DNA, 61 bp, Chlorella protothecoides
tcctcgtcctcatcctcagcagctcgggtcgtctcatccctgcatagtgatcaaacgtttg

SEQ ID NO: 27309 - DNA, 64 bp, Chlorella protothecoides
tctcatccctgcatagtgatcaaacgtttggtgaataagggtgcactgccctgatcagaacaaa

SEQ ID NO: 27310 - DNA, 61 bp, Chlorella protothecoides
agcggtatgaactggacccgcaaggagggggggtccttggctcctggtgcactctggaggt

SEQ ID NO: 27311 - DNA, 87 bp, Chlorella protothecoides
agcaaggcggggagtgtgcgaacatctaccctgaatatcctgggtctgtccatggatgctgtccgcatgagtactgcagagctagtg

SEQ ID NO: 27312 - DNA, 61 bp, Chlorella protothecoides
ggcggaagaggcccgagtcgcagcccaggggggtggagtggccctggctcatcccggaggc

SEQ ID NO: 27313 - DNA, 69 bp, Chlorella protothecoides
tctccacctcccagccctccaccttcccccccgccaacacccccaccgccgtctccacctcccagccct

SEQ ID NO: 27314 - DNA, 71 bp, Chlorella protothecoides
ttgcagcaccttgctgctccgtggcagaaatgtaaagcaaccctgagccttttgatagccacataaaggag

SEQ ID NO: 27315 - DNA, 163 bp, Chlorella protothecoides
tagcgagaggataggcgtcttaaaatagtcttcctataggaatcagactgtatcctgtaaacaacggattaattgtcatcttccaatggtcgacggtcccctgtattactcacatgcaactttgcggagaggacatccgcgcccgcctgagatctggaattga

SEQ ID NO: 27316 - DNA, 61 bp, Chlorella protothecoides
tcggctccagattcccggtgacgaggcaggtcatgaagtctgtgtcttcctggtgaccagc

SEQ ID NO: 27317 - DNA, 131 bp, Chlorella protothecoides
tcacgtgaccagctctatacaccctgggattgaatggtcacttttgaaaagcgcacactcatcatccagccgcccaatacccacccccctgctcctccaaacccccctcaggctccctcctggccctgtcc

SEQ ID NO: 27318 - DNA, 61 bp, Chlorella protothecoides
ctcatcctcgtcaccctcggcctcctcgtcatcctcctccccttcttcctcctcgtcatct

SEQ ID NO: 27319 - DNA, 68 bp, Chlorella protothecoides
gatgtctcccttgctggtctccaggatcacagacatgctggctgtcctccgggctcgcctcccctgct

SEQ ID NO: 27320 - DNA, 80 bp, Chlorella protothecoides
tcaaaaccatcttcccgcaggtgcccgacccgtaaaacagcaagcacagcggtgctcctatcccgggtcgtgaagatcgt

SEQ ID NO: 27321 - DNA, 61 bp, Chlorella protothecoides
gatggcggcctcgatcaccatgtccaccgacccaaactcgtcgtaggtcagggtgcccgtc

SEQ ID NO: 27322 - DNA, 213 bp, Chlorella protothecoides
caaatgctgtcaggaaatcaagaggcaggagcttcgaaaattttatctgtgaagtatgctcctttgggcaatgcttgcaatgtccgagagacctgattcggaaagcatgcacggaggggcctctcctagccactgccgtcaggcacctaacgacatcggcgcgctgggctccccctgaactcttacctgtgaacacgaactgagcgacaatgg

SEQ ID NO: 27323 - DNA, 66 bp, Chlorella protothecoides
acagctgcttgtcaagtgcccccatattataacatactcccctgaggaccacggcctgtcaatctt

SEQ ID NO: 27324 - DNA, 61 bp, Chlorella protothecoides
tacactgcagagcctaaagtacctgcacagcggccctacgctaacgcatcgagactcggtc

SEQ ID NO: 27325 - DNA, 75 bp, Chlorella protothecoides
ctgctttgcgactccatccttgggattctcgcgtaacaaacccaccccacctgcaggacatgggagaagcccagg

SEQ ID NO: 27326 - DNA, 167 bp, Chlorella protothecoides
gcccgcagcggggacctgcacccctcctcctggtacgcggtggcctggtaccccctgtactgcgtccccgcccttgcggccgccggccccgcgcgcgcgctgcaggccgccttcctcaccttccacgcgctgggcgtgggcggcgcggcggccgccgccgcgccgct

SEQ ID NO: 27327 - DNA, 79 bp, Chlorella protothecoides
ggccagtgaaaaggtggacatgtcagccgcaaggcagaatcaggagcccggcggagatactcaccggtctttgggggcg

SEQ ID NO: 27328 - DNA, 1806 bp, Chlorella protothecoides
  modified_base (1182)..(1191): a, c, t, g, unknown or other
tcacgctacctcaagatggtttgcaagggcggcattttccccctatgagagctctcacagccctgactggcgtggcatccaaagccctacacccatgtccaccgcagggaagatgccctggccctccagactgcggcgctggagaaagaacggcgggaagtggacgagcagggcgagaggctggcggcggaggccgtccgcctggcgactgcggaggccgattgctcggcggaacgtgcctccctgcaggcccggggcgacgagctggcggcgctgctgggggagttggaggcgcggcaggcggcgctggatgccagggaggccgaggtggcggcgctggagggtcgcacgaagctcggcgcggccgaggccgagcagcgcggcagcgcgctggcgcaggaggaggcgctgctggcctccatgcgcggcgcgctggaggcgcgccagctccagctcgaggtgagggaagcaaggggggaaggctcggggtggtggggtggtgctgcgtagggcagggccagccggctggcgaccgtggcgagtgtgtcactgtcactgtgcggcgatctgtctatctacatggggacatacacgaactgcatggtgcagtctctgcccctgcgtcttcctcgagccaaattgacaacccccaccgcaggcccgggagcgggaggcggcagaggcagtggagggggcacaaaaagcgacgcagcgtgcggagcgcgggctcgaggaggcgcggcgccagctggaagaggccgagggccgggagcggcgggtggatgagggcgaggccggcctgcgcctacggggccgggagctggaggagctcaccctctccctgcaggaccagcaggctcgcctggtgcgatgagagcgtcgagtgtgccttgtgttgtggggtggttgggggttgtggggcgagttcttcaagatacagctggcaagtggggcagtgggcgggcgatgggggggttatcgatgggccaccggccctctggtgtctgccccacagggtctgagttacaatgtcggcggcacagcacagctcgcctgggacagggaggcgatgtagtggcacacgctgcgttccttgcctggctgccggtggcccgagggtcgcaggcgttgcatcataactacagcccctgaatcctctccgcaggaggccgagtcgcgccnnnnnnnnnncacaatgttggcggcacagcacagctcgcctgggacaggaaggcgatgtattggcacacgctgcgttccttgcctggccgccggtggcccgagggtcgcaagcgttgcatcataactacaacccccaaatcctctccgcaggaggccgagtcgcgccagctggaggcggagaagaccaggctggagctcaaggtcgcggaggcccgcgggcagctggaggccgccggcgacgtgtcggagcgggcacggcacctggaggcacgccttgtcgacctggaggcgagggatgcacggctggcagagtgcgaggccgctgccgccacggcaaatgatgtcgtggaggcggggcggcagcgcctggcttcggcccagcgagagctcgaggcccgcgagtcggaggcggccgcacggcgcagtgagctggacacgctgtccgccgccattgaggaggtgcggcgcgagcaggaggcctggaccgacgacgccgagcgccgcgcggccgcgctttcttcggcggagcaggtgccgggagtttctctttggtgggggtttgtctggggatgattcggatggccattgcgcggtggcgagaagctcactacgaatacacccccc

SEQ ID NO: 27329 - DNA, 75 bp, Chlorella protothecoides
ctccccgtctgcgtccccggcgcatccccccgtggcctgttgtccgcctgccccgcaaagaggtcgtagaagaaa

SEQ ID NO: 27330 - DNA, 70 bp, Chlorella protothecoides
gcggtgcctccagggggtctttggaatgggggcggtggatgcggtgcctccagggggtctttggaatggg

SEQ ID NO: 27331 - DNA, 265 bp, Chlorella protothecoides
aagaccctaacccccttaagtggctgcttttcagattgagggtatgaggggagaccgaaggacaattcggacatctagcaaggataccaccctaatgactggtgccagaggggttgtcactgttgagcgcaaccacccgaatttgggtgatgcgggcgcttcgtacgcatgtgcagccgcaggcatgacgctcccacgatgctctgaaaacaccgcatctcctccttcccggcacgacctcgcgaattacatcctcagggcgcga

SEQ ID NO: 27332 - DNA, 70 bp, Chlorella protothecoides
ggggaggagcgcacgagcgagaacgagtgcattgctgtgtgggggggtgttcccgcgcaatttcctgcgc

SEQ ID NO: 27333 - DNA, 78 bp, Chlorella protothecoides
ccgtgcatggctttgtcacccatcccgccccccgtttatttctacaagaaggtcgcgcggtgcgcatggtacagcagg

SEQ ID NO: 27334 - DNA, 102 bp, Chlorella protothecoides
gaaaagacagtctggcctacaattttcaagctgcatggcgctgacgaagtgaacaacaccaacatgattgataagacctccacaaacaacccgtctgcaagc

SEQ ID NO: 27335 - DNA, 114 bp, Chlorella protothecoides
gaatccggcagaatccaggtcctacaaccctcaaccccccaaaatccacgtgatgcagagctggtggtccaagcgctggtgacgggggccctccgcgacacctcggtgtccatc

SEQ ID NO: 27336 - DNA, 75 bp, Chlorella protothecoides
atgcactttgacaagggcaggggtgaggggtgtgcacgaggggactgggcggggcaccggcgggcaggcgtgttt

SEQ ID NO: 27337 - DNA, 109 bp, Chlorella protothecoides
catgagaaggtggatgtcgagtatagtcggccaatgctgcctgcccaacctgattataaagtttcgcattcctcgcctattgacactctgctattgcgcaccgatctgc

SEQ ID NO: 27338 - DNA, 68 bp, Chlorella protothecoides
atcgatagcttctttcctgtgccccttcgctgcaaaaatcctgcgatgcacgatgaataagaaactca

SEQ ID NO: 27339 - DNA, 67 bp, Chlorella protothecoides
cgtgcctgaagccgacctgtgctgaggcacggaggcacgcatggtcaggtaggtgttacttgcatgg

SEQ ID NO: 27340 - DNA, 61 bp, Chlorella protothecoides
aggtgtgcggtgatcggtgaaacagtgggaaccgccgatgctgatcgagccctctggactg

SEQ ID NO: 27341 - DNA, 61 bp, Chlorella protothecoides
gttcgatgatgcctggtgctctctggtgtttcttgcacctgcttcactcctcccatggtta

SEQ ID NO: 27342 - DNA, 177 bp, Chlorella protothecoides
caagtcgccctggcgacccccgggtgagaggagggaggcgcgacgggaaggctgtgggcaggaccagcagaggctgcgtgaagggaagatgctcccctcctggggcaaccctgttaccaccagacatggtcgccgcggcgcgggccgagcctcgggcaccgcgcgcagcgctggcgc

SEQ ID NO: 27343 - DNA, 61 bp, Chlorella protothecoides
tgggaggggtatacaagacatcctttccaattttggccctgccacttcctggtagaagaga

SEQ ID NO: 27344 - DNA, 61 bp, Chlorella protothecoides
gacatcgtgcttctctgaaagtggcaggcgggggggtatgtaggccatttgcgtgcctcca

SEQ ID NO: 27345 - DNA, 6193 bp, Chlorella protothecoides
  modified_base (1556)..(1565): a, c, t, g, unknown or other
  modified_base (1675)..(1718): a, c, t, g, unknown or other
  modified_base (1821)..(1830): a, c, t, g, unknown or other
  modified_base (2196)..(2205): a, c, t, g, unknown or other
  modified_base (2458)..(2467): a, c, t, g, unknown or other
  modified_base (3332)..(3341): a, c, t, g, unknown or other
gggggggggggggggggggggggacattggtggtggaaggggaagatcaggggtgggggcgatacaaagcccatgcccggtctgaattgggcaccgacacgccactgccaccatgactggtgcacttggaggtccaacatcagcaaaggcacccgccgtccgagcgaagcaggacccacctgcgcattggagcgccgggagcgggtcgaggtggtgctctttcgccgcttgagcgtgcgtgcaggccggcccgagctcccagactcgttgtagtcgtccccgtcgtcgtcatcctcatccccatcctcctcctccgagtccgggggccggggtgggaggcccgaggaggggccaccggccgagtattgactgaccacctcaccctcctgccgacctcgccccggcatggcgtccggcatacgaacatggggctccatgcccgcaaatgccccgctgccattctctgcgaggcggggggggcgcccgcggtgaggggaagggatccgaaaacgcgaaagacgactcgctccggaaatcagacagcacacggcactgaccctcgctgcgcagctgcaaacccaccggatatggaagggagggcgaagagggtcgcggggtggccaccagcgccgggacccagttgggcatcctgccctgtcctgtctagtcgggttgcagaggactgcaggttgccgctcctccacgcgtagtcctggagggtcatatcggagtgattggatagggtcggggcccactcccacgtcccatggccatggcgttgctttggtacaggcctcctgctgtactgccatagaacggtggcctagccggggcagcctcgaccacccacctggtcctgccgtgacgtttgaaacatgtcatcctgatgctggtccatcaccctggggtttccattcacgaaagagtgctgggccggatactccagcctctcgcaccggcaccaagtgtcgctcgaggaaccgttcagcgcttggccctgcagatttagtccaaaaattgtccttgctgtcgggaaaatgagcatcaggggccccggtgtgcggggtactctgttgcgagcgaggcggagaccaggcgtggaattttgtccccgtcagatgtgggaggttcctcaggctagccaccggcatgccttgataagggccatgaggggaatgcggaccacactttggacctgtgccagcaatttcggaaacctatgtaggagttgggcgtttagaacgctgttgcagatgtgcaccgtcccttctcctcgagggccaatagcgctgtccaagaacgagctggcagtgttttgtagttcgaggcgcctccacgtaaaaagcaaaccctctacgcgacgactcgcctcaacaccctcgcaaataattccattcagcagagcatatctgaatgagggcgcacacgaccctactgtgctgcaccgtgacccgcttagggcttgactggcccctttgaccatgccatgatcgacacccaagagaaccccaagtcaaacccgcagctccatgtcataaacattacttggtgtggcnnnnnnnnnnctgacccgcttagggcttgactggccccttcgaacatgcaatgatcgacacccaagagaaccccaggtcaaacccgcaactccatgtcataaacattacttggtgtggcnnnnnnnnnnnnnnnnnnnnnnnnnnnnnnnnnnnnnnnnnnnnaagaaccctggaaatggcaattcatgcacgactgcatcgtcatgtaaaatactgttgtccggaataatccaaggttgcacggtccattgacactgatgcacannnnnnnnnncaaaccctagaggaaccgctttatcttcaaacggatattgccctcgccgagggcaacgtgcgatggacacacgctccttcatactctgagaaccctggaaacggcaacttttgcacgactgcatcgtcatgtgaaaaactattgtccggaataatccagggttgcacggtccattgacactgatgcacatggagtagaagccctcatcctccaatggattgcagctggatcattctgccacgagcgccgtctctcggagggcaccaatctgcattgaatgactagattgtaaatgcttgtccaaacgacaccagctgaagcaattgactagcgagaatacatgtacatggaagccccaagggggannnnnnnnnnaccgtctctcggagtgcaccaatctgcattgaatgaccagattgtagatgcttgtccaaacgacaccagctgaagcgattgactaacgaaaatacatgtacatggaagccccaagggggatagttgcagaagcttccaagcaatacagcttgttcaccctcccttgatttctcaattttactgaataatggatatgacgtccttcaacattgatacctacaacttcagccatcattgagtccaccaaaggtgnnnnnnnnnncctttctcaattttactgaatcatggatatgacgtccttcaacatgatacctacagcttcagccatcattgagtccaccaaaggtgaacttgatgaaacgttaggcttcacaattgagtgggtgtggcatacctctgctttggggaagaaagatccttatgctctcttcgattatctcggtgaagcttagtattctgtctctgggccccaaatggcggtccatgcctggcgttccatttgcgcgggaaatcgtgggaactcctgcggcgcactttctatcgggcttattctgccgcccgagaagtgcctgggcgcaacgaggggtcgccctcattcggcaccgtagacgggcgttctggggggtgagcttcgagcacgggcaggcagaggctcgaggggatgtataggctgcgcgggacggtgacgacggctgatgccagcgcgtggctgccccgcttgtgctactgggcggttgaggttctgtgcggtagcgaccagatacgctgattgaatatatggtgccgtttgaggaccactggtgcccttgcacggcctctgagggctgctaccgccttccaaccacgacctccccttcccgcacagagcttcacaatgcagatcttcgtgaagaccctcacgggcaagacaatcacccttgaggtggagtccaatgacaccattggtgagagggaggttgacttgtgcatttgcggctggacgatatgttgtgagctccgggagctagcagggcacgtccctctcctcctcaacgattggcactgtgggaagagaccctgcctcctcaggatagcaacccacccataccctcatcgccctgcagacaacgtgaaggccaagattcagnnnnnnnnnntaaggagggaatccccccggaccaacagcgcctgatctttgcgggcaagcagctggaggatggccgcaccctgtccgactacaacatccagaaggagtccaccctccacctggtcctgcgcctgcgtggtggaatcatcgagccctccctgctcatcctggcccgcaagtacaaccaggacaagatgatctgccgcaagtaggtccagtggcgaggggtgatgttgcagttgcaccggtggtgctctggggcagcagggatggacctgagtcccaccccttgtccatggattttaggggtgactgggccttggaagtttccatgtcactgctttgcgagtgttccccaccccgggtgagacaaatttgccccattgtcgctccaaatgaccctgggatgaatactcacccaacactgatctccttcctcactttgccctcgggctgctttctctacagcccatgggtcattttatgggtggcacatgcccgccgtgataccctctcctccatgttgtgtctgtgaggtagcaccagctgccccctgcgccaagccacctcaacccccctgccccattcccctgtcttaggtgctatgcccgcctgcacccgcgcgcggtcaactgccgcaagaagaagtgcggacacagcaaccagctgcgccccaagaagaagctgaagtgatctgagcctcatgctttgtgattgggtgtaatgtggtgccagaacgaggcagggacgatgcctggagtttgggggtaacagctgccggggcgtgtgctgcagggagggatgctctctgccctgggaggctcgtgcgaaagtggcttggacccatgtatgttggatgttaagggtagaggtccctaaaggaccctccgacactgctgcgtctcggtacacccgggatgcatgctgtctctcatttcgcgtatttttaaagattgccacagagccagcaagcatggcatttttgtgctggcagcaggaggaatccgagcaatggagttggagcgacgccattcacaaagtcatagtacaaacttgaaagggggagggggggtggaggtccagaagacagatacagagtcacaatgcagcgaggtcgtcatcatgcatctgccttcttcttcttcttcttcttctccttctgcgaggggtgcgtgatggggtgagtgcgttggacagacttcagatcatcgatgtcgaagatcttgtgtgaaaacgcatcgctcaggtttgctgtttcctgacaaggatacggagccttgcatcccacaagccacgcccatggccgaaatacttggcgctataaaggccagctgcttcaccacgacaggaaagagccaccgcttaccttatccccgttctcaaggccattggctgcctctgcctcctcttcattcactgccacccctgcatcgcccgacttcttcttcttctttttcttggtgggctcctcggcctccactacgtccgcctccgcctcccgcttcttcttcttcttcttctcggtggttgccgcgacgacgtccgcgtccgcgttgtatgccttgggggtggtcagcagcgtcggcgcggcgccctggcgcgcggcgtcgtacggggctgcgccgggcagaccccggggcctcgctgcctcgccctccaactgccggccctccagctggcgcagacgggcctccacctggacaattgcagcgggggtgggggatggagggggggggtgagtccaggtgggcaggaactgctggcgaagaggagtttggcagccgccttggcggcgcatgagacatgcaatttgtagtcggcctggcacggggccgggcaccgagctgtggggccctggccgagcccctcccccccccgcccactgcgggagcggacggggcgggtgccaggcgcagacacatcgctgttgcccccgttcaaaacctgtgtacgcatccgtgcccatctcgcgttcttggcacggggttctgctcagaggcttgtggcctgcccgtgtcggacatgcacgaccctggactgtcgcgcacgccggccggcagacccttggcggccgcccacccaccctgcgcaccttggtgcgggcctccagaccgatggcaccgttgtcgctgacgtccgccagcgcgtccactcgcacgcccagcgcacacttggccgccaggacgcgcgagatcttgcccttgttcttgggcgcggcctggccaatgagcgaggcgtggtagatgaggccatacttgggcgtctcgtgcttggtcttgagcgccctgtgcaagacaagatgggggcgggtaggcttgagagaggtttatctcttccacatcgtcagggggctcatactatgcagtacgccgctgagcattggctttcccccgcccttgtgcccccttctcaccccgacgcacctgaacagcgccttctcggcccccaggatctggatggtggacgccggggctttggccaggttgaccagggagccgacgtgcgcgatgaggcgcgcgcccaccagctcgccgacgaggacggtgaggttgggcgcgatggccgccatgcgcgacttgaggtagtcatacagctggccgcggtagtcggagagggcgatgacctggtcgcagagtgcgcccacgttcagcacgtcctcctcgctcacctccgtccccatggagatgacggctgtgaagggaagggagagggcgaagggatgtgtggggtaggggtgtgtatggtgctggggtggagtgagcatgaggcgagctgcccatctcttccatgccgcctcgtcattcccccgtctccccgccctcatgcccccactgccacccccctggattccctcccacccat

SEQ ID NO: 27346 - DNA, 76 bp, Chlorella protothecoides
caaccgaaacgtacaagttgaagagtatccggtactctgtagcatgcagtgtccaaatcttcgctcattggggttc

SEQ ID NO: 27347 - DNA, 61 bp, Chlorella protothecoides
agacggaggcggcgcccctacccatccccgagcaaggttcccatgctgaggctgccccatc

SEQ ID NO: 27348 - DNA, 71 bp, Chlorella protothecoides
tcgtcccgcgaaactgtcagaaccaaggcggggcgcccttcggctgtgcaaatgcgggcctgggatcctga

SEQ ID NO: 27349 - DNA, 175 bp, Chlorella protothecoides
caggactgacggcaaaatgggatgatatgcaacctacatcgatcttaaacgtagcaacagtgccccgggcacaatacctggcgtcacttcgtacggccgacgacatgaggagtgcgataatcaccgcatgggcacgaaacccccaaacaagccccattgctgcactgagagacga

SEQ ID NO: 27350 - DNA, 142 bp, Chlorella protothecoides
gtagcccccacgccccctctgcagccgaccccctgtgccgacgtgacggtggttagtctaaagacacgctcctccccccccgctgcaccggacccctttatgctcacttgtgtctgatgaacaccaaggtccgcttggggtg

SEQ ID NO: 27351 - DNA, 92 bp, Chlorella protothecoides
ccccgccccccccccccccccccccccccggggctcacgtcacgtcagctggacgccggccctggaggccagggacgcgagcttggcctggt

SEQ ID NO: 27352 - DNA, 14422 bp, Chlorella protothecoides
  modified_base (1877)..(1886): a, c, t, g, unknown or other
  modified_base (3952)..(3961): a, c, t, g, unknown or other
  modified_base (4893)..(4902): a, c, t, g, unknown or other
  modified_base (9719)..(9728): a, c, t, g, unknown or other
  modified_base (11306)..(11315): a, c, t, g, unknown or other
  modified_base (11918)..(11927): a, c, t, g, unknown or other
  modified_base (12694)..(12703): a, c, t, g, unknown or other
  modified_base (13885)..(13894): a, c, t, g, unknown or other
  modified_base (14351)..(14360): a, c, t, g, unknown or other
gcaactcaaggcccggctggccaagggctccgaggtgcccctggaactcatcctggaggtcaaggagctgctggacgccacgccgcgcgccgagtgaagagctgtacacgcccggcgtcgtccccatgcccccccccatcagcgagcgagcgagtgccccccctggcgccccccgctcccccttccccacaccactgtatccccttgcaccgcgccccgggtgccgtcggccaccccgcccagatacaggcggggctcgagcctgccacccgcccgccaacgcaagccccttcctgccctgctccgtaccgcgcggcagcgccaacccgtgcgactggcctgccttcagccccacccccttttcacgccctctcccttccaactgcgaattacttgcccggccctgcgtcacgtcccatactcgatggcgcccgaccctctctctatccctgcggcgccccccccacaccatggaaaaccatgcctgccaccccgccccaggatcgcagaagtgtgcccctggtccggtcgggacccccctccctgggcctccgacccgtactccccttgctgtaccaccgccccgctcctgtggctctgtgctggaggtcaggggtcagcagccccatcgcagccgccggggcagctgtgtcccgccgccgcgatccgggcgctccttgtgctcgaggtgcggggcgggcgaccctcgccccggcctccatcgcggacctgctgcatggcttctcggcccggtatcccttcccccggagttgcccttcttgcgtttgcttgacgcccgtcccacttcgctgtccgaagtgggtcgtgccccggtgcctctgcccgccccggctgatgccagaggagatctcgaagatgaggcgacggacaccaccatgtgcttctagcttccctgttgttttccttccttttcatcctttgccactacctctagattgcttgcctagaatcgggtaataatgccgcagccttggtgtgcccaggggaagcgctgaagggtgtggtgcaagcgctcatgcccttggtggacgacaaggagggggaaggggggagtcaaaccaagtggcggaaagccacgtgcgatgcacggccttccccatcttcgctgctggcatcttctccgtccgcacattcaaacccataagcagtgtgccttctccgtgctgtgcgggctgtctgaacgtgcgtcctgctgcatgcacccggtcccgacagcttggtactcgtgcacagcggggttggcgagcgcataggtggtttcggcaggtgccccattccgccccacaccgtcatcatgccgtccaggtgatttgatccgtgcatcattggccacgggcgacctggttgcagggtgtggaagtggtgatgggttgccggctcaagattcccatccccgcagctcatgagccgccctcctcacccactttcatcccgacaccgtgcagatcgctcaaggccaagcatgtgggttgtgagatgaatgcatcgcttgcttggcatcgtgccatgctgtgcatgtgttgcctgggtttgcaacgactccacagtgatgcacagccagggtgcctgtctcaagggagggaggctggtcaaggcgcgccacacctgcccccttgcagcactttttcgtggatgtggacatgaaggaggtccttgtccccgtgccggagtccgacctgcacgcgggggtgggcaccaaaggtaggtgggatgcggtcgaccccggcgcaggccgggccttgaggcagtctgggtgctagtgattcttgcagtgcttttggcagccgtgtctacgccacacacttgcccatctccaattcccctggcacatgccacccctgcagtggtggtgacgnnnnnnnnnntggtcgaccctggcgcaggccggggcttgaggcagtctgggtgctattgattcttgcagtgcttttggcagtcaagtttacgccacacacttgcccatcttcaattccccttgcacatgccacccctgcagtggtggtgacgctcggtccatcctgccagtcggtggacgtcctcgtcgagctgctggcagccggcatgacctgcgcgcgtgtcgacctcaccgtgcgtccatgtgttggtggcttggcttttcctgctgccctactcctccgtcccgtgttggcgccgtgggaggagctgcatcgtcctccccaggctgtacagcccatcacctctgattgctgcattgccttcacgctgatgcccccctcccctttccctttcgcagtggggacccgccaccttccaccaggtgtccctggagaatctagcaaaggccatgcatgtcaccggccgcctgtgctgcgtgtggctcgacaccacgggaagggagatcaccgtgcggcgccccgccgagaccactgaggacgggtggctgcaccacggcacccccatcgagatcaagaagggccaggtgggcagtggggatgcaggacgggttggtgggggcgctgctcagcttctgaacgccggtgcctttcgaatatggaggcatggagaggtgctcctttgtgatatataaggccgctaggggccaccccccttcatctcgttttgcctgatcaggggccgtgcgcgatgcttcactcccgaagacctcgtccctcttcttcccgttcacgaccctctacgcccgccgcgtcctgcctccccatagagcgtcacgctgacacccaaggacgtaccggcgagcgagaccatgctgcccataacgtaccctggctttgcagacgccctggacattgggcagactgtggtggtgggttggaaggagtcggagcatgggtgcagggggggggcgtggtgggaatggaccattcggttggctgcaagagtgggcaccaggcacccatgatgggggcgatgcaggcagcgtccccttcccaacaccaccataggtggggcgttacctgagcacaggcgctgagggcggcaccctgctcctcgaggtaaggaaaggtcggcgcacatggttgttggagcctcagcattcagacgaccgggctgtttggccggctggattggcggtagtaaacgtccgtgcatctcccacttcacgccgtcccccacatccaaatcaatccaaaatccacctcccctgtcccttgcccaggtgacagagaagcaggacctggacatcgtgaccatcgcccagaccgacgccagcctggacggcctgctgacggtgatggccgcccaccccaacgaggccaacgacgccgcctttgacatggccatccccatcatgacccagcatgacgcaaactgcatcaagaagtttggcaaggtgggtggggaccgtgagggactgcagggccagagagcggatgaggtgtggaaccctgtaggccatctcggattgggagggctcatccttcagcctggcctgacaaggcagttgtgaatattcatgtgaaggatctcacacatgccctgcaaacagagactgagtgggatccacaggtatcaaagtgtatttgccccacctgctcggtgttcggcacgtgagtgtttcttggatttgctccatgcttataaaccccttccaactcaggagtatgagatcgactacatctcgctgtcctactgctcatctgtggaggatctgacagagtgccgcgcttttctggatgcgctgggcatgttccagaccaagatcattgctaaggtgggaatcaagggggaacaaggatcaggggtaaatgcttcgggttgtggtttcactggcagcacatccatgccgacttggacggacagcacacttgttgggaggatgccctgtggagaggcatttagaatgacatcaaattgaatgaggggcgtgttggggctgaattaagagcctggtgctggatctgtcgtccaggccccagtaccaaccccttatttccacaccagtcaagcnnnnnnnnnntcgtgttggggctgaatttagagcctggtgctggatctgtcgtccagcccccaggaccaaccccttatttccacaccagtcaagctcacgctcaccctttctccaaaccctacccgggcccaggtggagcgcaagcccgcggttcgaaactttgatgccatctgcctggccgcagacggcgtgctgatctcccgcggcaacctgggtctcgactatgacgcagaggtattgcccggcatgtatgatctggttggaggcatgggtggctcatgcagaggtttggttttgacccattgagcacttcattgcatctgaattcttcccagagcttttacgaggaacgactcccgcatgagcaggcttgtgccacacatccatccaccccgcgcgcgcatggcacggaccctccatgtctcccttcgtccccctccccgccccgcagctgatgtccctgctccagaagcggctggtggggcgctgcaacctgctgggcaagcccgtcatcgtgacccgcttcgtggacaccatggtcaacacgccgcgccccacccgcgcggaggccacggatgttgccaacgcggtgctggacggtgtggatggcgtgctcctgggcgccgagacactgcggggccagtaccccgtgctgacggtgcagacagtggtacgactgtgccgcgcggccgagctccactttgactaccgctcccaccacgagctcatggtcaacgagagctttgatgtgagggggaggcgggttttgaagttttttggggggggggaagggagtgagtttatagaagagcagctgagggcacagctgggttggggggtaggccccgccctcctcccctgcccttcccaatccgggaaatggtaccaaacacccttgtgcattctcaacccctccatcgcttgattgattgtcccaaatnnnnnnnnnntggggggggagggggtgagtttatagaagagcagctgagggcatagctgggttggggggtaggccccgccctcctcccctacccttcccaatccggggaatgttgccaagcacccttgtgcattctcaaaccctccatcgcttgattgattgtcccaaatccaccccaccgattcgtctccataattaacccccaggaggggctgtcgctgagccacccgtcggcctcggaggccgacatcccggggtcgtacgccggcctgccctcctccgcctccctgctgggcatgtccgagccggtggtcagcgtcggctccgtcgggcagcccaccgcccgcgccgggtctcgcccgggccgtgcgcggctgactgcgcagccgtcgagcctgacgctggccacaggggtctcacaggctcccaccggcgccggcccgatgtgggcggacggcggctcgccgccgcacccggcgtcggggctgggcggctcgcccacggcgcacaccgtgtccgcctttggcagcgtgccgtcacgcatcgtgcagcggggtccgcgccccggccgcgatgcggcctacctgcaaaagctggagagcgtggccagcaacgccacgcgcaccgcggagaagatcgcggcggggctgatcgtggtgctgacggcctcggggcggaccatcagcctggtggccaagttccggccgcccatgccggtgatggcggtggtggtgcccaccctgaagtcggacaggctgcgctggaggctggagggcaagttcctggcgcggcagtgcctcaccatgcgaggtggggcagttggggatttgggtttggggggaggcatagggaaggagtggtgtttggggggggggagggattcttggaggatttgcaacgaggaatggcaggggggattggaatgctggagaggcggaaataaacaaggtgggtggagcataccccacctgccatggcagcagcactgggggtctgttgcagtgagggttccgtgcagagcatatcttcacgccaagactccccaccagtgcactgcacgcaaagccccagtctctccccccccttccaaattcaacaggtgtgttccccatgcttgcggcgcccatgagctccggctcggacgatctgctgtctgaggccatcggcctggccgctgaaaacggtctctgcaagcccctggactatgtggtcgtcatcaccacagagcggggggccctggtggtcaagatcgtgcgggtggggcaggggccgtggtgtgggggacaggagcttggagaaaaagtggacgcactgttatgatgtcaacgttgctcggtgtgggtcgtgcatgcacatgggactaggctgcgacccttgaatggtgctgtgcaaggcaagagggcggggaaatgttcctgcccttctcgttcccttcagcacctacttcgaagaaggaagtcgcctgtgaataccccccatcgataaacactcccactcctcaatccctcgccgccgcaggtggacgaggccggcgagggcctgctgcacggcggcgagggcaggggacccttggcccctgagcaggccggcagcttcacctcctccctgatgagccccggtctgagcaacacgctgtctggcagcctggcggcggggcagcgcaccagcccctttggcagcgagggtggcagcccctttgcgcggggggtccccagcccctttggcgccgcaccagccgcttccgccgcttcgactcagggtgctcaccaccccaccaggtatgtttgaggtgacgaggaggtgggcttctcagttcagtgcatccagctgacccttccctgtcaccatgccatgcgcccaaatgaatacatcaccacccttcccgcagtcccggcgggcgtggccggcgccgtgcgcaccaggcaccctccttcctgggcgcaatgacggatgcagacgccatcagcgcctttgcccgcgcacagcagacggcggcgcacggctctgtggagccacgacttcgcacgctgtcggagctctgagtgcgcagcgaggctcgtcgccgtcttttgcatatgtttgcctcctgagggctgaccagtctagatctggcctccagaccctgctttaagctgtgagtctgcctgattctccttttgtgtgcgtcagagcatccctggcactctgccagagcgcgttgtgagtttcctgctggccatcgagtccgattggcagttgctgactgccttagagacaggggaaggaataggggtctggctgctaaaggtccattcttccatgcaatactcagttgcactctgtttgatgcattgtgccctaagccagtgcaatcgactggataatgtaaggacacaatctacagagtgtttgcactggatgcctgccttggagattgagtattgacctcttccaaaagcggtgcaagagcattcattactaagatatgaacgggggggggggacacattattgagcgtcaaggatgaggatcaagctgcaaccggccagaacataaaaacccgtccttcactttgcgagcctggacgccgcctccagcaattcctgcttctcaaacatgcccttaatcgagatgccctgggagctcagcagctgcttgagctgcttcacagagaagccctgcagatcagacctacacaggggtgagacgaggctgcccctcatcactggggcgcagcagggaccaaggagaggcagtgcatcccagtcgcgttgaagtgttgatcaccagcgactgatgtgtacccatgccattcctcgcacaaagcgctgtgcacccaaacctccaagctaacaacagtccatcccactcacagcgagggaggcgcatccgggaccacgcgtttcaggaaggcggcaaagtccgacatctcctcggggcagctgctgtgctgcatgccggggtagatccggaagtccacagaggaagcacctgatgattcaagaggggtcccagtattgcatgagctcattgcaggcagaaagggctgcacaggagcgtacagggctacctgcaagcacctttccagtacataatgatcccttcgggcgcacacaggaggccataccatcatacggtctggcttctcctttcaaacataccagcgagcacccttcccctctctcccacgccaatgatatcccaactgataagacgattccttcacctgcgtcgttgagggtcttgtacgatgtctgggccagaattgggggcagcagcggatcagcagaaccatgggccaggaaaatgggacgcctcaaggcctccttggagtactgtggagggatttggcatggagagttgcgatggaattgaggcaagggaggaggcggatggtgcagcatctcagcctctgcagcactaaatcgcgttgtcaatcagcaccatacatcagccggccacagtcaaggaatgtccactgcaggtcgcaatgtcattttgatctcagaataaccacgaagcgcaatgttccatgggctgatcgctctaggcccagcaagcctctagtaggcgcatgggaccccattcctaaacacaggaaacccttggctgtgccatatcctctccccccccacctctctccccaccggcatcttggagggctccagccaggtggaaagcgccgcgcagccggccagcgctggctcgtgccgcaggaaggccttgagggcgatgtgcccgccctggctaaagccgccgagaacaatgcggtcggtgggggtgcctgctgccacctcggccgcaatcaggtcatccacatacttgatggactctgcgatgccctccgggtctagtgccttgcctcccatcgccgcctgcaggtcgtcagagtccaggctcttaaggtcaaaccagcctgccagagtatgttaagaaggtgtagggtgggaatttggagggccgacggggctgacgcaggtgaggagggttttcatctttagagggactaagcgtcggggtgtgcttcgcgcaatttcataccatgcagaccacatcccctcgtgccaaggcccggcctagcaaagcctgtcatgcctggacatgcaactcttccagcgtgcagcccctcaacgccagtaacttgcctggcatggacatgcccatgttgatgctgatgggccgggtgggcgctgtagggaagaccatcttgatgtgtggcaggttgagctggggcccaactggtgcccagccattgcctggtcaacatgcattcacagagtgtgaggtctttactggaacattgcaggtgtggtggtgcaaagcagagcactcgcacccagtggtgcatgtcagtcctccaagggcgctgggtccacagagctctgtcgccttccacgaacccacttgggccgccccctccccattacaccaccctcgccatcccctcacctgtatctcccagtccatgcagcatgatcagggtcgccgagtggcgaccagccgcaggctgcgtgatcaagggtccgaacacgcgcgctgccatgtcggcagggtttttgaggctggggctgatgaggaaagcagcaaagtgtgtgaagacaggaaataatagaagtacgacgcacgggaagagtagattcggtctcacaaacggtatgaggcattgacgctctgtgggctgaggcacagctcagtttatggctcgcgctctcgggcggagagccagccagacctggcattgccaaagtcaccaagaactccaactagttctcccttgtaccaaatacgtaataactcccacaagaatgtcagttgccacgaatttatcctcctgcctcccaaaatctnnnnnnnnnncactagttctcccttgtaccaaatacgcaataactcccacaataatttcagttgctacgaatttatcctcctgcctcccaaaatctctcattgaaaaagaattgtctatgcacaggcatgccaatacactcttccagggtcagggcatgtactgtgatggaccccatcatgagtgccttaacgcatgccaaagacgagcatgctgtgagctaccggatattggaaggtcttgataagatctgccctttgtgctgcttgattggtgggtgaactaagactgaacggcacgcaaaggagggtgtgagtagagcacatcagtggctttgaggtggaccaaccttgagctcggttgtcccgtgagtccttaccagcatttgctcggaagtgtgtgtagttccactgacaggttgagcattgagagcaccgcaacaggtgcccggttaatgtctctcagacgcgtggagagtaagaaagcacgcgggcgttaagcatgcggaagccaccggacacccgggtccgatgccggtgtcggtggacctcatgaggccgccctccgatgcgtgtcggaacacagtctctgaataccaagtcaatccaggtttctctacaatgtcttcgtcaccctttgaggctgcggccagccccgggggtcgtgtcgtgatccccgccccggcggtgacccctccccccttcccctcggaggtgcgcgagcccctgctcaccccccgcatcagctcctaccgctcccagtccatgcagcctcccagctcatgggaggcggggacgcacatggtgaaatccatcctgggggtggcgctgctggccttgccccgcgtgttctccatgctggggatcggggcgggctccatctgcctggcggcagtcgccctgctggcctacgcctccctgcacgccctggcgaaggcgtcggcccgcacgggggtcatgaacatgtcggttctggccagggaggagctgggggtgaccggccaggcggtgctggacatggcactcatcttcaactgctttggtgcgtggggccgagcaaggaggggggccaagggtgagcagtctgctctgcatgcgtcctcctcctgcctggattgttgttgcccatggatgcactcgagaaaagaggtctgacgccgcttgagactccccttttcagccgccttccatgcatgcctgcgatactcaacccccaacaacacccatgtgcgaggtttgcagggatgctggtggtgtacctggtggtcatcggtgacatgctggtgggctcccccggcgagccgggcatcctcacccaggactgtggatccaggagggtggtcctggcggtggtggccgtggtcctcctcgcccccctggtctcctccaccagcacgtgcgcgcgccggggttctggtgggggtgtgctgtgcctggcacccaatgggacatggtggatcggacctgaggatggcgtgcgaggaggaggaacctgaaagggcttcaagacgtcctcctccttttgggaaggagtaggacaccaacattccccagcaacgtcctcccaacaccacgaacccacctgtgcgnnnnnnnnnncaggtcaccagcattcgccagcaacctcctcccaacaccacgaacccacctgtgcgcaggcagagccgctcgctggccggggcgtcggccctgggtgtggcagccatcctgttgtgggccgctgtgtccctgattctcttcatcatcgcagcaaacaacggtgccctgagccacatgcactggtgaggggcgtggaggcatccacagaggggaggggggaggggcgcccgcaggtgcctgggcatgttgagaagggacggtgaggaagattcgcacaccctgtgaccctggactgatgcgtacctctctcccgccttctcctcgtcagcatggaccatgcatggcctggtccctccattctcatccactcttcccccaccccgcaggtggcccaaggggcatgcgctgatcgggcacggcttcaagtctgcggtggagctgacctccctgctctccatcatgctggtcgcctacacttgccactggaccctgcagcactccgtgcgtgtttgggggccgaggtggtgggatgcaacaacaccctctcaatgcctgctgagcagcgactacttgaggtggtcaacgcccacggctggtactgtnnnnnnnnnngccgaggtggcgggatccaacaacaccctctcaatgcctgccgagcagcgactactcgaggtggtcaacgcccacggctggtactgttggtatcccctcgtcgctctgtgcacaccagttcaaccgttaacactccacccttccccttgtcacagatgcagagcgcaagctccgtgagggagcgccaggcacagggcgtgtcggccggcgccatcgcggccagcacggccaccttcctcctcatctccatctgctcctacggcgtctttggcaacgccacatccgctgatgtcatcaacaactactcggtggagacgctgtccaagctgctcatccctgagctggctcaagcaggtagacagagaggtccatgctgccagcattttgggggtccgaggctgttggatgagaatcgtctgaccgctggtgtggcgtcgaggagtactcaggttcatgagactgtaaatccacacaacctcgtgagacctttgtaatatggaattacaatgtcagtccctcgatctttcctctcactcccatcacccccccaactccaggcttctttggcatccgtctcggagtgctcattgcgctcctgttgtccttccccctgcatgcgagtggcagagaagggatgagggtggtgaaggacacatccaaaaatctcctgtcaacctgcattcaccacagtccatggaaatggagtactccgccgtcgtactcatcaacctaaccaaacctcacactgcagatggcgcccctgcggnnnnnnnnnngtggaaatggagtactccgccgtcgttctcatccacctaacctaacctcacactgcagatggcgcccctgcggacctccctgtggcagctcgtcttccgccagcccctgcaaggacctggcctgtacctggtaacctatgtgaccctcggcgcggcatggctcgcggcggcccacctcagcgacatctggagtgtcttgatcctcatcggatcgactgcaggtaagggggaactggtgttgagggtctgggaggaggagaggttttgtcagggcacactcgttatttgcgaggatgttgccaacgcaagcttactgtcaggcactcctgtcatcaagtggtgtttgctgtatgacccgcatacttctctcaggttgcaccagatcgaatgggctccaagccttcacccagctgccatccatcattcgcatgagtcactgtctctgcttccagcacagccagagagccagtactggcgccaattctcaccacctgccgtgtaacctgtgctccacaggcgtgctcatctccctgatcctgcccggcctgctctccatcggcatggaggagaccctgaccgagacccggggctccaagatccgccgccagggtggcggcctggtgctgatcctcttcggcattggcattggggcagcaggcatcctgcacctcgccatgtatgccggcaagaccccccacttctgaggcaaacatgtgtgccagagatgctggccatccatatacatgacgaacgacactgtcccccatagcttccgccccccactgcatggcagcctgtggcatgacctggtgcaactcgcgccagcctcgccctgcatgatacctcgtttgccttttgcgctgcagcttgctcctttgcatccaaaattgccctgatcacatacgattcggcagcgctttgccacaaaggggtgattatgctcggtgccagcgtcgaatgggagcatggcttacggtcgcgcaatggcattcttggagacgcaggctcgggaggggaatgctgtggtcaaggggatcgtgctgctctgatgaataaagcccgctcgttcggagagagtggagtcttagggtgaggtatagaaacgccatgcctattggcatgacacccccagtcacaatacattggtcccctcagccggcggtggcatactctggcagcgannnnnnnnnnggtcttagggtgaggtatagaatcgccatgcctgttggcatgacacacccggtcacaatacattggtcccttcagccggcggtggcatactctggcagcgaggcgttggtgccaggcaggtccagcacgaactgaggcacgtccaaccgggtggcgttcatgatggatggcacgtacagccgctcgcagtcgtggtcgtcccaggaggtgtcccccagcccaaaggggggccggtccacggcaatgctgtagttggcccggaaccatacaccgtcggggagcgggcggtagtcgtcgatggggggcaggctcggcacctgcgcaaggtacagaggaggtcccggtcaagcatggagggtacatgatgatacctgcacatggcaggacctgcatcggggtccaccaatcgacggtctgcgaccgctaagtcttatatatgtctctatgcccccccccnnnnnnnnnncgggtcctccaatcaaaggtctgcgcccgctaagtcttatagatgtctctatgccccccccc

SEQ ID NO: 27353 - DNA, 61 bp, Chlorella protothecoides
agaagtgagggatccatctcaggcttgaggtgagggaccaagcaggggcaggctctcttgt

SEQ ID NO: 27354 - DNA, 61 bp, Chlorella protothecoides
cttatagtaaaacaaaaaaaaaaaataaaaccagtttaaataatttaaaaaataatttaaa

SEQ ID NO: 27355 - DNA, 72 bp, Chlorella protothecoides
gcgggtgggtcgcaccagggcacctgcaatcgaagtctaattgtgcgacattgtgaggtagcatgttcatcc

SEQ ID NO: 27356 - DNA, 104 bp, Chlorella protothecoides
caaaccctgcggggaggcgatggtgtgggacaggggtttggatggtggcggtcggtggatagccgaggcaccatgaatgccccaggagcggtgcatggtgcggc

SEQ ID NO: 27357 - DNA, 116 bp, Chlorella protothecoides
cctgacccgttccaccggcaattatcgaagcacccaccccctctcaaggaagtgagaaactccgaccccgacctcaggttgggcaagccagtcaacaagacacgaatggccctgac

SEQ ID NO: 27358 - DNA, 61 bp, Chlorella protothecoides
atgatccggcacaaccctcacaccctcgaaaggtgacaatttggaacagcatgaagcatgg

SEQ ID NO: 27359 - DNA, 61 bp, Chlorella protothecoides
ccagtctggctgaagcttctgcgcaaagctcatcccttgcccagactctggggtgctttgg

SEQ ID NO: 27360 - DNA, 61 bp, Chlorella protothecoides
tgatcgattttcacctggaggctcggcaacaccccatcgctatcttcaggatacggacata

SEQ ID NO: 27361 - DNA, 77 bp, Chlorella protothecoides
cagggccagtttgatggaaatcagggcgagaatgtgtatcgatgtgtgccatggccatgtgtgggtgggtgcccgag

SEQ ID NO: 27362 - DNA, 189 bp, Chlorella protothecoides
ctcgtctgaaccaagacgccttgccagcctcgtcagcgctgggagcgagcgaggcggagcgcatcttcgcggttcgggcgcgcccagtacaggacacctgcgcttggtgaggtcatgggccaagcttgccaacgcagacacaaatacttattcagctgttaaaatagctttccagcatccctttgatcg

SEQ ID NO: 27363 - DNA, 97 bp, Chlorella protothecoides
ggcgcttgagcagggttgctggggcgcggttgcaacgcgccatcatgagatgtgacataccctacactgcagatgcccctgtgcttcctggggaatt

SEQ ID NO: 27364 - DNA, 61 bp, Chlorella protothecoides
agggcttgtggcgtgggcgtgccttctggccaggaggtgccaggtttgggagcagcgatat

SEQ ID NO: 27365 - DNA, 79 bp, Chlorella protothecoides
cagcatcaccgcctgcaccgccgtcacccatcgcaggcgagcgggggaaacgcggcggatgcccaggaagcggcgacgc

SEQ ID NO: 27366 - DNA, 66 bp, Chlorella protothecoides
ccttgcggcgcaaccctgatcgtgtgcccccagcccatcatggagcagtggtggggcaggcagagg

SEQ ID NO: 27367 - DNA, 74 bp, Chlorella protothecoides
ttcgccacgccgcctccccacctgcgccccccaaaccttagggaggcggcatcgagaccacggtgctgaccagc

SEQ ID NO: 27368 - DNA, 80 bp, Chlorella protothecoides
tgcttgcaagcgagattgagcgtagcatgcattagataacagcgtggaggtgttatatttttgcattacaagaggcgttg

SEQ ID NO: 27369 - DNA, 63 bp, Chlorella protothecoides
gaggtcctgcaggaccagccacaggtctctggccccacatgcagggttcagagtacccacaac

SEQ ID NO: 27370 - DNA, 61 bp, Chlorella protothecoides
agcttcggcccccatccaatgtcatatggggccccccgaccattctctccagcaacctgct

SEQ ID NO: 27371 - DNA, 66 bp, Chlorella protothecoides
atagatctgtttctgctcgtgcacctgattataaattgtaagggacatcgagccaaaacataaaaa

SEQ ID NO: 27372 - DNA, 68 bp, Chlorella protothecoides
gggcatggccatcggcttctctgaccctcgtgtctccttgcacatttgcgacggtatcaagtttgtcc

SEQ ID NO: 27373 - DNA, 112 bp, Chlorella protothecoides
catcctgggagggggggggggggggggaaggcggcataggggcatgtcaggagagcccgcagaccccaggggatgcgcctcacaatcacgcccggccttggcttggttgtgc

SEQ ID NO: 27374 - DNA, 61 bp, Chlorella protothecoides
gcatccttgggcagcttgtcctcggcggggttgcccaggaagagggccacgctggaccctg

SEQ ID NO: 27375 - DNA, 94 bp, Chlorella protothecoides
gctaatacatgtcattgatgacaaaacgcccaggcgacccactcttcggtaccaactcgagaattattatttccaaagctatctggcatctgag

SEQ ID NO: 27376 - DNA, 289 bp, Chlorella protothecoides
cttcaaggacccccagctcgaggccgacttcaccctcgaccacgcagcgcgacaccgccgggaggatgccatgggctcctttctcgttgcaataatcctctatgtcatgatagtcttgacgaagactgccatggtgaggcagggagcggctcaccgagcaccgtgggtaacggcgtcgacttcatgaagcacgccctaggacagccatgcaggagaccctgcgccctccccccctgcatcactacagacggaccaggagtggtccatgcccatggatgagcttcgaccc

SEQ ID NO: 27377 - DNA, 461 bp, Chlorella protothecoides
  modified_base (132)..(374): a, c, t, g, unknown or other
caagcttgggcaggcgatctggcgcccgaactcagtcatgaagcttcgaaaaggacatccgggtcctcaaagtgaactctgacagaaggatgaccaaacgaaagggggagcgatagccgctccaatacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggctgatcagagtcctttaacactcattacaacaattgggtggaggttgcatgcccgttaaacacttttcgcgcagctccgttta

SEQ ID NO: 27378 - DNA, 98 bp, Chlorella protothecoides
tgtcgcagcaggtgcctggaggggttggggttgggggtgacgcttccgcaccgagcagcgcacgcgagatgtcagtgaccgtgccggtgccacaattc

SEQ ID NO: 27379 - DNA, 61 bp, Chlorella protothecoides
agcaggtccattccattcgacagcctgtgtaccctgcgagcctcccccctccccgcgcaga

SEQ ID NO: 27380 - DNA, 131 bp, Chlorella protothecoides
tgcttcctcacaccagaggcacagcatgtgagggaacccctgagacccgcgccgtgcgcccccacttctcctccccacacgtggccatgccagaccaccggtcccttccccctctcatcttcaagcccacc

SEQ ID NO: 27381 - DNA, 61 bp, Chlorella protothecoides
ctggtggagagggggcccagggtctgaggcccagatccggcccaacctggggctgcagtgg

SEQ ID NO: 27382 - DNA, 241 bp, Chlorella protothecoides
cggggatgggtgtggggattgggagggggggtgagaggtctgtactgctacttgggagcaggcattccgggaagagacgggcaacatgcccttgcgactcaggccccatgctcagtggctgctccttccctggcgcgccgcaccctcacgcccagagcgtgggccccaccaagccgcctgtcaaccgcgccccctccccacaaaaccaaagaacccacacgggccgcatcactcactcgca

SEQ ID NO: 27383 - DNA, 139 bp, Chlorella protothecoides
cctgtgctggtccagggaggggtgtggcattgcccctgtgccgccttcatgcagctccaagtgcaaggtccgttgcaaagccttcatccctgtacctggcaatcatactcccagcagtgttgacagcaaccacaaaact

SEQ ID NO: 27384 - DNA, 78 bp, Chlorella protothecoides
tcccaggcaatcccagtaacatgtcgacaatccggagaactatcctcggcagcacacaccccagtggtacagtcacgg

SEQ ID NO: 27385 - DNA, 61 bp, Chlorella protothecoides
gttcaaggggatgaggagcgggttgccgcagagcgcatccaggccggagtagggcgaccaa

SEQ ID NO: 27386 - DNA, 104 bp, Chlorella protothecoides
gacacactctccagcacatccagcgcccatctggaagttgctcgtgattctataggcgagacccaaattttgaatatttttaatgcatccgcaacaaggccacc

SEQ ID NO: 27387 - DNA, 3913 bp, Chlorella protothecoides
  modified_base (1722)..(1731): a, c, t, g, unknown or other
  modified_base (3286)..(3378): a, c, t, g, unknown or other
cctccttctcccagcccccctccttctctcagcccccctccctcaccaccttcaccacctccacccagcccttcaccttcacctccaccgccaggtgcgtccgccaccgtcgaattcagtgctcccaaagatggtctggtagacatcacatgtgtcatcaccacgccaggtttcactccctacggcttgacatgcatcctttacacatccagccttgcctttcttgttgggggtgagaatcgggcccccgtctttccttctaccaccatttccatggcaggcaaaccagaaacgatagcagcgtcgtattacactggctctgcagtaataatggagactgcgatcactacctggcagtcctactactgactctgctcaaccctgccccaccccctgttggaccagcgccacctccaccactctatggatccattaccggaagcatcacaaagagtggtaacaagttcacattctcagttaactttggagccaacaaaccaaccggcgtgaacttcgccatctttactgctacgaatgccataataagagcgggcacttccccttatagcggcaatccgatgacttggcccatcaacattctcgccagccaagcagctctcgcgtcctacgctcaggtcgtggcgtacacgagtggcagcgggacctcagatgcactgaccctacactggtagtcccattggaccgctaggttacacccttgggcgctgatgctgccctctacattggtcaatgtatgccgtgacaacaagggataagtgtaaacgtcagatcgcatcacacaacaagggggagagtcgtgaaagagccagcaacagagcagaaccagcctgggcgtcccactgtactcgagacaagcatccgagtctgtgccacctgctcccattcggcatgggacagctgtcaaaatcctgggttgctcgtctatgctacaagtccagagcgcacctctttttccattggctgggaacgcatcagacttagggcaaaaaaggtgcacccatggtcactccatgccttgcatgcgacttgcaactgactgctcagagtgtgctgctgagagcccgctgacctgccttgaaggggcaatggccacagacgcccaacagatacacctgcactgcgcactgatcccaagcaagggaccagcgttccgtgctgctaacgaccagcgcagaattgcagcacccgcgccacctgaggggtggcaacagtgtgttccacaatgcgctgcccgctctcctgcagtgctggcgggtggtacggcggcatatccatcagccatgccagcctcttcagggtgccccattgtactgcgcctttctgcccatgctcccgcctctcttgaatcgcggcagccgcttgccggggggcatgcggagaggcacggtagatgctgcagcgtggggcacaactcgcacctgctgcccagatctgcttctctccgccctgcatctcaaggatgtgagttgccgtctgtggtgacatcgtgcactgcaggcccacgacccatgcccaactgatgtgcaccgtgcctccttcctgcttcctcaccatgtccagggcgcaccaatttcaatgaaggcccttgcaacccccgctctcgtccagtctccagctcgtaggcatggccggcacggcaattttgaaagtgcatcgcaggcggcgggccacacccttgcctccagcgtccaccggaccctnnnnnnnnnnacccgtccatcgcccgaggtgagattatttactgagtggaataccccaagatgactttgagcgtcagttagggcaagcgcaacatcctttcacgctcatgtacgggttgacaacctcctggaggcaggaacccgggcgaggcacggctgtatgaaggatgggtaaaaatgtccggctggtacctaaaatgggggatagcatccgtatagagcacgaaccacccaatcagtccttctggagtggcgattctccgcagagcattttgaggttgtcagcaggtccagatcaacagatacacttgcactgcacactgatcccaagcaagggaccagcgttccgtgctgctaacgaccagcgcagaattgcagcccccgcgccgcctgagggatggcaacagtgtagcccacggtatgcggcccgctctcatgcagtgctggcgggtggatcggcggcacatccatccagccatgccagccccttaagggtgccccattgtactgcgcccttctgcccatgctcccgcctctcttgaatcgcggcaggcgcttgcccgggggccatgcggacaggcctggtagatgcggcaccgcgcggcagagctcgcacctgcgcctcagatctgcttctctcagccctgcacctcaaggacgcaaactgccgtcagtggtgacatcgtgcactggaagcacacaacccatgatccactgttgtgcaccgtacctcctcccttcttcctcactgtgtccagggcgtgccgactttgatgaaggccactgcaactcccgctctcgtccgctctccagctcgtagtcatggccggccaggccattttgaaagtgcatcgcaggcagcgggccgcaccctcgcctccagcgcccaccggaccctcagccctgccccacaacctcgccgtactccagggtcacgagccgcgtgcccatgagcagctccagtgtggagttccggcgggagatgcggatccggcggccgcatggcgtgaccagccccagcgactgcggttggctgagcgccacgatgcccgtcagcccggcggcgtcggggcgtgcggcgcaggccctcaccctgaccagggcgccgtggagctcggcgcccaggagccggtcgcgataggcctcgagggtgacgccggggtcgcgcgcagccagcctctccgcatacgcccgccacagcgcgtgcacggggaggaggcccaagtacctgcggcgcaaggtggggattgaggggattggggttggggaggttgggaggttggggggcgctgcgccagaaacaagcatgcacgtgcaatgattccggaggaagcgccagtcatggaccagcgctccaccgtcgctgccaggggcgcacagcatctgctgacagcgctgaatcccccgtccaactcgtccacccccaggcatgcccgtcgtgacaaacacttgtggtgcagcgtggcacccagactcttcgactcacgtgacggtggccagggcggcagcgctcagcgtcccaccctgacgcctggcgcgcttggctgtctgccgagcgcctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactcctgtgcaaagtgcagcaatggcacctccatatacctgtcccacagcctcgggatcctgcaccacccaccctttgacttggccttcatggggttctccagcaggacgctcttgtcttgcattcggagggagtatggcgcactggagcgtgcgccgttccccgacaccaagcctccgaccagcgcctctacagcagcttgtggatcacgtgcgggagggggaacctgcgcaatgagataccaatgttttgagggttgtcgttctaagatggaaggtctctcagacgatggtaacccaggagacgggagtgcagaggctatactccgcccaacaaataatcttcttgtcaaaaaccttgcacacactcatttcacccaccttgaggacctctgcggccagcaagcctcgtggcagggcatcgtacaccgggtgtggtggcgcgacagctgcagctgagaccagagatggcgatgctatgcttttcacttcaattgtgttggtcgatgtcttgggattggacccctcgagctt

SEQ ID NO: 27388 - DNA, 61 bp, Chlorella protothecoides
ccccagccccatgtcgtcggccagcacgccgtgcaggcccgtggcgcgaaggaagcagagc

SEQ ID NO: 27389 - DNA, 1290 bp, Chlorella protothecoides
  modified_base (169)..(238): a, c, t, g, unknown or other
  modified_base (425)..(434): a, c, t, g, unknown or other
  modified_base (760)..(769): a, c, t, g, unknown or other
  modified_base (1047)..(1056): a, c, t, g, unknown or other
cgcggcggtggtcgccgcgctgcccctggccctgggcgagggcggcgccggcggcctgccggtgccgccggggctgagcgacgcgcagcgcgccaccctgctggccgagaagcgattcctggaggcgctgctggcgggcccggcggcgcaaagttgtggcggggggggnnnnnnnnnnnnnnnnnnnnnnnnnnnnnnnnnnnnnnnnnnnnnnnnnnnnnnnnnnnnnnnnnnnnnncctgcgaccgtaccagcgcgagggcgtggcgtggctctgcttccttcgcgccacgggcctgcatggcgtgctggccgacgacatggggctggggaagaccgtgcaggccacggcggtgctggccctggcggcggccgaggagcgcgtggcggcgcatggcgagggcagggcgccccgcccctccctnnnnnnnnnntgctctggcggcggccgaggagggcgtggcggcgcgtggcgagggcagggcgccccgcccctccctcgtcctctgccccgccacccttgtcgcgcactggcccttcgagatccggaaggcgctgggaggggggggggggtcgccggtcgtcggcgcgcaggtgggtggcagcggcgacggccaaggagtgcggagctgcgacggccaggcagcggaacctggcgacgccaaagatccgaccacccccgccgccgccccgggcgtcgagcccctcgcggtgctgcagtacgccggcggcgcagcggagcgcgcggcgctgcgccccnnnnnnnnnnacccctggcggcgagcccctcgcggtgctgcagtacgccggtggcgcagcggagcgcgcggcgctgcgccccgccttcctggaccccgacgtggcccgcccgccggacgtggtggtggcctcgtacgagaccctgcgcgccgacgccgcccacctagccgcccgcgactggctctacgtggtggcggacgaggggcacgcgctgggcaacgccgccgggcgcgtggcgcgtgcggcgtgcgctctgcgcgcgcagcaccgcctggtgctgaccgggannnnnnnnnnacacgcgctgggcaacgccgccgggcgcgtcgcgcgtgcggcgtgcgcgctgtgcgcgcagcaccgcctggtgctgaccgggacgcccgtgcagaacggcgtgcgcgagctctgggcgctcttcgacttcctcatgccggggttcctgggcaccagccgcgccttcaacgccaagtacggcagggcgctgcaggtgcgctgtttttgaggggtgcttggggggggggcgggggg

SEQ ID NO: 27390 - DNA, 61 bp, Chlorella protothecoides
ccttgtcagggtctcagacggtgagaccgcacccgccaacagggactcaaacgccatgacc

SEQ ID NO: 27391 - DNA, 64 bp, Chlorella protothecoides
cccccgcttgcgggcaccgcctttgaccctgttcgtgcccgggccttccatgcaaactttggga

SEQ ID NO: 27392 - DNA, 152 bp, Chlorella protothecoides
ccctgccttctcagctaagcctcttctcgcagtagtccgcagccttgcttaacaattgcagggttgcaccccccgcacccccattgtaccctccccgcgcacctggcccttccgggcgcgcaatgtcgggggccacctcgatccctgtaaca

SEQ ID NO: 27393 - DNA, 81 bp, Chlorella protothecoides
gttctggtttgaatctgagcatcaggtggcatggtgctcctggagaaggacgaagtatgctcaagatctcccccccccccc

SEQ ID NO: 27394 - DNA, 61 bp, Chlorella protothecoides
tttagatacttatccgtactttgtatctggggttttacatttaatttcttctgccgtatta

SEQ ID NO: 27395 - DNA, 277 bp, Chlorella protothecoides
caacatgccctcacaggacgaggcacatgcatggatgtgccagctttggtgcgtgattttggggggctgctggtctggatggtgggaggtgacaagtgaaactgtgtcctgcagctcggggggtcttcctctggtggtggccatttactaggcgtaaaacacaactcagcaaggtcccccttggtactactcgcagcacctacgccaatacacgcatgtcgagccagcagtgccagatgtgcggcacggcccgaacccaaacctgactggccgtgcc

SEQ ID NO: 27396 - DNA, 154 bp, Chlorella protothecoides
tggcagtgctatttctggctcggcagtatccagctgtctgagtctgggaccccgcctagccacccaaattgtgaggacccactcccagacgatggacatcaatcccttgcctgcttaaccacatacaggcccgaaactgacccttccgactgca

SEQ ID NO: 27397 - DNA, 103 bp, Chlorella protothecoides
ctgcgacgcaccagcctcttggtgaccgggatcacatgcatgtgcccctgggtgggccgcgcctccctgaccgaattcacccccccctcgccagccacgcgca

SEQ ID NO: 27398 - DNA, 110 bp, Chlorella protothecoides
gagcatgcgaggggaaggcaagctgctgcaatacaacaagcagcccgcaacaaatccgccgacccggcttcaaagtgttgtttctcctcaacggcacgggctcggcgggc

SEQ ID NO: 27399 - DNA, 61 bp, Chlorella protothecoides
gctggtgagggccggggtgcccatgcgcagaccccccgggaccatggccgacacgtccccc

SEQ ID NO: 27400 - DNA, 264 bp, Chlorella protothecoides
tctgctctgcctggcctggtggtgccccggcgcaacagatccagcgggccggaggcgacctgccatcgtgcactctggtactggtcagggcgcggccgacgggaccgcaaacctcgagcgggggtggccagcgggacagaatgtgcggatcacaggaccgggcagcctgccgggttttcaatcccccctctcaaccccacccctcctcgttcagccctcttccacacacacacacaccaccatgaatcgcagagctggccgagc

SEQ ID NO: 27401 - DNA, 77 bp, Chlorella protothecoides
aaccccgctggtgggaggaacactgatcacagatcattcacctctgctcggcatcactcggacactgaatgaatttg

SEQ ID NO: 27402 - DNA, 62 bp, Chlorella protothecoides
ttgaaggtcaggggacaagtggactggctgtttccaacatggtactagcatcccccaatcaa

SEQ ID NO: 27403 - DNA, 382 bp, Chlorella protothecoides
cggcgcccttccccaccgacgccggcggcgcgacgcagaccgacgccacgctgcgcgtgctgggccacccccacgtcttcgcgctgggcgacgtcgcggtgtgcgccgagggggccggctccccggggtcgggcgggtccgcccccccgcgcctgccggccacggcccaagtggcgctgcagcaggcggactacgtggcttggaacctgtgggcggccgcgacggggcgccccctgctgcccttttcctaccagcaccttggggagatgatgagcctgggcagccgggccggggcggtgaccctgcccctccccatcccacccgcgctggccgacgcggcgcgcggcgccgcgctgggaccgctccttcgcgccgcggggct

SEQ ID NO: 27404 - DNA, 61 bp, Chlorella protothecoides
cagggcaccccaaaaagggtagtctcttccacccccccctccccccaaaagaccgacctgc

SEQ ID NO: 27405 - DNA, 61 bp, Chlorella protothecoides
tacgctccggctgttccgtcagcgtacgcttcggcatcaccagcgtaagctccggcatcca

SEQ ID NO: 27406 - DNA, 123 bp, Chlorella protothecoides
tcatccagggaccctgaggctttgatgtccaagctcttggcaccaacccctttccaaggctcacaccctccccaactcatgcgcccattggggccccactgcaagcgcaggccgcctcatgca

SEQ ID NO: 27407 - DNA, 179 bp, Chlorella protothecoides
agccctgcaggcaagttgttttgttctagggagttgtggtgagcgatgccttacagcgcaccccacccacatagtttacccgtgggagtccttcaaggttgaggtcgctggtccacatggatgcccaatcacccctccccagccgtatccatcatcctgtccctgccacagaggccgca

SEQ ID NO: 27408 - DNA, 1203 bp, Chlorella protothecoides
  modified_base (1002)..(1011): a, c, t, g, unknown or other
ttgctggcggatgcgccgtcggcgccgctgcccccgcccgttccgccgcgcggcgtgccggcctgccaccggtccagcaccaggcgctccagctcgtccagcgcgtccagcagcgcggcggcggcgttggcccgcagcagcagcgcgtcccagggcgtggccagcacgccctccgcctccgcgcgcgacacggggggcacccaagacagcgactccaggcccacacgcccgtcagcggcctccgcctcctgcgccgccgccaccacctcgcgcttgtaccgcgtcagcgccgggcgcggcgggcgcagcgtggccacgctgggcaggctggcgcgcacgccggcggcgtaggccccaagggcgccgtccacgccgtccaccaggcagcgcagcacgcccgtgggcagcggggagatgcccaggtcgaaaaggccctccagcgtgtccgtcgcggccttcaccgcctccgtcgtggacctggtggtggtggtgggggggtggatgagtgggggagtgtgtacatgtgggtgcgtgagcgggtggaccagggcaaagtcacgggtggaggccttcgcaggccggcctgccctgccaaacttgttggcgctcgggtactgcgaggtgctcgtgcctgtcttggcccaagagcatcctctgagctgcgccgtcgttcgcctttgcaatcccctgccccagacccgacgcgcctggccccgcgccccggctgcctcccgtggcgctgccagtcctcggaggccaggatgcgagtgatccagccgcgcagcatgctggcctggccctccacccactggtagagcaggggattgatgcgggcctgcaggtcccagggctcgcctgggtcctcgcgcgcctccttcttgagaaactcctccagcgccacgcccaggcgcagcgcctccagcgtggccttgtccagcacggtcacgcccaccacccagggcaggaaggcggcgccaaaggcgtcctgcagcgcgcgcgcgnnnnnnnnnnctcacgcccaccacccagggcaggaaggcagcgccaaaggcgtcctgcagcgcgcgcgcggccacgccgcgcgcgcgcggctccaccggcagcagcagtggggagtaggcgcgcagctcggtgcgcagcagctcgatggccgaggcggccagcgcggcggcggccgcggcctcgccggcggcgccgcgcgcg

SEQ ID NO: 27409 - DNA, 285 bp, Chlorella protothecoides
atgtctgtcgttgttgtgtgggggaggaagttggggttggggataccggggtgttggagtttgccagggtgttgttgttagaagcaggatgtgggggcacaagcagggaaaggggatctcctcggcccgtgccccaggcagagcacagcaccacgggtgagggatttccggcaccgggccggacccaaaggatcacgcagcccggtgggcatgctgattcgaacccccccgcgggaatgccatacaggcccccattagcccacccatggacttgaagaaggaggc

SEQ ID NO: 27410 - DNA, 412 bp, Chlorella protothecoides
  modified_base (125)..(236): a, c, t, g, unknown or other
cacctcgtcgaggcaatgcacacacaaggacgggaagcgtccccccaagggagcgtcctcagggccagcccctgttacgacgtgtggtacttcaggatcctctggcagcgggatcggcatcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtatctgaaaactgcgggaatacgaattgaaagtatgtgttgcctgccgatcccgtggttgcagtgcccacaaagaacctcacgcgcgatcaccagcgtgcttggtgggaagcccaggtacttcatgctgggtgtgcgatgcaggaggagatgaggctcctccgcaagatcggtg

SEQ ID NO: 27411 - DNA, 360 bp, Chlorella protothecoides
  modified_base (132)..(294): a, c, t, g, unknown or other
cccaccccctcctgttcatgcgcaaagaatttaccatgccattcttccacaacagtgggcggtggtcatgttttgtaaacatcacagcacagcagactaaaggtactcaactgcaggtgacgtgcacgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcaagcgccggttgctagcagcttcttcccgccaacgggataccactggcgcagttggttgcct

SEQ ID NO: 27412 - DNA, 166 bp, Chlorella protothecoides
ctggcaagccatctgtacggtgaggctggggtctggatgcctgtgatcaggttcaccttggatttagagtctgaacagggaaccttcgccgtaacacctgatccaaacgattgtgcttgcctgaagatgcctgctggggggtacacctgtgtcacaaagagcttct

SEQ ID NO: 27413 - DNA, 61 bp, Chlorella protothecoides
agtatgtggccatggaaggtgcggctgggggcgtggggaagctgtcgtgcctgcaggtgcc

SEQ ID NO: 27414 - DNA, 61 bp, Chlorella protothecoides
aaactcatcgatgcagcagatgccgcgatctgagagcaccagggctccgctctccagcacc

SEQ ID NO: 27415 - DNA, 97 bp, Chlorella protothecoides
ggggggggggatgccaaggtgcaaggtgcggtatgcactgggataggacaagcttccatcccaatgtctgcagctcctgcatggccaccccacgggg

SEQ ID NO: 27416 - DNA, 61 bp, Chlorella protothecoides
aggacatcgcactggtggatcgcagggttcaaggtcctttctttccacctgctggcgtgaa

SEQ ID NO: 27417 - DNA, 71 bp, Chlorella protothecoides
gctgcgggtacagggcaaccctgccatggccggtgtgtgtgggagagcacaaacgctggggtctggacaca

SEQ ID NO: 27418 - DNA, 202 bp, Chlorella protothecoides
ggcggcgtccagggggctgaagccaaggccgggggaggggcgggccaggctggccgccgccgcagtcgcagcgccgggcgcggggggggagaagtcgtccgggctctgctggcggactgtggcgtgggaggaggggtggtggtgggggattgggttgtggacatggaaaatgggcttggggcgggtcggaccggagaggcat

SEQ ID NO: 27419 - DNA, 63 bp, Chlorella protothecoides
gattcgcaagacagcctgcatcccccatccaaaccaacctgtccaacctctcctcccaacctg

SEQ ID NO: 27420 - DNA, 61 bp, Chlorella protothecoides
caaggcatcgtgggccggctctaccacaccgccagctcccatcccgccgtccgacagaacc

SEQ ID NO: 27421 - DNA, 69 bp, Chlorella protothecoides
gaaggcgtccccacctcctccaaggaaggcgtccccacttcctccaaggaaggcctcgccacctcctcc

SEQ ID NO: 27422 - DNA, 435 bp, Chlorella protothecoides
  modified_base (89)..(296): a, c, t, g, unknown or other
gggcgctggcatggcaggggcacatcacttcgggcgcctaccaggcggcaggcccggtcaccacggctgcgcaccagtccacccgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagagggagaacgaacagctgccgacgcacagcaccatcacgcagtcccctaccagtctgagatgctgcatcaaatagacctttccaaatcttaatttccatccaatgcgctcatgcaatggtcaccctcgcccacc

SEQ ID NO: 27423 - DNA, 61 bp, Chlorella protothecoides
cctattattgccaaaccccacttcaccaaacgatcacagtccgtgtacggcattcccacac

SEQ ID NO: 27424 - DNA, 74 bp, Chlorella protothecoides
tgaacatgccaacatgacatcctgctcctcaaaggagttccacgccatgtcggggtcaaagcggcggcagaaga

SEQ ID NO: 27425 - DNA, 90 bp, Chlorella protothecoides
tcaagaaattttacaatggtgtgatggtgaggcctcgcgatccgccccagcaccaagttttcatgctgtcgcgtgttggtgtaaagagca

SEQ ID NO: 27426 - DNA, 61 bp, Chlorella protothecoides
cacgcacactcgactgttttggggggggggtgtctgcagaggccgcaggcatggccccagc

SEQ ID NO: 27427 - DNA, 78 bp, Chlorella protothecoides
agggtcacgggagccaccgcttggctcagagtggcgctggtaaccacaccgtctgtcttgatgacgccgttgaagtcc

SEQ ID NO: 27428 - DNA, 92 bp, Chlorella protothecoides
cggcgcaggaggcggcggcgctgcgcgccggcgccgacgagctgcgcggcaccctgaccctgctcctgcagggcctgagtgcgacgccggtg

SEQ ID NO: 27429 - DNA, 66 bp, Chlorella protothecoides
ccccagcacgccggccacgccggcctgccccgtccccagcgccagctgcgtcagcgccaccgcctc

SEQ ID NO: 27430 - DNA, 61 bp, Chlorella protothecoides
gcggtcaaggatacagcatactgcaaagacttccagcccatgcctcgaatttgatcggctg

SEQ ID NO: 27431 - DNA, 70 bp, Chlorella protothecoides
ccggggtgggcacgcccctgcacagtcctggcccctccacccccacccctccttcccccttcccctgagc

SEQ ID NO: 27432 - DNA, 61 bp, Chlorella protothecoides
cgcggcggccgcggcgtcgccgccctcgcgtgtcagcgccagcaggggctgggccaggtcc

SEQ ID NO: 27433 - DNA, 95 bp, Chlorella protothecoides
gaggttggtggggagggagagggtgggattcttttatgggtggggccaaaggggcagaaagcggtcgcctggtgccgggggtctggacattgcac

SEQ ID NO: 27434 - DNA, 18011 bp, Chlorella protothecoides
  modified_base (708)..(717): a, c, t, g, unknown or other
  modified_base (1297)..(1306): a, c, t, g, unknown or other
  modified_base (2311)..(2320): a, c, t, g, unknown or other
  modified_base (2702)..(2711): a, c, t, g, unknown or other
  modified_base (4421)..(4430): a, c, t, g, unknown or other
  modified_base (4534)..(4722): a, c, t, g, unknown or other
  modified_base (4782)..(4791): a, c, t, g, unknown or other
  modified_base (5627)..(5636): a, c, t, g, unknown or other
  modified_base (8012)..(8021): a, c, t, g, unknown or other
  modified_base (8478)..(8487): a, c, t, g, unknown or other
  modified_base (8982)..(8991): a, c, t, g, unknown or other
  modified_base (9325)..(9334): a, c, t, g, unknown or other
  modified_base (11788)..(11797): a, c, t, g, unknown or other
  modified_base (12794)..(12803): a, c, t, g, unknown or other
  modified_base (13390)..(13399): a, c, t, g, unknown or other
  modified_base (13945)..(13954): a, c, t, g, unknown or other
  modified_base (14335)..(14344): a, c, t, g, unknown or other
  modified_base (16252)..(16261): a, c, t, g, unknown or other
  modified_base (16523)..(16532): a, c, t, g, unknown or other
  modified_base (16935)..(16944): a, c, t, g, unknown or other
  modified_base (17753)..(17762): a, c, t, g, unknown or other
cccctcctccaccaatacccctccacccccgccttcaccacctccaccgagtcctcgttctccacctccttcaccaccagcaactaccacaattcaattcggtgaacctgcagatgggtttgtcaacgccacgcatgttcataccactgtgggtacattcccatcgacatcgtatgccccatgtattcagccctgttgactgaactcagatccgtagagaacagcaacccaacatccttcgtctctacctttaaggggataccaatggctatgggaataacccctccagattcctttggctccgcatttctctacacagctcgtcttcttctctacgaagtgatccctctgactctctcaaacccttcaccaccctctcctgcatccttcccaacaccaccaccagcattggggtcccttactgggagcattggccgagctagtaagaagttcacattctcggtgacagctgggatcgtctctccggacataatcgattacgcggttttcaaaacagatggtacctcgatctacatgaattccactccttacagtagcgacccgaccagttgggaggaggagctggagaatgacgctgcagcatgggcatccattgcccaagtattgggtgtgagagggaagcataaatgctctgaccctaaactggtgaaagcctattgctccatggccgacattttatgtttttgnnnnnnnnnnccaccaccagcactggggcccctcactgggagcattggctagccagtaagaagttcacattctcggtgacggctgggatcgtctctccagacaccatcaactacgcgtttttcaaaacagatggtaccccgatctacatgggttccactctttacagtagcgacccgaccagttggaaggaggagctggagaatgacgctgcagcatgggcatcctttgcccaagtatggggtgtgaggtctgaagagggaagcataaatgttctgaccctaaactggtgaaagcctgttgctccatggccgacattttatgtttttgcattgttgtccttgtaatgaccataagagtacatgtcggccaagtaaccccacatgcagcaatggacgtcaagattttccgttcccaggtcgccctccgtgttcaacatccacgtcaacgtggcaccgacatcagcagggtgatcttgcgcatgaaaggtcacaaggcaataagtataccccctagactgtctatctacttcatttgctgaattggagggacatcctctgcgccgtgcaggcgcctgcgagctgctacagannnnnnnnnngtaccccctagactgtctctctagttcatttgctgaatttgagggacatcctctgtgccgtgcaggcgcctgcgagctgctacagaaggtgtctgaccttgtgttcccgggagactggcactcgtcatggcgcccagcacgatcgtcgatgccgaggccgctgtcaagtctaagaaatacgacgaggcactccgaatatacgatgaggcaagcgtgcaccctgccacacacgccaaccctgtgccaagcactggcctgctccacccgggtctgcctctcaagccagcagccccactcacccccacgccctttctgtaacacagctcatcgagggcagccattccaaggatcctatcctcctggcagatcgggccaacgtgcagtacaggctaaagaacattgagaaggccctgggggatgcggcctcggcactggagctggacccccgccaggttctggcgctccacgtgaaagggtgcgagggggaggttgaccccatgctatatattctttacaggtgatgacggtctccagagtttcacaaggtttgcatgccagccatccctccccgcaggcaggccctttttgcggagggtgacttttgcgcggcgctgcaagcctttgagcagctgatggtcctagagcctgccaagagggtgtacaaacagtgggtgggaatgtgccgcgtccgattgggaggtgagcagggggccgagggcgtgaggacgctggcacttgcgcaagatgttggatttatctgtaccaggggcctatgtgcctgtcaaggaggctggcagtgtgccccgaccaggatgtgggtggaaggagtgtaatgtagtgtgctgacctaattcctccaagcgatggctgtgtcaggaaccccatctcacaacacgcgcaagggcatcctgggcccctttcgaagtctttgcccccattccttcctcttccccaccgcaccatgctgcacagaaaaaattgcgcccaccgaggacagcgaggccnnnnnnnnnncccaggatgtgggtggaaggagtgtgatgtggtgtgctgatctaattcctccaagcgatggctgtgtcaggaatcccatctcacaacatgcgcaagagcatcctggccccctttcgaagtctttgccctcattccttcctttctccaccgcaccgtgctgcacagagaaaattgcgcccaccgaggacagcgaggccttctcactggggaaagcaccccaggccgtgcagtcccaccccgtcagctcgccatccaagcccaaggccgccaccattgacgacgccgagtacggcaagtactggcgaaccagcgccacgccggggggcaatggcgggggtggtggagcagggctctcagagccccagcccacctaccgccaccnnnnnnnnnnaaaccagcgccgcgcctgggggcaccggcgggggtggtggagcagggttctcagagccccagcccacctaccgccaccagtggttccagacggccgagaaggtgggcacagggtgtgtcttcttgaaagccgcatgtccgctgtgggagttgcacgactctcgagccgggtcaaagggctacttcgcaatggcgacgtcctagaaccttaatggtgtgtgtctaacactgctaggacattttcttggctacaacattcctggcagtgaaccccatgacatcgccgttatctgtccctgtcgcgcccttactttacactcgcccccaacctccacccccaataaattcatacacaaaggtggaggtcggcgtgcttgccaaggggctcaaggctgagcaggtggaggttgacatcgccgagcgccggctgcgtgtccagatccgggacgtctctggaaagcaggactataacctggatgtgcggctggcgggccaggtggcggcctcccagtcgagctggagcgtgctgggatcgaaggtggaggtggtgctggccaaggccgacgaccagcagtggcccgacctcgcagagaggccagttgccggcggcgggcctggcgtggatgagatggggaccattgccgatgcgtccctggccgcccaggagggtgcggccccagtctatccctatgctgggtaagaagggaagggaggggagaaaggattgccaaggacatgtttcaacagagtccttgttacccagcggatgtgcgagtgtgaacatggtagtgcggacggccttgggcctcatgaccactgagtggctctcttagccttgtctcccaccactgcacaccccgtaagcaggaagaaggtggactgggatgctgtggaagcagccgtgaaggctgaagagaagcaggagcagccggaaggcgatgcggtgggtgttgtgatcggtcggggttggccacccttgtttcggagcgcgactctgtgcagtggtgagaggggggcttctttccagcaacatccgcatcagctcaacccatacctccccatccgcccgcctcccagggggtcatgaagttcttccaggagctctaccagaatggcgacgaagacttccaacgagccatgatgaagtcctacgtcgagtcaggtgattcaagggggaactacgggagctttacattcgacagaggtcgcccctggtgttcatctgcaggtgcttgggggcatcatgaggcgcccggcggggtcccctgggcgccgtttccagcccacgtggcccttctgcttcgcagggggcgtcgagctgtccaccaactggaaggaggtggccaagaaagacttcaaggcctccagggcaaaacgctgaggtttgcgagctcccaagcaatgcttctcagccattgttctctcacctgccctggcccctcccttcttcctggtctgctgcacgggtgcctcaggtgtgctggacaagcaagctcagtcagagtgggagaaggatacgagttctgtggggagggcagtacacatgaattgcagggattgtgtgcagggctccaggatcgttgtcgtagattcaatacttgtgcaccgcaacactgggttgcaggagggtaaatgcgaagaggatgctgcgagcctttgcgggggcaaggtccccttgctccttcgagtgtcctgccgggatgcatctgannnnnnnnnngtcatgaggcgcccggcgagctcccctgtgcgccatttccagcccacatggcccttctgcctcgcagggggcatcgagctgtccaccaactggaaggaggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccagaggcacatcgctccttccagctgcccaggtctgccctctgacccaatcccccnnnnnnnnnncaatgcaaagagcatgctgcgagccttggcgggggcaaggtccccttgccccttcgagtgtcctgccgggatgcatctgatcttgcagaaagaccccagaagggcagcccagcctcgctgccagtcccttgcctactccccttgggcgatggtgttgtgctgcagaagggaagcagggggtattcgatcgagagactcgaatgagggcgccactccccaagagcttcgctctgcaccttcccccgcccagtggcacatcgctccttccaaccgcccaggtctgccctctgacccaatccccccacccctcccatgatcccacattccccctttttcttcgcaccagaaggaccagggtggccacggagaagaggacgcccagggagcagaccaggatgggcagcgtcacctccaccgcccagaagtagaggcgggagtggcgcggcgcgtggtagtgccggggcagggcaaagtagccaatgttggtgacggtgcccgaggccgtctcggggtcaagcgggggctccaggtgctgagcccccggcgcctccaccacgacgtagtcgtcggccgggcgcgccctctcgccctcaccgggcatcgccttggcctcgcccagcgagccgcctgcggggggtggggtgggggagggtgcatgggcgatcgcgcggggtctgagggcttgcacgtgtgctgcgcagcggttgtggagagaggcacagccggcgctgggagctaggtagcgcaggaaggtctcgcatgcgttcgacacaggagattcgaggagccacgcaggggcccccccgtcccagcccgggcttcgttcgcgctgggcnnnnnnnnnnaagccgcctgcggggggtggggggggcatgggcgatcgcgtggggtctgagggcttgcacatgcactgcgcagcgattgtggagagaggcacagccggcgctgggagccagggagcgcaggagggtctcgcatgcgtttcgatacaggtgtttcgaggaggcacgcagggccccccggtcccagcccgggcttcgttcgcgctgggcacgcccgcaatacccccttccctcaaatcaccctatcctcaaaccacctgcgaggggcgatccgtcagcagacttcaggaaggcggcgccgccagcgacactggcggagtcggcttgcaggggccgctggcagtgcccgcggccaaacaccaggaggaggtgggagaggacggggatgaggtaggacaccaggcacacgcccgtggcccccgtggcagtgatgacgttgcccgactgagagggcgcggccagggacacggccagggtgatggagatgacgatggccagattgatgcacttgcgggtgaagggcctcaggttctcgtaccgcccccggctggccatgaccatccagttgttgacggggatgcagcaggcaaagacgatggggggcagggagatggccaggtacatggtcatgaggaagttgagcgtgaactggccgccgccgccgttgcccgggaccagcgtgccgtcgggggccacggtgtagctgccaaaccactggttgtccaggatgttggaggcggtgttatcgtagccatacatggccgcgccgaagaaggcggtgacgatgtaggtcgtggccgccacgccgatcacggtcaccgccgaggcggcattggtgatgcgggagccggtgcggccgggcggcatttcgctcagcagcggcatcatgatggcctggaggtaaaaggcaaagccaaaggtgctgaaggcattggccacgtcggagatggagccctggttcaccaccgcaaacccgccgaacaggccgtccttgagcgcagggagcccgttcttgcaggagtagacgatgatcacaaacatgaggaaccagacgatgatgataccgaagccaccgatggtctccagcttgcgcatggagggcagcagggagaggggagtgatgatgcacagcgtgcagaacaccacgatggccagcccgccgcggtaggtcaggaagccaggggcggttgagggccaggtggacgtcagccccgccgcgccgacctccccgcactggatcatggcggcgatgatggtgcccaggagcaggatgatgatgctgaactcggtgaagaactgtgcacggtggggtggtcatgtggagggtcatgaaggggaaatacgggattctggttatgcagatgggatggatgggacacaattgtccttcaaaccatttcagacgtttcatgaccgagggtgctgtgcgcaatcccgtgaggaggggcatgccgcccggaggggaccgcccgccgtacgaatcccgctccacgtccagagggagatcgtgccggggggagatcgaggccctgctttcggtggccgatatccctaaccgacataccttgaaccatgggccgccgaccgcgtgggcaaagctctcgtagtcccgcgtcccggtatactgggccccccggatgagcagccggcatgtgtagacattggtcgcgccaaccaccagggcgacgatgatacccagcaccgcgccggtcgtggcaaacgcagaagcaacgggaaggattgcactgggggtaggggcggtggggggctggatggagcgtccgtggcctccgggggccgagtcagaaaaacgtcgcgttagccctcgaaccctcgccgagcctccgggccattgacggcagactacgatcggcatgcatccctttggaaactatgagccggcacaaatgcatatcttcctgccgagacctgcatttgccctaccgccgtgcaaccctagctcgggaaccagggcttggtcccaccgaccgaaatgaaccccctcaccttccgatgatgcccagcgtcagcaccagcgtcgccgacatgaggtgcttcatattggccggcgtccagccatgccactcctcccgagtgtcgggggccaagggcgaccctgagcccgacagggcgtcatcgttcgaggacaggaattgcccacccgcggagcctttggggctggacatagtaccctatgaggaggaaaagttcacattcgtcaagtatttgcacccgcaattgcatcgccgaacgtggggagccggaccaaaagctcgccgaaagccctctcagcggaagaatggaagaaatgatcttgtaaaccttttcagaactgggagcctgacgagggattcgtgagtaggtcgtattttacaagannnnnnnnnngacctattcggaactgggagcctgacgaaggattcgtgagtaggtcgtattttacaagaaaaggggcagagggtcacttggacgggcactaggcaagcctcgtgctctccaacgctgtggtgtttcacacagggcggcggctggaagctgacacgcacgggatcaggggctgctggagattggccccggacgggactggctcctctgtaatagggcatgcaggctgcccctggtgggcgaagagtcctcgtcactgtatggcacaccctcgccctccttccgcctgtgatgtggtcatggtgttgttgaagggagctgatgggtcagcaaaggaccggaccgacagtatcattcatgatggtagtgaggaaaagctgatgaggatacaagggagaaatgtgtttgtggcctgtgtgcaggctccctctccccagccagggcacaggattctgggtgnnnnnnnnnntagggagctgatgggtcagcaaaataccggaccgatagtatcattcatgatggtagtgaggaaaagctgacgaggatacaagggagaaacgtgtgtgtggcctgtgtgcaggctcccactccccagccagggcacaggattctgggtgacgaagagcgctgcgaggtccacctaggtcccactcgcatactcacgagctgttcctcccagcccttcctggaaccccctttgccagtcccactcaccggagcttggcatcccgggcgaaaaggcccttcaggtaggagggcggcgactgcaccaggttggcggtgtggttcttcgcctgcttccatgtccgccgccccatgtcggctatgttgtcgccagtgtccgtcaccacatctgtgtgcagtcgaggtgtgcatgacgttggcgggatggttgagggataaagactgcggcaactccgaggagggaagggctcacgacaccaagtatgctaggtagtgtatnnnnnnnnnnaatggttgagggataaagactgcggcaattccgaggggggaagggatcacgacaccaagtatgctaggtagtgtatggctgggcagcatcgcgcaaccaattctttgtgtgcttggtgtcctccagagcagggaagactttgacatgcgaaacatagaaataatccgcacccacaaccccccccccttgcatctcgccagccacaggtagacacccagcttctgctgtgacccagcatgagcacacctgatcgagtggcaacccgcatccccacccctctccccttcatcagaagtcctcgcctccccctcttccgcactatcaaaagccgccnnnnnnnnnntcaattctttgtgtgcttagtgtcctcagagcagggaagacattgccatgcgaaacatagaaataatccgcacccacaacccccccccttgcatctcgccagccacaggcagacacccagcttttgctgtgacccagcatgggcacgcctgatcgagtggcaacccgcattcccaccactctccccttcatcagaagtcctcgcgtccccctcttccgcactatcaaaagccgccgccgcaccttgcacatcatccacgacatcccgcacgtcaaacatgaccttgacgtttttgagaaagcctgggcgttgggagttggggtccatgtagtcctgtgggcagttggagacgcagaagggagttgtcaggggctgagtatggaggtctccgcctcggggtgggcagggtttgggtgccatgactgccgcatggcgtatgtgagagtgtggcagcggcagccactgagtggctggaggacatgcggccggtgcactagctcgccccagctccccttcccctccccatcaacaaagcgctgacctccactcccccctctccaaagcctccccagcccaacctgacccccacattcttcctcctttccccgccattccccgcccccaaagagcgcccaccccccccctccctcaccctgggcgggaaggcgtgggcatgcgcgatggcggcggcaaacatctccaggcagatgaggaagttctgcagcccggcggcgatgtcgtcgtcgtcgtaggtggaccaggaggcgggcttgagcaggtcaaacttggaggccaggttgatgcccaccgactgccagaaggtgaggaagacgacggccttgatgaccaggaacttggccagcgggcggatgggggccagctcctggcgcgtggcgcggtacatgaggatgaggcagtacagcgcccaggtctgggacagcgagccgaccgtggccagccaggggtaggcgcggtcgtgccggaactcgccgtcgccatagacgcccgccaggttggtcaccacccccaccgcggtggtgagcgggcgggtgatgacgtaggccagcacgccgcgcttggtttcccagaagaagtcggcgccgggggcccaggggcggagcaggcggtccatgggcgcggggtggggcacggggggacgcgtcgcgtagtaggcgtccacgtcgccatactcctcctccaggtaggccatgaggtagcagtagaagttgtagatgacaaaggcctcgtagcactcgcgcagcgggtcaatgtaggtgcgcgcgtcggagaagcgcaggctcagccacgcgtccacggcgtagatgggcaccatccacaggatgcgcaccacccggatctggagcgcggggcggttgtagtgctccaggtgcatggcaacctcgtaaatggaggcggagacggccaggatcacaaaaacgcccgcgatgaaccaggctggggtgtgtgtgggagggggtggtgattttttgttgttttggggggaaggaggggggaaagggggggcaatgggggagggggataaaactcatggggagcagggcggtggagcagcaggccctgtggccggctgggcaaagggcacaggcatggcgcctgaggaatcacatcccttcaactcaggggtctttgatgctcctcgcgagcgcggcaggtgtgacggagcctggacaccggggcatgctcctgctccccaagccccactccagtgttagctttgcaaggagtagcaccccaccaggcatcgccactttgctgctaggtgctcaccctggtagtggacggagaagtgctgcttgcgcagctccacgatcatccatggcagggcggagaaggtgcacagggtcagcaggatccagagctgcaggacggaaggtggtggggaaggtggtccaagggacatgcccattccgtgcaagaccatagccccagattacgtaggttcagccctgtgacaggacaaactcaccccccggaacacgcggcgcatcgggaactgggccatgaccggtccccgcgcctcccgtgcttcgcacaggtgtgtgggcctcgcactagccttccagtccgagtgacgagcaagccagccatgaacggaaagaattcattggtgccgaagagtccggcgaccgacgactggctgccgaatgtcgggactaggcgtttcgtagcagtagaattcgcgcgcgcctgccccgaggtggtcgctggggagctccctgcggtcacatccgcgatttcagggcagcatggatggacggacatgggctcctgccgactcgtctacacataagagatcgccttgatccattcacgaatctaggaaccaacatgcagggcacgatgcattgtgctttgggcgggcgccatgcccatgccgcgaataatccacgctccatgctgagacaggggcgactcacatgtgctcaggcgcgnnnnnnnnnnactttgggcgggcgccatgcccatgccgcaccgaataatccacgctccatgctgaaacaggggcgactcacatgtgctcaggcgcgtcaggggggagagatccgggctttgcaattgatattgtgcctttctcgccacgattccgagctcattggccctgcccatgcaggccaggtccgatgggcgtcggcatgactcgcaagtgtcctctgctcatggcgatgcccccactgcattccccgtgggcatagcgcgggcggcgctggccatgtctgcctctgtattactcgcattcgggcacactcagcccgcccacgccgtgtcggggggaggaggtgagccatgggatgggggagacgtggctgacatgattcgggggtgttagaatcgcctggacggctgaaggtgtgggtgcagcgtcgatgttgggatgcacggtccgggtctctacactacaaggcatctatgccaacaatatgatcacctgccaacgatctgaagttggcggtgccgtgaagctcaagcatgcaactgagtatgcatggctttgctatgacattgctcctgcctgctggcaatgcttgctggcgtatccgctgacttctccaagatccaagcgctctcctccctcttaattgcacaggcatgggttcctccctggcatacaaggacatgtctggccaggaccttcgcaaggccaagtacaacaaggccgacctgaggggggccgacttctccgggtccaaccttgcgggggtgcccatgtttggcgccatctgcgtcgatgccaaatttgtgggcaccgacctcagcgccgccgatctggaaagcgctgacctggagggggcagaccttaccaatgccgtgctgcagggcaccctggtgaggtcgctggtgccagggttggttgcatagtaaattgcctggcatgctcgttgcccgaggaccagggctgcattgccccaccgcctgcgccctcttgctacttttcacagtnnnnnnnnnngtagtaaattgcctggcatgctccttgcccgaggacagggctgcagtgccccatcgcctgcgccctcttgctacttttcacagtcagtaagccccttttacttcctccccgtcatcccagttgacaaatgctcagtggaagcgggttgccagcatcgagggcgccgacttcacggatgccctcattaggaaggacgtcgaggcctcgctgtgcaggctggccaagggcaccaaccccaccacaggcactgacacgcgtgagagcctgcactgtcgatagggcggcaaaaagccaagtgtgcgagcctggggtgttgcttggggcatgtcatgacaccggcgtttcagcttttgaagagtgtgtgtagaacggcaagacacaaagaatacaagcggagaggtgtgggtatgggtgcttgacacgtcttgagctcaggaacaccaaggtccgtgtgtcggtgacctggatgcaactctgattccgggaatgggtggtgcgggaccagactcagagtatgggggcgatggtgcctgcgtcgtccttagaatgggtgtccgctgcagcccaccttcttgtgtggaattggnnnnnnnnnnaaacaccaaggtccgtgtgtcgatgacctggatgcaagttgattccgggaatggatggtgcgggaccagactcagagtatggggccggtagtgcctgcgtcgtccttagaatgggtgtctgctgcagcccaccttcttgtgtggaattgggcgcactgggtgcctcgtcctgttctcaaacctcgcctgcggcgggccctgcttccaagcgatctgccgccaggaggggctcctcgccctgggcctgggtgagactcctgcgctgctcaaacctggcagccgctttgtctgcggcctccgacagattgatcgtgctggcgattccaagcatgacgcagccctggcgggggaattgggtgtgtgtatggtggaggtgtagattggattcatgtgtaaaccatggaactttcaatgctgggggtcaggggtgtgaccctattgcccccaacactccagcaaccaaggtcatctttggctgttccaatgtggtcgaggatccttccccactatctgttactgcactctccatcgtcagtgccgccgccnnnnnnnnnnatgcccccaacactccagcaatcaaggtcatctttggctgttccagtgtggtcgaggatccttccccactttctgtcactgcactctccatcgtcagtgccgccgccgcacctgcaggaggttgacgatgaccagtccccaccacagccccctcagccccaggttgcgcttgatgcccaggaaggctgccattgggatgccgatgcccctgttggttgattgggtaggagctcgatgttggaggggaagtaaccttgaagaggtttgacatggcagcaccctcagaatggctacccttgattgtgatttactcctagggaaagccacctcagccaccaggatttcacccgctgccacccacacccacgaccgcgctccagnnnnnnnnnnagctacccttgattgtgatttactcccaggaaaacccacctcagccaccagtatttaacccactgccacccacacccacgaccgcgctccagcccaccagtagctgcagatgttggccacggccccgatctcctgccttcctgccccgcgcaacaagccctggagcgtggcattggtcccgtcccccggcagcgtggcaacgaccagcaggagcaggtccacggtggcggccaccacggcgggcacgtcagtgaacacgcgcgcccagcgctcgcggttgagcgcgatggcggccgcgatggcgcactcagcggccagggtgcaggtcagcgcggcgccgacggcacgccgcgcggcggcgggcttccccgcgcccaggctgttgctcacgcggctggacagggccatgcccacgccggagatgagcatgaactgcgcgccggatgtgtccacagcgatgcccatggcggagagggaggtgggggggtcggggaggaggccggacagcaggatgacggcctcgaaggtccaccactcgcagcagatcatgaggacggagggcagcgcgtagcgcacatactcgccccagccgcccagcgcctcgcgcgacaggcccgcccaggtggcgcgccgggtgccggccaggcgccggtcgcgcgcgacgacggcgcccgccagcgtggccaccatgacaaggcccaccgcgtccatggccagcgcggcgccgagcaggcgcatgtcgcagcggtagatgaagagccagttgaaggcgggggcagcgaccacgcccaccagcgtggcggcggtgaccggcgcggccacgccctgggccatcaggtaacgcttcaggttctcaaacacgccctggcaccacagcgcgcccagggaggtgagcaggtagtagcgcgcggagcgggagatgtcggggtcctggcccagcaagatcagcgcgcggtcggcgccggtccacagcacgcccaacgcggcggtgagcagcgtggtgagcaggagggcgcgctggagcaccaccccgacgtgggagtagtgccccgcgccgtaggcctgccccgtcagcgtctccatggccgaggcgaagccggtgagcaccgacaggccggagacgttgaatatggaggtgctggtcaccaccacgctcagctcaaaggcgccaagccggccgacgaagccgatcgccaccaggctgatcactaggcccatcaggttgctcagcgacaggggcaccgccagggaggcgatgctgtgcgtgtttgggttggagaggaggggggggtgatttgttgggcaagggtgtagagtagcgcggggtcgggggttttgaagctaggctagtgagcggcctggggaagaggagactcaggggggttgcagggcgggtggagccccacgccctcctcaacacaatgccgcaagctgtggagttttcccacctcccgggccctttcccgacaggggattgaaattcacaacataacacacagttttatccccctttcaatgcccaccttgcgagctcggcgcggtatgccggccagccgaccaggcccggggcggggtcggccgtgtcggcgacgggggtgtcggcaaagggggaggggttgttcccgatggcccggggtgacatcagggtcgccccaaccaccgcgccgcttgggtagacgtccgcggcagcctcctcgaaggcatcgcgccagccggggtgagcggggactagggcttcggggggcatcgctgccggcgagggttggcgagctggccgaacaccgacccttagaggcgtcgccgcggctcagatgggtggcaccggtttttaagcacaggaataatggatagagtttgaggtccggttcctgcaaacctttgcaggccacccgacccacagtctggctnnnnnnnnnngtcaagcacaggaataatggatagagttcgaggtccggttgctgcaaacgtttgcaggccacccgacccacagtctggctggcagtgcagctgggagaatccaatcgtggctgcgagggcgcgccgcgcccatacctctcgacatggcgcaaccatgcatgcatacacttgaacgaacgcgaggtatgttgccgctgtgatttgctcacagtgaacatatgtgtttccttaaatagtctccgctgagaggggcccaccggcnnnnnnnnnntatatgttgccgccacgatttgctcacagtgaacatatgtgattccttgaatagtctccgctgagaggggcccaccggctgccgcaggccaggacaccaagacacacacaaggacgtcagcagtgttgtcattgatcaggcgcttctcctgagttgtctggcaccagttactccagaaaacatatactgctatggccaaaacagcggctcgcacccccagaaagagggcggctgcgtccgcagcaaccgaggtgatggaggcacagctcggtggacttgccgatgccctcgccgcaaagctcgcggcgtccgcacctcccggcaccgaatggacggtgaggttagaaatgtggtgctgtgcagtgctggggtttttgtttaggttgtgttgctcgtactgctnnnnnnnnnntgaatggacggtgaggttaaaaatgtggtgctgtgcagtactgggggttttgtttaggttgtgttgctcgtactgctgccaatgctgacaccgaccacactgagagtcgctccaacacataccagctggaccaagtgcggacggcgcttgccactgcgctgcaagggctcccagacagtgctcagcgcgctgatctggaggccaacttggagacgggcgccgcacgcatgcacgcccagctctccacggccctaggcgccaagcggccccggtcagccggtcaggacggtgcgaggggctttcgcaaaggatcaggggtcattgctgcaagggctgcactccttttgtttgacaacagccagcaggtcctgcgggggcacaatcttctgttgagttgtcaatgatagagcccaggctgtggccccaggtgtcatcgttctactctgtgcctccggctgcatggcatgctcccaaaccctcaccatacaccaaatgaccatcttatataccccgtcccttcctaccacttgcaggagaagctgatgaggagccagcgcccgcttccctcgccacgccggccgggtaccaggcagcggtggcggcggcctgcgccgagggctctgccgtgccgctcgacgcgctgtgtgcgctgtgccacgcccaagccccctgcccaccggagctgctggccgccgcgtgcgcgcggctggactccggcgccgccctgcagctctgctccggcgtggcatcgggggcagggagccctggcgaggcggccgccgccttcctccccgtggcgcgtcgcgccnnnnnnnnnntgggggcagggagcccgggcgaggcagcagccgccttcctccccgtggcgcgtcgcgccgtggagctcgcgggggaggagggtgcgcgcctggcgggcgccgcgatggccgcgctggggccctgcctcgctcggcagcgcctggctccgagcggccggggaagtgggaccccggccggcgtggtggaggccgctggcgccgaggcgcgcgccggcgaggcatgcgcggcgctggtcctcgcgcgcctcg

SEQ ID NO: 27435 - DNA, 61 bp, Chlorella protothecoides
ccggaaagaccacgctcatggtgaggctggggtgcctttggtggacagggggcttgggggg

SEQ ID NO: 27436 - DNA, 61 bp, Chlorella protothecoides
gagtgccctaaacggcatgcggagtgggagtgcggtgctccagcaccccggactgcgaatc

SEQ ID NO: 27437 - DNA, 61 bp, Chlorella protothecoides
ggctccatttgtctaggactaaagttctccaccccgccaagccctacacttgacacttgag

SEQ ID NO: 27438 - DNA, 400 bp, Chlorella protothecoides
ctcctgaggactcccccagcccctcccccgcggattcccccagcgcttatcctgagaccagtcccaccccgctccctgcgctctctccaagagttactccaccgcgcagtccctcctttgacagctcaggacaaacacttaatgtcaatcatggtgtcgaggaggactccagtaattctctcccgacacagacatcgacatccttgcctaaccccagcccattgcccagccctgtcccagtccccagccccagctcgcctcccggcctcagcccctcactcagccccagcccctcgcccgaggacagccccagcccctcgcccgaggacagccccagcccttctcccgaggattcccccagcccctcccccgaggattcccccagcccctcgcccgagga

SEQ ID NO: 27439 - DNA, 67 bp, Chlorella protothecoides
ggtctgctgcagctgcgcggcgcgctcggggccgacggtgatgccgggggtcgccggctggtgggag

SEQ ID NO: 27440 - DNA, 70 bp, Chlorella protothecoides
cgagtccaagccctagtcccagtctcagtccgtctcccagtcctagtcccagtcccagtcccagtcccag

SEQ ID NO: 27441 - DNA, 102 bp, Chlorella protothecoides
gaattcagacgacattcacgtcgacccaaaatcttgttaaccgttccggtactgcgcgcacacgcggtacggccgagaggaaagggcgctgaaccctaatat

SEQ ID NO: 27442 - DNA, 151 bp, Chlorella protothecoides
tgctgcagtgcagcatgaagtctcggccccgcggggcccacgatgctctgatacctcatccggcaccctgccagccagcaagccctaccctcctgcccctctcggacccatcagcggtcgtcgcaagagtatccttgtcagcttacagcaa

SEQ ID NO: 27443 - DNA, 7159 bp, Chlorella protothecoides
  modified_base (278)..(287): a, c, t, g, unknown or other
  modified_base (1219)..(1228): a, c, t, g, unknown or other
  modified_base (2821)..(2830): a, c, t, g, unknown or other
  modified_base (3232)..(3241): a, c, t, g, unknown or other
  modified_base (5479)..(5488): a, c, t, g, unknown or other
  modified_base (6148)..(6157): a, c, t, g, unknown or other
  modified_base (6300)..(6361): a, c, t, g, unknown or other
ccggctccggcggcgcgccgccggagccggggccgagggcgatcctgacgcgggtgagcgcggacgccggcacgccgccgcggtcggtgctgcgccgcatcggcagcgacccgggcttgctcaggcgccagcgtggcggggccgagggcaccgagggcaggctcgactcctaccccctgcgccttatctcctcgggtgagcggggtggtggtggggaaatggtgatgtgggggtctggggcctgatcagagggaatcaggaatgccacgtgccagagnnnnnnnnnncatctcctcgggtgagcggggggggagtgatgtgtgggtctggggcctgattagagggaatcaggaatgccacgtgccagagcctgcagcatcagaatgcggtgcggctcccaggatgcttgtgccggctcacctcccctcatcgaccgattcgaacattctgccgcctgcacgccccgcgcagtgtcctgggcggaggagctagagcatgtgcgggaggtgatgggcctgccggcgagcgaggcgggggagaccgcaggcgcgcagcaagccgggcagcggcaggtcacctccttcctcctcctcacactggtggcctccttcctgcagcgagtgctggcgcctgcctgagggggagcctgcgtgccccttgctgtgcccgagtgtgatgagagaagagctgacgatcgataatggacgcgattaaggggtggcttgcatgctgatacaggaacgcggcagggtggaaagcgggggacgactcgacactgttttcaactcgctggccatggggcagtcgagatcacttcctctgtccctcgacggtgtgcgggggattacgctccggcctcccagtcagcctttcccactcaccaaaccctcgcacacaatggcggatcaagagggcggcggcacggccaagtccggctggtctctgggcggcctgctcaactatgccacccagactgtcaacaggtgtgtgtgcgggttgctcctcggtccacaaaggctgccgcttgtgtcatgccgattctagcttgttcgtctgggtgacgaggaggctgcttgcccctgcggaggtgtctgagccccctgagagtccgctacctctgacctcccggcccacaagcgctctcgccatcttccccttctgtacagcgtcatgggctacgacgagctctctgtggttgatcccaacagccagtcggccnnnnnnnnnnaccccttctgcacagcgtgatgggctacgacgagctttctgtggttgatcccaacagccagtcggccggctctggcaaggacgtgcatgccaccaccaaactggaggaggtaggatgaaggcggtcaagagcagggttgggggattggggctatttgcgttggcaggggcatggcctgcagagatctatccaggccggtgtgagtgaggtgtatgctcacgatctgcggcatgcccatgaccccactgcgacgcatcccctgtccgggagtgcatgccagcaagcactcccctcgcaggaggggcgctctgactgcaccagccccttcagcctccaccctgcgctgcaccgcctcacaggaccgcaagcaagcctttaagtcgtacaaggactacctggggaaggacatcaccagcctggtcatcctgccggtctggatcatgcagcccttcaccatgctccagaacatggccgagatcatggagtacaccgaggcccttgacaaggcagccgtcaccgaggacccctacgagaggtgtgcctgggtgtgcagggaagatatgcctcatcctagactttgcaagcgtgacgttgcaccaacgtacgatacgccagcactgtaacccccaacccccatccccaaaaggctggcctgggtggtgggctacaccatgggtcccttcggagccatcgagcgcccctggaagcccttcaaccccatcctgggcgagacctttgagtaccacaagcccagcaccgggatcaagtaccttgtggagcaggtgtgtaggaggctctggtcagagtgggagtcggggggttcccagcaccccagcatgccagcggccccagcgccctttgcgtgcatcgctgacctatcagcgccctcatgttcaaacacatacccagtttctctcgacgaatctcacccctgctcgcctgccgccaggtgtcgcaccatccccccatcggtgctggccacgcggagtcccccctctggacctacgacctggtctccgcccccaagaccaagttcctgggcaactcggtggaggtctaccccatcggccgcacccgcatccggctgaagaccaccgacgaggtcttctcgttggtgccccccacctccaaggccaacaatgtcatcctggggtccacctgggtcgacacctacggcgactacaagctgctcaacgtgaccaccggcgccagggcgcacatggtctacaaggagtgcggctggtttgggtcggggcgatacgaggcgagtgcagtggatggctggggacgggtactggttgtctagtggatcctggggctcagcctgtgctactttgatacaaggggtaggagagaacaatggagccacaagcagatgtctgcacaggtccctggggttcgccacgcctgcgtggacagggtgggctctgatgattgcactcgccggccagcgagtcggaagccacagtcaaatttgtgctgtccgtctcaggatcccagcaccgtgctgtctcccacacacataatgtcaccccctacccaattggcctaaccccccatgacacagatcgacggctacatttaccgagaggnnnnnnnnnncagtgtcaccccctacccaactggcccaaccccccacggcacagatcgacggctacatttaccgagaggacggcaccaaagcctacatcctggaggggaagtggaacgagtacctggatgcggcccgctgcgacgaggcgggggagatgctgcccgacgctgagatccttcacctctggaaggtggggcccaaaggggtgtgggaaggcagattgtgcgtgctttggaagcccgctgcttggcagtcgggtggcgagaagcgatggcggggcgagacctcggtaccagccgctcccacggccttgggggcgcaggccattcaaatctgcagcgaggccaccccgccgctcttcgacccccaaatcacactccccccctcccctgggtcctgccaatctccannnnnnnnnntcgaaacctcggtaccagccggtcccacggccttgggggcgcaggccgttcaaatctgcaacgaggccaccccgccgctcctcaacccccaaatcacacttcccccctcccctgggtcctgccaatctccagtgcaaggacaagcccgagaacgacccctacgccttcactcactttgcacatgagctgaattcggccaacggcctgtcccccttgccctcggattcccgcagacggtgggtgatggggttgctttttgtggacaggcgtggttcagggccatggggaagggccgtcgtggtggcgtcggtctagaccgttggtgcttgcacagacttgtgcatgtgtccgcatcgctccacccactcaacgtgcttcctttggcagcctgccgtgtcctctacgagccactcgagtctgctgtgtgccacatgccacgccacccccgccttccctgtgcccattccaatgcctgccaaggctgacccctttttacacccccgtttgattgccacaccaccatcacctcccatcccccgcctcgcagtcccgaccgcgcgctgctggaggcggggcagtcctcggaggcagcggtggccaagtacaacctggaggagatgcagaggaaggagcggcgcgagcgcgaggagcgcggcgaggtctgggcgccgcgctggttccggccgctggggccggacgccgaggtgctgcaggatgagtacgacaacgagcagtgcgcgcagtacgagttcacgggggaccttgccgcgctggaggggcccaggacgccggaggaggtgccggaaggtgggcccgggtggtggggttgagtcggggagggggtggggcagcaggctcctaggggagggtgggggcctggaccatgtggcaccatggggtatggggggtgggcacgccgcttcgacacctcatcgtgcacctttcttcccctccaaacccgcccagcccatgcccccttccgacgcacacacacagactctgtctgcggcaaggggttcgtgccctggacctaccccgagatccacgacaacctgggcaaggaggcggagcggcagtgatgctggatggcagggtgtgccaggcccattctcggtccaccccttgggtccattcttggccctcccctccagtcaccccctgtggcttggcgcaccttgcaaaatctgtaacattgtatgcatccaacatgggcatggctgaggaggtagcaagggcttcaaggggggcacgtctcatatacatgtggggaacagtttggtacaggctggatgatgtctcaaccggggtccctgaatgactatggacagaagataatggatccttcctggcctgaaactcctgggttgttattgctggctctctctctcaggaacatgtgctcgcagggcatccagattctcccagtggcccaggtggtcgtcccatgctatgttgtgcttcccctccgacatggggtgcaatgccatggccctcaggaatgcggcatccgcaagggccgccaatcgccgagcttcggatcgattggggattagaccggggtgggtgcgggccagggagggattcttgggaacctgggggccctggctcaggttcgcggtgggtcgcgctctgcagttaagtctggcctggatcgtcatgctgtctcactcactcttcgtctctcaagaaggggggaggcctgagtatttcaaggcatcaactttaatggcgcacaacactgttcaaatcagccgggcgtgcgtgtaatgacgcctggcgcgtgtgacagtgatccgaaagtgtcggagatcagacgctcacgtgggttccgccatcccaccagcttcactttgaaaacttctgagccctcgcggtctgcctctccctcttctctcgtcgccgcttatctgcctcggactcgaacgatgtctgcagggtgggaggatggtatggagtggattgtggcctggtgttgcatgcacctcattgctagtcccagcatgtatggacccctcaccgtgtcggcacgaggtgcgctccagtaaggcagcagcacgtggatcacaagcaggtacgcacagtacgcaggcacctgtcgatcagagggacggagatgggggagaatcgtcatggcagatgcagagagagtacgcagactgcatctcatgagcagccgagcacttccaacgtctataaatgcaaagatagtacatcatcttaccgcaataaaggccagcnnnnnnnnnngctgcacctcatgagcagccaagcacttccaacgtctataaaggcaaggatcgtacatcatcttaccgcaataaaggccagccatgcccacttgctgattgtgcttccaagctgcacaaaggctgtgatgtagagcaggtcatgatagtaggagagcactcccccctgtgccaggtcagctccggcatacaccagttcgccacttgggctgtagtggggtgctgcgagtgcgggggagtagtccgacttgcggcatggtctcgtcagcttaccatataatacgaacagaggttctcagtacacctggtccagccgctgaacggcattccaaccacaagtgcctcacccaaggcagtcgcgattccagggtaacaaatggcatagaccagggaggtgaggcccagggctgcgtaactggtccaggtgacggtgctcctgcgaaggaggaagcgcaccaccagccatgccacctgcagcgacaggtggtcagaccagaggtatggaatcctccaaggaccacgaggggggatcacacctcttttagaatggcatgatggcatcgtcttacgtttgcaacaatgacgatgatcttgagtttgcgtaagtgatcggcattctgctctaagcgtttcttgtccccggccttggccatcgcccgtnnnnnnnnnncacaatgacaatgatcttgagtttgcgtatgtgatcggcattctgctccaagcgcttcttgtccccggccttggccatcgcccgtgagcaggtggatctccctggatgtgatacgttcgatgcacttgggagctgtcttttannnnnnnnnnnnnnnnnnnnnnnnnnnnnnnnnnnnnnnnnnnnnnnnnnnnnnnnnnnnnntcgcaacagggtcgcgcccgggcgcccgcgcgcagcatacaggagaggagcagcgatccaagcatacacctgcacgagtgaacactagactgcgagcctgtgtgaatgcacttcctgtgtatatttcgtcctttattgaagccatggcggtgtgccggcgggcatcgcagggtctcctgcgacaccacctgtgagtgcgggcctgcagggtgtcagcggcacgaccagcccctcacgacgacctggtcggggcaaggatccgtactggattcaatagttgtgcacagtgttgctcttgtactgccccacactgcccccctccccccctactcaccaccacagcaagacggccctggactgctggcaggcataccgggccaacccccccttcctgacccgcgccacctccagcctgcccggcaccccccacctgacccctgccatccagggccggctggacgagatcgcggcccggcacgccgcgttggtgcgcgattctctggcgccctccttttcgcggctgccgccccaggagatggcgcgcctggcccgcgacatcgcggagctggagcccgtggtggaggccgcggcgcgtctggcgcgccgccgcgcggagctggaggaggtggccgccatggcccgcgacccgggtgaggaggaggacctgcgcgccgcggccgcggccgagcgcgacgagctggcggccgcgctgcccgcgctggagtcggcggtgctcctgtccctggtcccgcccgacgccgccgacgggcgcggcgtggtgctggaggtccgcgccgg

SEQ ID NO: 27444 - DNA, 105 bp, Chlorella protothecoides
gatgccaaaaagcagaagctcgaaggtggagcacgggacgcagcctattcgggtttgggaactcgagacacgttcgtcctcgcgatcaggtgtgattccgtcgcc

SEQ ID NO: 27445 - DNA, 111 bp, Chlorella protothecoides
ctgaggggcctcggggggctccccaaactcgtggtggtttgctcaacattgacaaggctttgtcaaaccaaaccctgaaacccaatcgctgcacagctggagaatacggga

SEQ ID NO: 27446 - DNA, 76 bp, Chlorella protothecoides
cctggccgctcgcctggcgcggtacccggcgccggtggcagggggcgaaggggacgcgaccccggaccgcgaccca

SEQ ID NO: 27447 - DNA, 102 bp, Chlorella protothecoides
ctcgccctgcagcgctgtgcttgccggagcgcctggaagcagaggctggtattttcccctggggattcaatcatcccgcagatgtggtcatcgtgaccaccc

SEQ ID NO: 27448 - DNA, 700 bp, Chlorella protothecoides
gtcggtgtgcgggggtgggtgggtggggcgtttccggtcctctgtgtgtgtttgtggtgttggggggagatgggcccatcttcttcagtccacgacagtgcaaggtcgctgtcacggatggtgtgcgtggttttgggcagccatgctgaggatctgggagaaggcgggggggaggcccgcggcccggctggcgcgcgccgacatgcctgcctgccgatcatacgacccctccccccgcacgcacacgcctccaccccacaggccgcatcgagctggacctgcggggctccgcggggcagtcctttgcctgcttcatcacccgcggcgtgcacgtgacgctgacgggcgaggccaacgactacgtgtgcaagggcatggccgggggcgaggtggccatccggccgcccgaggagtcgcgcttccccgcgcgggaggcgagcatcgtggggaacacctgcctgtacggcgccacgggcggcgcactcttcgtcaacggccgcgcgggcgagcgcttcgcggtgcgcaactcgcgcgccgccgccgtggtggagggcgtgggcgaccacgcctgcgagtacatgacggggggggtggtggtggtgctgggcaagtcgggacgcaacgtcgcggcgggcatgaccggcggcctgggctacttctacgaccccgagggtgagaggctgatgtggggcaggggggg

SEQ ID NO: 27449 - DNA, 161 bp, Chlorella protothecoides
cagaggctctggcttctctcaacctcgtcaggtcgattggttcagtgcgtggatgctcagatgattcttggaaggaggacaaggggagtatgaccatcagtgaatggaaaacctcaactatttccgatgcgagatggttgccctcatccacggactgcaat

SEQ ID NO: 27450 - DNA, 76 bp, Chlorella protothecoides
tggtgggggagatgtgattggacggtggggcgggtgagaagggtggggcttcagccaggaggtgaagtgaagggcg

SEQ ID NO: 27451 - DNA, 758 bp, Chlorella protothecoides
gtgcctggccgccagagggcctggaatgtggaattgggcagaaaagcacctgaaaggaggctgtactctgcacccaagaggcatccgacgcaatgcactatattcccagaaactagaacaaaaacaaaaaggtctggtgccagtgatgatgtacaactctctccacagcaggcgcagcatgcaaaagtacctctccatgcagattccatctccgattcgacgtcaagggtgacgaccaaggcgtcgatttattcatttgggacgtttccgggggggaaccctggcccacgcattacgtgattgcacggttcgaaaagagggccagggtggaccacatcttatccaaatgccggagtctaacaagctgcgcccctccaattgccatggcctttttcaggcacctgcaggggggcccaagcttccataataccaccagacatgcacaaaaggtggtactatcacccaaaaaagagagaaggagtgaaatgtgaaaggagcatgaactaggggcaaaagaatgcgaaatcattttcccgcccaacgagggaagagaagcccaatacccatttggcgacggatcttgggaatcaggggtattgggtgtccaagaggctacctgagggcatatcttgagctacaggggtcagaacggcacagcacttggcacaggagtgtgctgatgtataatgtatagaataactaaattatagggtggcccctgcagacggacaatgtgcaggggcggcgggaaggcccaa

SEQ ID NO: 27452 - DNA, 80 bp, Chlorella protothecoides
ttgagcccatcgagctcttgcccatttatataatagcattggagtactggagtacttttgaggaaggtatatcctgccct

SEQ ID NO: 27453 - DNA, 3888 bp, Chlorella protothecoides
  modified_base (651)..(660): a, c, t, g, unknown or other
  modified_base (2045)..(2054): a, c, t, g, unknown or other
  modified_base (2703)..(2818): a, c, t, g, unknown or other
  modified_base (3452)..(3461): a, c, t, g, unknown or other
  modified_base (3684)..(3693): a, c, t, g, unknown or other
catatcttcgcatgtgttgcatatgttgctacagagtgtggatcatcccttggatggttgatttcgaggagatcacagctccccacccctttgacaccatggggagcggaggaaacgccgacattgactcgaactgaggaaagttgagagcagcaccgaccttgccacgaacaatgcccccgagtgcctcgggaggtcctggatgtacatccataacctcaaattttgatcagaggtacccttcaggagcccgccctgcgatgctggcggggtgcgacttccctctcgtgcgcgacagattttggagtacgggcgaggacaccgcccccggcaccagctgctcatctgcaccttcctctccactgaaaagtaccgcgataggacgccccggcctgcgagtgctggacctggggactctgcctcgggtggagtccccacccaccgagctccgggcgcgcaaggacaagctcgcctacttcgagcgccagtgctcccccgtgggccacggcctgttcgtgggagcagaatgtgtcgcccggaatcgcgaatcgctgcgagaggcgggcatcacacacgtgatcaattgcgtgggcttcctgtaccccgcctacttctctccggagctggagtaccggacgctctacctccagnnnnnnnnnntgtgatcaactgcgtgggcttcctgtaccccgcctacttttctccagagctggagtaccggacgctctacctccaggacacccccgcggaggacatcacgtgcatcatgtacgacgtcttcgacttcatccaggccgcggtgggacatggcgccgaccccgccggccgcgtgctgctccactgctcacagggcgtgtcacgctcagtgagcctcaccatcgcatacctcatgtggagggagggccggccgtacgaagaggtgtttgcctccgtgaaggctgcacgcggcatcgccaacccaaacatcggcttcgtttgccaggtgcgtgaggtgcaggggatgagtttgacagactgctcccaagaacttcacgcgctgccctccatcccctctgggctgtgcgccgctacacccacgtaccaacactcctccgcctggtcacccccatgccaccgcagctgctgcaatggcagaaaaggcgcaccactggccccggggccgagcgcctgtaccgactggctccccagtcgcccgcagccccgcagtacctggtaccacggtctgcaaagattcttgggtccgccggcctcgacccacggggctcctttgtactgcacaccagcacggcgctgttcctctggctggtgcgtagtgctgtgcggtgctgtgtcgtggcatgggcgctttgctgtgttttcagtttctggtggttcctacctgcatccagacccagcagaaggaaacgcaaggatacccatgtccttgcgctcacagctccactcccgtgtgcgcttggcagggcaaggcatgtccagaggggtttgctgcggcggccaccacctttgcagcgcaactggagcggtatgaggctgcaccagcgcccgctttgctgcaaagggatgggaaggagagcgaggagttctggacggcgctcaaagcaatgctctccagctccactggcgaggatgggccagaggcgtccggcagctggagggcagctgccgtgtgtgagatgcccgcgtacgacaaggactatgaggtgggtggctgtggaggtgatcagaccaagatttggttatggggatgtacacgttatttccaccccgctgtgtatggtccggaacaaaccctgtcaccatcccctgcatgcttgaagcactgcctgcaccagcagtcctgtcgcgcatgcccagaaggggatgcatacaaccaagcatcttctttgcgcagcccatggaccgcccacctcttctctcatattccttgttcccacatttgtttccttgcacaagcatccctcccgtatatccttcctgccatagcttctccacttacctgcatctcctcccgcatgatcctgccacatacttgctttccctcgcannnnnnnnnnaatccttcctcccatagcctctccacttacctgcatctcctcccgcaagatcctgccacatacttgctttccctcgcacaactccttcccacactgcacacagctttttgctcggtcacagaccgctcggagtagcaccgcagatgacagcgatgccagtccacggtcggctcgcaagacgccccgtgacgagaggtccgaggaagacccctcccccaacgagcggcagaggaagcatgcgcgggggacgccgccgacggtacctcgagacgccgccagcgccgatggccgggcccagagctctgctaacggtgctgtggctgcagcagccagccccaggaggcatgcttccaggctacccccggttcctccgttggacatgacgaggaggggggacccttccgtgaacagtaggagccgtgtgccgcgcataaatctgtcccctgtcgccacagtcgtatctgacgactaggagggcaccttatcttcatccttgtccactgaccgatagtacatgaaatgactgtcccggactccaggcggcgcctgcagtatgaaatgcaactttccagcgcgccaaagtcgaagtcgcaggacgagacgcgcgacctgttgagcaccccgtgagcgcagggtgtccacatgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagacgggggagctcgactgctgcgcccatgtgtaagctgggggagctgtgtagtatgcatccgaaacgttatatggcagccatctcatctagttttctatctcgcgcaggttctgcttcgcctgcatctcccagtgggccggcatcgagagccgttgcccactgtgcaaggagcgcttcaagcaaatacgccggaagcttctggcgagtcccaggtccaggaagcttgcgggacggtcttcggctgggaaggtcgtggacaccatcgtggtaccggagcaaaaccaggttcgtgacgagggtggagcacatctgggaggctgcctgcttggacggtggcaccggcactctacctcctgctgcgtcccggctgcggacatctgtgcatggttggtgtgcctacgctgtgccaagtcaccgagcaaacccatctccctgcgctgcaccccttgctagagggcggtcttcgaggatcccagcttccagacgtggatcgacggcttgcattgccaggactgcgggggtggtgaggacgaggaccagctcctcctctgcgatggtgaggcactgcttgctgagtctggttgtgttgccggtccggtggaagggcagtggagcaggttgtggggtgagnnnnnnnnnnagctgagtctgattgtgttgccggtctgcttgaagggcagtggagcaggttgtggggtgaggggcgtacacgccacaaaggtgatgccgggtggcttccagtccctgtgcatgaggcggggccaggggtggctctgttccccatgccaccctgttgtctacctcagcctccagccccgctacactgccccctccccacccccgacccaggctgtgactgcgcnnnnnnnnnnacggggacagggtggctctgttccccgtgccaccctgttgtctacctcagcctcaagccccgctaccctgcccccccccacccccgacccaggctgtgactgcgcgtggcacacctactgcatcggcctcccgggcatcccggagggccagtggttctgccccaactgcaccgccggcagggcccgctcggcgcc

SEQ ID NO: 27454 - DNA, 64 bp, Chlorella protothecoides
caaagattctggtcctcgctctccatccacttgcccagagcggttgcggatgcggagtcatgcg

SEQ ID NO: 27455 - DNA, 61 bp, Chlorella protothecoides
ggctgcctcgggtgccaggttcccagctcggagagtcgatggagggaccacgtcctcctcg

SEQ ID NO: 27456 - DNA, 105 bp, Chlorella protothecoides
acggcgaggccctgctctctttgctgcccgtgggtggccgggccctgttgaggctggggggctgcctccatggcacgccccatgtcgtcccctgcgccggcgccg

SEQ ID NO: 27457 - DNA, 66 bp, Chlorella protothecoides
gtggagctcaaacgcagctacttgcgcccttcactgcgtgcatctggtgatctggacccagcataa

SEQ ID NO: 27458 - DNA, 72 bp, Chlorella protothecoides
taagatcctttgtaacgccgctgtatggacccaccgacaactctgcgaaaactgcggtggctgagctcgagt

SEQ ID NO: 27459 - DNA, 61 bp, Chlorella protothecoides
gaattccagctcattgatccactgcacatggttcagtctcacagaggttatcgcacgagtc

SEQ ID NO: 27460 - DNA, 99 bp, Chlorella protothecoides
cccagcgctcgctgggcaccgcaaggcgctgcgagctgaggcttgccgctgagacaccatgatgctggcgctcacagcgtcctttctgccctgcgtccg

SEQ ID NO: 27461 - DNA, 105 bp, Chlorella protothecoides
tgggggtggggacttcttggcgggtgggggtgcagacttgctggtgggtggttgtggcgagtgactggtgggtggggatggtgactgagtggtgcgggggggtgg

SEQ ID NO: 27462 - DNA, 70 bp, Chlorella protothecoides
atgccttgggatgcctcctggggctcctggctgacgaccgagggagcagggcggtcgcctggaggggtct

SEQ ID NO: 27463 - DNA, 61 bp, Chlorella protothecoides
cgacttcgagggccccggccgccgcccgccggcgggccacgtcgtggcggtccgcatcacg

SEQ ID NO: 27464 - DNA, 106 bp, Chlorella protothecoides
aaggcatagggaggcattggtgaatacaaaatatgtctttacgataccatgcgtgaagtgtcacggagtgaaaatacggtgcgatctgatctccaagtagggtgac

SEQ ID NO: 27465 - DNA, 63 bp, Chlorella protothecoides
gtccgcaagtccgatacgtccggcggtcgaactgatactcttcaaaccaaggtccgaagtgga

SEQ ID NO: 27466 - DNA, 61 bp, Chlorella protothecoides
agcgtcaacttcgggtccttgatgacatctactccacttcaccacgaattcagtattgctc

SEQ ID NO: 27467 - DNA, 76 bp, Chlorella protothecoides
gcacccaagaaacccgctgccaagtcgaagaccgactcaaagaccaacgcccccgtggctgaaggcacgggagcca

SEQ ID NO: 27468 - DNA, 61 bp, Chlorella protothecoides
tgctgatacatatgctggctctcccccatctccttcatgcagacatctgactttgcagctg

SEQ ID NO: 27469 - DNA, 73 bp, Chlorella protothecoides
tgagattgtaacctgtgtgcattgatgtcgagtgcaaccgcttatatatggaatcgctaggggcggcagggca

SEQ ID NO: 27470 - DNA, 158 bp, Chlorella protothecoides
tggtcccggaaagacagctgtggggggtggggtgggggtagagggaagtaagaaggagcgacgcagcagtgtaggcagcacatcggaacaacatgtccttgttccggtccatcacgccctgccccagtgtatgccctcgagggacaaacccttgaaac

SEQ ID NO: 27471 - DNA, 67 bp, Chlorella protothecoides
ggccgagacggtttgcctcttcttactcgatcgcagactttgagcgttgaacaatcaccaagaagaa

SEQ ID NO: 27472 - DNA, 74 bp, Chlorella protothecoides
gtccacgcccttgcctacacatattagcccacctgttcatgcagtactccacatgtgttgccagttcatgtttg

SEQ ID NO: 27473 - DNA, 2092 bp, Chlorella protothecoides
  modified_base (137)..(146): a, c, t, g, unknown or other
  modified_base (576)..(585): a, c, t, g, unknown or other
  modified_base (883)..(892): a, c, t, g, unknown or other
gctgccgcgcggccacgcccgcggcctggctcgcctggcgctggcacccgcgccgtgctacgcgccgccgcgctctgatctggcgcacccccagcgcgttgtgcatagcacggcgcaggctgtgctggacctgctgnnnnnnnnnntcgcccgatggacacccggttgctgcgtggctacgtggtggaccagggacaggcgctgccgcgcggccacgcccgcggcctggcccgcctggcgctggcgcccgcgccgtgctatgcgccgccgcgcgctgagctggcgcacccccaacgcgtcgtgcacagcacggcgcaggctgtgctggacctgctggccgaggccctcctggacaggggcagggcggaggcctgacctttgtttcgcaccgctgaccacggctgccggcaagtcgccgcggaggcaaggttggtgcccagatgtcgcagcgcgacaggattgcacctgaggccacaccgcgccgttgtccacacctgttttatcccccccgcgctctgcagcgcgcgccaccaggaacaacccccgcaaccgcgctccgctgcaccatttgtgcgnnnnnnnnnncgttttatcccccccccgcgctctgcaacgcgcgccaccaggaacaacccctgcaaccgcgctccgctgcaccatttgtgcggcgggggcctagacccagaccccaaccctaccccacccccccctgaactgcctgcatctaaaaccattccagtcactgaatgcccttttccacagatggaacctgtgctgccccatcaggcgccaccccatgtttgactttgatcgcgctcggtgcagtttgacaccgcagagccccttcgcctcgcccccgtctttctgcaggaagaacatgcgnnnnnnnnnngtgtttgactttgatcgcgctcggtgcagttcgacaccgcagagcccctttgccttgcccccgtctttctgcaggaagaacatgcgttgtacccaatctcccaccccgctgccccaacatttcccatgcccttaggaccatctgaatccccttgctgtcatccatagtacaggacgacattcccctgtaacaacgttgccactgagtgctagtggggtgtgggaatgggccatgggtgttgcgttccacatcagagagccacgagggcgagcaggctgccccgccacaacttccgcacgctcagcagcgactcgctcgcaggcagtcggatgccatggcacggaccagggggtccctgctcgtttgacacctgctcaggcatccgtgcagcgaggccccgtcgaccttgccggggaccttctgcgccgccgccagcagccggcgcaggcccaccagcgccgccctgcccgccgcgtcgccggccgcggcgtgttccgcgagcagccacgccaggctcacacggtggtcggctggacttgagtctggcaggggagggggtgggggaccggtggggcaaacggtggcagtcgattgtggcatgctcagaagggttcaccttcactccatgtcttggcgcatgacggcgcaaggtgcaggacctcacgtcactcgcagatccctggcttcaccacctcatccaccagcccctccctcacccagcatggcgaagaaggcggcctctgcagccaggatggtcgcgatgtctgcgtcggctgcagtcaccttgctcagcgctgtctctagggctttggctcgggctggcaaagaggccaggcaggtgctgggtgcccctgtcgcggcggtcgtggcccggtccgcccgggccgcagcctggtcgccggtgcccgcttccacgaccgtgggtggtgatgcagcttcgctggtcccaccgtcagcacggtcatccgtcgcagctcctggcagaactggctcgccctctggcggcgtggcgatctctgccgccccgacatcgaccgaagcgggctccgcctcccctgcgccagtctccacagcaccagggtcctcccggggcccctggcaaactcgcacctccccagccggctcacggcccggcgctgcgccggcgcgcaggaggttggccagcgccggccgcgcctccgcggggacccggcccacgag

SEQ ID NO: 27474 - DNA, 74 bp, Chlorella protothecoides
ccatctcgcaggctccgcgagctggaggccgaagcggccggggctgcgctggcgaggcagcagctggcgaggct

SEQ ID NO: 27475 - DNA, 61 bp, Chlorella protothecoides
cttgtggctgggggcgtcctggaaggcctctgccgcgtggtcgttcacccaggcgatgcgg

SEQ ID NO: 27476 - DNA, 76 bp, Chlorella protothecoides
ggtgttcagacctcgggcacggccctgccgagcatgcgcttgacagctgggttggcgttggtctcgtactgcaggg

SEQ ID NO: 27477 - DNA, 72 bp, Chlorella protothecoides
gggtccaccaaatgctgtgggacgaagtgcgttctcaaaaaacacttggtcaacatcagcatgttggccgct

SEQ ID NO: 27478 - DNA, 66 bp, Chlorella protothecoides
gcttgcccgggcatcctcagtactgaggggcctataactcttgccgatcccctacataatctctat

SEQ ID NO: 27479 - DNA, 82 bp, Chlorella protothecoides
cccccccccctcccggctgggcgtccacggagcgcagcagcaccccgtcacaggtactggccgggagtgacagacactcccc

SEQ ID NO: 27480 - DNA, 94 bp, Chlorella protothecoides
tctcagcactgggtattgagcatgccgggggcaggcaagaaacgcaaggctcgcggtccaaggagtgtagccttgactgtgggcaaagtgcagt

SEQ ID NO: 27481 - DNA, 61 bp, Chlorella protothecoides
tcgcaagtccaacgatggcacgaaggcctcaccgccgccgccagcaaagctagcaagaaca

SEQ ID NO: 27482 - DNA, 68 bp, Chlorella protothecoides
tgggtaattctgtcgatcgatacggcaaagggcttggcttgcgatccgtgtgaccctttcgcaatagc

SEQ ID NO: 27483 - DNA, 121 bp, Chlorella protothecoides
cccggggtgcccctcgcgcccacttttgcgttgatctgcatcgcgcagtttattactttcatcattgtgacgctgtagttccacttcttcggatgtaaccgggcgtggtgctacagatcat

SEQ ID NO: 27484 - DNA, 74 bp, Chlorella protothecoides
ccctgcaagcgactgacagcccctgatgcagagggggaggtgtgccctgcaagcgactgacagcccctgatgca

SEQ ID NO: 27485 - DNA, 79 bp, Chlorella protothecoides
gtttgccaatgcttgtcctgcagccaccccccaactgagagcctcctggccccccagcgccctggcctgcattcctctg

SEQ ID NO: 27486 - DNA, 105 bp, Chlorella protothecoides
acagacatccagatggcacggcacaaccccgaggggggggatcaccgcacccgactggggagccaagggcacgacgggcgtgcccacgcccccccaactccacac

SEQ ID NO: 27487 - DNA, 61 bp, Chlorella protothecoides
tgccggctggctggttccacgcctgaggggtgccacaggcaacggaggatacctgcagtac

SEQ ID NO: 27488 - DNA, 61 bp, Chlorella protothecoides
cgaagtgcattctcaaaaaagcacttggttggcatcaggatgttggccgctccgttgacgt

SEQ ID NO: 27489 - DNA, 388 bp, Chlorella protothecoides
tttcaacacagcgtatgtttcagctggttttagccgaatcgaagcatctcccagaaagcctcatctgccgtgtaccattacacccggcgtttccgcacagccgtaacaacagcttttgtctgagatggcaatggctaatgccctcaatggcaagttgagaggcaatctctgttcattcattctcaattattgtgatctatcggaccgacgaggctgcgcagtatttgcgtgccatgtcttgccccactgctcaagtaatgatctgcccagggtactgacatctcagatggtgcaaatgaggtttataccactgctacaggacactccgtttctaacaaagatgtaatattcaatgtaacaaatttagagtgaaagcggatatggatgg

SEQ ID NO: 27490 - DNA, 67 bp, Chlorella protothecoides
gccaggctggtatgccttttcactttcctggactgaagggccacaggctgagccgatgctctttgct

SEQ ID NO: 27491 - DNA, 61 bp, Chlorella protothecoides
tgaacagagccgccacgcatgaatgggggatgcatggatggacgtgcatggacatgaacag

SEQ ID NO: 27492 - DNA, 68 bp, Chlorella protothecoides
gggaatagggcattaccagaagtgacacactctttttggtttttatagaaaaagtattaatttgggtc

SEQ ID NO: 27493 - DNA, 100 bp, Chlorella protothecoides
agctggctctgctgcacatgcctgcatgggattaccgacccctggtttgcgtccctggcggtgatacgttcaacctcccacttcttccctgcccgcccgc

SEQ ID NO: 27494 - DNA, 61 bp, Chlorella protothecoides
cacctgtcgggaagctgatggatacttaactacggtaaatgaatgtgtgataacagggatg

SEQ ID NO: 27495 - DNA, 108 bp, Chlorella protothecoides
cttgtccttcagcttgtagccaacctcgtaaccggggcggactggggatgcacgggggagggtcgggtcgagccccggtggcaggctacgtgctggggttcgcccacg

SEQ ID NO: 27496 - DNA, 61 bp, Chlorella protothecoides
cgccaatgccataggcgacgcagacagaggtgaagagccagatggcgttgctgagctggat

SEQ ID NO: 27497 - DNA, 61 bp, Chlorella protothecoides
cccagccatcttgtcaaagatatcctgcaggtgggggcaagccaggtgtcaggcagtggca

SEQ ID NO: 27498 - DNA, 72 bp, Chlorella protothecoides
cagggcgctgggtcaagagacaaagaagggtgggggggggttcagagggacttgggtctcctcctgccaccc

SEQ ID NO: 27499 - DNA, 122 bp, Chlorella protothecoides
atccgtcgagggtcgggtgctcgtcttccccttccaataaatctgtaatgctgatcttgactgattggacatgcactggaacgcgttgcgcatgcctgcgtgccctcctgacgaacccggca

SEQ ID NO: 27500 - DNA, 77 bp, Chlorella protothecoides
catagatccggccatgaatccacagcctgtacaatttcctcaccctccccccccttcctcccatcacaggtacaagc

SEQ ID NO: 27501 - DNA, 79 bp, Chlorella protothecoides
tggtcctggtgaggtggggtacacagatgggtgctctgaggtagcccccgtcaccaatgttcctgccacccttgtctga

SEQ ID NO: 27502 - DNA, 61 bp, Chlorella protothecoides
gctaggagagggagactcctcagggctgggactaggagagggagactcctcggggctagga

SEQ ID NO: 27503 - DNA, 61 bp, Chlorella protothecoides
ggccggcctactcatgcagatcttcttcgccgctgtcggcgccagcggcgacgtggcggct

SEQ ID NO: 27504 - DNA, 137 bp, Chlorella protothecoides
ggtgagtgcggctgagcgggtgccggcgctggcggcctttccatgacgagagatcggattgccattcccggatgctgatgggtggtgcttgacactccatgcccagctgtttcgcagcaagagtacatcctctgagc

SEQ ID NO: 27505 - DNA, 61 bp, Chlorella protothecoides
ccgattttgatgaaggtggggcccagccgcaccagcccctcccgcacccagcacgcctggc

SEQ ID NO: 27506 - DNA, 80 bp, Chlorella protothecoides
gaggggttcaatcgatgctcagaatggtatcgagatgccggcaaagtgaagaggacacagccaacatggagtgcgtcctg

SEQ ID NO: 27507 - DNA, 5328 bp, Chlorella protothecoides
  modified_base (4676)..(4685): a, c, t, g, unknown or other
tgtcggcgcggggcccgcccccgggccgccgcacgctgcggctgcgcggcggcacagacgcgcgcgccgcgccgcccgcggactacctgcgccacgtgctggcgcccgccctgcgcgcccacgccggcgtggacctggaggtggaggtcctgcgccgcggtttcttccccaaggcgagtggcaccggaagcagtggcgagggcgatcctctggggcggcatgcgaagtgcatgggcgtggacttgggaggggccccctgcgttctgcgctgtcaggcacatgaacccatggccaggcaacagctccaggacgtgtggccacattcaaacctggaaccccctctaccccccgacacatacacacgtcaattccctttcccacaaacagggcgggggcgaggtcgcgtgccgcgtggcgccactgtcgccgggctccagccttccccccctgcgcctgacgcagcggggtgaggtgcggggcatcgtcatccgcgccttccaagccggcagggtgccgcgcggtgtcgcggatcgcatggcaagggccgcccgagccgccctgggcgcgaacctcgcgaccctggtcgaggcggaggaggtggaggccctgcccccgtgccaagcggtgggggacgggtgcggggtgctcctcgcggctcacaccagctcgggctgcgtgctgggcgcctcaggtgcggcacaggccgatgcagagggggtttggagggtggtgatctgggtgggacctgagagcccatcatgctgcgtgcggtcatgacatcgggcggggatcggtcgctggggggagtatgccgcgagcaatggtgggtggatcgggccatggacagcctgggagccgatcactcctcaacgccggcgtgcatgggcttccacctgttcctggcgtggtcagctccaagcagctcatctgcccaccccccgcgcaaacccttccttctccacgaccactgcacaccaggcctcggggagcgtggcgtctcggccgaggcggtggggcggcgtgcaggcgccgagctggcggcgctcctggcgagcggggcctgcgtggacgcccacgccgcagaccagctggtcatcttcgccgccatggctggcggggagagcaggctcctgatgggagagcccacgctgcacaccctggcagccatcgcggtggcagagcagctcaccgcagcgcggttcgacctgcagacggtggagggcctgaccctcatggcctgccatggggcaggactgacgtggggctagggttcccgggcctttagtcaagtatgactcggggtgacaaggatggatgctcccaccacacgcccaattcctcacgtgcggtggtgttgaatactgcacaatgatcaacaaaagcagcttgaaaccgtggaacggctcggggaaggcttgatgaacgacgatgtcttgggggaaggtgtgggcaggaggaaagcgtgcgcggcgacggggagagacacgcatccctccgacctctcgaacatagcctgggggcattcctggtcctccagcataagttatctaccacttgtagataatccatgcccaattatcccctctcggtgtgccacactttcaatacactgtcgaatcgacttgctgccggattacgggtggcctgcccactcgtatcgcaggggagcagagggccctcggcccgcagctgctcctccaagggtctgcaggcagggcccggtatccccctgccgcctatcccctcagcttcgcactcagcgagtagtatttggaacaggaccagctaccgtatgctcgccagtcccgcaacccatttccggacggtcgcccagggcgaaggagaccagcgggctggtcatacctgcggccagcaggccatgcccctgcagctcaggactttgcaatccgtgtttgacctcgcaagggtgacctttgccaatggcaggaatcccacggaaggtcaactacagctcctacgacgtgccctcggtgcgtggtgtggagtgggctggttagaggcccacgccagggagctatttagaatgtatcatcatgccgttgatgattgccaatcgaccttttcttgagagactccgtgcctgagatgcgtttgtggcatggggttcagttgccagctggcttgcaatgttccaggccctctcgcagcccacgcccgcctcccgagtcctacccagcaccacatatcgcgttttatgcatcgcaggtcgggtgcagctcgacgagctgggcctgtccagtgatgcgtgcctccccatagatcgggacacgcctggcgccgcccagcccattcgctacctgcacatctttgaggacggcgaggtgtccctgggcatcttctgcctgcccaagggtgcctgcatcccgctgcacaaccaccccggcatgaccgtcttctcccgggccctgctcggacgcgtgcacgtgctttcctttgactgggcggaagcccacaccgacgccatggcaggcactgcggagggcgctgctgcccccgcacgggaggcgcggcgcgtgctggactgcgtcatgggctccggcgacgacccagccctgctgcagcccacctccggcgggaacatccaccagttcaccgccgtcacagactgcgcggtgctggacctcctgacgcccccctatagcctcgacgacggtgtgtggcagttggcaggactccgctccggggtgtgcaggatgtgcagtcctcctctgccgcagcgcctctgtgctccaatccctgttctgtgtgccctgggagagagcgggaatcttgcagagctgcattgcccactggcactgttttagaccttgacgtttcgacttccacatcatcctttccccttcatgcaggacgtgactgcacctactaccacgtcgaggggccaggttctggggacggcaccttcctgctgagggaggccgagccgccctcagactttgtcgtgggtgcgctggggatgtatgactggggctgagggcctggcccctgggcatcgttgtgatgggagggtgggggactggagagcatcgggacagtccctgccattgtcccccttctcacatccttcctggacgacgcccactccgcagtggacgctccctacaagggcaggaggcccatcgtgaggagtcccgtccatcccagccggccaggcccggaggctgtggtagagcaggagttgtaccgtgcacgagtctgaacttcgccctgtacccaccatccataatgcgtctgcaccccactgcactgtgctttgcccccaagtttgcggacaatggcctggctgggtcggctcacgaatgtgccgatccatgtcattgcttcaggcgatcgagcctgggtgcatccgcctgtctgtaccccaagaaattgtgacatcccccggccaaccttccagcgcgcgcagcaacgcggttcgaggtggttgtgccgggactgtaacgatgaagcatttgcaggccccacgccgttgtacaggatcatactatggagtttataaaaattcctgcctagcgtgattcgctgtgcaaggaccgtgtgggctcgatcacagccacctcggtcgtggcacttgggagtccgacacgcaatcctcccacaccatggcgcgggctttcgcggagcatgaggccaatctgcccgtcggggatacgctgggacagaccctgatccctgtgatcaataaactgcaggatgtgtttgcccaggtgcgggggggtgcctgtgtcgattgttaggggttgctcaaggctgtgggtaaccgcgcgacaggaggccacgaatcccagacacccaagcccggatgctacatatcatactttagtcctctcaggtctcagtaaacccctgatcacgccccacaggtgtccccggatgtgagactggacctcccccaagttgccgtgatcggcagccagagcagcggcaaatccagcgtcttggaggcactggtgggtgcgccatggggatgcatgcatgatggagtttgttgcggtgtcaagctcctgatggaaataggggctgggtgccacaagtgccgggcagtaagctctgcctgggcagccccgcacataggtgcatgccagtgcgcatgggtgctgcttgcctgcaagacccggtttcagtcatgatgccggggcggctgctgccttggaccaccaaaagatactcgaccgacgccttccttctcccactccccgacgttgccaggtcggccgcgatttcctgccccgggggtccaacatcgtgacgcggcgccccctgatcctgcagctgataaagatccctccctcccccgccggccccgccggcgactggggcgagttcctgcactgccacggcaagcgcttccacgactttgaccgcatccggcaggagatcctggcagagacggatcggctggtgggcaccaacaaaggtgtcagcgacaagcccatccgcctcaagatctattcctcctccgtcctgtgagcctgctagcataggggtggcgggttgtggggttggattggtttgggtggggcacgtcttgtgttggtcggtcccagccttgcgcagccatgtggtggggccgcctcaacccgaccctcaaaccacccacatccccgatccctcccccaggacgatgacgctcgtggacctgcccggcatcacgnnnnnnnnnngggggtgtggggttgtgggttggattggtttgggtggggcatgtcttgtgttggttggtcccagccttgcgcagccatttggttgggccgcctcaacccgacccacggaccacctaaatcaccgatccctccccaggacaatgacgctcgtggacctgcccggcatcacgcgtgtgcccgtgggtgaccagcccaacgacatcgaggcgcgggtgcgtgccatggtgctggactacatcgctgcggagtcgtgcatcatcctggcggtgacccccgccaaccaggacccggccgcctccgacgcgctggagctggcgcggcgcgccgaccccgcaggcgcgcgcaccatcggcgtgctgaccaagctggacctgatggaccgcgggaccgacgcggtggccgcgctgcgcaacgaggtggtccccctgcgcctgggtcacgtgggcgtggtcctgcgcagccaggaggacatcgccagccggcgcggcatggccgaggcgcgcgccgcggagcgcgccttcttcgaggcgcggcccgtttatgcagaagtagcagcggcctgcggcgtgccgcgcctggccgcggggctgaacgcggtgctggcggcgcacgtgcgcgccgcgctgcccgcgctgcgcacccg

SEQ ID NO: 27508 - DNA, 65 bp, Chlorella protothecoides
agcctgcacgcgcgtcggcaggtgcgccggatgcctcgtgtcctgcgtgggaccagagggaagga

SEQ ID NO: 27509 - DNA, 61 bp, Chlorella protothecoides
ccgggcggccagcagaacccacaaaacagcactgcctctgtggatggccgaagcagggtgc

SEQ ID NO: 27510 - DNA, 141 bp, Chlorella protothecoides
gacagcgatcggacaccaaggtgcaacgtccatgccaagcggatgtgggccaccggtactgtaaccccttagggttttcggagccctgaggtgaaggcgtgctgtactgaacaggcctcagcaacgatcgatccgccacac

SEQ ID NO: 27511 - DNA, 86 bp, Chlorella protothecoides
cacagcctcatgcagaccttacgctcaccaccccaaacctctgtgctttcctcctttcagggtgcagcactccaacctggtgctca

SEQ ID NO: 27512 - DNA, 78 bp, Chlorella protothecoides
cagcagattgctacgttcattggatccacatattggtcccgaagcctgcagttgccatccggtgcgcagctgggtcac

SEQ ID NO: 27513 - DNA, 103 bp, Chlorella protothecoides
ggtggcacccctcggcaaggactgggcggggcagagcggtcaccgcgcccctcccccccccatgttctcgctttccaggaatatgctctcgttctcctgctca

SEQ ID NO: 27514 - DNA, 68 bp, Chlorella protothecoides
cagagaattgggaccccctgtgaaggggcaatttcaggggctcagggccccaaccattctggtccttt

SEQ ID NO: 27515 - DNA, 75 bp, Chlorella protothecoides
tcccagcgtggcacacacacatcccatcgaaaacctgtccgaaacaaacacacacggcatggatcagtcaccact

SEQ ID NO: 27516 - DNA, 89 bp, Chlorella protothecoides
taccacgcatcgagtattgccctgcagaggcgcagcaggcctgcaggctcatagagcacaggccacagcgatcctccgcctcagtgctg

SEQ ID NO: 27517 - DNA, 61 bp, Chlorella protothecoides
gtcaacgccaggtcgtccactttcgcgcgcaggtgccccgcctcctcctggatctgcagtg

SEQ ID NO: 27518 - DNA, 61 bp, Chlorella protothecoides
tggtggtggccctcgtgggttgtctcccgtaccctcccgacaccgccagcctctgtgggag

SEQ ID NO: 27519 - DNA, 61 bp, Chlorella protothecoides
gtggctcatgagcagcgcggtgtccagggccaggaacatgtcgtgggagggctggtggagc

SEQ ID NO: 27520 - DNA, 78 bp, Chlorella protothecoides
ggtgcagggcggcaggaccagtgaatggcatatcatatggcgtgaccaagtgtgagggacggagaatttacaagtggg

SEQ ID NO: 27521 - DNA, 151 bp, Chlorella protothecoides
ctccttctcaaggtgggtagagggatctgatggggtccatgctggctctgtctcggactcgcatggactatgggtttgggaaacatgccagtacacacacgccagcatcctgccaaccctggaaagcctccctctcacatccaaacaagct

SEQ ID NO: 27522 - DNA, 69 bp, Chlorella protothecoides
tacgggttgcccagcgttcagcacatcccccccccgctgacaaggccctccatgactggcaggctggcg

SEQ ID NO: 27523 - DNA, 79 bp, Chlorella protothecoides
agagcactgcacattggagcaggacatgcgggtctgcagggatcatagttttgggcctctgcccccaaagtttggtcgc

SEQ ID NO: 27524 - DNA, 138 bp, Chlorella protothecoides
acagtcaagtcatgagtttgagatcgagaattcgacactgctcgcatcggtgggacccaatcatcgccggcgagccattagagagtagagggtggtcaaacaaacctgagccgcagtgggattcatgaagcctgcacg

SEQ ID NO: 27525 - DNA, 78 bp, Chlorella protothecoides
aacaggatgcgagccccagcgtgcctgggtagccaaccaaggccgacgtacactccaggatgaccaaaatccctgccg

SEQ ID NO: 27526 - DNA, 72 bp, Chlorella protothecoides
gagctgctgaatgatttactcaaggtgagtttgttgttgtgtgtttgtgtgtgtgtgtgggggggggggggg

SEQ ID NO: 27527 - DNA, 72 bp, Chlorella protothecoides
tgcaattttccaggaccaagctgaagccttttgtcccacgcctccatggtacaagtaacacaaacaacagca

SEQ ID NO: 27528 - DNA, 70 bp, Chlorella protothecoides
acgtgtgttaaagcccttcagcagctctgggaaatctcgtaccattgatctgttgcgaccaccggtttgc

SEQ ID NO: 27529 - DNA, 67 bp, Chlorella protothecoides
acgtagtccatgccgtacatgacctgtgcacgaggggagggggaatgatgggtgatggggatatagg

SEQ ID NO: 27530 - DNA, 61 bp, Chlorella protothecoides
taaacctcttgcatgaccgaagtaacacacaccgcagtcagtccaaccccaacacagttca

SEQ ID NO: 27531 - DNA, 131 bp, Chlorella protothecoides
gccaggatgtagtgtcatccctctgatgcaggactgatcccggctggcacctgcaggtccaggagcccccatgaccctaccccatttcccagaaaaagcaggcatccagcccacccaaccaatacaaagcc

SEQ ID NO: 27532 - DNA, 74 bp, Chlorella protothecoides
cgctcaagccacgctcatgctgccggcatgctgccggcatggagcaccacgtgccccaggtcggggaatcccag

SEQ ID NO: 27533 - DNA, 108 bp, Chlorella protothecoides
caagcggaagtgctcgtctgtgaggggaacgaggaaggggtgggaggactcaggggagggggctgtggcgcaggctcgggggcctgcaacctacgagtcacagtcgcc

SEQ ID NO: 27534 - DNA, 78 bp, Chlorella protothecoides
cggaggtgacggaggagctccctcttgtagaacgtggccgtcgccgtggctaggtcccccgccgcttcgtcgatgagc

SEQ ID NO: 27535 - DNA, 61 bp, Chlorella protothecoides
tgttttacaaaaagcctgtgaagaaaacagaggatgcgcggtcttcaacgtatgaccagag

SEQ ID NO: 27536 - DNA, 132 bp, Chlorella protothecoides
cctggcagcgtgaagcaggacagggggaggatagcgctcggttactttggacggctgcgcactcggactcttgctcgggcccccaggcctgtgacccatccaaaggctcactaggatggcggggatggcagc

SEQ ID NO: 27537 - DNA, 5226 bp, Chlorella protothecoides
  modified_base (2296)..(2375): a, c, t, g, unknown or other
atgcagggccactccttcattgtgcaagggacttctggacagctcacctccctgcaatttgacatgatggccgtggagagccctagtctgtcctgcatttttcttgaggtgaaggctccctgttcgctagagatatcacctcttctcccactccaccaggctgggacgcatccaatgtgctgaacaacttcacgtggacagatgtctcccagccctttggggactcgcagaagatctccactggcttgtgtgtgggagcacagaagctttgtggttggggtgtgcagcattgttatgatcgatgggccatgctctgcatgctgcctgcacagcactcggcccggatcctgggtccttgcctgctggcctctttcttccgtaatcccgctgtcaacgagtggctttagcacgatggctcgggtcccctcgatcagcaccactatccctgccccacccttgcttccagggtcattgggactgtcatgtcctcctacttcaatcaggatgggtatgttgaggtttctgccgacaccgactgtgactcaccgaggtgcgggtacttcaactccataatgtacagtgggactctccaggagggagccagtggcagtggtctggtgcatgacggtgagtgggtcgggagctgaggtgccgtgcctggtgctctggatttagggcattatcgtccctccgcactcaccccaaccagccccaagggctggcacggcatccccagcatctcagagttcctctcccatcctcgcctactgcttttgtgcagacctgcgcagggtcgtgggtgtgctgtccagcggagcaggcgaggactgtgccaatcccgaggatccctacgatgctgcgtcgcctagcatgacatttggacgcttggcaagggtgagtggtttccaatagaggcgcatgctgcccagctcaatgccgtggcccttgcgagcgctgtggctggatgaatgtgagccctgattgagacacctgacggacgcccgccaacccacccactcttacgccattctgagcgcaccaggcctggatcagtggactgtaccatctgtttgacggcgccacagtagaacagccaggcggtgctgattactcaacctactcggcccccttgcccactctgactatcgaaaacatagtgccagaggtgaatcccatcctagggcccgcagtcatctctatccagtgagaacgggcatggggatgatggccgaggggggggaagagggaggggggaggggtggagggtatataggtggccaggcccttaaactgacccatgtgcccgtggcaacggctgctcatagtgcctgggccgcaggatcgccaaccacccacagccaagcgacaactcagtgcaattcactgtccttcccttctcccacaggctgcagcaggccccacagcacacgaccacggtggagatcgcctcaatggacaagaccttgatcagcgtctcgccctcatctgtgaccttcaccgccagcaactggagcacgccgcagtatgtcaacctgactgccggtaaggacagtgtgttggtggcgaggacaggcgtcccgcgggaagtggttttggaaaggctaggtgcagtggctggcggcaccccaggcaggggaggtgcagaatgagacttatgtaagggtctgcaatacccgagctgagatgcaactcagtgagactgacaagtgtctcgccccctctcccaacacgcagtggacatcattccttcttcggagtcagctaaatcgttcgagctgagcctcacctggcccacagtgtcttcttccggagcgaaagggtcgcggaacaagactgtcacgtgagttggagctgagcatacagttctgagctgatatcctggggggtgggcctgtgcaaagatctctgagcggcccatggttcagcagaggccatgcttgatgcactctggcctgctgtggtcttatcacaacccccaatgcctgaccgtacttgggctccacttctcccaatgcacatgtgcacacaggggcatcatacggagcgatgtttatgggacaagcttttacaacccggtggtggtggacagccttccgtacgcggctgagggcagcatatcggtgagggagtacaggttggaaagctcggcgaggggtgaatataatggcacgaacgtggttgggcgcatgccgatggccctggttcaaagtctcacgctggcgcccccccttcagatgagctcacacattccctggcaattttcccgtgccccagagcttcaacccccaggcacccnnnnnnnnnnnnnnnnnnnnnnnnnnnnnnnnnnnnnnnnnnnnnnnnnnnnnnnnnnnnnnnnnnnnnnnnnnnnnnnnttataccccccgcgtagctgaggtgagggggctgttcttgatctaccaccgtgcatctcggtgccatgctcgcgtttcagcagatgccaggctcccatgcatgccgcctggaggtccacgcatgctggcccggcatcctcccccaactgttcatgttccttcctgggtccaaccccaaacatcctcctgcaagcagggcctctcgatggtagtgtgtcccgtcacctcgtctttggctcgaggctccctcaccgctaccatttacaattccaactggactgcctatcaactgctcccgtgagctgggtggggttgggcctggggtcctggcggcaatagaacccttgcattctgggtcttgggcttggctctcgtggatgtatgcgaaattgggaggcccctcttccggctatggttggggacacatcatggatgattcttgagggtgccgcacaggcaggcatcgacccattaggtccccaaaccatgctacctgcaggcaagttgctcaaccaataccagaggtcgggcttgggtgcacccaggtggtggcagcacttcccggaaatgacagtacgttgagattttgtacgtgcaggggaaaggctgggcgtcagatgatcgcccctgtcctgcctgcccctgtgcaagggagcagtcccaaggcattgcagccctcctctgcatggtgggagcgccccatccccctggtgcagcccacctgggagtctggtgatacccccggcacagttccctgcccctaaccctcccatcacacagcctactacatcgtcgcatacccggccacctcgatcgtcgcgcccggcacctcacaccatttccagggggactttgcggtgggcatagatgccctctccgtcgaaaaggtgggttgcctcccggccacctcactgcggataggcgtggcaggaatcgtgtagctggccctgccgcatgctgcgcctgtgccccgctggcagctggcatcgggagtccacgtcgacccccctccagccactatctcgcaccctggatccccccctgggcgcccacaggtcatggctgcgtttgacgcgagctcgctggtcgccagcatcaacagcatcccctacggcgcctatgcaacatccgacaccaccggcctggtcttctacttcaaccccccgctgagcactcgagtggacatcaccacctgcttcaacgccaccacggtggccacagtcgtgtccctcctggatggggagaccctgctgcccatcaggtgccgaccggggctgcatgcatggctgggtggggtctggggcagtgcagcggccagccagtcaatcgcccccactccccggccactcagatgacacctgcacacgcacatgagcatgcatgcacaccagagattacacacacactgacgcttgcttctcccagcatcccacccacccccctcgctcacaataacaaatcctcgcagcgtgagcgagagcgagggcgggaagcggtgcggcaccctcctggaccagccggtcacgcagggccaggcgtacttgatcctggtgaccacgccgcccaccgcggtgtccctcagccgcaccccttccgtggtgttcatgagcctggacatatccgcgggggcccctggggcgggcatggagtttggcgtggtggatcccgccgacaccgtcggcgtcgggaatctgaccgtctaccaggtgggcgacgggcccgccgtcgagcagctgctgggtcgctccgtgccgtgacggcttcctggctcgtgggcacggcagcacggcctggacccgtcccgggcgtgttcgatgcacccagtggctgcctggagtcgcagccctctgacagtgaggagtgccgtgccgggtcgggactacgaggagtgatcggcaaggctgtgggacgaccacaccgcagggacatgcgtctgtgcgcagccatggacctcgacatgcatggagtgtgtcgggatgttgttcctatggcggtgaataaccgcctatcactaacattgttgagctttcttgctgcttgtgcaatatccggaacagagtccccaccgtccggggtcggtgagctcgaatactccggagacaagagggtactatgggaccatcgagggttgcaaggacttccaccgctccggaagtttgagagtctcgcatccaatattgttaccgtgcatccttccagagttactcccagctacggtatacagggctgattgaaccgcctgacatcagaggatgtgtccgctcccggtatgtgcaggcgatacgcgtgtcggcactccaccgaggaagcggggcgagccatagggcccgccaaaagcccgacccttctctgcacgccgatattgcctgatacacagtagtctggcggcgtttcatcccatgcactatagtctttgtccacttcgaaggctgtttgcggtgggaactcccttgaatgcgccgtatcgccattctatgtctgcgctccgggatcaccttcaaaacccgaaaacctcattcttaaagaagtccgggagatgcgttattgtccatccatatcttagaccatagacccaagtccacacctcgggaacgtgccagcacctgcgttgccagcttccatccttttcaactgcagcttcctccggcgcagctttcgacgtccgcgtacgacagcggccctgttgattcggcagcgaatctgcagctggggaaggaggttctcaggccctcgctgggagtacatgggtattcaggaactgatatactctaccttcatctctacagagataaggccgcgtctcatgtcaccttgagaggctccgccatccccgagtgaagcagcgcgtcac

SEQ ID NO: 27538 - DNA, 61 bp, Chlorella protothecoides
cgcacgagggtttaggtagaccctggaaggagggtgcgtgacgaacttgcaccaccaagtc

SEQ ID NO: 27539 - DNA, 61 bp, Chlorella protothecoides
gggaatgcgccttggcagagatgcgcagccgacatcttgcctctcagcacaggtgcgcggc

SEQ ID NO: 27540 - DNA, 102 bp, Chlorella protothecoides
ggccggagccccgtgtcgtgcagctgccactcgtcgtccacgagggagtcctggaggacggagtcctgcgcatcaagtctttggagcttcagcatggggctc

SEQ ID NO: 27541 - DNA, 89 bp, Chlorella protothecoides
cgtcagcttcctggggcatgtcatcagcgccgatggcatccgcatggaggaggacaagctgcgcgccgtccgggactggcccgcgccct

SEQ ID NO: 27542 - DNA, 71 bp, Chlorella protothecoides
aagtactctcatcagatgaaaatgccacaggaggcaactgtagacggatgttccagcacagaaagcgccgc

SEQ ID NO: 27543 - DNA, 89 bp, Chlorella protothecoides
cgcggcaggccacagccactccgcgccggcgcacgcggcgtgtgtggcggcgggcgggcagtgcatcgtgctgagggacggcttctacc

SEQ ID NO: 27544 - DNA, 65 bp, Chlorella protothecoides
cgtccagcggcggcaccctcaaaaatccacccccccccactgcagggcctttgccgacagcaaga

SEQ ID NO: 27545 - DNA, 61 bp, Chlorella protothecoides
ggtgtggcggggcatcaagcctggcagaggtaggggatatgttgatggtgcccaaccatac

SEQ ID NO: 27546 - DNA, 61 bp, Chlorella protothecoides
cctattattgccaaaccccacttcaccaaatgatcacagtccgtgtacggcattcccaccc

SEQ ID NO: 27547 - DNA, 61 bp, Chlorella protothecoides
atggccatgccgttgccagagtgcataaacgtcgtgtgcaacaacgtgaagggcgtgttct

SEQ ID NO: 27548 - DNA, 61 bp, Chlorella protothecoides
ccatcctcgtccacggccacctcgaactccacgcgcttgctctggaggcaggcctccaccg

SEQ ID NO: 27549 - DNA, 61 bp, Chlorella protothecoides
ggattggagacacctggtacacttgatgaagaatagcaccccccttcaggatccactctag

SEQ ID NO: 27550 - DNA, 184 bp, Chlorella protothecoides
gagagctcgagcccccggtccatgtcggacctgctgggggtggcacaggcccgcaccccgctcacgctcgccgcaaggagggagccaggcagcctcgctgcgccggtcgccaccccgagcctgggacgggttcccctggtggcagatggcacgacacccatcgccacccaccagccgccccagc

SEQ ID NO: 27551 - DNA, 134 bp, Chlorella protothecoides
accaagatgagacattccctgtccgcaggtgcaccccggggggatgccttctgtgaggtggggaatactggcgcggtgggcgactgccggcctcaacttgggttgtctccacaacagtacccggctggaggacg

SEQ ID NO: 27552 - DNA, 62 bp, Chlorella protothecoides
cacagcggcagcgacggcgagggggacgaccaggaggacagcgagagcggggatcaggagga

SEQ ID NO: 27553 - DNA, 120 bp, Chlorella protothecoides
gcagcgagcacgccccggaccacccttggcatccgcttccccccaccccatgcaccaccatccagccagactgcacgcaccagggggtccacggaacggagcacgtagtccttcctgccc

SEQ ID NO: 27554 - DNA, 61 bp, Chlorella protothecoides
atgtccacctggggaatcatgctcctcgccaccccccacacccatgcggacaccacccccc

SEQ ID NO: 27555 - DNA, 71 bp, Chlorella protothecoides
caccaagcacctccatccccatccccgcgcattgcgtcgcggggcccactcacggggaagagcgcgacctt

SEQ ID NO: 27556 - DNA, 76 bp, Chlorella protothecoides
tgtgcacagagtccgtgcaatggaaggcatgccaagcatctctcaccatgtcaaaacctcgcgcccacccaagtca

SEQ ID NO: 27557 - DNA, 72 bp, Chlorella protothecoides
cccccccccccccccccccccccttcctttttctaacccaaccacagagtcgcccagcgggctggtagcgga

SEQ ID NO: 27558 - DNA, 62 bp, Chlorella protothecoides
agactccggagagggggcccccacaacacaggcctgcggtatctaggagctgggcgagccca

SEQ ID NO: 27559 - DNA, 77 bp, Chlorella protothecoides
caagactttctcccatcaaagtacatgtgatacgtacctgggaattacctaggatgtatgctgtgcccatgcattcc

SEQ ID NO: 27560 - DNA, 61 bp, Chlorella protothecoides
cagctaccaccaggaacgctgcaagtggagagcagtggtgacgtcagcacagtgttaacac

SEQ ID NO: 27561 - DNA, 71 bp, Chlorella protothecoides
ccaaacctatagccggcgggatcctttacgcaccatccttaaagtgacacacgtggggagctcgtcttaca

SEQ ID NO: 27562 - DNA, 93 bp, Chlorella protothecoides
agctcgagagagaagcccaggtggttcaaggcgacgagaagagattgaagtctctgtgctttaactggtattgtcacgtccaaacgtgtgtca

SEQ ID NO: 27563 - DNA, 61 bp, Chlorella protothecoides
gtaatgggggcccggtatcacgtgatatttcgacactctgtaactttgactccatagaccc

SEQ ID NO: 27564 - DNA, 1737 bp, Chlorella protothecoides
  modified_base (1072)..(1258): a, c, t, g, unknown or other
ccttgctattcgccttgtgcacatggaaggcatccttcagatggatttgaagttggaatcgacagggtaataatgcagtgcaatttgagaacagacaattccgacggccctgagctgggtgggaatcttctcgccataatcgccgtcgatgaatgctgatgctggggttttgcatgccgcagataaaagtttcaaacgatgagaaggcgggtcgtacgagtttgcagcgatttgaggaactgaagagagacgatttagtccatcttactgaaggttgtctcggtgcgacaggcagtaatgcgagacgctggactgaagagccagatgttgctgaatgtacgatggaaggaggttcatcctgttgaagttttgagcacttcccccaatccatggagagctttctgggcgacgcagggagagcttcgagtgcaaacgatcaagcccaagcttgacaagaagctatgccattctggtgatatttggaaaggggcaggaaggaacgatcttcagctcgttgatacactgcacaaaaggacattgatctttcgcttttcttcgctcacgtttcatgagctctttgggtgtgtccaaggatggtagctttggggacttctggggagcgctcgttataaaacatccaaagcgtcatcagtcaataaaggactcgccactgggatcaatcgacagaggtcctgcacggctgacccaggagaaggcaagaaggatgccggatgacggcgatttcccacttgtatgcaagcatgtgcagccatcgctcaagttttatttgctccaatcagttcctgcgatggagttccccatacacgcatgttatccagaagtaagtaagattcaacacccactacaggacaatcaaaccccacacgacacaaacaccctcccattcaatctgatgaggggaaatacctattcgtcaggaatggtccacccatgtttcctacgtgtgccaatactggaactgcaccctataataccgatgtgtgtctagggaattgtagatggtcatgtctgttagttttatggttctgtcgtgaatctgcagattcgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttgtacaacagctccatcttaagcggaactttgattttatacatgaccagcagtgcattcagactgcaccaaattatagatttaaggtcgtaatgttttcagctaccgttcattccagggctgctatgtttgctgtcaatcaggaatcgcagcaaaacaatctacctgacagcccgaacatggcatccggccactcgaggctctgcccggctgttacgcatcaatattgagggccgcacatagcccctgtagacgaatgtccggagatgctacaagttcatgcacacagcaagacagggtgcgttactctcagacagttgcgtggctgctccttctctcaccacattgcgcgcccagcctattgcattttgtttcgttgttgtttggactgagagcagatgaccagacgtcattgtggacctggaccatgtccctctcgtaaagagtacattcttgaccttcctggactgcttgct

SEQ ID NO: 27565 - DNA, 79 bp, Chlorella protothecoides
gcgggagacaaagcgacgaaggcgcctggctccgtgatcgaggatcgcccccctgttccttgctccccccctccagccc

SEQ ID NO: 27566 - DNA, 62 bp, Chlorella protothecoides
gcgacagaagcacctctgtgctggctgtcttatgggtcgggtacctgcgggaagaggggggg

SEQ ID NO: 27567 - DNA, 62 bp, Chlorella protothecoides
tgtgaccccctttgatcgcggggatgatggcaccaacactcgggacactcgcgagcatgttg

SEQ ID NO: 27568 - DNA, 315 bp, Chlorella protothecoides
tggaggcatgcgagccggaggttgtacggtgttttctcagtatctcattgcccaagcgaagtttacaagagttattaggtgccaatggggcttaggatcaagcaggagttgcacacgcacaaagggtttcggtgtccaaatgattcccgcgaggaaattttgccaacaggagtatatttcccaggctatcacagtacagctttttgacacggccattccattcctactgtattatattgaacacatcatacactccaacaggtccagcaatgtgcgcgaagtgtcgttgcagggcccagccgggtcgtgtgcgga

SEQ ID NO: 27569 - DNA, 61 bp, Chlorella protothecoides
agaccgtccagctctgaatttcaccaggctgcggaagtgatcttgggtgcacttgacagcc

SEQ ID NO: 27570 - DNA, 75 bp, Chlorella protothecoides
gcggcttcctcctcaatcaaaccggaccattcgtgtctatgggttaacatgccttcatccggtgcgcagatctga

SEQ ID NO: 27571 - DNA, 79 bp, Chlorella protothecoides
acttgaccctgcactggtaggcctggtggattactattcttccatccaagtgtggtttcatgtgtgcatgagactcttg

SEQ ID NO: 27572 - DNA, 61 bp, Chlorella protothecoides
cccttccatggaaacatctcattggccagggaaggctgcaagggcattgtcggtgaaaggg

SEQ ID NO: 27573 - DNA, 95 bp, Chlorella protothecoides
tgctgctgctcgccagttgtgccttcgcggtgagtcccagtgcactcaggccgatgacgatcccatatcatccacgctgctacaccgcggcgtcg

SEQ ID NO: 27574 - DNA, 79 bp, Chlorella protothecoides
gtggatcactccgctgggtcgctgcaagcacgccgatcaacatccaaattcaaggcctccccgcaccccacactcccgc

SEQ ID NO: 27575 - DNA, 61 bp, Chlorella protothecoides
gccgcgctcccccgccacgccctccaccaggcccagggcaagggcctgcggcgactggcgc

SEQ ID NO: 27576 - DNA, 107 bp, Chlorella protothecoides
cataccggtctgcagggatggtgggaggcttggtttccttggagggagggtggagaggagcatgacgggcaccatggaagacgggagagaggccactgtgcccactc

SEQ ID NO: 27577 - DNA, 149 bp, Chlorella protothecoides
tactggtactcccaatgttggaggggcacggtgctccccccgagaccggttttcttgagggcatgcggccagatggcggtgtccgaatagtcgcaagcaggcattcccaggtcgcgtgcagggtccaggacgtagatggagcatgatgc

SEQ ID NO: 27578 - DNA, 73 bp, Chlorella protothecoides
agggctggcgagcaccacgccctgccatgggtgtgtgtgtgtggagggactggatcacccaggatctgccaag

SEQ ID NO: 27579 - DNA, 102 bp, Chlorella protothecoides
gagggactggatcacccaggatctgccaagactgcaccattgaggacggggcactaccacagctcatgcatatatcaggtcctggtactccttccgtgcccc

SEQ ID NO: 27580 - DNA, 136 bp, Chlorella protothecoides
gctcgccgtcaggatcagggtgtactacgcaggggttagccatggtgctgattcacaccagagatctcaatcataaacccgtccaacaccaccatgactcttgctgaagaaaaagactggcagtgtttctcagcac

SEQ ID NO: 27581 - DNA, 74 bp, Chlorella protothecoides
gacagttcggttcactgaccgaggtggcccaccgatcccgacgagtgagggccgccacagcccagcacccgccg

SEQ ID NO: 27582 - DNA, 66 bp, Chlorella protothecoides
gccgccttcgacccgcagggcatcttgaacccctacaaggtcctgccaccggagtgatgcatggac

SEQ ID NO: 27583 - DNA, 61 bp, Chlorella protothecoides
caaggaacctggaaaaggttctatatctactccagcaccagaggacccgacacgaacgcgc

SEQ ID NO: 27584 - DNA, 78 bp, Chlorella protothecoides
attcaaggcctgaggatctggactgggtgggtgacgcgctcctcgggttcaaaccctggcgacgttattctcatagag

SEQ ID NO: 27585 - DNA, 66 bp, Chlorella protothecoides
gggggtgcagcatggagcagggcatatgcggttaaagagtgcaccgtgtagctcacccatgaacat

SEQ ID NO: 27586 - DNA, 61 bp, Chlorella protothecoides
ccatgatgagagcactcaatgaaatggatatttgttgttacagcattggagggcatgaggc

SEQ ID NO: 27587 - DNA, 61 bp, Chlorella protothecoides
cggtgtcacccctgccaagaagaccccgccacccctcactaagacgagtgcggcacctccc

SEQ ID NO: 27588 - DNA, 642 bp, Chlorella protothecoides
  modified_base (195)..(404): a, c, t, g, unknown or other
tgggcgatccgcatgatgtcaggtggggaaatcgggcagattgactccagagtgctggcggttggggcatgcattcatgaatgtccctgattgaccacttgctcgcgggattgatgagacttgagaccgggagggaggttgctgagggtgggagcttattggtgtatgccaatgtgcaaactgggactcgcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggtgtgactgcatgaagctggatggctgctgtctgagtcatgtatgaccggctggaggggctcctcgcgcagatgcccaagcaagaatacgcatgtgggtttcaccgtgatgcgcccgtgagcaaggctcaagcattcgcattcagcatcatccactctccgcatgcctgccccacccactcacaccccaccctcgcagacggaaagtccatcgccagcccccagttcaagctgg

SEQ ID NO: 27589 - DNA, 71 bp, Chlorella protothecoides
acgttcaggtcggagtagacgtactcatggctgtctggtccatggtggacgaggcgcatgaagagcatgcg

SEQ ID NO: 27590 - DNA, 133 bp, Chlorella protothecoides
gagctcagaggggcggaggagggggaagggacgggggatgacgggccaccgggctgattgggcggtgcgtgatgcttgagaagagggcggcgtgcttggacgccaggctcttgcgatggaagtcgatccctgg

SEQ ID NO: 27591 - DNA, 61 bp, Chlorella protothecoides
gcagatcaaaacttggaatttgcagcgtcatgatttctggccgtgagtccctcgggcccga

SEQ ID NO: 27592 - DNA, 74 bp, Chlorella protothecoides
ccagttgcccacgcccacgatagtggtcattccaggggggggcgcggaactgctccgcaagccggttgatggcc

SEQ ID NO: 27593 - DNA, 76 bp, Chlorella protothecoides
gacttgttgagggccacatgcaatggcctccatagcttcacaatcacgggaagccgtcagcctctgagaaactctc

SEQ ID NO: 27594 - DNA, 72 bp, Chlorella protothecoides
gcataccgacgccaccatgcctccagcctctctcagaatcggaagaccatgcatgcagcctccacctgatca

SEQ ID NO: 27595 - DNA, 120 bp, Chlorella protothecoides
ctcgtcgcaagtgtacgatgtcgaggccacggaggtcaagcccagcggtgagttgcctggcaggcgtcgccagtgacgttcagattggatgctcctgggagcgcggtggcaatagtacct

SEQ ID NO: 27596 - DNA, 69 bp, Chlorella protothecoides
gagcttataccccgccgccaggtgcatgtccttccagaacgtttccagctggtgccgcacctggtggta

SEQ ID NO: 27597 - DNA, 65 bp, Chlorella protothecoides
tgctgcggtgtacccttcaacaaccgtgcgatgttgctgccccggggctcggtaacgcgctttac

SEQ ID NO: 27598 - DNA, 623 bp, Chlorella protothecoides
gcgggcggcgtggacgccgcgctcacgcgcctggccgggttcgtggaggacacgctcgcgccggggctgaccccagccgcaaccccctccgccacgggcgcggccacgccacggcgcgcctccgccctcgatccggcgcgccgcgcctcctccgagtccagcgcctcctggaccccggccgaggcggtggaggagctggtggcggccgcacggggcgctgcctcgctgcagccggacggcacctcgctccccgccgcgcgctgcgaggtgggcttgcaatcactgagggcggggttcgtgcatgtgtagtgtggtgatgcggcgtgcggaggttgggacgggggcggccgatgctggcgtagttggataccctggccggcaccgcaggccccccacgtgaggaatcctgcagggttgacggacacccaagggtctcctgtgccgatgcttgatgagtcaccgctcagcaacccacacccatccacccggatacccacattcccccttccatccgcaggacctcgtgggtgtggtgcagcaggtgctggacgggggcgaggaggcggggccccgcggccggctggcgtcggggggcggcggctccccgcccgacggcgccggcg

SEQ ID NO: 27599 - DNA, 79 bp, Chlorella protothecoides
acgtcagcatgatgcaacttcccttgtggcacatcaacctcctgccctggactggaacgaggaccacgccaccccatgc

SEQ ID NO: 27600 - DNA, 92 bp, Chlorella protothecoides
gtgaggcgggagatggggcggccgatgcgcttgaagtaggggtcgatgaccaggtcaaagagggggacccagatgaggacggaggtggagtc

SEQ ID NO: 27601 - DNA, 61 bp, Chlorella protothecoides
ggttatgaggtactgtttgtcgtctggaaggaagggtcttgccttccgtgcatcacccgct

SEQ ID NO: 27602 - DNA, 97 bp, Chlorella protothecoides
gcaggggtcgttgttgagaaagatctgaatgaggtcgttgggctgcatgcctgatgctcgggcgggtaggacccatgggagggagagcatgggcgga

SEQ ID NO: 27603 - DNA, 80 bp, Chlorella protothecoides
aggtcgtgggaaagtgcttcctgactggataataccttccaattagcacgggggtaagacccaggagcccagtgtgcagc

SEQ ID NO: 27604 - DNA, 61 bp, Chlorella protothecoides
ccgatggatcgcgagtgtggaagaccagccaccccagcctcgccactctctgtgccttgct

SEQ ID NO: 27605 - DNA, 61 bp, Chlorella protothecoides
taactgcactcggcgttttctatcagcgggtgcagccgctccggatcagatctgagctcat

SEQ ID NO: 27606 - DNA, 66 bp, Chlorella protothecoides
gggtgagaatttgtatcggtagttgccatccaattccaggaaagaatcggagccgaaggcgatcgg

SEQ ID NO: 27607 - DNA, 61 bp, Chlorella protothecoides
ccccagccccatgtcgtcggccagcacgccatgcaggcccgtggcgcgaaggaagcagagc

SEQ ID NO: 27608 - DNA, 62 bp, Chlorella protothecoides
aagagtcaacaaaaggactcgtgtatctgctcatggcctgtcctcacttttcaacccaaaca

SEQ ID NO: 27609 - DNA, 68 bp, Chlorella protothecoides
ggccgaccctgtcccacacgaactcgcattccgatccgagcataccttcagccttggactgagctttg

SEQ ID NO: 27610 - DNA, 80 bp, Chlorella protothecoides
ctttcctgtaacataagactctgacaggacaaatccgagatttgcaatgtagctcttgaacatgccgccgctggccacaa

SEQ ID NO: 27611 - DNA, 68 bp, Chlorella protothecoides
ctggccatagtcactccctcccgcacatacttcaacaaccccccctcccccccccccccccccccccc

SEQ ID NO: 27612 - DNA, 195 bp, Chlorella protothecoides
ccattgtacgatcctgtatcctcagtaatggaaaggtgagatgacttggtctgcagagatgcttcagggattcaagagcgtactgtttgaacctggtctgaaaatgagacctggctaggtctgacaaggatgtgttacatgctggatgaccgtggaacatccggcgccatatttgatactgcagggaccggatgg

SEQ ID NO: 27613 - DNA, 110 bp, Chlorella protothecoides
ccagccgtaactgttgccagggtgtgcttgcggtcccacaaaccctccaggtacaacaagtcgatcatcacagcatgcagggcaccagcatgggcacaggactgcggaaa

SEQ ID NO: 27614 - DNA, 61 bp, Chlorella protothecoides
gatagagatgccccagaacgatgacatgcaactgtcagaggccagcaggcatgtcggggcg

SEQ ID NO: 27615 - DNA, 103 bp, Chlorella protothecoides
gtgaccgacactgggctttgggtgaagacagggctctaattttgatcgacacctccctcaaaacaagccgatgcatttgttacacacaggcagagatcgcaca

SEQ ID NO: 27616 - DNA, 61 bp, Chlorella protothecoides
cgaccgcgagaagtcggtggcgggcgtcccagacctgcccagcgccgggaagctggtggag

SEQ ID NO: 27617 - DNA, 114 bp, Chlorella protothecoides
gagtaagattggtggcatccaggcgatgtgcgtggcatggtggatttttaccgccacgagatgttgtactcaaggttacctccaccatacaccctgtgcactccattggcacag

SEQ ID NO: 27618 - DNA, 71 bp, Chlorella protothecoides
ccaggaggacagtggactgggcgatgcatgtttgacaaaaatctttgcagggcagtccagctctttcccac

SEQ ID NO: 27619 - DNA, 80 bp, Chlorella protothecoides
atgccctctgagcaggcaacgagagccagccagcccatctgtcaataattgcgcccgccacctcaccacctgggtgccat

SEQ ID NO: 27620 - DNA, 75 bp, Chlorella protothecoides
gctccgttgggaacaacggcagcatttcccccctaaggccccccgccccgctcaaacaactcacgggtttgtgat

SEQ ID NO: 27621 - DNA, 61 bp, Chlorella protothecoides
ggttaccttgacatgccgctctttcttcttcttctctttcttctccctcttgtcgtcacgg

SEQ ID NO: 27622 - DNA, 109 bp, Chlorella protothecoides
ggcaggtgctagggttcgcccccccccccccgcgtaaatttcagatgacctcgatgctacctacggagcatgtcgacacctcaatagtgttttattatggcatgcaggg

SEQ ID NO: 27623 - DNA, 71 bp, Chlorella protothecoides
ccccttcccacctgggctgcctcgatctcaaaggcgtgcaactcgcggtcggggtcgatctccaccgggtc

SEQ ID NO: 27624 - DNA, 1319 bp, Chlorella protothecoides
  modified_base (463)..(472): a, c, t, g, unknown or other
aggagcccgtggccgagccgggcgaccgcgacggcatccagtggcgcgagcccgccagcccgctggcgcccctcgccctggccggcgaggccagcgccgcgtccacgggcggcgccgtgccgggagcgggggaccccaacgtggcgctggccctgcagcgctctgcctacctggtgttcagggcgctgtgcaagctgtccatccgcagcgtggacggcgggggggggacggacgccaccaccgcccgcggcaaggtcggcggagcgtgtggttcgtgtttgtgggggatgagaggggggtcccagcggcgtgcatgcgtgtgtgggaggctcacgcgggctgtccgcagggtgactccgtgagcgcgacccgaacctgcgcacgctttccggctgatcgacgcttttcagagagcctctgatgcatccagttcccttcccttcctcatcgaacaacacccacnnnnnnnnnnggcagggtgactccgtgagcgcgacacgaacctgcgcacgctttccggctgatcggcgcttttcagagagcctctgatgcatccaatccccttcccttcctcatcgaacaacacccaccacccccgccaccccttcatacacacactcaaaattaggtgctggcgttggagttgctgaagatcgtgctggagaactcgggcccggtgtttgccaccagcgagcgtttcatgggcgccatccggcagtacctgtgcctgtccctgctcaagaactgcgcgagctcggtgcccgccgcgctgccgccctgcgcctccatcttcctcacgctgctgacccgcttccgtgccgcgctcaagggcgaggtgggcgtcttctaccccatgatcctgctgcggcccatcgaacccgtgggcgcgggcgtgctggcgcacaccacgggctccgtgggcggcgccgcgccggtggacgtggcctaccgcggcgtggccctggcctgcctggcccgcctggcggccgacggccaggcgttgatggacctgtacgtcaactacgactgcgacctggagggggccaacctgttcgagcgcaccgtggcggcgctggtgcgcctggcgcaggggtcgccggggctggaggccgccgtgcccgcgcccgccgaagagcgcgcgctgcgcttcgaggccctgcgctgcctggtcaccatgctgcgctccatgtcgacctgggccgccgagcagcagcgcggcgcggggccgggtgggcacggcggcggggctggaggggacggggcggacgccgacgacggcgattccaccggcgccgacccgtcgacgcaccgctccgcgg

SEQ ID NO: 27625 - DNA, 61 bp, Chlorella protothecoides
ctaccccatgatcctgctgcggcccatcgagcccgtgggcgcgggcgtgctggcgcacacc

SEQ ID NO: 27626 - DNA, 1724 bp, Chlorella protothecoides
  modified_base (472)..(481): a, c, t, g, unknown or other
  modified_base (1022)..(1031): a, c, t, g, unknown or other
cggcgccgccgcgccgcgcgtgtgctgccgcttcggccagggcgcggcggggtgtgcaagccccgccagcggcgccccgcagctcgacgcctcgcccgcctcgcccgcggtggaggggccgctggaggcggagcgactcgccctggccctcctcctcgtgcccgagctggagtggcggtccagcatcgagaacgaggacctgctccaggcggtgctggatttggtggacctgtcgcagcacagggtggtgggcttcgaggtgagatacctcgagtcccagtaccagcagctgacgctggaggagcctgcgggggaggcacccttggggaaggcgcttggctctgcgttgctgcagcgggagacgggtggcgggcagcagcggcaggaggcagagcagcaggcagcaggggagactgagggcctgagcgaggctctccatggggaccccctggggggccaggatgcggcgggnnnnnnnnnnttgagcgcctgagcgaggctctccatgggacccccctgggaggccaggatgcggcgggtgagggcctcagagcggtgcagtagctgcatgttcatccagtcatcctgggcagcaggcttgtctgacgaggccgcagacttgcagttgacacggccactgcctggccgtacgagccctgggccattggccatgtggggggtgatatcagtcgcatgcctttcctccctcatccatgagcaccgactgctccatgcgccaatcctttcctcgtgtactccttttcctgcacagtactggtctctcttccttccatgcagcagcctgtcccacgtccccatcccgtctctcgattctgctgtaatgcagcgtgcagcaccagtgtccttgcacgtcaccaatatcagtggggtagaggaatgccagggactccatcaggcaacagtggccagcacacagggtcgagcatgcctgttctgaatcaggcttccaaagaggcagcggcgaccagcgtcgtggaagccatgctggcactcaggcgacnnnnnnnnnngcagtggccagcacacagggttgggcatgcctgttctgaatcaggcttgcaaagaggcagcggcgaccagcatcgtggaagccatgctggcactcaggcgaccagcaccccacacccgcggtgcgcgtgagccatcccaaacttccgcacccccgtggcaccccttcacagcgcatactcgtacgcgggcgccacccccttgaccccggggatcctgatcctgtacaggccgccgtggtgcttgtgcgcgccctcccccgtctccacgcgggtggtgacgtacaggtcgcccaggtcccgcccgccaaaggtgcaggcggtggggcgctgcaccggcagcggcactttgtgcagcacggcgcccgactcggggtggtagcaggtgacctccccgctctcgccgtgcgccacccagaggttgccgtcggtgtcgatggtcatgccgtcgggcaccgtggcgagcccgctgggccggtgcgtgaccgtgcgccagctcagcgcgccgtcttcgccgcggcgcatgatgccctgctcgtccgcggcgtaggcgcgcacctcctccgtggaggagtcgatgaagtacaccacgcccttggcgccgtcccaggcgatgccgttgggtagatgcacctcctcggggctcatcacctccaccagcgtgcttcacagggggccggggcgtagggggttggg

SEQ ID NO: 27627 - DNA, 78 bp, Chlorella protothecoides
ggaagcgcagcctctgcgccgcaactcagttgcaatagcattacataaagtggccaatctcattgcaattcaagtttg

SEQ ID NO: 27628 - DNA, 61 bp, Chlorella protothecoides
gccaaggggtcgtggacaagggagtacgacaccgcagctgccatcaagcaacgcaacgccc

SEQ ID NO: 27629 - DNA, 62 bp, Chlorella protothecoides
ccttcaccaacacctgcactgagggagaccagctgcggcaggatcacgccaaacaccagcgc

SEQ ID NO: 27630 - DNA, 159 bp, Chlorella protothecoides
cagcatctgcagcgcctgcgagaaatggagggggaaagggcagacgatgggaagtgtgaggctccaggatggactgtaaaaaagtatctctcatcccctggcttcctgcatggctgaaaaatctccagggcccgtgatgtgctgcactccattggtccc

SEQ ID NO: 27631 - DNA, 61 bp, Chlorella protothecoides
taggagcaggtgtcagaacgccacttgctttctctcccgatctggctccctcaaccacaga

SEQ ID NO: 27632 - DNA, 75 bp, Chlorella protothecoides
tgcaggattgctgcagcctcttcaccccactatgttccctgctgcccatgcaggaccaggtggagttgctggaga

SEQ ID NO: 27633 - DNA, 190 bp, Chlorella protothecoides
cctcgtccgagccagcctcatcatcgctatcgggcgtccaagcctggagtagcctgcagcaggatcgatgggaggtgaggcctgatggctgacccttcagcagagggaagcagcaggctctgcctgcacatgcgatgtgaggcccatccttgtgccgaacactcatcacaaggcacaggatcccatccag

SEQ ID NO: 27634 - DNA, 121 bp, Chlorella protothecoides
tggaccctggaagctgcccgggacgtgcgcctgggagcgagagggttgtccctcatcgaggaaggtatggctggatgttgcttggatggagggcagtggcaaggatctaccacatggtgct

SEQ ID NO: 27635 - DNA, 72 bp, Chlorella protothecoides
cccatgcctgggcccgatggagggccctggaatggcacatgccatgtaaaccctgagcatgatgggagcgcg

SEQ ID NO: 27636 - DNA, 1229 bp, Chlorella protothecoides
  modified_base (230)..(239): a, c, t, g, unknown or other
  modified_base (431)..(440): a, c, t, g, unknown or other
  modified_base (680)..(689): a, c, t, g, unknown or other
gtcctccgtcctcaggtattccagcttgcactcgtagacaggcatgttgctgaagcacacgacctccttgccaacgttgtaatcgccgatattccgatccccagcgttgaagctgcctgcggtccagaggtcaagcgggtgagggcagtgctccttccctgggaggggttgacataccctgcgcccggcccagccccgcctcaccctggttgtcgtcacccctgttgctnnnnnnnnnntttgcagtcagactcggccatgttgttgttgcacacaatgttctcgccctggttgtaatcgccaacgttctgaaggccagtgttgtggctgcctgcggtccagaagtgatatgtttgagtgcaatgctcctacctgcgtgggggcccaaccccgaaccccagcccagccccgtctcaccctggttgtcgtcnnnnnnnnnngttgccgtggttgcgactccccaggttgttgttgcccacgttgccattagcgtccggctggcaggctggcaccccgctgggcaggccctccacaaccgagacaaaggcgcaggccggatccttggaggggatgcagacccgatacgtggaaggatccagggtgctgatggagaaggtggggaaggggtaggaggcattcagctccatcgtgtccaccagcgcactttgtgcatagccctnnnnnnnnnnatccttggaggggatgcagacctgataggtggaaggatccagggtgctgatggagaattcagggaagggataaggggcatccatcgccatcttgtccaccagcgcactttgtgcatagcccttcaacctgcgggatgggtggttggacgtcagtggccctgcaccgccccgtaccccgctcctgttggggtaggggcgcctgctcaacgcaggcaggcctcagatatgcagccgcctccctgcgcactcacttgcagaatgcgtcggcaccggagctggccaggaggtacagagcgccttggaaactggggggtggggaatccaggaggggtccgcggtgtgagatcagcctcagaccctgcaccgcctcggcaagacagggcccgtggacatcaggtgttgctgcccaaagcccggcatggactcactctactgtgggcagcgcaaaccacttgatggtcgggtcgcactcttgtccagggggtggggacgggggaggcaagggcgggggcaatgggggcggaggagggggatttgggg

SEQ ID NO: 27637 - DNA, 63 bp, Chlorella protothecoides
cagagacatcaaggcagagaatgtactactgcacagcaacggacagtgggtgttgtgcgattt

SEQ ID NO: 27638 - DNA, 73 bp, Chlorella protothecoides
ctcgcgctcccaagtgaccttgcgcgatgctggaaaattactgtgcgacattcgcgacaagtcgaaagacgtg

SEQ ID NO: 27639 - DNA, 65 bp, Chlorella protothecoides
tctccggagagggggcccccacaacactttcacatagggcagggttctttcacacagggcagggt

SEQ ID NO: 27640 - DNA, 61 bp, Chlorella protothecoides
gttggctgctccgtttctgggagcgactgcaggtgtgctgtttaccagcagcgaagtgcgc

SEQ ID NO: 27641 - DNA, 73 bp, Chlorella protothecoides
cctctgtctgcgtcgcctatggcattggcgcgagcctggctggacgcgtcgcgcagctgcctttcgtcagcag

SEQ ID NO: 27642 - DNA, 61 bp, Chlorella protothecoides
cttcttctgtggggtccagctggttgatgagaatatagagagtcaggtcttgctgtctagg

SEQ ID NO: 27643 - DNA, 73 bp, Chlorella protothecoides
tgcagatgccgcatgcctgccgtttctgtgcggccacggctccacttgaaagtatatcccttggaccccacct

SEQ ID NO: 27644 - DNA, 72 bp, Chlorella protothecoides
taatcacaccgtcttgttcccaagcgtgcaggtggtggtctcgcagctgtacagggctggagccgacgagga

SEQ ID NO: 27645 - DNA, 112 bp, Chlorella protothecoides
tgaacctggccagacccaccagacagccagccccgccctctggcatccccttcagcctcccagatcaggaaagagtgcaaactttcgaaaggctcacatcgatgatgctgcg

SEQ ID NO: 27646 - DNA, 107 bp, Chlorella protothecoides
atgcgagccatgtccattgcgcaccgacgcgaccaactgagctgccagacgatgggccaaggttgtggggccgactcgcgaacttgcacgacattgtgtacgagtgc

SEQ ID NO: 27647 - DNA, 69 bp, Chlorella protothecoides
tgaagggcttccagattatacattgggggggggcacggggttctgattgacgacgagagattctgatcg

SEQ ID NO: 27648 - DNA, 211 bp, Chlorella protothecoides
agcttcaacctgttggacactcacgagcttgatgcaacatcactctgcccggctcagggacaatggagccaccagcatggccaacatgtttgtccctcatgggcactgtaaactcctcttcaaagagtcagctgaagcaccctccccctcccttttgccccttgctgagataccactctcagcaccttttgctcgataaagaaggctggga

SEQ ID NO: 27649 - DNA, 78 bp, Chlorella protothecoides
atgaaactacaaggttgaggtcggttggactggggtgatggctcgatcgggccgagggtgatcatagcattcattctg

SEQ ID NO: 27650 - DNA, 249 bp, Chlorella protothecoides
atccttgccttccgtcgtcggtgtttcctgccttgtgtactatttgtcgtctccggacataacatcgaatgtgggtacctgcgtggcacactcttggggcatctcatgtcagggatggcatggcgtcatgattcaggagacaacatcctgcatccacattacagtataccacccgaagctctgttgtgggctttctgcactatacatgcaggcgcaggcctgtattcacctctgggctacagcgagttg

SEQ ID NO: 27651 - DNA, 346 bp, Chlorella protothecoides
  modified_base (92)..(278): a, c, t, g, unknown or other
tcggcagtctgaggcgcccagccatttccatgccctccaatcgtaccggtgtgtgtgtggggagggaccttggttgatgaagattgaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaagattcccacatccttagcgttgacctccttccatcgatcctgccaggacgaccatggctgtgct

SEQ ID NO: 27652 - DNA, 66 bp, Chlorella protothecoides
ccaggacgtgccgcacctccgcgccgcgcatgccgtggtgctgaagctggtgggcggggatggggc

SEQ ID NO: 27653 - DNA, 161 bp, Chlorella protothecoides
tgtgtaagttaacaacctcgtgaagtttggcagcccctcaccaaaattacgttaaccgcagcaatctgccagttgatacctctagtgtacgttgagatcctgtttcaacaatcatcttgacgaaccatcgtttccccaggtgcgagagcgcgccactttga

SEQ ID NO: 27654 - DNA, 96 bp, Chlorella protothecoides
agaggcgatggagatgagagtgagtgggagcggaaaggcgcggtgaagcttgctagacatcccatccagcgttgccactcttgcatctcaccagga

SEQ ID NO: 27655 - DNA, 154 bp, Chlorella protothecoides
tgcattatgtaaaacatttggatcgagcaatgcgacacaaagagctggaatcatcatcgcaagagggcggtgcaatgtctccaggtaattgggaggttggatactgggagccatgtgaacaatagcacaaatctaggtatcagtaaaggtgata

SEQ ID NO: 27656 - DNA, 69 bp, Chlorella protothecoides
gccagcttgggcgaggaagggtgggctcccagggcccatcggcggaccccaatccgcggctgctctgca

SEQ ID NO: 27657 - DNA, 77 bp, Chlorella protothecoides
cctgccacacacaccctaaccctcccctcccccccaaaccatgtgcatgcatcgaaacccacctgcactttcttgat

SEQ ID NO: 27658 - DNA, 69 bp, Chlorella protothecoides
gtgagcagaatggtgaagctgcatggggcccgggtggccacgcagacgagaggactctgcatcagcgaa

SEQ ID NO: 27659 - DNA, 106 bp, Chlorella protothecoides
gtgacgagaggcctgcgattgtgtgtgtttaaacagtgggtctcagatgactctgcttgtttgggcagacatcgtattgacatgtgcaacatccatagtgtgctgc

SEQ ID NO: 27660 - DNA, 64 bp, Chlorella protothecoides
ggggacacgcgcgcgctgctggaggctcagcttgcctctcgcctgggtgaggggtcgggagggg

SEQ ID NO: 27661 - DNA, 64 bp, Chlorella protothecoides
cctctcgcctgggtgaggggtcgggaggggctcagtgcagtctcctggtgcagaggggattgtg

SEQ ID NO: 27662 - DNA, 65 bp, Chlorella protothecoides
gtcgggcgcggcggccggggctggcgctgccgaggcgccggggcccaggcctggggtaggctggt

SEQ ID NO: 27663 - DNA, 61 bp, Chlorella protothecoides
ccaggagtgggccctgcccctggtccagcgcgccctcaaggaggcgggtgtcacgccccgc

SEQ ID NO: 27664 - DNA, 77 bp, Chlorella protothecoides
tcctcctcctctccccccttctcctccctaacaaaacccagccagcaccccagcacccgcccaccggctgcgtcatc

SEQ ID NO: 27665 - DNA, 72 bp, Chlorella protothecoides
cgcgtcagcaactttgactacctcatgcacttgaaccgcgaggcggggcgctccttcaacgacctcacccag

SEQ ID NO: 27666 - DNA, 167 bp, Chlorella protothecoides
tgggttgcgggatctgacatgcgcatgcaggggcccttttcttctcgattggtcgccctgagaaggagtttgaaccaggttttgggctgtgatgaacgccatttaatgctctggaacagtggcagagcacgtgcagtggtcttcttgctgtatgttggagcctctgg

SEQ ID NO: 27667 - DNA, 75 bp, Chlorella protothecoides
gcagagaataatttgcaggacaagccttgctgcactttcttaagatgcaacacagcagctttacagcctgctgac

SEQ ID NO: 27668 - DNA, 62 bp, Chlorella protothecoides
ccccctgcccgatgaattcggggcatggtatactctctccttcccaggatcggcaggcccaa

SEQ ID NO: 27669 - DNA, 71 bp, Chlorella protothecoides
gcttctgcaggcaagattgagcggggagttgttgtgtggtatagtagtggaggggggtgaaggagccctgg

SEQ ID NO: 27670 - DNA, 61 bp, Chlorella protothecoides
aatgtgcagcgagttcggcagcgtgatcgccgtcaagggacggattggggagaagaaaaac

SEQ ID NO: 27671 - DNA, 63 bp, Chlorella protothecoides
gtacccaccacccagcgcacccaccacccaactcccccccagcccaccaacccccagaaatca

SEQ ID NO: 27672 - DNA, 83 bp, Chlorella protothecoides
tgattttcgcgtgaatgagattcgccaggagggaggcgtcgtaagactggtcaacaccaccgtccccaaggtcagcatgtagt

SEQ ID NO: 27673 - DNA, 62 bp, Chlorella protothecoides
gctcacagatgaggatggggctggccttggccaccttgcccacgtcctcgtccgactgcatc

SEQ ID NO: 27674 - DNA, 91 bp, Chlorella protothecoides
tacaactcagaactggcgccccgttttactgtcgcaagaccctgcaaaccccccccggaaacccccctcctcccaacaggcgcatgacagt

SEQ ID NO: 27675 - DNA, 124 bp, Chlorella protothecoides
tgcgagggcagatcacccatggccgaggctgcacagcatgcccgtgagatgtctcggtccgaccccgccactgaccctccagcaagcatcggctgtggcccccagtcggggcgccgtgatcctg

SEQ ID NO: 27676 - DNA, 124 bp, Chlorella protothecoides
cccctgcgagcgggttgggtggggttggtgagcggcctggcgagcgcagacgctggggggaagcgcacggcaccgcttccacatggctccatgaggcctgcgcagacccccgccgcccggcctc

SEQ ID NO: 27677 - DNA, 68 bp, Chlorella protothecoides
tcacatacagcccagggaaaggctcgtgcccgccgccgaatgtgcgagtgcaggcattcaccacgaat

SEQ ID NO: 27678 - DNA, 106 bp, Chlorella protothecoides
tgcggggggagccgacgcatgtgcgggcgctggagacggggatgcccaggacccagactcccccgtggcccatgctggccggccaccgttcctggcacccggccca

SEQ ID NO: 27679 - DNA, 79 bp, Chlorella protothecoides
ccagtatgcctggcctgtggagggaatggccaccaggtttgggtgaagaggccactgcgatatgctcagatttgtgcat

SEQ ID NO: 27680 - DNA, 61 bp, Chlorella protothecoides
aatgcggaatgtgctatcaaagcaacagtcagaccggggccaaggccctccatcgggtgcc

SEQ ID NO: 27681 - DNA, 77 bp, Chlorella protothecoides
catacttgattatgtgagaggccaaagccttatacacaccatcaaattgttatggcttgagggcgtctcagcctccc

SEQ ID NO: 27682 - DNA, 71 bp, Chlorella protothecoides
caaggtccactggccatacttctcccagtgctccctcccatgggctccatgcagatgccgcacttgggccc

SEQ ID NO: 27683 - DNA, 118 bp, Chlorella protothecoides
tccgatgcgaagctggtcttgcgagggtctttcaacagcactttggcccctcatcccactgcctccctagaacatgacggtgtcgcctgccaagttcgagctcaagggcgagggcttc

SEQ ID NO: 27684 - DNA, 78 bp, Chlorella protothecoides
gccctgctggcgcccctgcggcaatggctgtctgaggctggagacgatgagccccagcctgcagcagggcgtaagcat

SEQ ID NO: 27685 - DNA, 64 bp, Chlorella protothecoides
caacgctgtgcgaggatgagcatggcttcgccaccacacacacacacacacacagaggcaatat

SEQ ID NO: 27686 - DNA, 204 bp, Chlorella protothecoides
ctggttgctggccaggtgcaccatgctcagcccctggagcctgaaccactgtggcggcagcctccctgcatgggcggaggggcgcggggggtggtagggcgatgacgaggggcagcgcccctccaagcctcagaggttgactgcgctgcctcccaggcaggcgccgcacgattacacgctggccattcccccagcccctttgcg

SEQ ID NO: 27687 - DNA, 61 bp, Chlorella protothecoides
ggcggtggctggcatagggataggaggaggtgggagtcgggtcatgctgctgttgccctct

SEQ ID NO: 27688 - DNA, 73 bp, Chlorella protothecoides
gagcatgagggggtgcaagttctataggtcatgtgggtcgaagcaaaggagcagcagcatacgtgcaagcacg

SEQ ID NO: 27689 - DNA, 76 bp, Chlorella protothecoides
ctccacctcgctctcgctgtcagccccgcagttgagccgtctctttgccacagcatgggctggcgctggattcagc

SEQ ID NO: 27690 - DNA, 75 bp, Chlorella protothecoides
cctttattatcgcttttggaagcataccctcggctccctcaggtgctccatacctgctgtgctacagattgcaag

SEQ ID NO: 27691 - DNA, 61 bp, Chlorella protothecoides
ccacgcccgccgtggctgaccagttggcaggcctgagcctggacaatctccccaagtccaa

SEQ ID NO: 27692 - DNA, 78 bp, Chlorella protothecoides
gctcgtcactcccgtgtgtccgctcggctgggatcttgccaattatctcccccgcgcgcgctgtttcatgtggacgac

SEQ ID NO: 27693 - DNA, 61 bp, Chlorella protothecoides
atcgtgcactgacgcatatgagccggcagcgcatgtgctccctcccccgtccaccggcggg

SEQ ID NO: 27694 - DNA, 80 bp, Chlorella protothecoides
gagagagcacgaatagtcgtgctgtccctgccgtctcatggtgtacaccatgcctatgtgtgccaggcctcccgtgtcct

SEQ ID NO: 27695 - DNA, 79 bp, Chlorella protothecoides
gcaggggcactgagacggaacgggcctccggagtaattaaggtccctgcggaaggaacctcgcgatacactctgcaagc

SEQ ID NO: 27696 - DNA, 74 bp, Chlorella protothecoides
ggcaaggccgccacacaattctgaggtctttcatgaaacggagcgcctctaaaatgcagcaacgcatgatccaa

SEQ ID NO: 27697 - DNA, 61 bp, Chlorella protothecoides
aaaggaagtcctgtcccacgtcgagggttttattatccatacgaggaccagccaccaggtc

SEQ ID NO: 27698 - DNA, 94 bp, Chlorella protothecoides
gctgcctcagcatgatccttgtgcatatattcaaggaagcattgatggcataagtctctttcaatcctacccatgcctgctgcccctctcgacc

SEQ ID NO: 27699 - DNA, 103 bp, Chlorella protothecoides
taccgtgtcaagggcaggagatcatcacgatcccgcggatagagttctcaagagtgatgatgcctttcaaactccgctttcaagctgccttgcagtcatagca

SEQ ID NO: 27700 - DNA, 61 bp, Chlorella protothecoides
taccggatgcctggagaccgggggggagatagggattgggggtgcgacagggggggtgagg

SEQ ID NO: 27701 - DNA, 150 bp, Chlorella protothecoides
gttccactgcagtccgggcatctccgtgctgcccgacgggcccccgttgggcttgacgaggccaagggggaattcctcacagccgttcccctcaccaggccccagatgccagccatccacaaaccacctgcctggatgctggccgcattg

SEQ ID NO: 27702 - DNA, 61 bp, Chlorella protothecoides
gcagcgaggaggtgtgaggggtgtgcagggcctggcagcagggagagcatctcccatccca

SEQ ID NO: 27703 - DNA, 61 bp, Chlorella protothecoides
catcgataactcctctgcgatggtgcgcaagcctgatcaaagtcattcagtgtccgagtga

SEQ ID NO: 27704 - DNA, 115 bp, Chlorella protothecoides
gttcatgccatacagtagcagaacgaaaaacagacacagacatgtctccagcaaaccttgcaaggcaagacagtgggcacccattccccagacctcacgtcaatgtacagcatat

SEQ ID NO: 27705 - DNA, 73 bp, Chlorella protothecoides
aaggcagggccggggcagggggtgcatgtttgtactctggaggtagctcaacaaggaggcccgagtgaagccc

SEQ ID NO: 27706 - DNA, 61 bp, Chlorella protothecoides
ctccctccctcgctcccccatcatttgttaacccctgcacgcacacgacgcaagcgagcgt

SEQ ID NO: 27707 - DNA, 66 bp, Chlorella protothecoides
tccagcagcggaaccagctcaagcagcggaaccagttccagcagcggaaccagctcaagcagcgga

SEQ ID NO: 27708 - DNA, 61 bp, Chlorella protothecoides
cgggaggcggccgacgacaagctggtctccaccagccgcgtcattggcaaggtccggtcca

SEQ ID NO: 27709 - DNA, 105 bp, Chlorella protothecoides
gcgggacagcgggtgaggggctgcttggcctggacttgggctgctgggctcaaactgctaagttccatgggggccgggaggggcaactgtctgcagagccatgca

SEQ ID NO: 27710 - DNA, 61 bp, Chlorella protothecoides
gtattcggctggcaagcctcccagccctgcacccgccggagtggcgagcgagctcgtctcc

SEQ ID NO: 27711 - DNA, 97 bp, Chlorella protothecoides
tcatggacaacacaatatcaggaagaagctactcttcaagtcccatgcacccatcaagtgtttcttttgccgacttcccatagttaaaagtactgtg

SEQ ID NO: 27712 - DNA, 61 bp, Chlorella protothecoides
tttcccctgggcccggcgggccaccaggtctgagagcacccgcaggactgccgtgctctgt

SEQ ID NO: 27713 - DNA, 74 bp, Chlorella protothecoides
cctggggactggccctgacagccttgcgcagagcgcaccagggcatgcgcgttggtgccctgtccaaaggaggg

SEQ ID NO: 27714 - DNA, 141 bp, Chlorella protothecoides
caggacctttacactgagtgagcttgtggtgctcgagaaaaggctggggtgggccttctttggacagattcgtaggccatgggctcccaagcattgttttgggtatgattcggtgtgcaccctgatttctgccatcagttc

SEQ ID NO: 27715 - DNA, 61 bp, Chlorella protothecoides
ggttcgaagctgcagaggagacgatgcaggtcatgggaccttgctcaccctcacacaaaac

SEQ ID NO: 27716 - DNA, 61 bp, Chlorella protothecoides
tgggttggtctcctggcaacggcgggggggtgtcctgtgtgttgactggagagctgtcctc

SEQ ID NO: 27717 - DNA, 75 bp, Chlorella protothecoides
catgcgaatgatggatggcagctgggtgaaggcttggagcccattcgatctggtgcaacctgagagaagtatgcg

SEQ ID NO: 27718 - DNA, 443 bp, Chlorella protothecoides
ctccttcccacaagaagtccccacctccgctcaagacgaggttcccttcacctcacaggaagagctctcctccttcacccaagacgaggtcgcctccccctcacaagaagtaactgcagtgaacgaaagtctatgacaatgtttgtcaccatcccacaaagtacttcgactctgaagtgtgctcgaatacaatgtctctccaaaacccaatcaacctgggattacggcgcttttggttcccaggccttcaataatatttgccatggaacctccgcattaatctgtttgcccaccatccaccccctattccaaactcgtcctttgcatggatgcaggcgcgtcaagtgcctttcctgcatccactcgctgggcttctgtgtacactactcttgtccacagtgtaacccaagatgatgcataggcaagagacagacgcacgtgcc

SEQ ID NO: 27719 - DNA, 86 bp, Chlorella protothecoides
ccgtggacgtctattgcccgcccgggccccattttctgccccagcttccttctggagccacagctggctttgacaggtcgtcaaac

SEQ ID NO: 27720 - DNA, 61 bp, Chlorella protothecoides
ctggccacggtggcgacatgtatggaagggtgcgccgggtcggcgaattcgatgggtgcag

SEQ ID NO: 27721 - DNA, 73 bp, Chlorella protothecoides
tccaggcagtccagttacagtgtgaacagcagccaatggatgaatatgagcaggaaacctcaagcaaaaccac

SEQ ID NO: 27722 - DNA, 74 bp, Chlorella protothecoides
gctggcgcgccctacgctctgcgacagggggggacgcagacacacagttgatgtcggatggtagaactctcagt

SEQ ID NO: 27723 - DNA, 132 bp, Chlorella protothecoides
gggggtgaggggcatcattgggcatcctttggaattcgtggacttggagtttggggcataggatgcaccattcaccagcgcttcccctccaacaccccccctacaggccagcattcagggcagcagtcatca

SEQ ID NO: 27724 - DNA, 124 bp, Chlorella protothecoides
taccacaagaccgacaaggaggtgagggtccgggtcaggctattggcccgagtcctgtgggttagagatcccttcccttccttccttgctcctaccgcttgcattgcaacagcaccccagccag

SEQ ID NO: 27725 - DNA, 152 bp, Chlorella protothecoides
tggtgagaatggaagcaagggctgagataattgctctccaggttgcagacatgggagtcaagtctgttgcaggctcaaaagtcacactccctcacccccctccgcgaaaggatattttggccatgtgtcgaaaggcgggtgtcaagaaccag

SEQ ID NO: 27726 - DNA, 62 bp, Chlorella protothecoides
gccaactttggggcactgctgctacaggcggtggaacccatgcccatgcgacctggcatcga

SEQ ID NO: 27727 - DNA, 74 bp, Chlorella protothecoides
ttcctttttcttcctgtgcgtagagtgcttcaatctccttttgttccatcctgcaggtggcccccccgtgctgc

SEQ ID NO: 27728 - DNA, 69 bp, Chlorella protothecoides
acacgcttggtgcaggaaccagggcaaatatttaccaacccccgcttttaacaaggcaccatcagtctg

SEQ ID NO: 27729 - DNA, 61 bp, Chlorella protothecoides
acaacttgcaatttgtatccttgaatcctttcccctccctctttgccactctgtgcatcgc

SEQ ID NO: 27730 - DNA, 61 bp, Chlorella protothecoides
cagggctggcatgaggcccccatgcaggcctgggcagccgctctccaatcccatgcacaaa

SEQ ID NO: 27731 - DNA, 100 bp, Chlorella protothecoides
gtcagacacatgcccacagcactctcttgcaacagcgcagtgtcatgtcaccacagcttccattgacacccgccagggaagcatcccctccacctccccc

SEQ ID NO: 27732 - DNA, 120 bp, Chlorella protothecoides
gggctgcgtggcctttgctgtgctggccgccgtcaccgtgatgctgctcaagctgaacagaatgcgctccaaggcaagcaggggcgcaagggggtgctcccgatgtggcctgcaggggtg

SEQ ID NO: 27733 - DNA, 682 bp, Chlorella protothecoides
aagcccggcgccgcactggcgggagtgtacgtggcggcgccgggagcgggcggcgtggccgcgccgccgccgccgcccctcgtcctcgagcccgaggacctgccgcgctacacccggctgcacacggggagggtgaccctgcgccagaccctggccctgcacgcgccctttgaccaggtggtggctgggttgaggtgcgggagggatgcgttttgttgtgggcggggagcgcgcgggacgcgagcagggctcgcccacgccccctcgacagggcgtcggcacgtgtgggtctccgatcgccctccagcctctgaggggttccgacacccaccgtgcgccctctccatcccagcgccatggcctctctccagctgaacagtagcctcccccccgtctcctctcatcttcccccccccccaaaggtccggctggcgctggagctgctgttcgagggcgtgcatggcgccggggacctggccctggtcagcagcgaccagtgcgccacggcaaacgaccgggagggtgcgcctgtggcgccgcagatcctgcgcgtgggcgaggcggtgaccgtcagctacgacccggcgagtgcgcctggccggctgacgctggagtggcagggcgggcccggcgcggacgccgtcgccgacgccgtggtggcggtggtgctgggcgccgggcc

SEQ ID NO: 27734 - DNA, 97 bp, Chlorella protothecoides
gtccacctgccgcgcctcacgctgtgaccctgaggccgccgcgccagaggccggcgctggggtcccccccgcaccctcagatccctgccttgcgttg

SEQ ID NO: 27735 - DNA, 61 bp, Chlorella protothecoides
acatgtcgctccgagtacctcccttgttgagatgagaaggtggtggaacgctcagcctcac

SEQ ID NO: 27736 - DNA, 123 bp, Chlorella protothecoides
aacacgtctcaaatggcaaatgagacatgccatgggcttcttgaactgcagggatagtcagtaagcagacaaaaaaatgctctgcaaaagcacaggtagtgcgtaaacgtattggcagcagag

SEQ ID NO: 27737 - DNA, 61 bp, Chlorella protothecoides
aggtgccggtcatgctcatgccgagggtggagggggtatgcagattgaagatccaccaagc

SEQ ID NO: 27738 - DNA, 85 bp, Chlorella protothecoides
cacgccatgttggggtccaagcggcgggagaagactattgggaagtggcacgcggaggccccagactatgtcaaggagctgcaca

SEQ ID NO: 27739 - DNA, 80 bp, Chlorella protothecoides
tggtgcacggcatgaacgggctggaatatccccaatggagctacagtattgcaataaaaggagtgtgtgataaagtctgc

SEQ ID NO: 27740 - DNA, 5407 bp, Chlorella protothecoides
  modified_base (288)..(297): a, c, t, g, unknown or other
  modified_base (1423)..(1432): a, c, t, g, unknown or other
  modified_base (2436)..(2445): a, c, t, g, unknown or other
  modified_base (4306)..(4315): a, c, t, g, unknown or other
ccggcgccgccgccggccccgccccggcggaccagctgaaccgcggcgggcgggtgtttgccgcgccgggcccgggcgccgagccgcgcggcgccaagctggtgaagctgcaggctctgcggtccgagctggagcatcaccgtgccacggtccgggatctggaggcgctggtggccggcctggaggccgagctggagggcggcgggtactgagctggcagcgtgtgttttgggaggggcgcggggtggagagcgcgccggccaatgtctcacttgctccaacatggtnnnnnnnnnngctgagctggcaacgtgtgttatgggaggggctcggggtggagagcgcgtcggccaatgtctcacttgctccaacatggtgaggcatgacgtaatcaccatcaaaaagacccgccgacatgattgcaccatgagggtttcgtgttaacattgcagcgcatcacacgaggagcaatgaagacatgtgcacggcgccatgggcaccagaaacggaaggttgcaaggatggccatcgaccaaccgtcaccgatcaggtcagagcaggcagtcggcgatggcggcgcgcatgcgctcccgtggcaccggcgccggccgacccgccagcgactcctctccctgctccgccgccagcgcggcaaaggcgccgagcagcgcggcggccgtgccctcgtccggatcgtggttcctcccgagtccaagccccagcaccccgacgcggcaggcggcgcaggtctgcgccagggcctcggcggcggggacggggaggcgcgaagcttcaggcaccaccccgtcgcgaccgggcccgtcgcgcggcccgcacgggttgaggcacagcgggcacagcgtggcgccccggtcctgcgcccgacccgtctgtgcgtccacgccgcctgcccgcccagcctcgctccagtcgaaggcctgcaggcggtccagcacgctcatcacgttgctggcggccgacgggttggcggccagcagcgccagcgcaaagtcctcggccagcaggttgatgctgcgcgcgccacgccggccggccaagtagcgctggggggcgcgggcggggacggggagggccaggaggtgcgcgcaggccgccagctcccgcgtggacgtgtcgcggaaggggcggaagaaaaagggcagcgcgggcccgtggctgatggagtgagcgggtgggagtatggggttctcaagggaagagtgcagaaaaggggaagccgagcgttggcgacctcctggggcactcccaagcaggggctggccagcccccgcctcatagcgccctggctggcgcgcaaaacatgcagcccggaacacccgccaccaatgaaaacgcaagaaatattaccccccgcacacacacgctcaccgcgcgtcgacgaggcgcgcgccggccgcgacgnnnnnnnnnncacacccgccaccaatgaaaacgcaagaaaaaataccccccgcacacacacgctcaccgtgcgtcgacgaggcgcgcgccggccgcgacgccgtggcctcggcccttgcaggcctcagccagcgcgtgggccgccaggcgcgtgctgctgcagcccagggccaggctgcgcgcccccagcgcgcgcgcggtgcggaggagcagccgcgtgcgcagcgcgcgcagcgtgtcgtcgcgcgccgtcgcgtcggccaccgagtccagcagtgcgcggaggcgtcctgcgccggccgccgtgttgggttcggtcccgctgtgtgagccgccgtccaacagcactgcatgcagggggacggcgtggaaggcgaccccggcgtcggtgcagtagccgcccaccgccgctgcatgcgccgaggggccgggcccgctttcctcaacattctcggagtgagcggcccgctcgtcaatgtgcaccacgtgcagcgtgaagggcacctgtcggagcgagggacatggagtacggttgagccggtgggccttgcggccgggagctggggatgaaagacggggccgaccgattgtcctggccatcgtgagctgagctggaaggaggttgcccagcggcctcaacccccaagttccgtcctcccactcgagcaccctttcctacacaccttgcgcttctctgggtgcttgaggttgagggagcgcatggcggcgaggaggtggaggagcagggcggaggcatggcccccagagtaggcgagcaccaccgtgtcccccgggcggatgagggcatgggagcggatggcagagcgggcctttgcggagatgctgtcgtgcaggcaggggctgcacaggggctcatgctggcgcaccaccacctggtgcagggtgcgatttgaatggtgagatcgtgtgggatcaatgctgtgttgccgttccaccacaccattcccagtatcagacagagagggggcctgcatgccacatgcatgcaagccnnnnnnnnnngatggtgagatcgtgtgggatcaatgctgtgctgccgttccaccacaccattcccagtctcagacagagaggggggcctgcatgccacatgcatgcaagcctccgccatggtgcccaaatgtgcaccctgcattgcctaattttcctcacctgcgctggccgatcccgacatttgcgacaaagcctgatgtttgtagccttcttggcgattcccgaggtctcgggccggcagcatgcgctggtgtgaggagtgtgacaggtctggcagccgggaacctgctcgccagacaaagtgcagcccctgtccgcaatcatgttgggattcggagtatttagacgcaacattagatgagcatatattatgctgttagtctgtgtggcatcgtgggtgggattcctgccggtccttgcgcccaaactcgagcagcccggggcggaagctctcccgagggaggacttcaatgccctgccgctggccgtccccagccccattcctggagatcgacgaccttgaaccgctgttcgacaaggttacgtctgatccgcgacaagaacaccattctagcctggctatcggaccgcagcatatcggcggaagagtgggccagtggccgggtcctcgcaaagacagggcaccatgaatatcttcaggctggcgggggacatgactcatctgatgagcatcgtggtcctgctgctcaagatcagagccaccaagtcatgccgaggtgagctgcctgctcagctgtcgggtccgatctctgcggccaggcaacacaaccgatccttctcctcacccctcccgtgcgcacaggcatatccctgaggacccaggaaatgtacctcctcgtgttcctgtgtcgctacctggacctcttctactccttcgtctccctgtgagcacctatacgtgcaggggcgatggacagggggctggaaggctcacatcccagcaccaaccccgactgtcaagccccacacccccttgccgcctgattgatgtaccaggatcctcccccccttgctctccaccctcaggtacaacacggtgatgaagctcatcttcctggcctcctcggcggccattgtgtactacatgcggtatgaccgggtggtcaagcagacgtatgatcggcgccaggacaccttccgctacctcttcctcatcgtgccgtgcctgatccttgccctgctcatcaaccacgccttcacgctcacagaggtgggacctggttatggagccacgatggccctgctctgccaggcatgtcgccactggactcccatccaccatctgccattcatcctcttcacacccctcacctgacacagatcctgtggaccttctccatctacctggaggccgtagcaatcctgccccagttggtgctgatgcaacgaacccagaacattgacaacctgaccggaaactatgtgctactgctcgggtgggggtggatttatgggtggagagggaagtggagagcatcgagcgggtcaccggaaggttgctgtgttctcgatggcgtcacagcctttgggacatgcatcatctccttgctcgtgctgcggcgcttggcgataggatgctcacggcatataccactccccttctgtgcacaggacataccggggcctatacatcctcaactggatcttccggttcttcacagaaccacactaccgtcagtggctgggtgagccatcagcctcgggttcaggggggcatgagctggctgttgtactcgcatttgggcacggctgttgtgtagcatgatttggccgtcacgaacgccactccccaccgtacaccccacagtatggataagtgggctgctgcaaacggcgctgtatggtgacnnnnnnnnnnaaatgccactcccaccgtacaccccacagtatggataagcgggctgctgcaaacggcgctgtatggtgacttcttctattattatttcaagtgctggaagagcaataagaagctcacactccctgcatgacttagtcttcccttttgtaagcacttgtccccaggaggggtggctgtgaagcaggacttggcggcacccaacaccccgatcaaggtccaatatgaaccgagctgtgggcaagttcgcgctcagcgctcatctgcacccgcttaccagtcttagccgcatgctgggcgcacatcgtgaaaaacataccggaaaatcgacggcacgggcctagcaggtacccaacctcccgtccacctcgctctcgccatcgcaccccccacccctgcctgcgttgcggtaccaccgcgatgcagctgatggtcccgctaatctgaccagggtcaccctctgatcttttcctgccgccatacggcccgtcagccccgtcttcgcggccacacccggtcgacccgtcgccggggtgtcccagcatgccgggcctcccagggagcgcagctgaccccgccccgagcctggcatcgctactagccagagatgggtccctggaggcgtcggtgcaggccgcccttgcctccctccccaccctggacccggagccccgcaccgccccctccatggccgatgccgtggccatggtgcacgcccgggacgacgcccgcaagaaagtctcctccggtcccgccctgtccaaggccaagcgcgcggcgcgcacctcctccctccccgtggtggaggaccgcttccccggcgcgcggcgcggcggcggcgaccccgccgccttctggctctacgtggaggactacttccgggacgtcaccgcacacgacctcgccgctctgctgcccgccgcctgcccccgcctggacaccgacccgcacctgctggtgcccccgctgggcccgccgccgacgcggggccctcagccactgccgcccgccgccgcgccggccgcagaaccggccccaacccccgcgagcaagtcggcgctgggcgccgacgccgcggcggccccccccaccgcc

SEQ ID NO: 27741 - DNA, 70 bp, Chlorella protothecoides
catgcagtcagtgcatgagcatggggcggtcgtgggggcaactaccggccgcgacatgctcccccgctcc

SEQ ID NO: 27742 - DNA, 77 bp, Chlorella protothecoides
cgccgcgcggggcaggcgcgccaccgctggacctgttggaccaggggcgcgtctgcccgcgttcgcgggctggccgg

SEQ ID NO: 27743 - DNA, 61 bp, Chlorella protothecoides
gcccgccgcatccgtggcgagcgcgcttgaatgtagcaaggtccactacgtcaagccatcc

SEQ ID NO: 27744 - DNA, 92 bp, Chlorella protothecoides
gaggaacaaggggtaggttttgggtttagtccccctgaaggtgagtaggtgtggaaagctgtgcccattctccccgcacatgagcatccaga

SEQ ID NO: 27745 - DNA, 61 bp, Chlorella protothecoides
agggtgtctttacatttcctgggagtgaacaccccgtccactgtgtagttctaccatcaga

SEQ ID NO: 27746 - DNA, 100 bp, Chlorella protothecoides
cttgggtgagtcactgccctgtctagctgtgggttggggtcggggaggggggggtagtaatggatacaccgcgccatggagaagcaaggcagcgggagtc

SEQ ID NO: 27747 - DNA, 68 bp, Chlorella protothecoides
ggggaaaggcctggagggaccaggcacggagtgcagtgagtgtggctgctggggcttcctgagaaatg

SEQ ID NO: 27748 - DNA, 148 bp, Chlorella protothecoides
aggtcagggctcatgtaatgtgaactttctctaggattgtaccaagccagaactcgaggtacaggcaaggttaagaatgagagttcggtgtgtcttcataagcatgaaggtcaagtcctctgcacatgtcctcttcgtataggctcgg

SEQ ID NO: 27749 - DNA, 61 bp, Chlorella protothecoides
tctgcacatgtcctcttcgtataggctcggtactgctttattaaaaaccctagctacttct

SEQ ID NO: 27750 - DNA, 123 bp, Chlorella protothecoides
acatctccctggcctgttgatggcagggtgggtggggagccggggtggggacagcaggattagggtagggagcgggaggctcgggcaatgttcttcctgagaggagcaccgccagaaaagcaa

SEQ ID NO: 27751 - DNA, 61 bp, Chlorella protothecoides
tgcacaggcattggacatgccaataaggtgttcctggaaagagctcttgggccgcttgccg

SEQ ID NO: 27752 - DNA, 79 bp, Chlorella protothecoides
atgcttccagctggttcatcacctgcatgaagcgatcgaggggtccttaacgatcgacttgtttaccttgcccagtccc

SEQ ID NO: 27753 - DNA, 79 bp, Chlorella protothecoides
gaacatgccctgccatggaagaaaggaagaggatgagcagcgggcatggggcatgtgggcagggagaccgtggcgggga

SEQ ID NO: 27754 - DNA, 62 bp, Chlorella protothecoides
ggcgcggaactccttggaggagcaggatgtcgtgttggcatgttcatcgatagccgtgaaca

SEQ ID NO: 27755 - DNA, 61 bp, Chlorella protothecoides
gcatgcaacgacgccgagtgtgtagtctgaattgtatccgaggatcctgcctgcgcgatgg

SEQ ID NO: 27756 - DNA, 76 bp, Chlorella protothecoides
agcatggcatgtgcgacgattgcagaggcaggtacaaggggggtgaaccctgtttggcggtgcaggccaggtcagc

SEQ ID NO: 27757 - DNA, 75 bp, Chlorella protothecoides
ctcgtggtgggtcattgagcgtgggcactccctggctgtgttgtgtcagcacagatatgaaagctgtggtgcccc

SEQ ID NO: 27758 - DNA, 155 bp, Chlorella protothecoides
gcatacggcacagcagacacgaggtgtggaagcggtgggggctgctgaccaccaccaacaacctggcgggcaggcgctcctgtgactttccagcgagaccaaagtataccttgccctacaacccgaccatcatcatcgtcacctgcagggccagg

SEQ ID NO: 27759 - DNA, 61 bp, Chlorella protothecoides
ttcttatgaaatgccacaaggggtgagctcttgccaagtcgatcagcgtacgcgttgctaa

SEQ ID NO: 27760 - DNA, 95 bp, Chlorella protothecoides
gcagcagcaggggacgagggggatggggataggcttgcaacatgatgcacagcaggggcaacgaatggcaaaggcaatacccgtcccctcagccc

SEQ ID NO: 27761 - DNA, 61 bp, Chlorella protothecoides
taggagcaggtgtcagaacgccacttgcttcctctcccgatctggctccctcaaccacaga

SEQ ID NO: 27762 - DNA, 154 bp, Chlorella protothecoides
tgacggggggagggactgaccggtctgcagtgccgaatgtacgtgcaaggtgtgatggggttgcttggcaccagtgctttcttggtcgacatgatgactgcagaccctgcgcccgcaccccgtcactcagcatgactggctgaagagggacctg

SEQ ID NO: 27763 - DNA, 114 bp, Chlorella protothecoides
gagagtctggacgagttgcaggtgatgggggcaggaagaactggtgctcgtagtgccaagcatcatttgggtcgggccctggaaggctgaggtggcaatgcaatactctgttag

SEQ ID NO: 27764 - DNA, 64 bp, Chlorella protothecoides
ggagaaatgtggcaatccctgaccagctaaggccccgattgctgccctgcatgccatgcactcg

SEQ ID NO: 27765 - DNA, 78 bp, Chlorella protothecoides
gaacaccagggcgggatgtgagtgcaggaacttgctaaggggcacacccccgcccatgggtccacgcgtcatttcttc

SEQ ID NO: 27766 - DNA, 133 bp, Chlorella protothecoides
gtggaggggtcgggcgtgggcatggggggacagagcgcgggcagggcgtggggaaccaaggcgcgagctcgcgtaggatcccgaggagaggcagggcacgtctcagcgactgctggggggattcagctcacat

SEQ ID NO: 27767 - DNA, 79 bp, Chlorella protothecoides
ccagaggcaggctttcgctctgcggcgaatcgaggttgtgtggagggggtccatggttcagcaccgagtggtggccgcc

SEQ ID NO: 27768 - DNA, 131 bp, Chlorella protothecoides
ctattgcatgaggagtgcaagtgcgccatgatattttagagattgttccctcaagccacacgatggcttccccttcaaatccagctgagccacaccggtggcacacctccaacccattccctcacctggcc

SEQ ID NO: 27769 - DNA, 61 bp, Chlorella protothecoides
gcgaggctgctgcttcatcaacccctgccaacatctcagccagcctgctgagcgccccatg

SEQ ID NO: 27770 - DNA, 61 bp, Chlorella protothecoides
ggagaagaaggaggagtctgaggaggaggacgcggtgagtggctgcagggccggtgcagca

SEQ ID NO: 27771 - DNA, 119 bp, Chlorella protothecoides
tggaaggatgctgaggccctgagcgcacagcccacccaaagcttgtcgcttgctgatactgcagctcacgcatcgcaggcactaatgcctggaatggtccacaggcccagctccagtcc

SEQ ID NO: 27772 - DNA, 61 bp, Chlorella protothecoides
cacctggggaaggaacgacaaggggcagctggggctgggggacaccgtaacccgcaacgta

SEQ ID NO: 27773 - DNA, 139 bp, Chlorella protothecoides
tttgcgaggcaatgggtgaggcatgggatgctgttgtttgagattgaatcagcctccttgggcaccgtttcagttctcctcatgtggagcaatctcaaattcatccttcatacccatcatgcactcagcccatcaccat

SEQ ID NO: 27774 - DNA, 61 bp, Chlorella protothecoides
gtgattgcctgggacgcttgcaagtggtgccggagtgttggctgctctgttcctgggagtg

SEQ ID NO: 27775 - DNA, 61 bp, Chlorella protothecoides
cgacatcgaggactctgcagcggttcaggccgccgctgtcgacacgccagtgacgaggtgg

SEQ ID NO: 27776 - DNA, 144 bp, Chlorella protothecoides
catccagcctccaagatccagcggtgtgcagtcctaaatgggttgtttccgacttgagagacagggagatacacccgaacccggggtcaaatacaacagcttccggggggaaacatctcggcaagcgtggggagcaggccgttc

SEQ ID NO: 27777 - DNA, 921 bp, Chlorella protothecoides
atggagtgtccaaggcttggattggaacatttgggtgttatatacgctgacacagggatctctcatctcctatgattgtgccttgtggagcacttccctgtatcattgaacgcgtagtcccgtcagcttgtccagacatggtccccagcccgttgacgttactcattccttgcttctgatcacagaattcgtgcaaagctcactcagactatgaagaatcctgctatgtggagtgtcatgaatgacaccttcatggtaagcctcttggtggaggggttgcttgtctggcttgcgacatcacttggcatgagctcagctgccagcttgtctacgctgctgtgatcactgcagccctgcaagatgcctccacatgtattcttgcaggaagccatcgtggctctatgcatgaaagaccagtcttggaaggtgacgtttggtcagaaactttgtgaggaaacacttgcagcaggagaagtgcaacaccagtcatcttcatctcctgcggagcaccatccgccagcgctcaggtacaaagcatctcgtgcagcatggatgtgaagctgggtagggatgtatctaccttgttgtgctttgccacaggtgaatactctaccacccaccgattctgattgttccccgcccactctcatctcaacatctgcagtgctcatcacggttcttcctcagaattctcctctgaagcagagaatgttcacgcgatggccaacctgttccctgactgtacgcaccgtgctatgctgaaggtgtgtttcctggctggtcgcacaggtgatgcttgttccgtttgctgatatgtacttgggcccatgtcttgtgtcccaaggcacaaactgctgcacatacatttgtagtcccctcttacatgcattcccaatgctccttactcagccacagcattcg

SEQ ID NO: 27778 - DNA, 95 bp, Chlorella protothecoides
gcttgatgcctgccatgctctcagctggacagcgaccacaggcagccagcatccccaccctatatcagaattcctgttcccctcactgaccccgc

SEQ ID NO: 27779 - DNA, 410 bp, Chlorella protothecoides
  modified_base (128)..(328): a, c, t, g, unknown or other
caccaatctgcggtgcaacaacgcgattggaactcggaaggttataaacacgtgcagcctcaatgagctccgcaaatctgtggtcaaggattacaatcaaccaccgccctcacctcccaagaaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagtcctcctcctccatcgcctcctcccccgtcgcctcctccgctttcgcctccacccccttcacctccaccaccctcacc

SEQ ID NO: 27780 - DNA, 75 bp, Chlorella protothecoides
caaggccccaccatccccagccagtacagtgacatcccccaaaacccatgccaggcacaccttttgcatgcgagt

SEQ ID NO: 27781 - DNA, 61 bp, Chlorella protothecoides
tcagtttagccacctggccggcgccagcccacacctacgcttcttcggcaacctccgcctg

SEQ ID NO: 27782 - DNA, 61 bp, Chlorella protothecoides
cctgtgaacatacaacataatctgtcaatagtaaactccaagggtgttagatcaggctggg

SEQ ID NO: 27783 - DNA, 61 bp, Chlorella protothecoides
tagtatcacctcaaaaagagggaaagagtggaatgtgaaaggagcatgaactaggggcaaa

SEQ ID NO: 27784 - DNA, 77 bp, Chlorella protothecoides
gaggggtggcaaagagtggtgatgcccaggttttacgggggaatgatgagcgggggtggagactccacagctggcct

SEQ ID NO: 27785 - DNA, 193 bp, Chlorella protothecoides
aggcgaggccttggtggtccaacagccccgctgcgatgccgcccagcgaacccagcgaaccctgcacacaccttcccaccagtgcgcgcgcatgcacgtggcgagaataccctgcgagggtcgactgcgggtcgaaaaccccattccccccaagaaaccccaaccgcccgcccagccagcgcacactacctgg

SEQ ID NO: 27786 - DNA, 309 bp, Chlorella protothecoides
aggagcagcggcgtgggcccacgcggcccctcgcccgcgtggcgcccgacggcggcggcgccggcccgcagcagcagggccatcgccgcgccgtcgtcgcggcagacggcggcgtgcagcaggcccgcccactgcgccgggctgggcgagtttggccaatgccgtggccgtggtacgagcggcacgatgcgcaggtgatcagatcccgtcgtggacggttggcgtcgtcagggctgcctcaggtgtgttccccggcagattgactacgcgtggtgccttggcgatcgtcatgccgccgtcctggggctg

SEQ ID NO: 27787 - DNA, 135 bp, Chlorella protothecoides
aaggccgccagcaaggccagccggctgggcacgggggccgccggctcgggccggggggtgggcctcctcgcccggcgcggcagcggcgtgtccgccgtggccgcctcgccgccgcccgccggcgccgacctttcc

SEQ ID NO: 27788 - DNA, 104 bp, Chlorella protothecoides
catgtctccatgcccatagggttgcagagccgcaggccaagctggggcatctaggtcatgtggggaggaagtgctattctggatctgcccactcaagaggcagc

SEQ ID NO: 27789 - DNA, 67 bp, Chlorella protothecoides
ctggaccccacaaggcatcgctcgtcccgcaggtactcacactcaacgagcgagagcttgctgggca

SEQ ID NO: 27790 - DNA, 67 bp, Chlorella protothecoides
tctccctgcaggagctccgatggttggctgtccaccagcctcttctacaccggcaaggagcccctcc

SEQ ID NO: 27791 - DNA, 67 bp, Chlorella protothecoides
tagttgagcatgtcccaggcatcactcgaggtgttggctgggatcccacgagagagctgtggaatgc

SEQ ID NO: 27792 - DNA, 61 bp, Chlorella protothecoides
gcctggtagttctgagggggatacccctgattgtactgctgctgggggtaatactcccccg

SEQ ID NO: 27793 - DNA, 61 bp, Chlorella protothecoides
ccccgccccgttggcgccctcccctgggcgcccagccgggcctgtacccaacaggagtgga

SEQ ID NO: 27794 - DNA, 71 bp, Chlorella protothecoides
gtttgtgtgtggcgaggagggagaggggggccaggccgtggggaagtggggaacgccagtggagtcaaacc

SEQ ID NO: 27795 - DNA, 8822 bp, Chlorella protothecoides
  modified_base (97)..(153): a, c, t, g, unknown or other
  modified_base (688)..(697): a, c, t, g, unknown or other
  modified_base (2228)..(2237): a, c, t, g, unknown or other
  modified_base (2463)..(2472): a, c, t, g, unknown or other
  modified_base (4716)..(4725): a, c, t, g, unknown or other
  modified_base (4927)..(4936): a, c, t, g, unknown or other
  modified_base (5024)..(5033): a, c, t, g, unknown or other
  modified_base (5450)..(5459): a, c, t, g, unknown or other
  modified_base (5949)..(5958): a, c, t, g, unknown or other
  modified_base (6572)..(6581): a, c, t, g, unknown or other
  modified_base (6667)..(6676): a, c, t, g, unknown or other
  modified_base (8301)..(8310): a, c, t, g, unknown or other
cagggccccagccagtcggcgcccaggccgtgggccagcgcgcccagcgcgtcgtccagcgccagcctggcggcccaccaggcgcgcgcctgggcgnnnnnnnnnnnnnnnnnnnnnnnnnnnnnnnnnnnnnnnnnnnnnnnnnnnnnnnnnggtgggcaggtcgcgcatgctggccgtggacgccgcggcgatgcgctccatctcctgcaccgcgcgctgtacgaggctgtggtgcgggcgggagttcgggttgagaagggtcggaggagaggggagggggtgggtggggagctccaaaaactgcacaggtctacgatgcatgctgtgcaccacagatcggctgtcccatcgagcaaggcctcggacagatccgcacacctagtctggggccctgggccgccctcggcatcgccgtcgaggtcctcgctgagagcgcgcgccgtgcccccgctcctctccggcaggggcagctccagcatgaggggcggcacgccgcgctccaggcggcacaggagcagggtctgcggtgcggtccccgccgcgccctcctcaccagacccccagacctggaggctggccagtgcggcgtgtgagcgcccggccaggcggtggagggcctcggcaaggaggcgtgccgcctcgacctccaggcggtccaggagcctgggcaggcccggggcggcgnnnnnnnnnncaggctggccagtgcggcgtgtgagcggccggccaggcggtggagggcctcggccaggaggcgtgccgcctcgatctccaggcgctccaggagcctgggcaggcccggggcggcggtggatgttttggggaggtgccacagcgcccgccaggcgcgcgtcgtggcgtcgggcaacggtgtgttcgccgactcatcttgcactgcatcggccccctgcagcagccaggccaggcagtcgtcggtcagcctggccaggcgtgccagcgccgccccgtccagcccgagcagtggcaggcgggcgccgcttgcggggtcacttgccgcgtcctctgactccccgtccaccgccgtcctctcctgcctcccttgcaccagcgcgcgctgctgggccagggcgcagcccagcgagcagtgcacgcagagcgcggcgaggtggggcttgccggcggcggcaagcaccggcgcggcggcgcgtagcacgcggcgatgcaggcgggggagggaggaggacagcaggaccgcacgccagaggatcgggtcgagttctggtttggggggatgtgcgatcggaccggggggttgccgcctgccccggtgcggcgcggccaagccacgcgtcgatcccgccttcctgctttgggcccgcgcaatggcaccctcatcgcgtgcgtcgcccgcctcagcacctgcttcccctcgcccatccggcggtacagcgccggcaccccacaccgccacgcgcccctccgggcgaggggccagggcgcgggccgccgcagtgcaggcggtttcgcacagggcctgcacccccaggctggttgccgcgcccgagggtcggcctcgggcgagcgcctccaggctggcgccagcggcggtggccggcgagcgcgagaagttgcgctccagctgcgccagcgcctcgcgctcctcccgggctccggtgcgaggcgccagacccagtccctttgcagcgccgtccgccggcttaaccgttcgtcgggctgcggggtctgctgcctctgcacggctcgtcccctccgccagccgggcgacgatcgccgcccgcgccgcggccgccgcctctgccgccgcggcctggccgtgcctcgtgagcatggccgccaggtcctcggtcaggcgcaggcacgccgcgcccaggcccagcgcggcagcctgaggcgtcggtaaggagaaagagaagcctcgaggagggatccatgtgtaaaaagcgtgtctctgaatgccaggtgagtccggacgtgctcgccgcggcgtttccctgctgtggtcaggcactgcaggcagtccttgacccggtcatgaacgcccccaccctcccaaccccatcccctcgctcaccagacgctgcgcctcccgcagcgccgtcctcgcctcctccgccaggcccagggcgtcgaagccctggctcagcgcgcgcagcgtgggcactgccagcgccgcggcctggcaccacacgcccacacaggcgcccgcaccgctgtcgtacagcagcggactgagcaggcgctgnnnnnnnnnncggcaccaggcgcccacgcaggcgcccgcaccgccgtcgtacagcagcggactgagcaggcgctgcgcgtccgccaggcaccgcgtcgccagcacatggtcgcagcgcagggcgtgccgctccgccgcccacctcagcgcagccgcccgacgcagctgcgctgcctggcggggagcgccggtggcagcggtacccgaggccaggccggcgtcgtcaccagaggccnnnnnnnnnnccgtcgctgtcctccgcctggccgtcgctctcctcctcatggtcctcgcccgtgctgccgtccttgtcgccagccaggtacgctggcccatccaccgggtcaaagagtgccagcccgccgtcagacgccagccaggccagcaggcgcgccactcttcgaaccgtcaaacgagtacaccgagtggctccctcactaccatcgcggggctccggcgcctcaaatgactcgatcgcgatggcgagggacgccctcgccgctgcccaggctggcaggtccggaacggcagggccgacggtcgcgcttggtgaggcggctgagctgccgggcgggccagaatctccctcggtgggcctctccgccggcacctcaggcacgccaggcgtcagccccgcgcgaatcagctcccgcagcgccagcaagcagcgcaggccgcgcagctcggcggccagggcgcgtgcctttccgtcctgtgcggcggcggggaggggtgtgcgggtgaccaagagcgatctgcatccgccagcacggacaccgtgaaggccagaggtctgggatagcgcatgcatgcaggcacgcaccttgtgacccttctccagctgcgccaggagtcccgccagggccttctcggcgtcgtagggcgccggaaaggccccaaccgcggcgcaccgcgccacggctgcggcgtggttcagaagtccttcctcctcgggccagacctcctgcaggaggagctgggaggctgccaccgcgatggcgtcctcctccctctgccccgccaagagcaggcacgcctcggtctgggccgccttgccaccgcccagccgacccaagaccgtcagaacggcgtgcggcaggtcgggcgcgggccacgccgcggcgacggcgccggcgacctccggccccagggacccaccctcgccgccccacagcacgaagcaggcaaaggccgctgcagcggcctggcgcagcacggcagagccctcgtctggagccgctcgggccagctccagcacccgccgcgccgcgtcggctcgtgcccgggctgtgcaggttgcggcagctgctttgtcctcgcataaaactctcagccgggtcagggccacgctggcggccgacacgagcagagtgatgggtgatggtgtcagtgtgggatggtcccgactcctaggttctgaggctgggtgggaggacatcgcgatgtgggcggcggccaggcagccggacagccaggccagttcctgcgactcgggaggcgcatcatgcctgcacagcgatttcggggagggaggtgtgatttgaggggtccggtgatgcggtgtgcagaacgcagtatgacctggagtagtagtctctagaccatggcacgaaggcatactcgccaacttcagagcaaggcgaccagcgcggttgcccttccaaacggcatggcagcctcggacccgcccacccgagagtgtctggatcggcgtcagcatcttcagacagccgcgccagccctccccagccgcacagggcggagactgcaatgtccaggtccacaagaatctcctccagcccgctgcactgccccgagctcagcagcctcacggcgacgccgcaggccgcggccgccgcatggcgccgttccggggggggcgggctggccccggcctccgccgcgcggtacacgacgagcggcagcaccaggagcgcccgtgccagcacagtgccctcccttgcgctcagcgccggcgcgtcggcctgccgcgcggcggccgcccggcgcagggcattgagggcggggaggcaggcctccgcgtccttgacggggcaacaggcccgtcgcagctcggccaggctgcactccactcggtccaggagcgaaatgggggctgcagggccgccgagtaaggggacgaggagcgccagtaggggcgctggcggcagggagggcgccagcgcggcgagcagggcatagaaggcagcggcgccggcggccgtcagccggcggtgtcccgccacggccttgcagagcgcgagcggcagggcggggtcggtggcggcacaggcgcagagcactggctgcatgggcgccaggcaggggcccaacagctcatccggacaggtctgcagcgcacccgaggctgcctgttgggtggagggagggtaggcgcgggtgattgagacctggagtttggatgatgtgttgatcaattcttaccgcagtgtcacttgtgggacctctggcaattctgcaatcgccgnnnnnnnnnntgcgggtaattgagacctggagttcggatgatgtcttgatcaattcttaccgcattgtcactggtgggacctctggcaattctgcaatcgccgctggtccttgcctgacacaggacaccagactgtcctgggaagtctgcggccagtttcagcatgattgccaaccaggtcgggaaggtagcccaggcgcccgaggacctgnnnnnnnnnncagggctgccatgggcttcgtggttcaagcctttagcaagactcgatcccgcaccccctgcccaagactcgccttgcacaggtaggcnnnnnnnnnnaacaggacaacagactgtcctgggaagtcggcggccagtttcagcatgatcgccaaccaggtagggaaggtagcccaggcgcccgaggacctgatctgggcggcaccctggtgatggaggggcgggtgtactagggcaggcttagtaaggagcttgctaggattgctgagggctgccatgggtttcgtggttccagccttcagcaggactcgataccgcaccttctgcccaagactcgccttgcacaggtaggcagacaaggccttggcatggtcggatgcattcttgagtccgttctgactgcgcatggcaagagggcgtggaagtttcaccatgtgaacagcagacatccaaaactgcactgtctcagacacacaagcctgcgtcgcgcacgcacctgaggaccgctggtgcagnnnnnnnnnnatttcaccatgtgaacagcagacatccaacactgcactgtctcagacactcaagcctgcgccgcgcacgcacctgaggaccgctggtgcagcttctatgaacttcaaggcatcttcccagcctgatcccgtcttggcacagcagagggcaagtgtgaggaggcccccaatggcaggggtgcagagggctgctggtattgggaaccctaccctgctctggaatgatgcgcagagggctgcagcctgagtatgtgcttctggaaggtggttgtgcgacaccagagccctcactaatgcgtatctcagcttcaacgactgatgaagaggaggtgcacggccggtactctccagcacactgcatgccgtgctggccagctccgacagtgaggctacatctggccccgctgagtccacaaactctggtaaatgagtaagcaatttggttgcaagagtattcttggaggtcttggtggccgtggagcggaagaagnnnnnnnnnngttaagaggaggtgcacggcctgtgctctccagcacactacatgccgtgctggccagctccgacagagaggctacatctggccccgctgagtccacaaactctggtatctgagtaagcagtttggttgcaagagtattcttcgaggtcttggtggccgtggagcggaagaagtcgtccacatcctgcactgcgccacggaggtccggtccgcgaagtccctccagcagggcctccggcgtcgccatgtatggcgtctggcctacgcggaccagatgatgagcatggtgattgaccccatgcagggcgacgcgagctcatcccttgagagccctcgactgcttgagtgtcgctgtcgccattgccgggggttgtgcgacaggtgatttggaattgagctggggcgcaacatgcacagcatgaaggtgtccaggggaccgggatctctaccggcacacccattctggagccttgcgagtagcaaggacccatcctaaacttcacaagccgacttaaaacaaacaggcagccagcatgcctagggtgtgcactggtccttggcgtcacgcatgctaccctttcttgcgcagcttggccagccgaccctggccctgtnnnnnnnnnntactgaggttgcacagcgcgtgccacgagcaggtcacacccaggtcacactgctatctggcaggatgcccaactacactcggctcnnnnnnnnnngaacttcacaagccgacttaaaacaacgggcaggcagcatgcctagggtgtgcactggtccctggcgtcacgcctgctaccctttcttacgcagcttggccagccgaccctggccctgtttcagggccggtctgggtcgcccggcccccgccgcgaactccatgtagcgcatacccgcagcgccagacagggcggccatgttgccagccgttcttctcgccgccccggatttcctgtggcccggatgcggggagtttgtgatgaactgaggttgcacagcgcctgccacgagcaggtcatacccaggtcacactgctgtctggcaggatgcccaactacactcggctccttcatcatcctcacctcaaaggcacgccgtccacctccgccaggttctcgtcgccgatgtcagtctcgttggcagccaggatggcggccagcacatccagctgctcgtccagagagctgagcagcagcccctcctcaccacctaggcatgaagtagcaagatttgaatgtgtgaggttttacttgatacttgttgggaagagaggagacttttgaagtgatcagctgtaagctatggaaaacaagactatggcactgggaggaggggcggctgagtgacgctgagggcagggccgagtctggcaaaaccccggcagcgagcaggggaccacccttggtgggatgtaagcgtccctgatcatgattcctgtacgcaagcaccactccagcctcacaacgtcacaacaaaatgctccgcatgcgccccgcgcgtgcgcccacctgcgttctccaggagggaggggatgaccttgtagctgtagccctggtccaccaggaactgctgccgcttgctggtaaagtagacctcctgcggagccagaagagttttgaggacaagttgaaagggtagaggaggtatatttactcgttctgtccgatgagaactctgctacagtgcagtgcattcgcgttcaaagcacccccctcctcttgcttcgaggccaggcttggaatttcaccgaccagcgggcacagccctcctccctcctccccgttgccatgtcagtccgccttctttcctctggtgcctcacctccccgccccccaacacacccacccacctgggtgtcgttggacacgagggtgtagaagaaggcgtcaaactcctcggcctcccccacccccagccgcgccttcttcttgcgcaggatgcggcccaggcgctgggcctcctggcgcctggaccccgcgtggctggagatttggaccaggacgttggcctcggggatgtccagcgagttgtcgcccaccttggacaggaagacggtgttcacctccgggttgtgcttgaaggcgtgcaggatgcgggtgcgctcctggtgccccgtggcgccgtagatgaaggggcgcttcatgcgcaccgcgtattcgcgcagcgcgtagatgttgtcactgaacacgatgaccttgtcgcccctgttgggatttggtttttattttggggggaggagatgttggagggaagggttgggaagccaaagggaaatggttggggaggggggccaaggggaggggtggggtagaagtgcgggggtgccagccagtcggtgcccctnnnnnnnnnncatggttggggcggggagacaaggggaggggaggggtaggtgtgcgggggtgccagccagtcggtgcccctccccacgtccctaggaccccctcctcaaatcagacaatgcgaggccaccacccaccgccgttcgtggtactggacgaggaactggcaggcctggagcttggaggggttcatgacgtagagcagctggcgctgggtgacgggcgtgcccgggcgcagatactcgcggtagaactcacgggtcatggggcaccacacctccgcgcactgtacgttggcgatgtgccccgcccgggttaggtccagccagttggcctcgtacagcttgggaccgatgaggaagttgaggtcagtgatgaggtggtcctcccgcaccagcgtcgccgtcaggcccagcttgcagtgcgccttgacgatgccgatcacctgcatgggtggggcggggtgcgacgtcaggtggaaagggggagtttggggtggggacagggtggggacagggtgggg

SEQ ID NO: 27796 - DNA, 61 bp, Chlorella protothecoides
accaagaagagggaattgacagtccttactacggtgtgcgcacgtgctgcctcgaggaggc

SEQ ID NO: 27797 - DNA, 232 bp, Chlorella protothecoides
ccctgaggggagaagtcccgcaggttctgggccccgaaccccgagcaccaaccccggccagctcggtgggcggcctgcagagcctgcaccgcacgatcaaactcccatgcacagcccaagcaaatgcgtaggaggctgcactcgggcgcatgtgctgccgatgcccctctcccccaaacacgcacaccacagaccctcgacccacctccccgcaggcccgggggcaggccca

SEQ ID NO: 27798 - DNA, 67 bp, Chlorella protothecoides
cgcctcggggctggggctgggtgagggtgatgcctcagggctgggtgacgcctcggggctggggctg

SEQ ID NO: 27799 - DNA, 61 bp, Chlorella protothecoides
cagcgcacggtgtcccaatgcagctggcccacccttccatctgccgatcagatacaacctg

SEQ ID NO: 27800 - DNA, 74 bp, Chlorella protothecoides
ataccctcaagaggattgctgaaaaggcacgaacacatgccgttaccttagtgtcatgcgttgagtttcaaggc

SEQ ID NO: 27801 - DNA, 103 bp, Chlorella protothecoides
aagttgtccactcgacgttcgaggtgggggctcctgcagggctgggaggcgtcggcgacaggtgtccaaaaggtctcggaggtggttttctgagcctcacggc

SEQ ID NO: 27802 - DNA, 66 bp, Chlorella protothecoides
ccgggggggcatcatgcgggggcccccgccagggccctggatcaagttcttgcggcgcctgcggcg

SEQ ID NO: 27803 - DNA, 77 bp, Chlorella protothecoides
tcgacgatcggggcctgctttatttattcttgcagacgcattctgcaaaccaagtcgatgggccgttctggccgttt

SEQ ID NO: 27804 - DNA, 149 bp, Chlorella protothecoides
cgggcagcccgctccatcgcctgaggctgggaggggagaaaggggccgtggcgcacggagggatacgcctggcgagaagggctgcaggggcaaagtgtgcggcccgcccgctggccatcgcatccctcatcacccaggcgcccggcgca

SEQ ID NO: 27805 - DNA, 123 bp, Chlorella protothecoides
tccagcccttcgacatcattgtgtatgggcgcgcagccagagttttccccttgcttctccagctactaagatattgtcgagcatgtagtagtggcggcgtatgcttcgcacgagccgaagata

SEQ ID NO: 27806 - DNA, 72 bp, Chlorella protothecoides
tttccagagtacggcgagggcggcatgcccagcgtgtcaggagaggttggggaagccactgtgctggccccc

SEQ ID NO: 27807 - DNA, 263 bp, Chlorella protothecoides
atagcatgcccgaccgcattcacgactcacccggcatcatgacttttcgcatacatccatacaatcggtacatcgaatgcactgtcctggaaggagccggaagcattttcggccaccacttccgccgcccttcactcgacctctatgactcacatggcgctgggaagagcaatgaatgctgactcgcaggcttcctgtggattccaagaaggtttggctactgcgacagccgtttgtatggtggaggaatttccttatgcgct

SEQ ID NO: 27808 - DNA, 61 bp, Chlorella protothecoides
ccaagacacggtacctgtgagataagccagacccctggcaagccgtacattcaagttggga

SEQ ID NO: 27809 - DNA, 101 bp, Chlorella protothecoides
tgcggccgcagcacgagccagactctccaacaggcatcggggctttccggtgtggaggctgtgcaccaccatctcagagcctggcaggcacggcgctgcgc

SEQ ID NO: 27810 - DNA, 570 bp, Chlorella protothecoides
cgggacccccgccccgcggcggcggcggggacgcctcgccctccgccaccagcccgcaccagagcctggcgctggagaccatgaactcggagctgaccgcgctgtcggcagccatggcgggcttgaccgcggagcgcgacgggctggagagccggctgcgcgacgtggagacccagttcgccgcgcagcaggccgtgctcgccctggcccaggacgtgagctggggctgttggtgggttttgggggggtgggggcttgggtgatcatgtcgcgctcactcatgcaggtcgtgcatgggcagccccgatgggaggctcccatgcgggggttgccgacccctggacacccctgggccaccacacgcttcgccatccaaccccgacctccaaaccccgaatcagcgcgtggcggcgcgggaggcgcagctggcggcgctggaggagatgcaggccgcgctcatcgccgcgggcccccgcgccgggtccctgggcgccggcctgggtcaggggcgaggagatgcgcacgggcacgacggcggcgccgcggaggccgcccaggacgcggcggccg

SEQ ID NO: 27811 - DNA, 70 bp, Chlorella protothecoides
gcaaggccagccaatgcaacaggggcaccaatgcaactcgcagctacgcccatgcataagtggctcgtcc

SEQ ID NO: 27812 - DNA, 130 bp, Chlorella protothecoides
cctgcacctgttggacgtccccggggcctccgcccgtcgaggcctcacgcggcccaagggggagggggtgccaggtgaggggcggtcccctcctctcccttgcccgtccggaggcactgccgccccgcac

SEQ ID NO: 27813 - DNA, 523 bp, Chlorella protothecoides
ctggcggcggcgccggcggccagcaggcccttcagcccggcgtcagcgccgggcgcggagatggcggggccggggaggggggacgcacgcgccccggcgcccaccagcggctcctgctggtagcgcatgaccaggggtttgaggcctgtcagcgcgggcaccaccacgccgtccagggccgccatggcgctggccgcgccggccatgtcgccaaagttgacaaaggcgtaggccttgagggggaagacgcgcaccgagtccacgcggccatagggcgagaagaggtccaccagggcctggtcggaggggcgctggttgatgttgcccagccagaggtggcgcgacgcggacagcggcccgcgcgcagaatcgcccggcgcggccaagccctcgcgctcccccggcgtctcgcccgccggcttgtaccgcatcttcagctgcttgcccccggacagcgcgggcaccacctggagcatgggatgggggggggtggaggcagggtggggggggcggggagggcgca

SEQ ID NO: 27814 - DNA, 1973 bp, Chlorella protothecoides
  modified_base (722)..(731): a, c, t, g, unknown or other
aagtgagagctgtttgtggagctccccacgacctccggaaggggcattgcataatggcgggacccttgaccctaattgtaatacaacctagtaggaatactcacatggcggatggcagggagtagaacttggacgtgcatgctccctggcatgtgtgaggtgggatttctggtcggtgaaggatgggcctcggggacgtgcatgtgactgcccttgccaattgcataccttaattgccaccgtaaggcttaaaaagcagagagctatgccccaagaggtcgatagcccgtgggaccgcattctggcgcggcgaggtcggagcgacgcacagctttgctgtgttaccggaagaggccgaagagagctgtgaggccgggaaaacagtctcccatatatatatgggttcatggagcgtgcatcgggaagcgctgcctcgtaaatttgcgtacccgaggcgcccttggccctctccggcaacggtgtgaccggacactaaagattgacgcgacgtcccgccccccggagtgctccggacggggatggtctctgctaaatatttcaaaagcatacgcagctgagctgccatcgcggcctcgtccagtgcgtcggtcttctaccaacccccatctctatggtgagggtgattattgcagccaatcactggagtgcctgcttcacctctgatccaccttctggtggaaaggcggtgttgcttgggatgnnnnnnnnnngctgttgaatatttcaaagcacacgcagctgcgctgccatcgcggcctcgtccagtgcgtcgctcttctcccaacccccatctctatggtcagggtgatcattgcagccaatcactggagtgcctgcttcgcctctgatccaccctctggtggaaaggcggtgttgcttgggatgctcaggcatggtggcgtgcaatattctctatgatttgcagggcggtaacaccgtccagtcttggacctcgggcctctcgcatgttgcttcaatgtcagggcgggaggaaaatggttcaggtacactggacgttgctccctgcccaatcctcctggcggtgccagccatggatctcgagatgagttctatgtcgaagcgtgcacagagggatgcatcagcaagctggtgcgtctggtggaaccccagccgcaaccactcacaacaacaatccaggcacccctccgcggtgtccgccgtggcatcctccctcccctgactggcagccggcgtgctcgggggccctgcgccatggcgccccagggttcctcccatccctatacaggaccagacccgcagccttggcctcccgcaggccgacccgcttcaggccccctcacgcccattgcactccggcgcggccctgcgagcccggaccccctgcctggacgccctgacgtccaggcagccccgcgtcaccaccgcgccctggccccgcagccagcgcgccgcggccttgagcgtggcgaaccccagccagggcgccagggttcccagctccacctcggtggcgtaggccgacaggatcgccgctgcagggggtgggggggcgatgggggttaggcttcgacgagagccggcgcgagggtgaccacgcagggtgggagcgcacaggtgtggggatccgttggcgtgccggcggcggccccttcgctccccttcccagtcctcatgacccagcctcgccactgctctcagggcatgctaggacaccccccccctccggcgcaccgaatgcgtggtccctcagccctggccggaggaggtcgaggcagtaggaggccatgcgcggggccgcggccgccagccgcgcggcttcccgccagtttcctgcgcggtgggccgccaccgaggccagtgcgtgacgcagcatgggccccggaccggtcccccgcgctgcgcagcgggcggccgcgccgcgcagctcggcgcccagcgcggacgcctggcgggaagctgcgcccccagcc

SEQ ID NO: 27815 - DNA, 73 bp, Chlorella protothecoides
accagttgaacacaaagaggtagggacccctctccgccaccaacacctgtatgtcgggtagtgccacgagagg

SEQ ID NO: 27816 - DNA, 77 bp, Chlorella protothecoides
acacgcttgccttctagggagtggagcctcgacgtaactgtggtgcgcagccttgatggggtcccaacatgcccgag

SEQ ID NO: 27817 - DNA, 135 bp, Chlorella protothecoides
gctgtgcagggatgacccctgagcagctcctgcagcttgtgtatgccaccgtggatgccaatgccatggagacaggggtccacattcgtctcatggtcacccgcggcctgaagcccacggtgtgcacttggagcc

SEQ ID NO: 27818 - DNA, 61 bp, Chlorella protothecoides
cccggagacgcactacagcgcacagaaggcgggcatgctgaccgccgacgggcgctgcaag

SEQ ID NO: 27819 - DNA, 86 bp, Chlorella protothecoides
gggggtcccaggctgaggcatgggtgaggttgcccatgcatgtgccctggatctcgacatcctgttggcactgcaggacatgcgca

SEQ ID NO: 27820 - DNA, 80 bp, Chlorella protothecoides
cgtgctccgggtgcgcagacctgccgggggacggggcctgtagggtcgctgcgccgtgggcgtaggcgccgcgcttgatg

SEQ ID NO: 27821 - DNA, 156 bp, Chlorella protothecoides
tctggggtgcatcggaagggggggggggggcgaaggggggtgaggactgcgccaaggacctgcatgctggccagccaggaggcccctcggtctcaagctcaagcagggtgtgggcacagatccccaggagcccccctccatctcccagcacagagc

SEQ ID NO: 27822 - DNA, 61 bp, Chlorella protothecoides
atacaacatctttctcatttggcttctgatcaggcgaacctcgcaaatcacttccactcac

SEQ ID NO: 27823 - DNA, 79 bp, Chlorella protothecoides
agggcgcccagggtggccctgcgctggccaaacctatgcagcagctcttcaggcaccccggggaggctccacacccatc

SEQ ID NO: 27824 - DNA, 61 bp, Chlorella protothecoides
tggaggtaattgtgagtatcggttgatgggtggaatcctgcacccatgacagcatggtaaa

SEQ ID NO: 27825 - DNA, 72 bp, Chlorella protothecoides
caatcggcaggtgaataagcgccccccctatggggggggggaggagattgctgcaccagcaaaatgggctca

SEQ ID NO: 27826 - DNA, 61 bp, Chlorella protothecoides
gtcagtgcatatacccatggcaggatatggggttggatgtaaagcatctggcggaggtgct

SEQ ID NO: 27827 - DNA, 61 bp, Chlorella protothecoides
tggcacgtccgacccactgcaaggctgagcttcgccgctcatcggatgagcagtgtttctc

SEQ ID NO: 27828 - DNA, 80 bp, Chlorella protothecoides
agtgtcaatgatgagatgacttcgcgcacagaccgttgtctggcagagtttggcattgcggggctcttccgaaagctcga

SEQ ID NO: 27829 - DNA, 120 bp, Chlorella protothecoides
ttgccctgcagacaggttgaggcagcacggagttgatcaatggcttacgctgcttttcctgtatggtgttcccatgcctgcccacacaacaatcactatctacctggtgcacggcatagc

SEQ ID NO: 27830 - DNA, 79 bp, Chlorella protothecoides
ttgtttcacagcaaagggagcccgggatcaccccccggaacgtgggtcaccagggtgccggcttccctcccatgactgg

SEQ ID NO: 27831 - DNA, 61 bp, Chlorella protothecoides
cgacatggcgtggaactccttggaggagcaagatgtcatgttggcgtgttcgtccaccgcg

SEQ ID NO: 27832 - DNA, 127 bp, Chlorella protothecoides
gttttgtagagccaatgggtgtgaccacacaaccaccggactctcctcgcttgctgccgatggcaaagcgcacacatgcccctcatccgtttcaagtcagaccctcgcctcggagaacttgatgctc

SEQ ID NO: 27833 - DNA, 61 bp, Chlorella protothecoides
cagtgtgtttgtcgccgagtgatgctcccttcaccctccatacctaccgtgctcctgcaaa

SEQ ID NO: 27834 - DNA, 139 bp, Chlorella protothecoides
ggtggagcgcccgcgagtgtcgtgccggcggggtgcattgattcgccaccactcctgccgaccatcgcttgcggccctgctcaaggaaacctacttgatcaatccctcccacatcctccaccccccaatcactgtggca

SEQ ID NO: 27835 - DNA, 72 bp, Chlorella protothecoides
gtatccaggcagatgacggtgggaaataccacccccagcacgaagaggccgctgcccaaggccgcactgatg

SEQ ID NO: 27836 - DNA, 75 bp, Chlorella protothecoides
gccgcctcgtggataaaggggccgaggcacgagggtcgctgtcgactgttgacctaggagtcaaatgggccggcc

SEQ ID NO: 27837 - DNA, 77 bp, Chlorella protothecoides
tgggaagtcgtaatataggactaccgcggaattgggctgccctggagttcggtggacgggatccggccgcgtcgaca

SEQ ID NO: 27838 - DNA, 131 bp, Chlorella protothecoides
cgtggagtgctttgaggtgcggggcggtggtggggacgctcatgtcatgggtgtggtgattttccaatgtcgctgcaccctgctcgatcaggacaaggtggtggagtctcgcacccttttcgcactgtcag

SEQ ID NO: 27839 - DNA, 61 bp, Chlorella protothecoides
tcccagggtaccattcatcaagtcctcactttggccccacacccacacccacagcacaaca

SEQ ID NO: 27840 - DNA, 68 bp, Chlorella protothecoides
acggccttggaacactcgtcctctatcatgtcgggggccatttgagccatttcagggatggactatgg

SEQ ID NO: 27841 - DNA, 61 bp, Chlorella protothecoides
gcgccccagtaggccaccatgctgatgaggacccctgccgaacccctctgatcgctgctcc

SEQ ID NO: 27842 - DNA, 94 bp, Chlorella protothecoides
gagctcctggatggtacaaggtcggggcgcggacctgagcggcccaaaggtgacgagcccccggggggtatacataaaagtcggacaacggggg

SEQ ID NO: 27843 - DNA, 74 bp, Chlorella protothecoides
gtctacatgctggagctcaacagcgcggatgccttttgcaagtgtgtgctcggctcttgcatgaatgtggcttg

SEQ ID NO: 27844 - DNA, 78 bp, Chlorella protothecoides
tgttgccattcttgtcagccgtgcacgcctcctgtcccggcttgagacactcgacgctgactatgatgtcagtggacc

SEQ ID NO: 27845 - DNA, 169 bp, Chlorella protothecoides
gtgctccagaccttgcggtttaggcgtgcgagggaggggaagtcatgagagccctcacagacatgtctcccggcagctcaccaggatcaggaggccgcgaggtcgtcccagggaatccacccacctggcacccccagcgtgcccacaggttctgcctcgctgcggtctc

SEQ ID NO: 27846 - DNA, 71 bp, Chlorella protothecoides
cctttcactcccgccttggtggtgcagccttacacccccctccaacacacacacgcacccaacacacacac

SEQ ID NO: 27847 - DNA, 63 bp, Chlorella protothecoides
cctcctcccggggcggcggcggcgccgggtcagtgaccggcgcgggcgccgccctcttcgtcc

SEQ ID NO: 27848 - DNA, 114 bp, Chlorella protothecoides
tctgttggagtatttttggaccattggacaatcggtacgctcggaagtccagcaggacgaatgccttgttggaaaattgaaaatatctgggccgctccgcttcgacccgggcct

SEQ ID NO: 27849 - DNA, 78 bp, Chlorella protothecoides
gtgagcagcgccttgtacttggccttgtcctttgccagcttggcgagccgggagtgcgcctcggtcagcaaggtctgt

SEQ ID NO: 27850 - DNA, 102 bp, Chlorella protothecoides
ggagcagggctgaggctggcgtggagagggggctgcaaccctttcacaggtgcggcaggccgttggccggggacgtggggcctaggccaggcgcaaggcccc

SEQ ID NO: 27851 - DNA, 100 bp, Chlorella protothecoides
ccaaaagcaagaaaacgatggtaggccacaaggtcagcaaaatttcgcggtaaactgatgtatgtgctcagaaagagtgagctgcggcgacacagggggc

SEQ ID NO: 27852 - DNA, 61 bp, Chlorella protothecoides
tggtggtgatcgcaaacatccctcagcaatacgtccgttggtttcgtgtctcgcatgttgg

SEQ ID NO: 27853 - DNA, 70 bp, Chlorella protothecoides
ggtactgcagggcagggggtcctggtaccgcgcgcgggtagtcaaggacgccggggaccgcgttctcctg

SEQ ID NO: 27854 - DNA, 96 bp, Chlorella protothecoides
aacatgcgcaatgggaggggagctggagtgcaaggaatgggattgaaacgccggtgagacccacgtggcatccctcttcccagggcacacatacga

SEQ ID NO: 27855 - DNA, 61 bp, Chlorella protothecoides
cgcgtgataccccagggtgaggcacactggtacccgagttctcacctcttcgttgaaatac

SEQ ID NO: 27856 - DNA, 88 bp, Chlorella protothecoides
tttccaaatgctgacccaggctcatttaccgcctgggaccccagctgctgatgcgtctgtcgtcaagaggacctgggccgggctggcc

SEQ ID NO: 27857 - DNA, 69 bp, Chlorella protothecoides
agcatggcacagccacgatcgaaaactcggaggtcctttccccccccttccactttccaagccactcac

SEQ ID NO: 27858 - DNA, 61 bp, Chlorella protothecoides
gaacgtgagccaaaggatgagggggggggggactggaatggggcaggacggcacgtgggcc

SEQ ID NO: 27859 - DNA, 113 bp, Chlorella protothecoides
atatggcctgcagggcggccgaaaggggtgggggaggatggggattccgcatgacgatccgagctaggatgccggcaggtgcgatggtttctgcccatgctgccttccccacc

SEQ ID NO: 27860 - DNA, 72 bp, Chlorella protothecoides
cctgtctccttgtgaatctgtgcgggagcacgtccgaacatcgattccatgtgacactcgggagatgctcgg

SEQ ID NO: 27861 - DNA, 78 bp, Chlorella protothecoides
caatcttgctcctgcctcccagctcccactctaaccctccccccccccttccccacctgcgagccagccggacgtcgt

SEQ ID NO: 27862 - DNA, 74 bp, Chlorella protothecoides
cctggcctggcatgggaagcaatggtgccgaagagcacgctgccgtgtcccatgatcataccatgcctccctac

SEQ ID NO: 27863 - DNA, 112 bp, Chlorella protothecoides
ttgagaccaaaggctgcgccgctccccccaacactctccactgcccagcactgattcccccccgattgtaccccagggcccctcattgtacatagtctacactgccgtgttc

SEQ ID NO: 27864 - DNA, 66 bp, Chlorella protothecoides
gcgcgcagcagccagggcgccaccagcgtgcctggatcgccggggctgagggtccgtggcgtcgtc

SEQ ID NO: 27865 - DNA, 73 bp, Chlorella protothecoides
ctgcagccaggtgggaaggatgtttgggaaattcacgaagtccgtcctcgcctttctgtgtcacagttgcgcc

SEQ ID NO: 27866 - DNA, 61 bp, Chlorella protothecoides
cgaggcgcagctcgcgctcgccgaagcaggccaggcggcgcaggaagccgacggcgcgcag

SEQ ID NO: 27867 - DNA, 129 bp, Chlorella protothecoides
cgacgctggtgccatagtgttcccatacctgatcaattgcacatgatgataataaaaataggatcgatggcgcctcgtaaccaataccagctccgcttcagggttgcctttgtccttccctgatggacc

SEQ ID NO: 27868 - DNA, 135 bp, Chlorella protothecoides
cggggaggtaggtgctgtttgtacgtgtgttggggggtgggggcatggctggtgagggggcggcctgcactcggtgtatgcatgcatgcatgtgcctgcagaaagagagttcctgacggtccttgtggaattggc

SEQ ID NO: 27869 - DNA, 89 bp, Chlorella protothecoides
tctcgataagaatgttaggatgggcagagggatggcatttactgtgcctcacagctttacctgctgtgtccggtatgaaactgccaata

SEQ ID NO: 27870 - DNA, 69 bp, Chlorella protothecoides
gcaatcctcagccggtccaggtccaggcggaggtgggcgctggagccgcctggcgtcagcatgcggccc

SEQ ID NO: 27871 - DNA, 165 bp, Chlorella protothecoides
atggtacagggatcacagcagactgtgctgggtccacaacccatctcaaagtaaaaactgtcaggtcatgatgttccaggcaattcctctggcagctgggtcgagcttttgatgccgcgtgcaaactgtgctccgatcaggcacaccactccaaagaaggtgtag

SEQ ID NO: 27872 - DNA, 61 bp, Chlorella protothecoides
aggacaaggagcactccgtggtgagtggaacggaaagtcggtctttggtgcacaacttttg

SEQ ID NO: 27873 - DNA, 96 bp, Chlorella protothecoides
aagtggtcatgcaggcttgctgggcatcctagagcactagtcccccagggagggcgctatgtatgcttgcgcaccggggtttaggggttgccgcat

SEQ ID NO: 27874 - DNA, 78 bp, Chlorella protothecoides
gagtgagcgggaaacgtgagatgtggacagcagggagacctgaacgatgcgccgtgctcggccgaggactgccagtgt

SEQ ID NO: 27875 - DNA, 61 bp, Chlorella protothecoides
gtctccccctccacccaagaagtcgtctccacctccacccaagaagtcgtctccccctcca

SEQ ID NO: 27876 - DNA, 76 bp, Chlorella protothecoides
aatgcgtctggctcaagatcgtgatgcgccacgacgcgtacatcaggcaaagatgccaattgtcttgcccatgtga

SEQ ID NO: 27877 - DNA, 458 bp, Chlorella protothecoides
  modified_base (97)..(261): a, c, t, g, unknown or other
  modified_base (337)..(346): a, c, t, g, unknown or other
ggtacagtcacggaccactcaccggtagtagtcgtcggcgattcccctgctgtttggggcgcccaagggcgccccgccgcgggtgcgcttgccgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctccagtgcccagcagagtaccacccgcagccctcaaagcggcggaagttgaacaggagggcgaagaaggccnnnnnnnnnntccgcagccctcgaagcgccgaaagttgaacaggagagcaaagaaggcccacccgacgtgtacaaaccaggcagtcttcttttcgtccgtcttctccgtcttcttcctcccc

SEQ ID NO: 27878 - DNA, 74 bp, Chlorella protothecoides
cccgcggccaagaggcgagcgagtggtggccactatgcgggacagggtttccccacattctctgttgagcacgt

SEQ ID NO: 27879 - DNA, 61 bp, Chlorella protothecoides
tgaaactcgttgaaaatctctcctgtagggaccttccgatgccatgcccgctgcaggacca

SEQ ID NO: 27880 - DNA, 65 bp, Chlorella protothecoides
aacgccccgcgattgtgtccctccaccctcaaaatattcgctcctttcctccccccgggcaccgc

SEQ ID NO: 27881 - DNA, 942 bp, Chlorella protothecoides
  modified_base (326)..(411): a, c, t, g, unknown or other
cggcggcgcagagcccgtccaggaaagagtcctcacgccccgcttccagcagcgccgccagcctggcggccagcgcggccgggacctcggggcggcacagcacgcggcactccggcgagccgccgctggcgcggggggtcccgagctcactcacgcccggtcccgcgccccctcccgtgccgcgccccgcgcccagggtctcccacaacacctcggcggtgagcagggggccgtgcgctgagggcccccgcccctccaccacgaaggtggcggacaggaggcccgcgctggccaggcggcaccggcagctgccgggcagccgcccnnnnnnnnnnnnnnnnnnnnnnnnnnnnnnnnnnnnnnnnnnnnnnnnnnnnnnnnnnnnnnnnnnnnnnnnnnnnnnnnnnnnnncccctcctcccccgcaacctcaccattctcatgctcgacctccggcgcggcccggcagcgggccatgcagcgcgccaggcagaggtgcaggcgcaggctggaaagcagggcggccacgcctcgcagcacgctctggcctgtgtcggttttggaaagggggaaggcggggagggttcggcggcttgcagcgacacagcttgccggcggcgttcaccgccccgaggcaccgccaggcaggacgccacggcacgaccgaggacccaccagcaccaagacacatgggcccggccccacctcgctggaagctgcccgccagctccagcccgcggcgcccgcagcgcacgacctcgaccgccggggccttcccgtcgcagccatcctgcagctcgacgcccgcgtcacgcagccgcgcggcccgggaggcaaagtagcgcgagtccagctcccccctccactccccccggtcgccgtgcagccagaagcgcgcctggggggcgcacaacccaacgccggcgccggcgccggccgcgc

SEQ ID NO: 27882 - DNA, 11993 bp, Chlorella protothecoides
  modified_base (1140)..(1149): a, c, t, g, unknown or other
  modified_base (2196)..(2281): a, c, t, g, unknown or other
  modified_base (2436)..(2445): a, c, t, g, unknown or other
  modified_base (2677)..(2686): a, c, t, g, unknown or other
  modified_base (6890)..(6930): a, c, t, g, unknown or other
  modified_base (7751)..(7760): a, c, t, g, unknown or other
  modified_base (9301)..(9310): a, c, t, g, unknown or other
ggggggggcgcggtgccatgtgggcagagacgcccgcattcgatgtgatgggtgcagtgggcgagacgaggttgcccagcaagtcgataataggatccaacagacacgctgtgtcaacactcgccctcccccccacacatctgaaatccctttccccctatgcttcacacctttggcaaagttgaggaaaaagtccagcgtcgccttcttgtcctcgttcttgaggtccttgagtgccgcgccgatgatctcaaaagcggtcttcgccatggggtgcgcgcacttgtcggggtggaccatgagggaggacttgcggtactgccgcggcacaacctccatgctcgcgtcaaagcgcaggcccagctgctcataggggttcagcttgaaggcgcccaagatgcggttgacctcgttgtctcggtccacctccttcatgtcggagtagaactcctgtgcagggggaaggcatgcagattgctagcgtggtaagaagacaagggcgaggggctgccgcaggcacggcattgcatcatgcacactcaaggcacaggaggggaaaggggatgcgacaccctgctggcaccacttggctgggcagcagccatcaacacatgtcaatgccgccacacctggaagccatcctcgcgaaccccttgcatcaatccagcatttaccttgagcgccggatcgtcggtatcatggatgtctgccgcctcctccagggccagctccgcctcctccctctccctctgtgcaacgatgaggggatcctcctcctcttccacctcctcagcatcggctatgggaggagttgggacggactcaccatttgtatcagattcgggaggtagaggaggggaaacgcctggaggatcagcggggggtgcctgctccttgagcggagggacagcgtccggggttatggaggttaatccagcctcctctggctgccctgactcggccattatatcgtggaatgtttgaaattcgttcaggacagagcttcaatggtgcacctcgcaatcgtgctcaagtttttctcatcgacgaacccttcaggacatccaggtcgtcgcgccctggctgcgacagggcgcgatgaatgggtgtattgttcgtcgctgcatacatcgtggggcnnnnnnnnnnccaggacatccaggtcgtcgcgccctggccgcgacagggcgcgatggatgggtatattgttcgtcgctgcatacatcgtggggccaggccgtcacaaacagtagacctggacaaaagcatgtatatataccattgaaactccgagcactgaatatagccccagacaccccgagtctgcaccccgcatgctgccgtggtctttgctagtatccgcatatatataaggctttgcggtccttcttgcaaactacagtgcgaagtcgtgtagaccaatgtcgggtctccgcgctgcaggcggtgtggccaagcgctcggccaagaaggtcgcaaaaggcttctcaggtacggtgggtggagactcgcatctgccagggagcactcacgcagcaagaggttgagacctgagccaaggcaggaaaccagaaaggctgaactacaggcaaattcacgctcttttctctcccaggcattgagttccacaagtccaagggccagcatatcttgaagaaccccctggttgtgcagtccatcgtcgacaagtctggcctcaagtcgaccgatgttgtccttgaaattgggccaggaaccggtaacctgaccatgaagctgctggaaaaggcgaaaagagtggtcgccgtcgagcttgatccgcgaatggtgaggcagggggcaggagcctcctggtgggaggatgctgtgtgtcgagccacttctggaccagcgcccggagtcagagccttgctgcgggtggcgccccactcctcctgatctggtatacagaatgctgaaaacccctcccctcactacctctgtgctgtcttgtcgtgctgctcctcaggtgttggagctgcagcgaagagtggcggggactccacacagcgcctccctccagatcatccacggcgatgtcatgaaggtcgacctcccatatttcgacgtgtgtgtggccaacatcccatatcagatctcctccccgctcacattcaagctgctgtcccacaggtgggtgacttagggggggtgaggggcatcattgggcatcctttnnnnnnnnnnnnnnnnnnnnnnnnnnnnnnnnnnnnnnnnnnnnnnnnnnnnnnnnnnnnnnnnnnnnnnnnnnnnnnnnnnnnnntgtaccagcacgagtttgccatgcggctggtggcaaggcccggggaccccctgtactccaggctgaccgtcaacactcagctcctctccaggtctgttgcggggattcgttgtgggcgtcgtccagcttgtacagcctggatggggtactgagtnnnnnnnnnnccagctcctctccaggtctgttgcagggattcgttgtaggcattgtcgagcttgtacagcctggatggggtactgagtgtcgggtgtgcggctttccgaaggttacaaaggcaggcgcacgacttgaatgcctcgagctgtcatttgggagcggcttcagtcctcttctcctaaaaatctctcaccctttctgactcaagtatcgtcctgagggcaccatgcgccaaggccnnnnnnnnnntctcctatgaatctctcactctttctgactcaaggatcgtcctgagggcaccatgcgccaaggcccaactcaccccacgcgctcccatcaatccgctcacagggtgcaccatctgctcaaggtgggcaagaacaacttccgcccgccccccaaggtggactccagcgtggtgcgcatcgagccgcgcaacccccctccccccatcaacttcctggagtgggacgggctggtcaggctgtgctttgggcgcaagaacaagacgctgagcgccctgttccggcagtccacaacgctgcaccagctggaggagaactacctgctgagtaacgcgctggtgaagggcgcggacgggaccacccaggacctggcctcggcgctggctacgatggccatcgaggcgccggctggaaaggaggcggaggagggcgaggaggagggcgaggaggaggacgaggacgaggagatggacttggagggtggcgcacagcaggccaaggctgcgcaaccgaggaggaagaagcgggggagggccagcgaggagtttaagcaaaaggtgctgggcgtgctgcagggcggcggcttcagcgactggcgcgccgccaagctgagtcaggacgagttcctggccctgctcgcggctttcaatagggcaggcatccactttgtatgacgctgcctgcatggctgcgctggtatcgtacaactctgtaacattgacagccgccacatctgtcctgggagcgttcgacgacccggatgcgatcatgagttgacgaatcaccgtcacgtgggccagcaaacatgaggatcggatcatggcggtgaagcatgttgcagaggcacggcccatttgatcgtactgagttctgggactggtgttatcaaggattcacacacgccatgatactcgccgcagcgcaccccgtccctcgagtcaccggcagggtcccggcctcgcagggtccatcatgcagtaccaggagggcgatggcagtgaggacggcgtgccaggctgctccacatgatatggagaggcgccatgccctgatcgggatgcttggtgagaggatggggcccatgcgattggcctggtcgcccatgctgctgcacccccctcgtgcatgagcatcatgggtggtttctgcgtgcccagggtaatccgactccctcccagaccgctgcctgcaccccatgccccccaggtgccggctgcttcctgccctcggcggcagcccaggcccaggaactgggctcccaggtgagtgtggaccagctgaacacattccagaaggccgacatcatcgctgacgtgcagcggcgggcgctcaaggcgctgaagcaggagctgacggccgctgacgcctccagcgcgctgcgcctcgtcctgcacgacgccgccacctacaacgtggccaccggaaccggtggcgtggatgggtccattgtcacctcgtgagcggggggccttgttgcagagtgtcatgggatggaaggctgtggcatgggatgtggttgcgagggaggtggagggggttgcagggagactccctagcacaaatgttgcccagccacgtacaccagcatgcgctgcggtgaatgaagtggagggcatgccatgctgcagcctccctaccccaccgcaatttgctgttcccttgctacagggaggagctggatcggccagagaacaagtccttggtgccgctggtcaagcgcctgtccaaggtcaaggcggagctggatgggcaggcggagaagcggggtcaggcccccatctcctgggcggatctcatcgtgctggccggtgctgcggcggccagcctggactggaaggccatcaagctgggccgcgccaccgacgccgcagggggggagatcatcgcctcgcagctggccacccccatccccgtctcgctggggaggggggactcgccggcgcccaaccccagccccatcatccctatcccgaccgagaacgccagcccccaggaagtcaaggtggggcccatggagggtgaggtgtggtgtgtgagagggggcgtaggccaccttactgctggagcatgcaacagagaaggcgccagcagcgcagcaggggaaaggattatggagcatggtcggcatgctcagcaccttcccgcgacatggttctgcacggacgtatgccgattcctctcctcaacccagcacatgcctgttgtgccctcaacaaccctgcaggactttttcaaccgactgggcaaccccagctccgacaatggggagggtctgttctcacgcaagccccccttcttccctcgggccgcctttgtgctgtggacagcggcgcagccagaccccgcagcggcggaggcgaagctggctacggacccggcctttgcggagtggaagaccagctacgaccgcagccggcgcaccgtcacccgcaacagtgagtcgttggagtttggtctgggggcttgatggtgatcctgagtggcactctgctctcgcagtgtgtttcattgccactaggtgggatgcaggtccaggaaggtgccaagttgcgcattatgtcacctcaagcagaagcttcctgctgcagtgcccagcacctcaatgtagagcagcctccgatgtcccccaactgtgcctgcccaaacccctgattccccctaaacccctcaacccagactacgaggtggactttggcacctactacgagcgcctggccaacctgggtgccaagtttgatcgcacccgctacctcattcccctgaaaacagccaacatcccccggctctgaggtgcttctcctgttgtaccaagagaaaggtcaccatgttgtcgttgagcttacacaataccgagagtctccaatcactttgacttttcaggataaagaaaagtggcagtttgggcaccaggcgcagctgcagtgaaacctcacgggcggcgcaccccctgacgcagaacaaggatgcatagcacatgccacgccagacccctcactcgtcagccactccctccaccagctggaaagcgcgcagggtgtcgcacaccgcctccacccccgccccccgccggatgatggaaaaggtccctggccgcgtcaggtccaccaccgtcgacccggtccgatcggtgcccagcaccccgtcatcatacaccgcctcgcactgcggccagagttgctgcggggtggtgggtgagagtgtggtgcccgaggtatgatgcgtttggaacggggccccaccaatcatccctcgacaccgttacgcagccgggtaccccctccatcacctgaccacaacatatccgcctctctttctccccaccccacccccaaaatccccctcctcacctgaaactcggtcaccgccacgctgctggtctgccccgaggcgttggccgaggtgagggccagcgcgccgcccagctgtcgggcgaccgcccgcacgaaggccgagtccgggattcgcacgcccaggctcgccgtcccgcggttgagccccggcgccagcggcgcgtcggccctcctttccagcagcagggtgacaggtccggggagcagggcccccaccaggccgggcggcaggtgggcggcggtcacgtagcgcggcagcgcccgcgtgtcggccagcgcgatcgccacgggcttggcgtgccgccggcccttgacggcgtagaggcgggccacgccgccctcgtcgcgcgcgctggcggccaggccgtagagcgtgtcagtgggcagcgccacgacgccgccgccggccagcgcagcggccgcagcgcgcacagcgtgcagggcggcggggcgcacgccgccggccgaggtggggggcggtccttgggtgctgacgcagcgcggcgactcgggcgacgctccgccgtcgaccctcggtccttgagagccgctcgccctcgcgcgagagggcaggaaggagaggtcaaagaccacagggaggtggtcggagggcaggctgcgggagggcaggaaggagcccagctcggcggcgctgggcgtcggcatgacatcgacgcactccagcgcggcagggtcatacctgcaatattggggaggtttgggaggaagtgggcaagtgtggtgaacgggagccgggtggatgaaattctttccccattgacatctttaccgaccattcatgcgtcacatcactactgcacgcaccgcccgtcctccccccccccccccccccccccnnnnnnnnnnnnnnnnnnnnnnnnnnnnnnnnnnnnnnnnncaatgcatcacacgcaccacacatagtccaagaggccctggtagccggagacgtagttgctgaagggcgcctgcaggtcgcccgctggcctcaacggccttggccaggcgaggctcaagtccaggccacaagcggcagggtcaggccggaccgcggctgcctctggtaagggagcaggcccccccttcggctcgccctcgtcctcctcgccgatctcgtcgccggaattccccttgttcttccccgtccgatgccagtcaaagtccacccccgcctcccagtcccaatagtctgcgcccagctgcccagtctccagcagctgcagggcacctgcgcgattgcaatggcaaagggtagcgagtaacttgagcggggccaacgattgagttgtatggctgcaccccgtagtgcccgccgggcttgctctgaggcgttgcatgccctgtcgagcgtccaaaacagcaatagcacccaggtcagagtgtgtggaacagctaccaccacctctctgccgcccacctgggatgccgtcgttcaggtcgctgttcatgtcgccgcagaagagcagggtgggctccagctcgcagtccttcaccaggtcggctgattcttgcaggaaggcacacgcctcctgcaagcagggaacatggggagggaacgcacgtgagccaggtgctctgtagtctgagaggcgtgcgcggactatcagcacagaaaagctcacccttccgtgcgggccccgatcagcctttctgcatgaggattgcagcgtcccaaatccagtgggtcacccctcgttcccgccttcctcacgccccttnnnnnnnnnntgcagcacagaaaacctcatccttccgtgcgggccccgaccagcctttctgcatgaggattgcagcgtccaaaatccagtgggtcgcccctcgttcccgccttcctcacgccccttcccatcccttcttcttcccaccttgacggcggcccaggtgtgcagggttcgaatgtgaggcgcatcgttgtggaagaagaggtgtgtgttgacgaggcacagcggcgcgtggcggggatcccgcgggcgcagcagcagcagctgggccaccgtccccacgcgctgcagcgcctccctcagcgaggggtgcgcctccaggaaggccgccagggcggggccgtatcgctcggagagaggggatcgtgtggccatggaccccgcagcgtcttcgggcccgtctgcctcacgcctggcaagaaaggccgcccgaaagtccacatcgcggcgcgcggccagctcgtagcggtcggagcgaaagaaagcggcctccccctccgccaccttgcccagcttgttggtgtagacgccgctgtacccggcgtcccgcaggccaggctccagcaggccgcggaaggccgactcgtccacctcctggaggcacaggatatcggcctggaactccaggagctggcccaggatgaggggccggcggtgcgttggcctcaggtacctggagatggggggcgggaggtggcgcagcgcgggtgagggagctggtcacggaacggggaaagaagaccatggacagtgcagaaatggccaggatgcggctccggggtcagagagcaacaggagcctggccccccacaaaacactctgcctacttttctgggcagtggccgaagagcaccgacttggctcgctcggtggccgcatactggtcggccaggatgttgtaggacacaaccctcagccgtgggggcaccgtcgcctccagcctggcgggggggatgcagaccttggcggggccaggctgagttgcagggtggggctgcaccctgccgccggcgacggcaagagccgcctcgccccacgtcggcgccgcgccaccttttccacgccgtccgggggtgcaccgcaccctgaccagggcgcccacatcctctggggtggggatgtaggtccgctgcactccgcgcccggcagagcaagccgggtcgccgcccaccctggtccagacggaggcaggcggacgctgcacttcccactcccaggagcaggcgtcctcgtccgcaaacagcagctgtgggtcagttgggtgtatgtgtgggaggagggggatgttggtgctcagcgtggacatcactcctgccgagggacacttgtctgggcaggtcaaagtcccatgctggccattccagaaggtttatctgcgatgccggcgacccacacgcctcccagtcgtataccttccctccctcacggtgcccacagcacaacctccatcctcacctggggcacggggacgagcgggatacccacaaaggcgtccccatacacgtctagcttggcgatgaggggcgggttccgcaggatgggcagccnnnnnnnnnngcctccatccccacctggggcacggggacgagcgggatacctacaaaggcatccccatacacgtccagcttggcggtgaggggcgggttccgcaggatgggcagcctcgcctccccgagctgcagaatgtgccccgtcacccaggccgcctcgttggtgacagaggatgcatccaggctcggctgcgtcagccctgccaggaccgccaccgaggcagaggctggctgggccgaggaggggtctgtggcctgctggctccggcccttatgtttcttgcctgggaggtgggccacatgggtgttgaggagacgcatcagtcatggcagcggcacagactgcatgtgtgcacagatcttctagggatatcagagaggttggggctgaagccctcctggcgccagactctacctttccctggggcggagaggtttgcgaggagtctggccaggggtttctcgaggagctcctccttgggccgctgcaagtggcgttgaacgccccccacagtcagactgattgtcatgtttggttccccaggaacggacttgacgaccacctgcagcaggacatggagtgctctcatgagcgcactgcatgcgggggccacttgcaccggcttgcagctggccaaacttggtgccacgacccaattgtgcactatccaccagggcaaggcccagcagtttgcatatctcactttgtgggcttcgtcgctcctgggctgctcggcagaagccatggttcggggtcggtggaggccgcccaacacacccagtggccgagggactcgaacttggcgcgtgagggcccttaaaagggagcccctcgcacgacaggaaagcaacatcagggtttcatgactcctcctgtctccgggacctcatgcatggttgagctgggggcatcagcctcaaaacttgtgaagggacggtcctggacctgggccgactgcccgtgcgttcagcagtggcaccacaccaatccaatcgctgactggtcctcataaaaatatcatttaaatcaatcctttcggccaacatccgctgcacagctggtgtgaggcccggcatgatgctcgtcgggattgcagtccagggcgcgggcgcgctgcggttggatgtgtacccacctcagatctgatgctcaactccacacccactggccctgtgctcggtatacatagggtaatgggggcactgcaatattctcagcaagcgcagggggttcagggggctatgcaaccagctgcctcgagggggaaaggggatacccagctgaggatacattaaatccttggcagccgtgagggtgtagaccatggggtggtgcaggtggcggaggtgaggggcagggtaaacggaagggtggggaggggggcccggtggcaaaaagaagggggctccggacgggcactgcggccgagggcagccctggattccagaccattggggtgcctccctccgtctcacaaaagcgggaccagcgagcatgaaggacaccagcgtgcatttgagccagggggcagcgatgaaggaggggttcaagcttgtatgcaaggtgcaaggggggtgagggggggtcgagcgggagcgacgcgccggcgcactccagggggccacgcccggggggggggcatgcagggactgtgcaggccggctcccagcacgtctggcactcgccccgagcggcagatgaaaagggatgggcgacactgtgaggcggacttgcctctgcccgctcccatgcggggccaccgtccccggcagcattcgagggggtggcctgacaaaactttggggctggggccctgagcacgccagatccctgtgaaggggcccctggcgcttctccacgccccatcagcagaatgaacgggggcggccgggggagggaggggaggtggtgacgcggcgcgccccagtgcctcgcctcgggtccacccgctctccagcagccacgcgtcagaggtcgcggcccaggacctctgaccccggcgccgaccccggcctgctcgcggcggccaccaggttcatggcgccgcccgcgccggcagggacgggccggcaggcggccatgggcgtgccgcggaccaggcgcgcgccgccgcccagcacgccgccctccagcaggttgagcgagcgcaactccacggccttcatggcgtcggcggccgcgcggcgcagcgtctccttgtctgtggatgggtgtcgggggcggtgggttggtgctccgaacgccgatcactgcggctggtgccaggagcgcgggccggggcccagcaaccatttcccaccctgtgtcagagccggcgcagccacgcgcgcccggcctcctgcaaaaccccacgccggccagcattcatgcctcctcctacacacacacacaccccactccccccaaacacatgctcaactagctccaacccttccaagggtcccccttcccatcgactcaccccgcggcacgaggctggacagcttgcgcgtgccctccagcaggcagccggcgacggacttggtgggcgacgcagacgcgtcggcgcgctgcggcgaggcctcgcggctgaccacgccgctgacgggcgcagaggccgtcaccagcgcggaggccaccagcggcgcgcccaggcccgcctcgtccacgcccatggcgggggccgggcgcgcagcggcgccgaccccgc

SEQ ID NO: 27883 - DNA, 62 bp, Chlorella protothecoides
ggaaacagacggaggctcgtgaggttgaggtgccagcatgtcccacccgtgcgacccatact

SEQ ID NO: 27884 - DNA, 176 bp, Chlorella protothecoides
ctgtggtagccgatgcctggaagtaccgctcgtcaacatctgatcaagtctcttaaccacttgtcatgtaggcgtcgcctctagctgttctacgagcatgggtcaggagtatccctcccgtcacgaggtggggaagggcgggtccccctttgggccgtagcgcgctcggatcgcgt

SEQ ID NO: 27885 - DNA, 74 bp, Chlorella protothecoides
tgcatgcatgcagttgggtatgtgcatgggcttgaagctgtaggggagacaatgcaggccatgggaccttgctc

SEQ ID NO: 27886 - DNA, 96 bp, Chlorella protothecoides
ggtgcggggacccccggggtctacgccaggaagggacggtgaggggacgaccgtttgcggtaccaatttccgcagtacccaaactcctcgacccag

SEQ ID NO: 27887 - DNA, 92 bp, Chlorella protothecoides
cctggcacacccttccttttatacccaggttcccccaacccttccctgcctcccagcaatttgtctgcggactgtttgacagaaacaacccc

SEQ ID NO: 27888 - DNA, 72 bp, Chlorella protothecoides
gcataccgacgccaccatgcctccagcctccctcagaataaaaagaccatgcatgcagcctccacctgatca

SEQ ID NO: 27889 - DNA, 704 bp, Chlorella protothecoides
gggggggggcgcgtgggtgttggtgctcgatcagaggggcagcaggtgtgtgcggctgggggcgtgtttgcaagcctgcgcagcgcgagagcctggccgagggaccgatgaacttgccgggccccccccacctcaatctggtcaccagcaccacgcacatgatgttgctggcgatgacggccttgttgtccttcccccttgtgatctcggtgaggttgagcaggtcccggatgacggtgaccaagaacctgggaggggttcagaggccatggagcggtgaggtcggcgtgactggacatgccaggacaacgagggcagtgagctgcacggtaaccctggccccggagcagcagtcacgccctcgccccctcacgcctcccaccttcccatccctggcagcccatgcgcggtgccgccctgccacccaccctcgcacctgttctcctggtcctccaccatgctgccggagatgctgccaatggcccagcacagccggttgagggcagaccagccccagttggcgccgttgatttgctgagatggggagtggggttcaggggtggggcaaagcatggtgaacggttgcagggcgttgccctgaggggtgtggcacgaagccccgcatcttgcagcccagctgctgatgtgagccagcctgcatggcaaaagtaaacacccatcccccccccaccccctccccccac

SEQ ID NO: 27890 - DNA, 68 bp, Chlorella protothecoides
aaggcgtgagcagggacggtgcacctgacccacagagaccatgctcggcaggacatggagcggggtgg

SEQ ID NO: 27891 - DNA, 170 bp, Chlorella protothecoides
ggacgtcactcaaatacgacgcttcgggaataaaaaggtgtcaattcaacccatttcttaaaatgggtgctgcagtgccgtgatgcagcgtgtggcgtggtggagtgtcgcaactcaccccctggaaggacgcgagcgtcaattgcattgcaccctcatcaagccatagg

SEQ ID NO: 27892 - DNA, 113 bp, Chlorella protothecoides
aatatctctgcgcagggtggttggacacctcgtgaaggtttgaccataggatgctgtatggaattcagattgccagtacccacgctgcctgacccacgaagaacaccctgcac

SEQ ID NO: 27893 - DNA, 65 bp, Chlorella protothecoides
ccagccaccctggggcaacacccaagcacttggtcgcggcaacacccccaatgatccaaagcccc

SEQ ID NO: 27894 - DNA, 65 bp, Chlorella protothecoides
atccccttgccgcagacatcctctggcgtgtgggacacctgcgcgccgctgtccccctccacctc

SEQ ID NO: 27895 - DNA, 7245 bp, Chlorella protothecoides
  modified_base (139)..(148): a, c, t, g, unknown or other
  modified_base (854)..(863): a, c, t, g, unknown or other
  modified_base (1657)..(1666): a, c, t, g, unknown or other
  modified_base (1998)..(2008): a, c, t, g, unknown or other
  modified_base (2619)..(2628): a, c, t, g, unknown or other
  modified_base (3835)..(3844): a, c, t, g, unknown or other
  modified_base (4042)..(4051): a, c, t, g, unknown or other
  modified_base (4740)..(4749): a, c, t, g, unknown or other
  modified_base (6031)..(6040): a, c, t, g, unknown or other
  modified_base (6924)..(6933): a, c, t, g, unknown or other
  modified_base (7060)..(7069): a, c, t, g, unknown or other
ccccaccctgtgtgaagatcgggcgctggcccaaccccaggtccccacacgcagtctgccaggggacaccccccaccccacacacacacggtcagtgcacgagggcccagggcgcgtcatggccgccgtgcgtggaagnnnnnnnnnnaacaccccccccacacacacacagggtcagtgcaggagggccgagggcgcgtcatggccgccgtgcgtggaagacgccccagcagtgctcgcctgcgtgggcgcgctcaagcttggcctcccacccggccaccatgtcggcgtgctcccgctccgagaagcgcgccacaaactcgtcgcggcgctcccgcaggcgctccagctcggcgcccagtgtggcgacgaatcgcggcgtttcgtcccgcgcagacagcacctcaaaccccgcggcggagagcagggccgcgtactcggccaccgccaccaggtcgtacccccggtcgtcgatgtaggcggagaagcccggggagggcgggccgccgccgcggcagtagtccgtgaccaggagctggccgccggggcgcagtgcgcgcagcaggcgggagaacagcgccggcttgtcgtggatgtggagcagggagtcacgtgtgaagaccgcgtcgaaggaggcctcgggcagcgcgcgtctcgtggcgtcgctcacctccagggacacctgcgcacgcgtggggcaaggggggctgaggaggtgaggtccgcagcgagtggcacggggtgccgggcagcagggccgctgcgtgggggccgatgatgcctccttgcccgaaggcaaacccgggactcgactggcaggctacagcaccccagggattgtctgagggagcccnnnnnnnnnntgggtgaggcccgcagcgtgtggcatggggtgccggggagcagggccgctgcgtgggggctactgatgcctccttgcccgcaggcaaacccgagactcgactggcaggctgcagcaccccagggattgtctgagggagccccaggccctagcagccgcaatctgctgccttcatgcagctgcgctctgcgcaggcctggcaagagtcggggggggggcaggcaggttgtccaaggtgcgcagtcccgcccagccttcccaaaccccaccctccatcccacccagccgccggctcgccttgtcgccgttgcccgaggcggcggcccgttccagggccgtcaggatcatgttggccgacaagtccatcccgtacacatagcagccaagggtgcgggccaaatggaaggcgctgccgccgacgccgcaacccacgtccagcacgtgtgcgtcggggttgaggcccagccgcgccgctagctcctgcgtcagccgctcgccgccgggcgagatgaagccctggccaaacacaaactcgtagcgcgcgatgctgcccgcggtgtagcgctggccgtccaggaagtgccggtcgacgcggaaggccgtgggcgcgggcttaatgatctgtgtgtgcgtaccgagggtttgtcatacaaaaggtccatggactggagctcaggcttggtgcctaggtctgcaggaacattgcctgctgtccgtgggatgccaagagcatggaaattcaatgtaatctggcccactgagatgcaaggggcgggtgtccctgccgtgaaagcnnnnnnnnnntgtgggcgcgggcttaatgatctgtgtgtgtgtaccgagggtttgtcatacaaaaggtccgtggactggagctcaggcttggtgcccaggtctgcaggaacattgcctgctgtccatgggatgccaagagcatggaaattcagtataatctggcccactgagacgcaaggggcgggtgtccctgccgtgaaagccaaggcggggggccccgtcctggggtgtggcagcaagcacacgctggtggtacgggcgcaaaatctaggtggctgtaggtctcacacctggccccctccctttgcttgcgccggaggccacccgccacggacaccccnnnnnnnnnnntctcaagcacacataccttgcgccacttccagcagacttggttctgattctgcttgacacgcacgtatgtgtccacgctcttgcagcacaccaggtcgaacaccgcgacgcggccgtctggctgcaccacctcgcactcgtcgaagattttgaagtactcgcggggattgcggtagtgggtggggttgctgccgcgcgccttgtcgccagactgcctgaagcaggactcgcggaagaagaccgtgcccccgaccttgacccaggtgagcatgttgtgagccagcttggccacctcgtcgtcggcaaggtacatgagcagccagttggagaacaccaggtcagcacagccggcgggcaggtccagctccgtggcatcgccgcacctgcacggtgtcgggaccaagtacacgggggatgggagtgcgtggcggctgggtcgtccagcaactcaggcagctgcacattcacaagctggagtccttgacagacgagaattttcagtaccgcaacgggggcctcgtcgccttgcccagggaccttgaagcacaaccaccacgacatacagccccttttcctcagtaaaaacccaccggaagtcgatgttgcccagnnnnnnnnnngagctggagtccttgacagacgagatttttcagtaccgcaacgggggcctcatcgccttgcccagggaccttgaagcacagccaccacgacgtacagctcctgttcctcagtaaaaaacccaccggaagtcgatgttgcccaggtgaccattgtccaccctgttctgctcaatcaggttgggcatgaagtccagagccaccacactgcgtgcctcctccgccaaggggcgggtgaatcgcccgatgccagcacccagttccacaacatccaggccgtccacagaccccaggagcttgagcacctgctcgagggggtgtggaccctcagagtgacagcttgccctagagccacgtcagcagtcacggcaacgagacccacgacacacctctggcctttccagtttgtcaatatccgcagcctggctgtcgagcatcatcgactccaccgtggcgttgctcgagtgctccgcccagtagctcttctgggcttctcgttcctggggagttcccatggcagcagtggcggctcgtaccctctggcgactgccgatgcgggataccgtcgagttcacgacaaatactgcgaggtcagcgggtatgctcccgatcaatccgcagggaagctggatcgatatatccagtgggggggcgacgtctgtcgccagcagagcgcgctacgaaagcacgaaaatctatgcagcagcgagtcggaaacccgaaaaccagtccttccccacgacacaaacccggcgtcatcgcactcggtgctgctggaagctgttctgcgtaacttgacgtaagggtggtcgcagcaatggcctccaaagcctccttcatgcgcaggacgtccgtgaacccggtcggcctcaccaggtaggagtcggaggaaatcacttttaagccacttccctcaagcacctgtaccacatctcggaaggatgcgcccgcaatgcagcctcaagaatatccacttgagctcgatagacctccctcacctcgacggcggactgaaggagggcgttagccccgacgtccagcgacaaatcgaggtgtgccaatggcaatgaggtcacgtcttggcccgcgatgtgtctctgggggctggatcaggatccgtttgcccccccttctcctaccaggcactggtcgaccaggcaaggtccgagtttcccgaccatgcagggtccaacttgctgtaagtaggccnnnnnnnnnngtcccctaccaggcattggtcgaccaggcaaggtccgagtttcctgactatgcagggtccaacttgctgtaagtaggccctccctggtgtgttggacggggcaatctcacaggattcaagcagtgttgcatgccctcctgagactagggcatgccctggctcctactcgaaacacccctgtgtggccctcaggatctnnnnnnnnnngcctgggactagggccatgccctggctcctacacgaaacacccctgtgtggccctcaggatctgccgcatgctggcccctggaacatggcggggtggccaggctgcatgccatctggccaccattgcagcacacaacccccccaccaccacccttaaacccccccacacaacaccacaggtctgacgtgctggacatcagcagccccctgaacgatgccgccagcgccatcgtggacgactccttcctccgctgcttcacctccgccgtggacgagccctggaattggaacttctacctgctccccctctggatcctgggcgtcgtcctgcgcaacgcaatcatcttccccctgcgcctgctcaccctcctcctgggcgccctcgtcttcatcgtggccttcatggttgcggaggccctgcccgccaaacaccgcaccctggccgagcgcagggtggtgcagttcatggcccagatcttcgtcacctcctggacaggcatgcgggagggggaatgttctgtggttggcaaactgagcagaggggctgtgtatggggtgtttgaagagttcatggctgtctcggcacacgctgacgcagcggtgcgcgctgtcatcccacatcgggtagattccacgacgcagcgtcctcatcgccctctgtgcatcgagcccacccggccatcaccagnnnnnnnnnntgctgtgcatggggtgtttgaagagttcttggctgtctcggcacatgctgacgcagtggtgcgcgctgtcgtcccacatcgggtagatcccacggcgcagcgtcctcatcgccctttgtgcatcgagcccacccggccatcaccagacagccctttcggggccatccgtgtcccagcacgcactgtcaccccaccaccaccactctgggcatgtttcctaccctccagcaacctcactcccccccataaaatcccgctttcccgcgcaggcgtgatccggtaccacgggccccgccccgtctccacggccaaccgcgtgtgggtggccaaccacacctccatgatcgactacgcggtgctgtgcgcctacacgccctttgccgccatcatgcagctccaccccggctgggtgggcctgttccagaagcgctacctcaactccctgggctgcctgtacttcaaccgcacgcaggccaaggaccggacgctggtgcaccagcgcatgcgcgaccacgtggccgaccccaactccatgcccctgctcatcttcccggagggcacctgcgtgaacaacgagtactgcgtcatgttccggaagggagccttcgacctcggcgccacggtctgccccatcgccatcaagtacaacaagatcttcgtggacgcgttctggaacagcaagcgccagtccttcaccgctcacctgctcaagatcatgcgttcctgggcgttggtctgcgacgtctacttcctggagccgcagagtaagcagccgggggagagctcccaggagtttgccgagcgcgtgcaggccatgatcgcgaagcgggcgcggctcacggtcgccccctgggacggctacctcaagtactacaacctggccgagaaggtgcgggccgaggggcagaggtttgctggcggtgcatcgggcggctgttccagattggcagctggaaggggggactggaagagctcgccagcatgcccgtacaggggcccactggtggtgtcgggagggaacccgccgacaatgtgtgctatggctggcgtgggttgagagtttgtctgaatacgttcccaccctcccgtcccaaccccacccccctcacacccatccccctcaacgcacaacagcaccccgatctgattgagagccagcggcgaacctacagcgccatcatcagcaagcatgtggtgccgctgtgatccgggaggtcgatgaaagcgtcggaagccaaaggaagaggagcgggacgctctcctcacatccggcagccatccnnnnnnnnnnccgatgaaagcatcggaagccagaggaagaggagcaggacgctctcctcacatccggcagccatccctggccaatatttccgccacaagtatgccccaaacccagagcttcagcccttgagccacgattgcacagcactggagccccacgccgcaagacgggggctcatgcccttcccgcctggccgccccttgtcacggccacaggccacatttttcgaggcccggctgttttccccctcctgtgccggtgtcgtgccccagtatcttgttatgaggtctttcatgtctggctcgagagtcgaggttgctgggcaggagtgaggggtatgccatggtgcagtcatgctgaggggatggcgccatggaccacttgacacgatcatgacgggcaaaggtgaccgcgctcccgccctgatacccctggctgccaaggactccagcccgcccacacgctgcccagcctgaggatgtccaggtctggcgacacccggcagcagcgctcaggacgcggccgcacagatgagcgccacgccccgcagcacccagtgcgcgggctccacactggtccgcagcggcaggctggccacaagccccgcctggccccgctccggcgtgcggaagcagggggcctcgtacacgcgtccctggggcctgtccctggccggcaccgcggtgatgagcagcacgggcatggcggcgaggggccggccggcctccgcctccaccaggcagtcgtgccgccggctccagcccgcgccctccagcgccaggccatgcacgtagatgccctcaggggggccctcgcgcacggcgccggggtctagcctcgtcacctccatcgccaggcccaggtcgtccagggaccagcgctcggcggcgtgnnnnnnnnnncagccttgtcacctccatcgccaggcccatgtcgtccagggaccagcgctcggcggcgtggcgccgcgcggcctcctgccgcaccgccaacaggaggcccgcggggttggccaggccacccagccannnnnnnnnngggggcggcgcccccgcgcccagccaccgcgccagctgctcgtgccgcgcgaccaggcccgcctcccaccgcgccagccccggcccgtcccaggagcgggcggcccagtccgggggcaggccgccggccagcagggcgtgggccgccgcgcccagcgccggcgtctgcggccccgt

SEQ ID NO: 27896 - DNA, 99 bp, Chlorella protothecoides
gtgacatacctggtgggtggtggatgaagggtggggagacagcatctttatcctgaccaagaagctcaggacatttaccaagcacagggcacatttgca

SEQ ID NO: 27897 - DNA, 81 bp, Chlorella protothecoides
tccgcgttgccgaggtgcggggaggggtccggagggatgggggggggcaattgcgtccgaatgttgcctcggatgggggtc

SEQ ID NO: 27898 - DNA, 68 bp, Chlorella protothecoides
gcgccgcctttgaggtctgaggcgcaccttcttcggcatgacctttcggctggaccaagtttccccgg

SEQ ID NO: 27899 - DNA, 73 bp, Chlorella protothecoides
ttgtgggggccagcccgcccccacaacaggggtgcggcggcgttgcggcgcacgagtcgaagatatgtcgcta

SEQ ID NO: 27900 - DNA, 149 bp, Chlorella protothecoides
attggtgaagtgtgcattgcgagccatattgcacagtaatagccccctgctggtctatcaaattgcaagatgggaagcttacatgtgactggaaggagagcacaggcccgaattccacgtgcatcacaggtccactatgggcgagcatc

SEQ ID NO: 27901 - DNA, 123 bp, Chlorella protothecoides
aagggttaccaggtgcagagtggagggaggaggatggagattgtgagggggggggggctgatccgagggcacggagggtaagaacacacacaacgtatttgagcttgatggaggcatgttcca

SEQ ID NO: 27902 - DNA, 170 bp, Chlorella protothecoides
gactgcggtgtctgctcgatgctgggcgtctgagtcggcataggcgacgagctggcgctggaccctcatgcaccgagtctccagctcagtatgctgcgccgtcatgctggccagggcagctgcgctctgctgaccggcctccagcagctccgagagcagggtgaaaagca

SEQ ID NO: 27903 - DNA, 78 bp, Chlorella protothecoides
gcgccctcctgcacgcctcgcgccctcagcggaccccatagattacccccaccatcccagcacgcacctggttgaagt

SEQ ID NO: 27904 - DNA, 61 bp, Chlorella protothecoides
tttgatatcgtttttaagagtatggctgggtgccactggggcagttgtagcctgtcatagc

SEQ ID NO: 27905 - DNA, 80 bp, Chlorella protothecoides
tctgtgctgcaggctgtttggtcacctgggtctgcttggcctgcttggccacctgggcttccttggcctgcttggcttgc

SEQ ID NO: 27906 - DNA, 76 bp, Chlorella protothecoides
ggtgacgctgtacgacctactggagattggcgatggctacgtgttccagtcagatgggggagtgcaccacgatacc

SEQ ID NO: 27907 - DNA, 126 bp, Chlorella protothecoides
acaggaggaaagcaccacagcacaggccgccacccccaaggtacttctcaagagcaccttcccgcttgccgactgtctttcccctgtatgaatccacatcgcctcacccgtgccagctgctgccac

SEQ ID NO: 27908 - DNA, 61 bp, Chlorella protothecoides
cctcgacgggttcatgggaagaggccccgaactcttccacatccctgacaccaacctgagc

SEQ ID NO: 27909 - DNA, 147 bp, Chlorella protothecoides
gacatcctggggaaagcgggaatggttgcccggggcgcagaatcaaggctccactgtccttgcttaggtacaccagcgagcgtggtgcggtaggtccagagcaggaatctcccacactccgcctacgtgcccagcagccttacctga

SEQ ID NO: 27910 - DNA, 126 bp, Chlorella protothecoides
aaacacgatctggagattgctgacagtgaaaccagccacgttggtcatagcacgccatgtcatccctttctcccccctccaacacggcgcaggccttcccccaacctgtggagctttgtgtgcctg

SEQ ID NO: 27911 - DNA, 132 bp, Chlorella protothecoides
caccctgtacgacacaaacttgcgaccatcgctctggggctccatttcgtgatttccaacggtgaacaagaatgggacggatgaggtcacaggctctgccaggcgtccccatgtgtcccttcagagattggg

SEQ ID NO: 27912 - DNA, 78 bp, Chlorella protothecoides
tcaagacaggtgtggcttcgggtgtggattgtttcatgagtgtcggcggcgagacgttgacacctctttgtgctggtg

SEQ ID NO: 27913 - DNA, 82 bp, Chlorella protothecoides
gtgtggcgaggtgctgtcgagacaaaggcttgtgctccctacacatcacccgaagcagcactcatcgttccgatccacggcg

SEQ ID NO: 27914 - DNA, 74 bp, Chlorella protothecoides
tcagcttccacaaggtacttgtagagtgctccgtgcttcgcacacactccctcttccgcaatcagtttgatcct

SEQ ID NO: 27915 - DNA, 98 bp, Chlorella protothecoides
ccctcttcccggagatggtcagggtgcgtttgaagaaagggggaggggggtgtttgtcgggtagggtttgtgatgccgttggacgagtagttctgagt

SEQ ID NO: 27916 - DNA, 61 bp, Chlorella protothecoides
ctggcgaatagcggcagcgccgcgagacggtttcaacgccggacgctgcatgatggatggt

SEQ ID NO: 27917 - DNA, 78 bp, Chlorella protothecoides
caaggccgcccgcgccgccttccgcgtgcgcaaggagcgcgccgcacaccgagccgcggcgctggcggtggcgcggcg

SEQ ID NO: 27918 - DNA, 63 bp, Chlorella protothecoides
tttccaagtatctgtgcacatctattctggccaaaaacatgtctaatggtctcgtatagttgt

SEQ ID NO: 27919 - DNA, 5119 bp, Chlorella protothecoides
  modified_base (926)..(935): a, c, t, g, unknown or other
  modified_base (2805)..(2814): a, c, t, g, unknown or other
  modified_base (3140)..(3149): a, c, t, g, unknown or other
  modified_base (3238)..(3247): a, c, t, g, unknown or other
  modified_base (4065)..(4109): a, c, t, g, unknown or other
  modified_base (4605)..(4614): a, c, t, g, unknown or other
ggcttggggctagggggctgggggccgggggcggggctgtgacatcatgcatgtgtcgcgacaggggagtcctatccatggcatgtgctcgccatgcgactctgacatggcatcaatgcgtatgctgctcatcctcgttaccatgagtcacacaccacaatccaccacccatcacaaacaggtggcgcacacggatgtggtgctggacgacgtgtggagcctggacctctccaagctggacgggtggacgtgcgtgcaggagaacacgggcggggaggagctgaaggacctcagcgactgggagtccgacgaggaggacagcgactcggaggcggagtgaccggggccagtgcggtgctcgagccggtgggggcagaagcagtcccactcgcatcgccaggcagtcttgtcactcagcgctgtgttgtaacattgacgaggctcactcctcctcggcatcacatgactcgaaaagaaagggggcacatgcaggacaagcgcagcaagggcacacacagcacgctctggggggtgcagctccacttccgacaggcctgtgccatacagggctgcttgggaagccgcacagggggcatgccctggctacctgatgccgggggcgcgcgcatgggcagcggctctccggtcggtgacgaggtggaaggggtcctgggctgtgggcagccgaggggccactatgggcaccccccgttgcttcgactcctctgagaacatactcttgctgcaggtgtgaggggggagggtgggtggctggggctgaggaggagtgagagaccgccgcgcgagttccacagcatcccaggagggggagcagaacagccctccagcacgccccccatcaccgacttcccagcccattgaaccctcgatcggcccccctttccagcccagctcactccagctgnnnnnnnnnntatactcttgctgcaggtgtgaggggggtgggtgggtagccggggctgaggaggagtgagagactgccgcgcgagttccacagcatcccaggagcgggagcagaacagccctccagcacggcccccatcaccgacttcccagcccattggaccctcgatcggccccctttccagcccagctcactccagctggcgagcgcggaaggggggcatcgccgccatctcctccgcctccacctcctccctgggcttgaagcgcggcggccgagcccgtttccgcgtggccagggctggcgagcgcggcagggtcaggccactccccgcgccggtctcggcgccttcgttccgcggccgcttcgcgggcccggcccttcctcctgctcttgtgcgcgccgctgcatgggacgatcgggccggctgccgcccctcgaactctgcgatgcgctctgctctcgacctccatggtgaggcggaggggggctcctgctgggaatcagggggaagcgcagggttttatgagatgggagggaggggccagggcaggggttgacggggacggagagatgcaatgcaacatccctattcctgacctccaggccagccaccaaggacaccccaacaacagaatggctaaaatctccgggacgcacctcgctggcggcggagcgggtgcgcatgccatgcacccgtgctttcttctgggcctgcgacccggcctcgacaggggtccgcgcggtttgcgaggcgggacctgcccggtgggagggttgtcccgtccgcctgggcgcggggacctcgggctgctgcggcagaacaacagcgcgtgccgccttccccgtgatgccgtgcgagagcaccggcgggtctgggcggctgggctgggcccccgctcccttctccggcgcaggggcggagccctggggtgggtcctggatcggcctgcagcacaggggaaggggtcaggctgcgtcaaagggggtgcatttcgcaggcttgtaagccctggaaatagaacctgaggctccctgatcactcagccgcaggaatggtctcacagaaaccattccgagtacaccccagcctcacccgtcgtccagcagcaactctatggtcgtatcctgctcttcatcaaccgctgcgaccgcagccgtcgccgcctcgacatccagcacagtattcgtgatggatgccaaggccgggcgcttgctgctggccttgccggccggctggctggcgagcttgttctccgacgactttggtatggggtgagaggttgcaagggtttgggcaccacaatatcgcagttttgcaaagttgcggctgcgggagctcaacctcgagcactgtacctggctggccttgggagtcgtggttggtgcaggaggattggagtcctttgcaatcccaggtggtgtcctcaggcctgcatacatcgggatgggctcggacaccctgctcatggagtgaacatgagttaagcctgcccacctaaatcctacagctccccccgtcttcccaccggcagtcgccttcgtgctgaaccagtcatccggtcgatccatggtggactctgggctgccattgccgaaatcgtagtatcgaggggcatcgaattcgaagcgcgtgtctcgcggcccggcctcgagacccggctcgccatcctgcttgtcctcacgcgtcggccgtgacacgggatcagccacgtctgtcatggagtttgcttttctaccagaatgctcccggcatgctcgggaggtcggaggatgaaaggcccggccggcgacagggacgacggactgcgcctcttctcgcgctgaagagtgacagtccttttttgtgccctgctgtgcagtctaatcccggatgcaannnnnnnnnncctcgcgctgaagggtgacagtccttttttgtaccctgctgtgcagtctaatcccggatgcaaatcctttccccaatgctgcgcatcttttggcctcccatgcaacttcgtagcgccctctgagcccatctgtcaattcgtgcagggataacaagttccggggtctcccccgacatgccacaggggccagatgatgagagggacgaccactctgttccgtcccagtaaatcggtaaatcgtcaaggctcggcgaatctgagcctctgcgtttgttgcgttgtcgagacctttgactgggtcaagaatcccaacaattccgtgttgnnnnnnnnnnacggcgatgaggtttccgtggtggctttgggagcgcacgcgtttcaaacgccagcaatctatgaccccgctccactcccgagcagaccnnnnnnnnnnttttgttgcgttgtcgagacctttgattgggtcaagaatcccaacaattccgtgttgcggtctgggagtgaaaatgctgcgtgtcgcccttttgttcggcctcctggccctgggcagcgccttcgatcttcagagccaccatgtgtttctatctcaggcccaggtgaggcggcgatgaggtttccgtggtggctttaggagcgcacgcgtttcaaacgccagcaaactatgaccccgctccactcccgagcagaccgacccgcgcggtgcgttcgacttctggactagggagctgaacaaagcgtacgatcgtatcgaggtgaggatgagccagcccggaatgcaggggcccgcgtctcggcccctctcggcccgatcagtccacacgagggtcgagactgacttccggtcctgccaccacgatgcaggagtacgagcaccgatttgccatttggatggacaatctgcagtatgtgattgagtataacgccgcgcacaccagccactgggtgagcggagagttgggtggtgtagggttgtggttgccaggatgtggggagccggtggggctgggcaattccatgggcgtcatggtggggttctcatggtgctcgatactacaggctcactactgccgcgcacgcacctattaaatcatcatcatcgcatcttggctgctgtatctcgcatccgctgcccctgtggtatttacagcctctggcgtggaccgcgtcgctcccatcctcatctgcctcagcccctgcctttatactgcaaacccctcctgccaacccccccccccccccccccccccatcnnnnnnnnnnnnnnnnnnnnnnnnnnnnnnnnnnnnnnnnnnnnncagctgggcatgggcacctgggccgacctgacccaggacgagtatcgcgtgcgtgcactgggcttcaggcccgacctggcggcgcagcggccgcggcacgaggatgcgcgcctgtctgcgaccaaccccgccgcgctgccggaggcggtggactggcgcaagcagggcgcggtgtccgaggtgaagaaccagaagatgtgcgggagctgctgggcgtttgccaccacgggcgcgatcgagggcatctccgcgatcgtcacgggcaagctggactcgctgtcggagcagcagctggtggactgcgaccgcgagcgcgaccatggctgccacggcggcctcatggattttgcgtacgagtacgtgatcaggaacgggggcctggacaccgaggccgactacgggtacagggcggcggagggggtgtgcgatccggcgcgcgaggctcgccacgtggtgaccatcgacgggtacgaggacgtgccgcgtttcgacgagnnnnnnnnnntgagtacgtgatcaagaacggcggcctggacaccgaggccgactacgggtacaaggcggcggagggggtctgcgacccggcgcgcgaggcccgccacgtggtgaccatcgatgggtacgaggacgtgccgcgtttcgacgagggcgcgctgcgcgccgcggtggcgcgccagccggtggcggtggccatcgaggccgaccagcgccccttccagctctacgcgggcggcgtgtttgacacgccctgcggcaccgcgctcgaccacggcgtgctggtggtcggctacggctccgagaacaacggcaccgcggacgtgccgttctggatcgtgaagaattcgtggggcggcgcctggggcgacgcagggtacatccgcctgctgcgcgccgagatcgcggcgccggcgggccccggccagtgcggcatcgccatgcaggccagctacccagtgaagaaggggcctaacccgcccacgccgccgcccacgccccccgcgccgcccccg

SEQ ID NO: 27920 - DNA, 66 bp, Chlorella protothecoides
cctggtggcgcaccttccgaaacggcttctggtgcatgtgccaggccaggccctgtcgcaaggtgg

SEQ ID NO: 27921 - DNA, 86 bp, Chlorella protothecoides
agatacaccagtacatcggcatcgacccggggcggaccaagatgtttaccgaggtggacgaacatgccaacgtgacatcctgctcc

SEQ ID NO: 27922 - DNA, 80 bp, Chlorella protothecoides
ccacgtgaagacagcaggagggagcgggagaggtcgcgagaggcgactgggcgggagcgcaggcaggaggctgacgtgcg

SEQ ID NO: 27923 - DNA, 80 bp, Chlorella protothecoides
atgtgggtgcgatcgggccaagccccccccattgcgtgagggggcgaccgtgtcacgtgctggggatgccttctggtgcc

SEQ ID NO: 27924 - DNA, 62 bp, Chlorella protothecoides
ggggctcgcctggcggacaatggggcgaggtgtttggaggcaggtgagggtacgagactgcc

SEQ ID NO: 27925 - DNA, 519 bp, Chlorella protothecoides
  modified_base (145)..(272): a, c, t, g, unknown or other
ctccttcccacaagaagtccccacctccgcccaagacgaggtccccttcacctcacaggaagagctctcccccttcacccaaggcgaggtcgcctccccctcacaagaagtaattgcagtgaacgaaagtctatgacaatgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccaaaccccaatcaacctggggttccggcgcttttggttcccaggccttcaagagtatttgccatggaacctccgcattaatccgtttgcccaccatccaccccctattccaaactcgttctttgcatggatgcaggcccggtaagagcctttcctgcatccaatcgctgggcttctgtgtacactaatcttgtccgcagtgtaacccaagactatgcataggcaagagacagacgcacgtgcc

SEQ ID NO: 27926 - DNA, 147 bp, Chlorella protothecoides
ttgggttacatccacggcctccgtagacaggagggagttggacgtgacagcattgtcgctcgcaaatgcttccagttgctctctcacctggtgtggccaagtagtcagtcagtaggctcagtgaccagactcaagtctctgcggtca

SEQ ID NO: 27927 - DNA, 61 bp, Chlorella protothecoides
ctctggcatctggcaccttcaagcgtgtttcttggagcgggagcctgcgggagcgggagcc

SEQ ID NO: 27928 - DNA, 73 bp, Chlorella protothecoides
tccaggggggaggagcacagcctgttgaaagcaggtgaggcaggggagtcaggtggaggtagacgatatcaca

SEQ ID NO: 27929 - DNA, 91 bp, Chlorella protothecoides
tactgccccacagacgcaccactgcaagggtctgaacggcggcaaagaggacgagggtcttagcactgggtattgagcatgccggggacag

SEQ ID NO: 27930 - DNA, 105 bp, Chlorella protothecoides
ggtgggggcgctgcagcaacagtccatggggaggctgcgacgacagccgatgggtgcctccatgacacccctcgagtctccatcctggtgctggataagtacatg

SEQ ID NO: 27931 - DNA, 417 bp, Chlorella protothecoides
  modified_base (113)..(364): a, c, t, g, unknown or other
ggattttgatcatccatggtcagctccaggagtttcaagccttgcgtgtgtgtccccgatatcgtcccgtgtaccccaaccacgcgatgtgcccacccgcacatccctattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccgtttagtgattgggcgcccctgcctcacaccttgtttagcatgctgctc

SEQ ID NO: 27932 - DNA, 129 bp, Chlorella protothecoides
ctcaccggctcatgcacttcccagacacaccgcacagatcagcatgagggccaggcctgactccatccacatgcgtccctgcacaagcaatcacagagcagcggccgacaggcatgatccacaggaacc

SEQ ID NO: 27933 - DNA, 82 bp, Chlorella protothecoides
cagggagggggtggtctcccaggacacccccgccgtggaggtggtgcgggggttcctggaccgcatccatgcgcagaatgcc

SEQ ID NO: 27934 - DNA, 6730 bp, Chlorella protothecoides
  modified_base (3032)..(3041): a, c, t, g, unknown or other
  modified_base (4002)..(4053): a, c, t, g, unknown or other
  modified_base (4479)..(4488): a, c, t, g, unknown or other
  modified_base (5085)..(5094): a, c, t, g, unknown or other
  modified_base (6647)..(6656): a, c, t, g, unknown or other
ggcggcgccggccggggcaggcgcgcgcgccggcaccggcgccgccgtggtgtccacgacctgcgcgccgcggcgcaccacctccagcgccatgcgcttcaggctctcaaacgcatcgtcggtgctggcgccggccagcacctcctcctgcccgcgctgggccgcggccagcttggcctgctcggccagcgcgcggcggtagtccggcgggaacactttgacgaagccctgcaccgccgcgtcccagtcggccagcagcgctcggcccttcgcggatcgcgtgaagcgcacatgccgctggatcaggctgcgcagcgcggccacgtcctcctcgtcctccacggggaacaggtcgccggcgacatccgggttgcagcgcgcctgcaggcgcgcctcggggtcgtacacgaaggccacgccgcccgacatccccgcgccaaagttcttgcccgtgccgcccaggaccaccacggtgccgcccgtcatgtactcgcagccgtgatcgcccacaccctccaccacggcgcgcgcgccggagttgcgcacgcagaagcgctccgcagccatgcccgcgaagtaggcctcgccagagacggcgccgtagaggcagacgttgcccacgatgatgttctcccccggctcgaagtcggagacggcgggcgggtagacggcaatgatgccgccggacaggcccttgcccacgtagtcgttggagtcgccctccagctccagcgtgatgccggggcagagccacgcgcccaggctctgcccgccgtgcccggacagggccaggtggatggtgccctccggcaggccctccgcgccgtagcgcttggtcacctcgtgcgacagagtggtgcccgtggcgcggtgcgtgttgcaaaccgctgcctccaggaagacgtgccgtgcctggtcgcgccgcgggcgcagcgcggcggagcacagcgggatcagctccgcgtccagccccgcctccagcccgtggtcctgcttctcgctgcaggtctgggccgcgccggggcgcaggctggcggcggggagcagcaggcgggacaggtcgatgttggcaagcttggggttggcggccaccacctcggggtccacctccagcatgtcggcgcggcccaccatctcctgcacgctcctgaagcccatgtcggccatgtaggtgcgtgcctcctctgccaccatgaacaggaagttgatgacgtgctcgggctggcccgcgaacttggcgcgcaggacagggtcctgcgtagcgatgcccacggggcaggtgttggtgtggcacttgcgcatcatgatgcaccccagcgcgatgaggggggcggtggcgaacccaaactcctccgcgcccaggagcgcggccacgacgatgtcgcgccccgtcttcatctggccgtcggcctgaagggtggtgcgcccgcgcaggccgttggccaccagggtctggtgcgtctcggccaggcccagctcccagggcaggcccgcggacttgatggaggtccacttggccgcgccggtgccgccgtcatgccccgagatgagcacgtggtcggcgtggcccttgaccacgccggaggccaccacgcccaccccgttctcggacaccagcttgaccgagacgcgggccgaggggttggcggacttgaggtcgtagatgagctgggccaggtcctcgatggagtaaatgtcgtggtgggggggcggcgagatgaggcccacgccgggcgtggagttgcgcgtgcgcgcgatgtcgcccttgaccttgccccccggcagctcgccgccctcgccgggcttggcgccctggctgatcttgatctgcagctcgtcggcgttggtcaggtagtgcgcggtgacgccaaaccgccccgacgcgatctgcttgatggaggaccgcatggggttcccgctgccgtcggcgttgggcaccaggcgtcgcgggttctccccgccctcccccgtgttggacttgccgcccagcgagttcatggcgatggccagcgcggtgtgcgcctccagcgagatggagccgtagctcatggcccccgtcacgaagcgccgcacgatggccgccgcgggctccacctcctccagcgcaaccggcgccgcgccgcgccggaagcgcagcatgccgcgcaggttcacgctgcggttcagctcctgggtcaggcgcgagtactcggcgtacgcgccgcgcgaccccgtgcgcgccgcctcctgtagcttggccatggcgatggggtcgttcaggtgcagctcgtgacccatcgtcgaccggaagtggtagtcgcccgggtcgggcagcatggctgccgcggcggggggcacgtacgccgcggcgtgcagcgccagcaggtccacggccaggtcggccaggctcatgccgccgatgcgcgaggcggtgcccgtgaagcaggcgtccaccacctccgcgtccaggcccaccgcctcgaagatctgggagcccttgtaggaggccacagtgctgatccccatcttggccatgaccttgaggatgccgtcgcccaccgcgcggaagtaggcgtcctccagctccgcgcgggacaggccggccggcacgcggccgtcggcctgcagcgccagcaccgcctccagcgcgaggtagggcgacaccgcgtccgcgccgtacccgatcagcaggcagaactggtgcacctcgcgcacgtcggccgcctccaccagcaggcccacgcgtgagcgcttctgcaggcccaccaggtgctggtgcacccggcccgtggccatgatggagggtatgccgcaccggctcgcgtctgcgtggcatgccgaggcgagggggtgagttccgaaagtaggcaggggtttgaggggtcacccttgcatgcatgaagccaactcgacagggtctgggggaggatggtgcgccaccccaaggaagtgcaaacggcccgcacctgcaaacctggtcagggcaccccttaaccacccagcacaaccaatacgcccaccaactcacccgcagcacggtcggacagcacgannnnnnnnnnaccgcaccggctcgcgtctgcgtggcgtgccaaggcgagggggtgagttccggaagtaggcaggggtttgagggggtcacccttgcatacatgaagccaactcgacaggatctgggggaggatggcgcgccaccccaaggaggtgcaaacggcccgcacctgcaaacctggtcagggcacctcccaatcacccagcacaaccaatacgcactcacccgcagcacggtcggacagcacgatgaagtcgacgccggcctcaatggcggcggcggcctcgtcgcagatgcgcgccagggcggcctccaggccacctggcccctcggcgacaggccaggtggcgtccaccagccgcgtctcccagccgctgtaggtcatgtgcttcatggcctgcatctccaagggccgcagcagcggctgctccagctccaggcggtgggcctgggactgcccggtctccgtcaggtcgccctccggcccgatcatggcccgggtggaggtgacgaggcgctcgcgcagcgggtcgatcgccgggttggtcacctgggcgaacagctgcttgaagtactcggacagcagcttggggcgctggctgatggcggccaggggcgagtcgttgcccatggagcccagcggctccgccccagacttggccatgggcagcagcagcacctccatcgtctcgacctggggaggaagggggatgagaggaagacaggaaatttgagctcaattcaagtggcgggcaagcgcagaattctcgccgcttaggcgaggactgggtgccgaggagtgggaacgcccaccccggaaaacatgcatgcactgttctggccccattctttggcctgccagcgaggtgcaaggggcacaagagggctgagcggctcccgactcacggtatagccaaaggctgtgaggggcttaagcaggcggtggatgccggagacaccgtcggagggcnnnnnnnnnnnnnnnnnnnnnnnnnnnnnnnnnnnnnnnnnnnnnnnnnnnncacccttcacggttggcagctccagcaccgctgggtccaccgactccacgatgcggtccagggtgaccacctcatcctccagccacttgccgtaggggcgcgcagaggcgtacttgtgcttcatctgcaggtcgggagtgggaaggagaggagggggccgtcaggcacttcaggatggcaacccatcggccaagaggagggtcggtgggcgcagtcgtgagctatcgatagacttaaatacatgctgctcacaaaagatccatggcatgcacgaggggccgtcatggcacattgcgcagacattgcggagctgatcccactcagcatgcaaccatgtcatcatggtagctactcagcatgcttcctcccaaacccaaaccacccccccccctccagctcaccgcctcgtcgtccacgacgcagtgnnnnnnnnnnccttctcagcgtgcttcctcccaaacccaaaccacccgcccccctccggctcaccgcctcgtcgtccacgacgcagtggcggtcaaagtcgaccaggaagatgttgcccggcatgaggcgccccttcttcgcgacgtccgtggggtccacatccacggtgcccacctcggaggccatgatgacgcggccgctcttggtgatgtagtagcgccccgggcgcagcccgttgcggtcaagggtggccccgatgtagcgcccgtcggtgaaggagaggagcgcggggccgtcccacggctccatgatggccgagtggaagcggtaaaagtccttcttctcctcgctcatcagcgcgtcgttctgccaggcctcgggcaccatcatgagcatggcctcgggcaggtcgcgccccgaccgcaccagcagctccagcacagcgtcgaaggagccggagtcggactgccccggcggcaccaccggcagcagcttctgcagcgtgcgctccggcaggcccagcgcctcgcagtgcatgacgccctgccgcgagcgcatccagttaacattcccgcgcagcgtgttgatctcgccgttgtgccccannnnnnnnnngggcaggcccagcgcctcgcagcgcatgacgccctgccgcgcgcgcatccagttaacgttcccgcgcagcgtgttgatctcgccattgtggcccagcatgcgcatgggctgcgcgcggtgccaggaggggaaggtgttggtggagaagcgggagtgcaccagcgccatgtaggaggtgaagcgcgggtcctgcaggtcacggtagtagccgggaacctgggccggcgtcagctgccccttgtacacgatggtgcgcgaagacagtgagcagatgtacacgtcgtcgtcgcccaggtgctgcaggcgcagcttggactcgatcagcttgcgcaggaggtacatctgctgctcgatgccgcgcgagcggcggcccgcgccgggcgcggcgcgggacaccacaaactgctccaccaccggctcggtggacagcgcggaggggcccaggccggcggggtcggtggggacgcggcgccagcccagcacgtggttgcccaggcgctccgccacgttgccgatgatgtcgcggatggccttggcctcctcgatgtcgcggggcaggaacacctgaccgatgccgtagtcgccgggcggggggaggtcgaagcaggcctcgtcggccatcacctcggcgaagaaggggtggggaatggccaccaggatgcccgcgccgtcgcccgtgttctcctcgcagccgcaggcgccgcggtgggtcatgcgcaccagcatctccagcgcgtcctccaccgtggcacgggagggcttcttggacagctcggccacgaagcccacgccgcaggcatcccggtcgttggcggggtcgaacaggccctgggcctcggggatggcgctgtgcttggagaccacctgcggggaagagggggagggcacagggtggttgacggcggcggcgatgaggggagttcggtcacgtttcgggccccttgcgctgtgaattcagaaaaatcaaccccatccagacccacctggagtgctccgccgcgaccgaccctgctgggggtgacgcgcagggtggggatcgcccgaccgtgcctctgactaaccgaacccgagcggaaccctgtgaaggtgcgcaggggtgccacaccctgcgcattgggcatgcatggcgagcccgactgcaggcgacagccctgtagtcgcgcttgctgcatgatgctgcggggggcggtccgccccgagcggactagggttgagtgttccggccttggatggagccgaagtcagcctcctggctatgcttgatgtgagtataaatatacactttgtttttcggtctgaaagaactgggatcccaggcaacgatggctgcggggctgcgaaacgtgacagcagggttctgggaaaatatcctacgtggggggggggtggcgtgacccgtcagcaattgattgcaatgcacgggaatacccttgttcccctaccgggcttgcgccggttgcaaatagcttattcccgagagttggataatcgctggcgcagttgattgcctcaaatgccgaaccggggggtgggggtggggggaagggggcgannnnnnnnnnttcgagagctggataatctctggcgcagttgattgcctcaaatggcgaaccggggggtgggggtggggggaagg

SEQ ID NO: 27935 - DNA, 93 bp, Chlorella protothecoides
tgctcccgcaggactggcaatggcagggccacccaccacacccaccgcccacgcaccctgcatgtagcctcggacgatgcttggagtgtgctg

SEQ ID NO: 27936 - DNA, 355 bp, Chlorella protothecoides
  modified_base (99)..(285): a, c, t, g, unknown or other
tgcccgccggcacaccgccatggcttcaatcaaggatgaaacatacacaggaaaagcattcatacagactcgcagtctagtgttcactcgtgcaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagcctcatgcgggtgagtgatctccatttcttcactataaaagacagctcccaagtgcatcgaacgt

SEQ ID NO: 27937 - DNA, 79 bp, Chlorella protothecoides
gctttaatggtctcgcagtaggtggactgggagggggacagggagagaggagtcaagttgggtgtgcccagtctacgtg

SEQ ID NO: 27938 - DNA, 76 bp, Chlorella protothecoides
ccctgttacagacccaatagcagcccaagcacctatattacagccagtacctccaaagcagtccgtttcgatcggt

SEQ ID NO: 27939 - DNA, 112 bp, Chlorella protothecoides
caagacccaccgttccagagagcgctcccaacccgggaccatactggcgtcgaggccttggaacccaacccccttggtccccgacctgaagaggctgagatcatatcggtaa

SEQ ID NO: 27940 - DNA, 67 bp, Chlorella protothecoides
gcactgctcacatgtcacgcacaccaacccaatctgcaacaccaatcgagttgaattggttcgagtc

SEQ ID NO: 27941 - DNA, 139 bp, Chlorella protothecoides
tttgcgaggcaatgggtgaggcatgggatgatgttgtttgggattgaatcagcctccttgggcatcgttccagttctcctcgtgtggagcaatctcaaatacatcctttatacccatcatgcactcagcccatcaccat

SEQ ID NO: 27942 - DNA, 61 bp, Chlorella protothecoides
tgacgacggccacgacgtcgtccactgtcgatcgaagcgcatccaacacgcactgctgctg

SEQ ID NO: 27943 - DNA, 61 bp, Chlorella protothecoides
gtgcctgaaggggagccaggatggtggagcaccatccccagccaattgcctttcccaagct

SEQ ID NO: 27944 - DNA, 97 bp, Chlorella protothecoides
ccatccccagccaattgcctttcccaagctgtgcccccaaattcccacctgggtcgtcattgccgatctccgctaccatgtcggcgcccacgatgcc

SEQ ID NO: 27945 - DNA, 61 bp, Chlorella protothecoides
gctggaggtcgccgaccgcgacgtgaagggtgcctgcatgaacacctttgtcgccgcgctc

SEQ ID NO: 27946 - DNA, 80 bp, Chlorella protothecoides
acccccgcttcgagttgggtaccaggtgagccacctcggtcggtgcggttaggtttcagtatctcctaggcaggttttat

SEQ ID NO: 27947 - DNA, 61 bp, Chlorella protothecoides
aatccctcacgccatcgtctgtgcgcccccaccataccggcctgccacatccaagatcaat

SEQ ID NO: 27948 - DNA, 61 bp, Chlorella protothecoides
ccacggtgcgcatggttagtgtggagggggtggaaagtttggcaggtggtgcagtctcttg

SEQ ID NO: 27949 - DNA, 76 bp, Chlorella protothecoides
tgttcgtgtaacagggcctgctgccctcgcggagcaacccccctggccttgctctcccggccatacccgtgttgtc

SEQ ID NO: 27950 - DNA, 65 bp, Chlorella protothecoides
ttatgctcttgatgatagggtggctgtggcacagtcctcatggtgactcgatggcacttttaaaa

SEQ ID NO: 27951 - DNA, 68 bp, Chlorella protothecoides
gtcctggctgacatgtttgagctggagctgcctgcaaccatcgtgtttgaccaccccactgcaacaac

SEQ ID NO: 27952 - DNA, 124 bp, Chlorella protothecoides
gttcttgggccagatcttgcgccagacctggggagtgaggtgatgtgtggaggcaggggggccgactggttgagcggagaaccgaagacacgccgcgaggccattggggatgggcacaacactg

SEQ ID NO: 27953 - DNA, 132 bp, Chlorella protothecoides
atgacgcacaagccagggcgaacaagagggatgaatagggacgcagaggtgcatcgcagcgggtggtacaaaaccgcaacagattcttcatcttgcccactcgggccggcacaggatcccaaggagcacacc

SEQ ID NO: 27954 - DNA, 133 bp, Chlorella protothecoides
tgttcccttgtctcacgtgagcacctctttcaacctcacctgctctcccagcgacctgaggcacagtggcgagcaagagcatgagtgtcgctgcccataaagcagcgaggacgccgcgctgctgagccatgaa

SEQ ID NO: 27955 - DNA, 247 bp, Chlorella protothecoides
ccgccccaagatcgccggcgacgtggtgggtttttggaggggagagggggggtgactcggacgatgcatgctggtccagggtggtagtggctccaggctgcactgatgagaggtcagagcactccacagactctatgccggcgccgcatacccccttacaaggcacctcatgcctcacaccacgcctcatcacctcgcatcctccaacgcacccccaccgacccagactgaggagggcgcgagcctg

SEQ ID NO: 27956 - DNA, 61 bp, Chlorella protothecoides
gaactgcgtgacggggtcttgctgcagtaacacctgtgctgtgtgtcggtgccggcacact

SEQ ID NO: 27957 - DNA, 151 bp, Chlorella protothecoides
tggaaacggaaggggcagagtcagcatgcgaggtgaccgctgaacctatctctgtgaatttctggcggtttctgaggttccatcttgcagcagaccattttaaggctgtgctcggcgggcacgaagcaccttcatcgtatgcctaccactg

SEQ ID NO: 27958 - DNA, 135 bp, Chlorella protothecoides
gtgcgctttgcttcatcttagcgctagcgcttcgcgagcaggtgtcggaattgacccgggggtatagcaaaagagggagaacctcgatccttgaggatgggaggtatgcacatgtcggttgtaggggcgaagagg

SEQ ID NO: 27959 - DNA, 61 bp, Chlorella protothecoides
tcgcccgaactctgacccgactgcctcatcgctggccaacctccccttcaagcctgccacc

SEQ ID NO: 27960 - DNA, 79 bp, Chlorella protothecoides
gggtgggctcgggctgagcccgcgtgtgctcctgagcagcgtgaggcaccatgcagctactaagctgctagtggaccca

SEQ ID NO: 27961 - DNA, 116 bp, Chlorella protothecoides
gcgggtggcagagtgagggctggcaggcggcgtgaggcgcgtttggggagtggaagctcatccgtgaaagtgcagcaggctggtcaatccaagcccccccacctggtggtagagat

SEQ ID NO: 27962 - DNA, 78 bp, Chlorella protothecoides
cgcggccgttctcgcagcagatcgcctgctgcggcttctcgcccaggatcatggaaggtgagggtcacagcaagccgg

SEQ ID NO: 27963 - DNA, 140 bp, Chlorella protothecoides
gtcttattcccaggatcctgaccctcaggcctgatcaaactggagcaacgaaattctcgagatcactttcagaggggtgtttagggtcctgccccgggcctgacatacgtctgccatgacatgcaacccttcattcatga

SEQ ID NO: 27964 - DNA, 69 bp, Chlorella protothecoides
cccctccgtctcctccaccccctcccccaagcccgccatcccctcccccaaactctccaccaccacccc

SEQ ID NO: 27965 - DNA, 12532 bp, Chlorella protothecoides
  modified_base (482)..(491): a, c, t, g, unknown or other
  modified_base (588)..(597): a, c, t, g, unknown or other
  modified_base (3782)..(3791): a, c, t, g, unknown or other
  modified_base (8526)..(8699): a, c, t, g, unknown or other
cccctcccccaaactctccaccaccacccccagctgatgaatgcacgggtgcgccagtaatgaccacttactcatgccacaataacctttacccagccatctgcattcgaaacgatgtccaaactgccttctgtgttgcaacaaaaccaaccactaccttggcatgcacaggtcagtatgatgacaccgttaacggtgtatgcaataaagtatcacgccccatcatgaagatctgcgaagtaacagggagctactatgcggagtgttttccggcttaagtagcccccacagtgtggactgctgtaaccgatatgaacaggaaatgttacaggacatgtccccagaggtggtgtgggcattgggtgtcgttgccgtgtgcgcatggcgggggcattgtgcagtggtagggtgcatgtggagagaggaaagggcccagtcagggtaggcacatgacatcctccctcgcctggatggcaggcctnnnnnnnnnncattggaggccgcgcccaaatggcttgtgctacacggtggcttcgactggatttaccggggtgtcactatcgtcgacgaagacgggcggcgggtggnnnnnnnnnngatccaggaaggcgtgcagtcagggtggcctcgtcattgggatggccatgcctccccatcatgtattggaggccgcgcccaaatggcttgtgctgcacggtggcttcgactggttttaccggggtgtcgctatcgtcgacgaagacgggcggcgggtggtggtcgatgtcgccatggaagggctcgaggttgctgacattgactgtgggttttcattcccttggagaggtgcagagccagcgtcgctgccctggtgccgcgcatcgcggtgatcgtggagcgggccaaagcggccgccagcttacggccatcgggggccacgagtttgacgtggacgccgctcatcatgacacgatcgccagctcttcgaggtgtggtcctggcacgtccggttggcctgagtagccatgcatgcgtcgcactgggccgcggtggcccgcatgtgtgcaagtgtctactgcagctgcgcggcgcgctcaggccaggtggtggcgcagggtgtcgcaggcaggtgggagttgagctgggccgggccgggagggtctgaaccatacacgggcttgaatgacatggcaccagaaggagcgccgctgaccatgctggtgacgaactccgtctcagccaggtgtttgtttcccagccggacagcagctcatccagggtgcggccagaccggacatcccgagaaaatgtgttgtggggtgtgcaccaagccatgatgcactggtttggccaacatccggtccacagcctactgagctgtgccatcaacacccaagaagagaaagccacctcctcaaccggttcatgccacgggatgttgcgtctcacgcacggcagaccctcgtgccgcgggcttctgccctggctaggagtatatccaggcccccagcgctcggttgtgccaccttacccccgccatcccatcagcctgattcttgaccgaccaggataaggtcaaattccggttctaaacgaccagtcagggtagagagcctcgtacgccgctgggcctacccgcgcttctcttacaaagctggtcttcaacgagtagcccagcaacacgctaagagtgatgatttggtgcagggcggactgcccccactcatccaattcccgagggccgtttgatttcacgacatagcactcaatgcctgacccatccgttgggtgaggcaagcgcaacgtctctttacgcccatgagtggacatttcatcagctgctcgagggcaggtaagtagtgtgacgctcccgcacggaaactatataaaacactccggatcgacttgtaaaagcactcgcaggtatcttagggctattcaagatgttcagaggaatatcttatgaatcaacgtgctctttaggacctgacgggccattgcgcgagggtgccagaggaacctccggatgcggaaatgctgttcctgaggcggcgttgaagggggtcagaagctgtcatctttgtcaggcgacttgtctgggaatgatcagatcttgaagatcacagtatcccagaacatgttttacgattgggtatatttaccttgcgaattatttcctcatcacccacgccgcgttcaccgtgcatcacttcatcacggggaccggctgaatccctccggattgccgtgacgagcatcatcttgatacccttgcaaaaatcaagatgaaagcacggggtaataataggacgagaacagctcttttagtccatcaatcgaccaagatacagcaaagtaaaggtgtacacgcataaaggcgaaccatcctatccggacaagtcgagccagcagggaacaatggcaacgccgtcaggtgtaggatgtcaccagccgtcaggaactctatattactgactggacttgtgctgctactgattagatgcgccttcgcggtaagttggagcgctcgctggtcactgtcgatcccgcgtgagccggactgcacttgctgcttttccgcttgcttccccacattcctcgcccaacgcaggcgacacgtagatcaaccttcatagctctgcccagtgaaatgtgagacgcctgaagtatgcatgcgggatgtatggtgcggcgtcagcgacgttcctgtcaccccaagacccttgcggacatggcgccggtcagacacctttcttgcccttctgagggtcggcgaatctgcatcctttagtctggcacacaaacaccaactccagtccacctctggtcggatactgcacgccgatgctatctcatcagccctcacgggattggtccttgcagcctcgaatcgcatgtgcaccttgtgacggctggcagtgcagatgccatctgcaagtaaatactgtccgacggatagcgtatttgaccaagtcttttcacgtcactgagcggaccaacttgttatttccaacaaggtgacacagtgtctgccatgctctgtgaccagcacgccccaatccgtgcgcatccatgctcgatggttggcaggcatatgggcttcagcaaggcgagagctgttcacatccactctcgacaccatgggtatctcagtgagtgccatccgtgtgagcaacctggacatcatgacaccacgcttcacggagatcttggtggccgtggcatacctcaaggcgggccagaaggtgtgcacgacagacgacagtggcaacatcggctccggcaacaagggcaagaccaactttggcacgaagaatttggggaaggaacaacaaaggtgagcaaagagttgggtgttagcgacacaaagaatgtgcacttctgctgcaatcttgggttgaatcaactcagaaccgaagtggtgttacctctgcaggtaactccaacgtgggcactgccaactggggagatggcaacaatggcaagggcaaccgcagcttcaacaggactggggatcgcaacgtcgtcagcgattgcagcttgctttggctcagctagcatgcgagaccccctcacctttccccgcctcccgccaagctggcgccaccaccacctgccaagaagtttcggacccagccatcaaggaagtcgccaccgccactcaccaagaggtcacaaccgccacccgcccagaagtcaccacccacacccaccaagacctctccacttcccccaccaagacatctccacccccatccctaatccaagccctctcctccccccagtccccctccttcccccannnnnnnnnncgatggcctcctttggtgctaccaaggagagagtctcctcctggggtgacaggtcgtcctatacacaagggaggtgggttcagtagacctgcatttattctcggtcgtttgcgatgcgcatgcggcagctttgaacctgacactcgatccacttgatctcagccatgcacgacggcattcgatccctcctctgcaatgatgcgcatgccttcaacaatgtcactctcttcgagtatacatcacggtcaggtgtgagtaacgaactatcgaagcttcccatttgctgcggggcagtgttttattcacaatctcgaagaatccatgtgtcggccctttgatcgagtcatgcaatggttactctgaagatttgatctccgactcaagcctttgcaatgacagcaggggatctctcagtgcggcgtgaacaaaatgggacaggcgaggtcgatctgagtcagggcgcgacctggcatcaacccctgtggagcctaaagacccaaggaccggacagcgtcaccgccttccacctcgtgaacggtcatggcacacaatctcgacggtgagcatcccaagtaatcaggtctgccaccagaagggatccagaggtcgaccaggagcagcgaggctggcaacactggtcaacctgattgcggagaagggagagcatgcagagcatgataccttttaaaagtaccttatagaagctgacccacctgtgctgcccgcttggtcagctgagaccatcccctacgatcggcacattacgtgcaaagcacgccgcatctggtcccaccttgagagagggggtggcacgaggtggcggactgcttcagcaagcaaataaggggcaaggtgacctttacctgttgcgaatcacatgtatgtcaaggatcaggccagtatccagacaggcagtgtataagaagcgggtagctggccctatagaagggctaaggatgggggaagtcccattgaccaccaggcaggccacgggaggacaccaggcaagactggtgtgtgccgacggcgtctcatcgctcttgtactcgatgttatcactctcctatgagatttaaaaacaagaaatgcctcttttcatgtgttcgcatcgcctaccggccacgacggggcctctcgtatggaggaatgagacccgcacaacgaagggctctcggaggcccatcaagcaacttacaggatatttgctccgtatggagtatgagttggcttgagtggcgccaggctaggcgttcaatgtcgtccagtgatggccgattcaggactcctggagccaaccccgctgccggagcccttgtggatggtaagaagtatatcatgcctggccatattgcttcttgtctccgtcgttgatgtactttggtgaagaaatcaaaagggaattgttccaccaccaccacccggtggtatcctgtctgcaaggttgcccgtcgaagtcctccaccaccagcttcgacaaccgtagcgtccagtgcccattcccatcgtagggtcggttgtaccaaaagtgtaattgcgtgttgattccatggtgttgatgtggtagagatctagagtctcctaagtctggtcaagatgtccgggtttaaatgctgcgctgttacatatggcctcgttggccagcagagtccaccggggcccgaccagctgggaggctatcacgctgttgcccttcccatcccaaagaaaatcggcccactcccactacagcagcgacggagagctatcatcgaaggaggaaatcttgaggagctcattgaatcataccggagaatcagccaccgacatgtcgacgatgagtagggggtccgcggacgtactaatcctctgtatacattgcgcggattggcaatactcttaaataccgcgcgacaattacaatatccctctaacagacggtgtcctgttcatccctcagcgaagactcggcgaaaagacaagtgtcagaggtgggctccattatgctgagacccgggccacatcctgatatcaactcgagatgataccccgtcttaccgagcatactgtggattgttgttcagcgaggagaccggtggtagtctgtggtgtaatcccggccaggcgccggtacgtcgtgtgggtgggtgacgtggcaagtattacacctccacagcctcccctatcgcactgttatgcggactcagcagcatgtcacccgtatctgccgcacgcattgacctagcagcaggagatagggttcacactccctctcctaaagccattttccagcccacagtgggatgaagagtgcatttcgcatgttcctgtggtgttttacggaaacgtgggtgcaggcggtcactatcgctagtggtccatagaacttgccgtgcaagttgggttgagatcccggcagggatgtatcggagagtaggacttgtgtggcactcccacgggccgtcagcacacccctggtatctctcccgctctggtcccttgtccagcatcgggtctcgatcttcctgaagaatctcgactcatcctctctgcctatagaagcattgactctcggtaacgtctcagggtcaatggtgtcagtgtcggattcggatgagtcgcggattacacaaccgaaacaaaactaggcagttgctctctctactaaatgtcactgcatactcacatggcaagtcagcttcgcaacatgaacaggcactcactaaagggggcaagaggggaaggggcattagtaggcttatgctaaggcgcggacggctctgtaacagaaacgaaaagcatggcaaggtttaatacaggagtccctctggtagattcgcggacattcttagcgtcttaggcagactttggctatctagggtgtgttatcagccgtttatcaggcctacccgtcaggagtgagagcattcgaagtgccgccaccaggtttgtacgccactacttgggcatacgacgcaagaggggtctgactggaggtcagcgtgctagtccaagtcattggcgtggtagaatatttgtgtttctaagcttgcatcaggccaccagctgcaataaagaaagcgtatttgacaccgttcggtgtgaagcctctaatgctgacattgaatgagagcacacccccaatcctgatgaaactcccgcttatggatcccaatgctggtggtggtggagaagctcctgggggtggtgacgaaggatggagctgagtcagaggtacaacttcaataacatcgagtaagctgtatacattgctgcagagccaaaggaaaaaagtgctgttgtgctcgggtcttggtctgtcagagtggctgtggtgacagcagcggtagttgcttggtttgcaccaccaaggctgttaaagtctgatgagtacaggttccaatcaatggaggcgggtatataacctactgtggtgacaacgaaagtgatgtccaccaagccatccctaggagcactgaactggaccgtggcagatgcatgtggtggcggaggtgcagaagagagatttggtgggggtggtgaagctggtgatggagaggcgtttgatggtggtgaggggctgggtggaggagggagtctggttggtggggacggggtgggttccggaggtgggctgggttcaggaggtgggctggctggtgaggacggactgggtggtggaggggcctggtcggtggaagggacctgggcggaggaggggcctgtaggcttgatggcaacggtggtgactccttggtgcggggaggtggagacattttggtagggggcagaggagacttgcaggatggtggtggtgggaacctccaggatggcggcggtgggaacttccaggatggcggcggtggggacttcttcgccgggggggtgggaagtcaaggacacatgcatgcttccggaactcaagcaaggtacacgtgttgacgactttgcgatccccagtcctgttgaagcagcggttgcccttgcctctgttgccatctccccagttggcattgcccacattgaagttccctgcaaaggcagtaccatttcacttcttagtcttttctggccatgcttgcagcagctgcagaattgtctgtactcagtgtgcaccccattctttgctcaccaatgttgtcatccccattgttcttggtgccaaagttgtttttgcccttgttgtcagacccaatgttgccgtcgctgtctgccgcacatgccttctggcccgccttgaggcactccacggctaccaagatctccgtggagagtggcgtcacaatctccaaagattgcagacggaccgcactcactgagaggcccatgatgctaagggtcgaagtgcgaatagagcctgccttgctaaagccattctgcctgcaaacagttgaaggtaaatgtgatgggtgggcgcgcacagaattggtcgttcttgacattgcacatgtctgaagccgtttccgaccggtgtgacgaaaagtactccggaatattgatgtgcaagcacttgcactggtctatccccctgacgcgacactcacctgcagatggtgtctgcactgtcaaccgtcgtcagatacacatgggctcccagactgtgcggaatcgaacaaaagcgacatgttggaggagcatcgggaccagactcggatcgtgagggcgactctagcacggtgtgttacatgcgtgcatgaccgaggaagcaggttcgccgaccccccaacgatgctgagtagggacacggatgttgggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgaggggggcgggatgctgaggaagtgagtgaggaaggggccaccgcagtccggctgacgcgggttcgagatcgaccagcgagccctccaactcaccgcgacggcgcatctggtcagtagcagcacgagaccagtcaggaatataggattcctgacggtccgtgacattctgcacctctcagcgctgtcactggtccgcttactggattcacttgtcgaattaaggtaggttacctttgcgttaggaccccttgcctttgcaacacctaggtcggctaccttgatgcaagaactgctatcaacctactttgttcctgttatttcatcatttatttttgcaggggtaccacgggctacgtgggagattctcttcacgggaatccggagaggtccagctacttcccatgatcaaatgacgcagggtgaaggcagcgtcggtttcaaggaaaagcttcgcaagggatgcaaacccaaattccaatcctctacttgtgcatcacaggccccatcaaccgttggatcctggtaaagtcacccgatgagggtggcaggttttgacctcctcaacgccgcctcaggaatcgcatgtccgcatccggaagaccctccggcaaactcgtgcaaagtcttccgtctattcctgcggagcatgatcgtacgtaagaaactccattgcacgtctcaaatcattctttatcgcctgtaaataatttaatcaccaatgggagtgttgttcctatgttctttgccatgtcgatgtctctgcctctgagcagctggtcgaccacccactcgggagcctgaaagggcgttgcgcttgcctcacgcgactgatggaccaggcagtcagtgttccattccaacacgattgctcctcaggcaatgtacgagtggaggtagtcctaccgcgcgccagacatgcatccgtactccgccccggggctgctcatttaacgccagcatggaacccggcatcaagccgcaccgcaccagggtcattttcccatactccagctccccgagctccatgtgctttgttcaatgcatcaaagggcggcatgcatgatcaggatgtgagccatggcatcacagggctatgattcactgtctgaaaaggctggcccaagcaggtacaatggggtctcagcgccggccggcatgcgtccatcgcgccaccagccatgcagcgatgaaattctcgtcaagcacactcgcgccctgcacaagatagatctgcatacacctgcatccgccccatagcgccaaaatcacaaggcgccagacccataatctgcacacagtgatagccagacgcatcccggatcccttgcgcgcccgaagatttctgcctaaacgggcttggtgcagatatcaaatgagggttgagggagctcggccaggaggtaggtgccagcgatgggtcttgatcccaaagctgtcacaggggctgcctgataagtgacagcccacactcgaatcgaccaccgagaggtctgtgcatctgaagagaatagccaccctgacactgcatggcaggagcccttgctctgaagccgtttgctgcctgggatgggacccggaagcctgaacctccacttctttcactagggagacctctatacccacctccatatgcaaacttcccagtggctgactggtttgattgcctgatcaaacccctcgtggtatgcagtccggctccacaaggaaaatacagatctacatggtacagcttcctcggcttaccttgcatcaggttgtatcccagtgcgccagacggccagcttggcatgcagcgggccgttgcacgcaatgctcagcagacccggggatcgaggggcactgtccctggttaggcgcacacctacatgcaatcaatgctccgctgtaacacactgtcctcatcatcccaaaaggctggctgttgatagaccagctcaaggtcacaaatcggtttggagatgaaatcgagtcagaaagtgtcgcacgccacctcagcctgcccatgcttatgtcatatggtgctgtatggccggaccacaatcctgaagggacctgggcatgggaagatactcagccatcagatcgaagttgacatccactcaatgagactcaccttcctaggaatggattagtcctcggcatcccaacctgggttcggcatgctcaatgtactcgcaacatgcagccccgttggaacagcgggggaggacatcatcatctgcattgcgccctcgccctggatgctgagtttcgccaagtccctccggctcgtggatgcaagctggcatcctagtgatgatgagccatgatacaccacgcttgggagctttgtcacagtctcagaccgagaggggcaatgccccggcaaaaaccgtactgcgagtgcagcggccggacagggatgtcagtggttaattatacataaggacaatcattcttatcacgaaatgagttagggaggggtgatgatttgtctgcggtgttgcgctgcgtctcaagccaagctagctgctgaagagcagctcaatgtcttgcagggctagtgggatatgcacagatgtccaggaagcggagttcggcgggagtgaaatcaaacaggggttgtctggtgtgttgatgggccctaacctgtcatttttgaccataaccggtagaatgaccagtgtcaggtcctcacaacggcgcaccaaggtgtcacataggcggattcgccaagcttgcatcacccagtgccaaaggctaggtacaacgtcagcaggggtgccgcacccgagatctggattgtgataagtcctgttcgattcccacttcaagcctcgagtggtctcgaagagccaaactctgccaaatgctcaatgtggcccacatactgtccagactaaaggccgttacagcgtcactccaaggtgtctcatctcagatcgctaaggtcggatgatccagcacgggacactaggtcaagatgagctgtgtatgaaggggatccccccattcataaggtgccatgagaatctccggtaaaataaggctgctgcatgctacacgctcctgtgaggccggaagggagctcaccacagaatgtcctcccaaggcccacagaagtgccgcaacatctgcttgtttactggttcgggagttacaacccagcaaaattctcagcacacaaatgaacacttcgcatttcatgccactggtgggtgcaagggtttttgctcatccctctattccttgctagatcaggtgggtaatgctccttcttctgtatagatcttgcattgtaaagagctgagctgtggttgttgcaggttcacacaccagaatggagcctctttctgccaatagcctccatcacaacacctgaccccaggtactatctcactgaggaagtcatccataggggactatagtgacctgcttcgaattcggcgccttgttgccctgagcatctgctgcaaccgcaatgaagtagactggctttcccggtgagaaatgtgtcgatggatgttcagtgtgcgtgtatgagtttgggctactgaaggtgaattttaccgaaccactctgcaaaatctgtatggttgcagcgtagaagccagttgtctgaactgtgaagatcaatgtgtagtcatggttgtctttgatggtcaggacaggcgcgctgtaatttggaggcggtgggggagaaggtgggggcggggatggaggtggaggcaaagatggaggagagggtggcggcggcgagggcggcggcgagggtggaggagatggtggcggcggcgagggtggaggagacgggggcggcggcgacggcggcggcgagggcgggggag

SEQ ID NO: 27966 - DNA, 148 bp, Chlorella protothecoides
ggctggcagtcggcccccgggccctcgaccccggggtcaggtgcggcggcgcgcagcacacccccacccaggtcctcgggctgccagtcgcaggactgcacggcccgcgcggccaggcgccccgcccggcgccgcatgcgccggttgg

SEQ ID NO: 27967 - DNA, 61 bp, Chlorella protothecoides
ggttgattggacggagtccaggaacgaggattcatctgtgaatgcttgcagcttgtcgcca

SEQ ID NO: 27968 - DNA, 80 bp, Chlorella protothecoides
cccttgtccctcgttgggtcttgctgcctcatcaattcctctatattgatccccctgtgcctgttgtatgccgctggacc

SEQ ID NO: 27969 - DNA, 61 bp, Chlorella protothecoides
ccaaataaagacaatgctctgaaacccagggattgccgaaaaaattggcaagatcgatggc

SEQ ID NO: 27970 - DNA, 79 bp, Chlorella protothecoides
aagtaatggagagttgcctctgattagaaaagggaagcgcgggtgccaggcagaggagcgtatgcgggcggggcagtaa

SEQ ID NO: 27971 - DNA, 61 bp, Chlorella protothecoides
atgcacgctgtggtagctcctgcaaggggggtggaggagggagggaatgaaaggctgcact

SEQ ID NO: 27972 - DNA, 61 bp, Chlorella protothecoides
cagtccatctcccagtccatctcccagcccatctcccagcccttctcccagcccttctccc

SEQ ID NO: 27973 - DNA, 461 bp, Chlorella protothecoides
  modified_base (133)..(355): a, c, t, g, unknown or other
gccaagatggtcggccgagacactccctcgagagtggcacaccaggggggtagtgcccgccggcttggctctaacccagagactggtaagaagaagagataatctggcaaacagcctgctgtgactccttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcccgaggactcgtgcgtgccctatgccttcaaggagggtctctgatggggccgaaacgaggacaggaatgagacgggcccatccaggagcgctgcgcggccc

SEQ ID NO: 27974 - DNA, 23105 bp, Chlorella protothecoides
  modified_base (4151)..(4160): a, c, t, g, unknown or other
  modified_base (4325)..(4334): a, c, t, g, unknown or other
  modified_base (4437)..(4446): a, c, t, g, unknown or other
  modified_base (4498)..(4507): a, c, t, g, unknown or other
  modified_base (4891)..(4900): a, c, t, g, unknown or other
  modified_base (5952)..(5961): a, c, t, g, unknown or other
  modified_base (6361)..(6370): a, c, t, g, unknown or other
  modified_base (7516)..(7525): a, c, t, g, unknown or other
  modified_base (8015)..(8024): a, c, t, g, unknown or other
  modified_base (8092)..(8101): a, c, t, g, unknown or other
  modified_base (8542)..(8551): a, c, t, g, unknown or other
  modified_base (9061)..(9070): a, c, t, g, unknown or other
  modified_base (9301)..(9310): a, c, t, g, unknown or other
  modified_base (9633)..(9642): a, c, t, g, unknown or other
  modified_base (10117)..(10146): a, c, t, g, unknown or other
  modified_base (10891)..(10900): a, c, t, g, unknown or other
  modified_base (11103)..(11112): a, c, t, g, unknown or other
  modified_base (11684)..(11693): a, c, t, g, unknown or other
  modified_base (12344)..(12353): a, c, t, g, unknown or other
  modified_base (13184)..(13193): a, c, t, g, unknown or other
  modified_base (13529)..(13538): a, c, t, g, unknown or other
  modified_base (16162)..(16171): a, c, t, g, unknown or other
  modified_base (16497)..(16506): a, c, t, g, unknown or other
  modified_base (17070)..(17079): a, c, t, g, unknown or other
  modified_base (17606)..(17615): a, c, t, g, unknown or other
  modified_base (17772)..(17781): a, c, t, g, unknown or other
  modified_base (18065)..(18074): a, c, t, g, unknown or other
  modified_base (18685)..(18694): a, c, t, g, unknown or other
  modified_base (20068)..(20077): a, c, t, g, unknown or other
  modified_base (20233)..(20242): a, c, t, g, unknown or other
  modified_base (20869)..(20878): a, c, t, g, unknown or other
  modified_base (20988)..(20997): a, c, t, g, unknown or other
  modified_base (21185)..(21194): a, c, t, g, unknown or other
  modified_base (21774)..(21783): a, c, t, g, unknown or other
  modified_base (22496)..(22505): a, c, t, g, unknown or other
ggcgcgcagcatgccggcgatgcgccgcgccgcctcggcgccgcgcgccgggccctgcagccgcacgctcagccgccgcgcctgggtcagcagggagcgggccagggcctcctcctccgcgctgtcttcgttggcggggggcgcgccgccaaagtggtccagctgcgcgacgcgggcaaagtaagggccgtgcgccgggtcggcggtggtcacgtcgccgacccgcacgcggctctgcccctccaggctcagggtccagacgccagactgcgcagaggtggaggaggaggttgaggtagagggtaaggcatgcttgctcctcaggtaggtgtctgctttatggcaacccagacacatgacaccttgttgacccaaggggaatagcctccaccaatggacctccagccgtctggtccaggcgtattctcctagatcccatgagctcaataaccaataaaaccagacgagtactcagacagacactattccccactctggccgggggcggttccgaaacatagacctactggggttcccatggaggagaaacaacatgcacggaaagccccctctccctcccttccctgctttcgaaatcgaataccttggagcttttgtgcagctgcacgactttcgctgcggtgccggtgtggaacaggcggtcatggtccaggggctggtccccctcgctgtccgctgggccatggtcctccccgttgtcgggggagtagggcacagcggccaccatcacgtctcggccctgttcatgcaccaagtgcttgatgagatggctgttgccttgcacggccacagtgagcatgcccccgggcaggagaacatgggtggagagaggcagcaggggaagggtgcgctcctggccctcctggccaggtttgcctcgcttcattgcgaaggctcgcactggagcacgcagcagagcggaataaaatcgagcttccaggggaagcaggatgtgcccgtatgtcttgaccggtgttggaaatggccgtgtcagcgtttcggaaaaacagggttctggtcggaaaacagatctgagggcgcgtacacatccgcatgaagagcgtgtgatcagggtgacccatcccacacatgggttagttgtacaccgcagcaatagttgcctgtgaataaaccagcttgagagtgcccgtagacaccactggaggtcccgtggggacggccccatgtcgaggcgggagcttcagttcctggatgcacaggatgaggacgatgcctcctcctcccagtctggatctccttcagcatccgaggatgaaactgggtaccccagcagcgacgacgacagccctgcggtgtgcagcgaccgaccgggaccgagtgctgccccccagcccgtcacacccccgctccaggccgggagaaagatctccattaagctgggaggaacctccagcgagctcacatgccacgtgcgtggtgtgtggtgtgaagggcggcctgccctgggaaacgtgtagtcagtgtggctcacccagggtgcctcgccctgcacacacaggtctgtggaaagaagggccattgtgctggcttcatcggcgcccgctacttcgactgccccaacaagccctgctacctgtgcgggcagagcggtcatagcaccatgacctgtcccttccggatagatcccggtcacggctgcagcgccgcccctggatccaaccccacagacggggttcagtgggaggtgctccggcgggagcagggcgcggcgggcgccgccgccccggggttgccgcctcagcgcaagcgctggcaggtggagagcgcggtgctccgcctgcatgaccgccgtgtggtgtgcctggaattccatccgcgcaaccagaacatcgtcctgtcggggtccaagggcgggcgcatcgcggtctgggacatggagaaggtgacgagtgcgtgcttgaggggtgggctgccaaggaagagagcgattgaagactgtggtgcgcatcaggcctgcgtactcccagtggttgtatggccaatcttgtgtcaaggtgcgtgcgcatgcctgccactcccttcagctcaggcagcttcgtcctccccgcaggtgtatgagcgcactgtctaccgctccatcaacttctggctcacgagtgctctgaagtttgcgccaggcagcgatggattggcctgtgccacctgtagctacgacagcaccgtcaaggtgcgtgcatgcatggatggtactggggggatcatcctgtagctccaagctgaggtactgggtaggattttgtatcgaagtgaacagggcgagcacagttggcacacccttgcaagatcgcctgcagtgctgcatacgatattcccctcgctccacgtgtctgtgcattacagatctttgatgttgagacgggagcagcaaccacactgcacactgccaccccacgggagtggaggggtcctgtagaggaggatgggagctggattacccagatggccatggacgtcatgcagggtgagcatcacatctcgggagtgggaggtacaagggttgggagttgagataatcctgtggaggtgccggggttcaattgttgatggcatggtgcctgaccggccccaccaccccaccacattcatgccatgcggtctttgcaggtgggattgtagtggccggggacaataagggcatgctctacttctgcgacccgcggcactcctcggcctttgcgaccatgcaggcccacaagaagggcaccaaggtgcaactggagcgggtgtgatatcgtttgttgcttgcacggactatgaggctgtctgacagtggccctttgatgtttgaaaagtccctcctgcaccccacatgcgaatgctcttggcctgcattctcaccccccacatccacatgcccctcgctgtcccctaggtccagagcgtggctgggaaccccgtggacgccaacctcctgctcacggcagggaacgactatgctgctcgcctgcttgacctgagggtgctgggaggaaagcaggaagcgggggccgaggtgccccgtgctgagctggcgtcgctgcagcacagcaaggtgatcaatgccgcgtacttcagccccatcacgggccgcaagattctcaccaccagccaggacaaccgactcagagtgtgggactatgtgtatacctcggatcaggtacgagagaggtggacactcgaggggggcaggggtctggaactcaagagggaggggctggcacgcgcacctggaggtggagaccgagtttgcgggcaagggtgtactttgtcattgcgtggctcctgctatgtgccattcacagtctgcctgggcagccatggatgcactcctcttggggatggacatcgtcaggctgcattcctgcagcatgtcaggctgcatcctgcatctcccttgcaggagccggaccgaatgattgtgcacagcaataacttcaaccgctacttgacgcccttccgggcagagtgggaccccaaggatctcacggaaaggctcatcgtgtgcggcaggtcggtttgtcagacaggggatgggttgtacgccttgaggatcaagtctgggaccagacctggagtgtgtgatccgtaacaggacagtagcggtgcagtgctgcacaaagctgaggggcacgggtgcactgggcatgcacccacccagacagcatgtaagcccatctccctgacaccaaaatcactcgtcttcactctgtttcagatacatatcggaggactttgggggcgtggccctgcatccagtggatctcctggatgcgtccactggtgaactggtatctgaactggtcgacccaaatctcaccaccatctctccagtgaacaagctgcaccccaatcaggaattgatcgtcagtgggagcagccgatcactctttgtgtggaggcccgccccaggtgagggaacggcgtggaggatgctgcatcaagccgtgtcatgcatggcaagcatcatgcacaaatgagaaggggtagcgtcatctgatcactgtgtgctcgcaatggtgcatggactacagccgagtacacatgctcttcaagcactctgcatgtaccatcacccattctacagatggtgagctcgtgcgagatattgggctgacagcttccaacagcannnnnnnnnngtgcacaaatgagaaggggttgcgtcatcagatcactgtgtgctcgcaatggtgcatggatgccagccgaatgcacatgcacttcaagcactctgcatatatcaccacccactctacagatggtgagctcgagagagatattgggctgacagcttccaacagcannnnnnnnnngaaaggacgaggaggggccttgaacttaggctgaatgcaatctactttaagagtcgatttgacaacatctttaggcgtgatgtgacacatagggaatctcttnnnnnnnnnntttatcgacttcgtttcttcttcttcttcttctcacgcttctctattctctnnnnnnnnnntttgacgctgacgagagcgagacacccaagaagaaggccaaatctgcaacaggagctccaaaaacagatgacgccggcgagagcactaagaagaagcctccacgcaagcggaaaaaggacgaggaggggccttgaatttaggctgaatgcaatctcctttaagagtcaatttgacatcatcttcaggcgtgatgtgacacatagggaatctcttgctaggcagccgaatggcccttctaccttgtgaggaggtttgtcggtccatgacagttatgtaatttaaagagggcttcacaccaaacccttccttgtcatagcttcagtagagcataagcactctggaagagattcaggattgtcacatgggagagcgtcagggtgagnnnnnnnnnngccatgacaaatatgtaatttaaagagggcttcacctcaaacccttccttgtcatcgcttaactagagcataagcactctggaagagactcaagattgtcacatgggagagcgtcagggtgagaaagtgcataaaacgaacacacagggagtttcttaccgacttcgtttcttcatcttcttcttctcacgcttctctattctctttttatacttggaagactttcccctcgatctgcggtctgtcttccttgctttcctgttctcactgctggaagggctgtcgcttgggatgcggctccgcgatggcgacatgcaaaggaacgaacccccagcgtctttgccttgcgaaccctcctcagacttcacgccagcaggtggaaagaaaggaccttgaaccctgcgatccaccagtgcgatgtcctcattcaccctctcccttgcgtcagtagcagggagggatgggcctgcctcgtccatccttgcacccatgccgcccctccctctgcaatgtggggaaagccggagaaaggaaggactggaggtcagctgccatgatgagatgggtggccactattaaccactctgacccaccggtgcacctcttgcactaacattgtctcgtctcagtaaactcgcccaggaattgccgatgctgctcacctgaccctatggctgggctgcggaacgtcatcaacaggcattctcctgggcacaccggagtcccaagcgctcgtctccgtgactgctgccagcgctgcggcgcaactgggatgcgcctggcccccctgctgaggatgttctgctttgccttcactgctctggcgatggtgcatgtgcctcgcccacatctcctgctcctgagctcgtttgttggctgtcggggtgttgtcagatggcagggcttgaaggtatcagcattgccagcagatcatgatccacgctctcgatcttcactggtgcaagcatgcacaccttggaattgcgcctgtatccaacccccatatgtaagggaatacacgcacacactcaccatgttccacactccgcagnnnnnnnnnnctgcgcctgtattcaacctccatatgtaagggaatacacacacacactcaccatgttccacactccgcagagtggtgtgcagaaatcttgtattgggtttctccctctggacgggtctctgaacataggcgctcaccccggcatctgcaggacaaggtgggtaaatttgcaagggttttagatgacgttaatacgaacaaactgtgctggagattatgaggcgactctgcccggcacatgcactcagaccttgagcattgcgtcggagttgctcggcgtcccgcaggatgagggcagctaatttagaggttgtgtgggccatgatgggtgcactctctgtaaatcctcataagactgccgagctgatgcttgtgagcatcgagtagtggccacccgtcgnnnnnnnnnncagaggttgtgtgggccatgctgtgtgcactctctgtaaatcgtcataagactgccgagctgatgattgtgagcatcgagtagtggccacccgtcgcgggtgggatgcggatcacttctgaaaggcccttggtggcaataatattctctagattgtccaatgccgatgcaagcctctttgctatcattaagttatatcccgttggacgagacccgcagattctaaggacgctgttgcatgcaagacacgcacacgatcaccccttcgtggctttcgaattccatgcggggcagcgcgctaaagctatgtgtcggcaaatacagatccgcatcgactcatcgaccctcgaagaccgttctaccaagaagataccagcgatacttaccaccagtacacatctgcacgagatcgtctcatccccttgcagcaaaggcggagagggatggtggatcccaaaccccgaaggcgcattgtgccggttcagatcgctgcatcgcccacaatcgtatcgaatcaggcaactgtggatgatgaagcccatgtagaggaggtctgtcccagaggggcagacctgcaggcacaggcagagtatgctgccgccaatctgggcgccgatcgtaagctgtacgtggatctctccggcctggagccatccaagcccatggtggactggaaggaggtgggtgactcgatttatcagagcaaaatgtgtgaatgggggaaacggggcctgtgtggtgttggcaactcaatgcatctctttgtctctcggcactgctgcaatcctgctgtgcctccaaaatacaatgcttctgaactctccgccatccctacagcttctcaaggctcgagggagttccaacggcccagacaagcagatcgctgcacgggacgagcaagaggcgaagagtagcctggctgcatccgacgaggtgagtcgtcattgctgatctgggggttcatgatgctgccattggaaggagggccaggataaaagctgacaatttcgagtgtaaaatcggctgcatggatctctgaaccctcttgacattgagtgggccagcaatggatcggtgttcactcctccatacaggtgtccaacattcgccagctgtctgggttggcaagagtgatagctcgccttgnnnnnnnnnnaagtgggccagcaatcgatcggtgttcactccttcatacagatgtccaacattcgccagctgactgggttggcaagagtgatagctcgccttgagcagaagattggggtgagtctgtgcagaggaagaggaggcttcactctttcgcatgcctcggctcctgcctgcatgtgggagctgtggctgcgtctgtgctccacaaatgcaacccccttctccctgcacagatggggggaggcagcagctcagacagcgattccggcgagcccgatggggacgcgatgtccgatgaggtgtgtgtggatgttgggcgctcgctgaggatatgtgtaatgctgagaccctgcggggctctttccacctgccatgtgtcccatggaagccagtgggcaactattcggcgctcccctcccatgccaggacaatgcggacggcgacaatggcacggatggaggcggcgctacaggaacagacctggagacccgccgcannnnnnnnnnatggcgggcgtgttacatatgcagcggggttgattgctggctcgaggcatgcttgataaccttgcagnnnnnnnnnnatcacatggacgagttcatcgatgactcaggtttgctgggaaggttgaatggggtactggtggctggcgtgttacatgtgcagcggggttgattgttggctcgaggcatgcttgataaccttgcaggaatttggtccatcgagtctggtgtctgccaacacagcaatggtcatgaagcctgcgggcaaccctcaatcccatacccgcttgctcgatcccttgcctggcgcagagttcattgagctgatggaggacagcgacaggcggcggaccaaatttcagggcttcttcatcacgagggtgaggggtctgcggtgggccacaaccagtccaaacccctgggttttgtgttgcatggcgccgaccagggacaacatacctgtgagcatccgtctcaaggcgcgctggagatggacacaagttccggcggcgccaagcccnnnnnnnnnnttggaggacagcgaccgccggcggaccaaattccagggcttcttcatcacgagggtgaggggtctgcggagggccacaaccagtccacacccctgagttttgtgttgcgcggcgccgaccagggacaacatacgtgtgagcatccgtctcaaggcgcgctggaaatggacacaagttccggcggcgccaagcccccctcaccttgtatttgctgcgcagggcgagattgagcgcctggacagcccgcctgccgcgccacaggagaaggataagaagaagcggaaggcgacggatgccgtggtttctggtgcagttgcacctgctccgccgccaaagccggtcaaggtgaggcgaggacagacggcgtgtggagctaggaccagagtctcaaatccccgcctcttgtgaggcatgcatggccctttggaagaatgaatttaggattcaccttccacaacccctgactttccactccaatacgtcaggcaagcaaggggactgcagcggatnnnnnnnnnnaaggaatagagtccccaatcgccgcctcttctgcggcatgcctggccccttggaagaatggatttaggattcaccatccccaacccctgactttccactccaatgcgtcaggcaagcaaggggactgcagcggatggctctggcggcgcaaagtctgcggcagtcaagcccgcgtctgacgcaggccaagcctcgccaaggaagaagaagcggaagaaggtggatgcgacnnnnnnnnnnccaagcccgcgtctgacacaggccacgcctcgccaaagaagaagaagcggaagaaggtggatgcgacgtcaggtgttgaagggcagaatgcgaacgtttctgcacccgccccgccccaacagccagcgcccttgagcatcgcacagttggcagcccgcgccggggctggcggggcggctgggcccgacgcaggggcagcttctcaaagtgcgcaggtgggcgcccgcgccgcctcgcctggccgggcggcaggcgcagtcgctgctccggcagcgccgcagaccgcgtctgtgaccgtacctgcgattgtgccggcggccttnnnnnnnnnnggtggctgctccggcagcgccgcagcccgcgtctgcgaccgtacctgcgattgtgccggcggccttgcccgcggctgcggcgcagcctgggccaccgccagtgcataacgcagccggacagcttcccggcgaggaacgcctgaaggccgagctggcggagttggggcagtatctggcaactgccttgccccccgccccaccccccgccgcgacccccgaggagcagaaggaagcggaggcggttgcctggaagctgctgcccacggccctgcgccagcgcgtgtacgcgagcctgcgcctggtcctgcgcgacaccgacctcaacagcgcgatgggcaaggcgtggctggcccaggtgcacgccgccttcccgtctggccgtctcacactggcgggcgtgcgccggatctacgcgcagcagcgcaagcgcgagacaaaccgcgccgccgccagggaaaaggcggcggccgccggnnnnnnnnnnnnnnnnnnnnnnnnnnnnnngcgcgggccccacgtcgcccctgctcgcgtcgccgagccagcgccggggacaggaggcgggcacggctaccccgcagcggcccgcttcggggcccggcgcggcgcccgaggtcggggcggtgtcaggcgggggcttgacgccgcagcgctcccccagcgcagaagcccaggcctgggtggagagggcgctggcacgagggcaggcgcgtgtgtcgccaccaccgccgcccgggcggcagggcgcagggaagctggcgagcgcgctgccaggcggatcgggggccgcggtgccctgtgtgctcgctgccgccgcgcccgcgctcccggcggcagcggtcgcgcaggcaggacaggcactggagcgcattgctgggcctggggctgggctggcgaatgatcggacgccaggagtggctggaatcatggccccgccgcctgcccagcagcgagagatcgccgatggcggcctcatccccacaggcgtgccgggggcggaagggcccggggctcccattcctgaaagcgttctggaggaggcaggcctggcaccggtcatgggcgacgaggagatcctggtgaggagggctggctggtgcttgagcggggccagggcccgcagagtcgggccctgctgggcccctcatgcgctggccctgctgcaaggggccacgcgtgcagttcacgtccgagcactccaccgtcgaacccgcgatccccccggtccaccaaaacgcagtcggcggcnnnnnnnnnnggtggtcgcgcaggcaggacaggcaatggagcgcattgttgggcctgggcctgggctggcgaatgatcaaacgccaggagtggctgaaaacatggccccgccacctgcgcagcagcgagagatcgccgacggcggcctcatccccacaggcatgccggggtcggaagggcctggggctcccattcctgaaagcgttctggagnnnnnnnnnntgtgcagctcacgcccgagcactccaccgtcgaacccgcaactcccccggtccaccaaaacgcagtcggcggccgccacccagggcagctgcgacgccgcggcgctgtcgttcgcgctttcctccacgcgcggctccctgtacgggcgggcgctgacccgggtgctggccctggccgggccgcgcggcgcctccacggccgaggcggcggggcggggggtggagctgcgcctgctctccccctcgcgcatggcgccggagcagcgcagcgccaccgtggccgggctgggaagggccagcgccaaggagcacgtcgcgcatgtcggcggctatcgctacgcgctcaaggcctttgccggcgtggtggaccagcccaagccccagaaggccggcggggcaggggcggcgtccaagggcccggccccggggcctgcatgaggaggccggtgctttggccggggggggactgaggtgggaccctgcggtctctaggagtgccctggtctgtgcgtattcgtgttgcgcggcgatgcgagtccattcctgctgtgtgatgtgaagaatatttgcacnnnnnnnnnncggatgaggaggccagtgctttggccgggggggaactgaggtgggaccctgcggtctctgggagtgccctggtctgtgcgtattcgtgtggcgcggcgatgcgagtccatgcctgctgtgtgatgtgaagaatatttgcacccatttgcctgtccgcaatcctggctggaggccgaggcggacacaatcctccgaatttgtacgagagaggtccaacaacggaccccgaggtgaacgtagctcacaaagcgcagcgcccaggaacaaatttacaccatgtcggtctctccaatagggttactcagtaccaggagctgctccggtcctgctcccccgccgccacctcggggtcctcctcctcctgctttccgcccagcgccaccacctcatccgcaaaggcctgcagggcgcggttggtcctgccgccaaggagtacgctgccgtcctcggtcgccacgccccagagctgggagtgggataggtaggacaccaccaccgtgatgcacaggcctggacagcggtggggtgaggtggagattcggtcgaggggctggactgacgaggcggggggagatcacgagattgacttgatggctcagcatgaatctagaaatggtgcagaggattctgtggtgagggcagtcagccacnnnnnnnnnncaggtaggacaccaccaccgtaatgcacaggcctggaacagcggtggggtgaggtggagattcggtcaaggggctggactgacggggccgggggggggatcacgagattgagtggatggctcagcatgaatctagaattggtgcggaggattctgtggtgagggcagtcagccactgcacgacttcatcttcctcgtgtcattgcacccacatggccccgggcacgaccgaagaacctcacccacaacaacagctttgctatcgttgcaaacccttactcaccaaggaagccagcgtacaccaaggggaccccggggtcaatcttcagctgcatgccgctggagggcgtgatggcgccgatgcggagctccactccctccaccgtgatggggaggtttgaccccgggcgcctcacccccacaaaggcccccttgccgtcgtatagcaccaccgtctggagatcccgcgccagcagggagattccgcgcgggttggaccccggcgcgccgtcctccgcgggcaggcccagcgtggacaggggcaggaaggtgccgaacagcttgctttcggggctctcccccgccagctgggccatgggaagagacagttggacaggctgccgcgggggattgggtactggctttccctggccctccgagacaccggcttcatctggtggcgtttgagaaagagcggtgcccgtctgtggtcccaaggcagcgtcgctcaggggcagggccgacaccctcacggctgccagggcccagtcggtttggtaggccgtcagtcccttgtaccggagcggctggttcacgctcacggtctggcgannnnnnnnnncgccagggcccagtctgtctggtaggccgtcagtcccttgtaccgaagcggctggttcacgctcacggtctggcgagccaccggcactccttcctcgaggactgaagagcaaggggtacaaatagggatgagatctccatgcgtaaggagatggaccagggaggacttgtaaacaggcatggcttaacatgtagagtcggacgccgcacacatatcaggaagcggttgctttgcacagagtagacccccccacgggtcccccaggcccagcctcacctgtgacgctggtgacaaactggcgaatgctgccgtcgtcccggtagtctatctggaagnnnnnnnnnngcaaataaggttgagatctccatgcgcaaggagatggaccagggaggacttgtaaacgggcatggctaaacatgtagagttggacaccgcacataaatcaggaagcggttgctttgcacagagtagaaccccccacaggtccccaggcccagcctcacctgtgatgctggtgaggaactggcgaatactgccgtcgtcccggtagtctatctggaaggcgtcaaacttgaggtccgcagcgtgcgccgccgcctcccaggcaaagggcgaggcggggtgcagaagttcgcgcaccggcgaggcggcgccctccggcatcatcacgaccccctcccaccgccccaccgcgccaaggctgacccccgccagcaccgccagcatggaggcatgcaccccgatgggcccaagcttccccgccagccctttgaaggcgtacagcgcacggggctcgctgctggggggccctgatgccgtcgaagcgccgcccgccgcgcccgcctgccgcgccccctcgacgaagacctggtacccccggtcccgcaacagctgacccacgctgcgcacgctgtgcccctccatctcggtcacggcgggcagcgcgcgcagggcctcgacgccgggcttgaagcgccagcgctgcgcgacgcgggcctgcggccactgcgtggtggtggtgcaggccgccagcgaggcgcccagcaggcccagcaggccaagaaagtagggcgcactgtagatgtggtccagctggagggggaggatgatgggccagggtagccagacctggcccagtgggtagtgctccacgtagtaggcgggggactggccctggtccaccagcgtgccgcaggccgacagccccgcgatcaccgccagctcggcgatggccaggcgcaggttggagagcgcacgcagcgccacgcgccagacgtagcgcggtgtgggggtggagggccgcgcggcggcggggagctgcacgcgacgctgggcggagggctcggacaggtccagcaaccccggaccgggagcaggctcctcggtgccggggttcaacgccttgggtggaggtggccctgagactgatggggagaaggggggtggggaggagttgcagagacccggggcgcatggcttgtgaggctagaaggggactgcagacaaatgacagggcagtgggcatccccatgcacagcttcaaccctcgaccccagccaccccctcaccaccatgctgacgatggcacgatccccaggtacgagcgaggaccacatggtggattatgtgcgacgcgaacagagtgtttggtggtatcctacccctgctgctgcatgtggtgcctggcctggcatgggaagcaatggtgccggagagcacgctgctgtgtcccatgatcataccatgcctccctacatggccatccaaaggatcaaattaaacaaaaataagctcatgtgctgataatagtgcttgattgtatattgtcgcacatgtgaaagttgctcgggagcctcacatggagcgtagggcagttccatgcacgagcggcatcgctatcggggggaactcctcctttccaccccgctgcgaactcgaccgtgattctgacagatggggactcgcccgcagtactccgacgcctacgcggagcctggcggcaatccgcgactgggcacaccggcctttaaatatctccagatcagcctggccctgggatgacagcgatgcgacgcctgtgaccgttccagcgatgcagggtgccgagagcgcccgagcgcaggctccggtcaggaccagggaggagatgctgcaggaatggagggagcagcgtgctgtacgcatctcggggaaagccgatgtaaaattacagcaatcttcggccccggcgccctctggcgatgctgggaaggaaaaccatgggaccaccagaccacctatggcgagtcacaaggtcacccaatcccagccggagccccattccgccccttctcgaggcgtgaattccatcgcggcccggctggagagtttgaagcgggagtccctgcggccctccatagccccaccctccacttcccaggcggggatccagtttgaagctgcgggccccgtagactccaccgcgctgcgtcgcctggcggggcagctcttcgacgacgagagctggaagcagctgtacgataaagggatgaacgcgaagctgacgcgaagtagggatggggccaccgaggagaccaagataaaagaacttgcaggtatgatgttaaggggttgatggggaggatgactgattctgacactgcataggttattgtcatctaaattcctttatcgcaatccatggagaccagaagattatcctccgcatccatgctgctaacagacatggtcaagctcttgcggagggccctgaaggagctccagggaaggactcagaccttcatcgatcaaagctgtcgatttgagcgagacataggacagcaggcaagggcattgatgagggtgccgcgtttgcgagggggaaccgggcgacacccttagtggggagactctgcacaacacagcaccagcatgtgccatccacacagacggcaatcctcccgccgctgctccaacaggtggaagccgcnnnnnnnnnngacaagacagtagcagcatgtgccatccacacagactgcaatccgcccgccgctgctccaacaggtggaagccgccaagctgtcaagtgagtctggggccatggccgcccacgccgaactggccaatgccaggcgagaggcggctgccgccgcagcagctcacaagaacgcgctggccgtctggaaggtgcggagctggcggtgcggtcatccctgtttgctcatcacagtgcatgcagatggtgccgagcagccaggggaccgggtcgggtgcgcatgctgcgctctgtcgtctccggaaccaggattcctggtgacctatctcnnnnnnnnnnagggaccgggtcgggtgcgcatgctacgctctctcgtccccggaaccaggattcctggtgacctatctccatacaaacgcacaccatccccgccgcagggcgagctgcaggggcagcaggcagaggtggcgcgcctgcgtcgcgagtccgaccggctgcaggccgaggtcacccggctgagcggcgaggcgaggcggagcgaggccgcccgcgccgcggcggaagaggcggcccacgacgccaagcgcgcggcgacgctggcagcgcgagaggcttctggcgccaagctcgccctggagcgcgacttggcctccgagcgcgaggcctcggccgcggctcggctcggcgccgaggcagagcaggccgccgccaaggcggaggccgagcgcctggccgcgcgccgcgacgccgcggaggcccgtgccaagctgctggagggggaagtcgccggcatgcgcgtggagctgcgtgaggcggacgtgaggctgcaggccaccaccgccgactgcgagggcgcgcgacgccagctggcagagcaccgcgcggtgcatgaccgcgtggtgnnnnnnnnnnaggcgtgaggctgcaggccaccaccgcctactgcgagggcgcgcgacgtcagctggcggagcaccgcgcggtgcatgaccgcgtggtggccgacgccgccgccgtgctcgccgagctccaggactggcaggtgagcggggtcggttgatgttttggttgttatttgtggggtgaggggccttgcaggacttggacagtccatgggtggagccagggagggatggcgtatgctgagcactgtctcatgcatgttgcaaatttggcgaaagccgcctgagagggtaatgtgacctaggcttaaggaaagagaataggccactcaatcaaacgccgggcttggagtccccaggcacaaccctgcctaaaccttcctcccccacagacaaaggcagcgacgctgcttgaggagctggagcgggagaggcagcgggcgggccaggcagaggcccagaacgccacgacctccgcgcagctggcagaatcccaggcatccgcggccgcgcgagaagcccaattacaggtactgnnnnnnnnnnatatgctgagcactgtctcatgcatgtggcaaatttggcaaaagccgcctgagagggtaatatgacctaggcctaaggaagggggataggccactcaataaaaacgccgggcttggagtcccccgacacaaccctgcctaaaccttcctcccccacnnnnnnnnnncaatgccacgacctccgcgcagctggcggaaacccaggcatccgcagccgcgcgagaagcccaattacaggtactggttggttgcgggtttgagctgtggacggtggaagcctgtccagttgccggcatgatgctcgattgagacaatagggggagaaaggtgccgtgctgcaagcatgacccccgtcaggctgtgatgtttttctacattgtcacactccgtggcgccatactgcaggagggcctcgcggcagcactggagcgagcggcagccgccgaggcgnnnnnnnnnnctctacatcgtcacactcggtagcgccatactgcaggagggcctcgcggcggcactggagcgagcggcagccgccgaggcggcgggccgcgcggcgcgcgaggcggccagcgccgcggaggtgcgctgcgacgagctcgagctggcggtccgggccctgaccagcgacctggaggggagccgggcggagggtgcgcagagcacggcgcgggcggagggcttggcgggggatctggccgaggcgaggcgcggcgccgaggcgctggaggcctcgctgggctcgagccgcgaggagtgtgcggaggcgcggcgggccgccgccgacgcctcggcccggctgcagcggctggggggggagctggaggcactgcaggagtgcacgctaggcctggggtcgggggaccagggcgagatgctcagccgactgctgcaccgggtgggggcgctggagggcgcgctgctggcttccgagaccaggaggcgggccctgcacaacaccctggtggagctgcgcggcaacgtgagtcagcagaagtgcttgccctgtttcatgttgggattgggaggggtggggaggggaaagaaactactttggaggggtggatgccttcnnnnnnnnnnggcagaagtgcttgctgtattttatgttgggattgggaggggtgaggaggggtgagaaactactttggaggggtggatgccttcacagtgggcgagaaggttggcatgcacaggcagagatattgttgccccacagcacgtttgtgcggtgctgggattgcagagtctcacacccgattcctgcggcgacctggccctgccgcctccaccagtaccccgacgccctgccgtgtgtggatgtccatgtcgtcccctcagggatgcctgttgaatctgtacatgtgcttacagccatcacactcaacacccacccccaccaaagcttcaccaaacctccacaccccccacccaatttccatgccccagatccgcgtgttctgccgcatccggccccaccctgcgagcgtggtccgcgtggcccccgacggctgcagtctgtgcctgtccgccgaggggcgggagcacacctttgccttcgaccgcgtcttcccgccgggtgccacccaggctggggtgtacgaaggcgtggcggagctggtgcagagtgcgctggacggctacaaggtctgcctcttctcctacggccagacgggggcggggaagacgcacaccatgcagggcgcggcggccggggagggcgcgggcgtcgtgccgcgcgcggtgcgccagatcctggccgccgcgcgcgccgcggcagaccagggctgggagtacgcgctgcaggccgcgttcgtggaggtgtacaacgagaccctgcgcgacctgctggccgagcgacgcggcgagggccggctgggggacggcggcatcctgcacgcgcccgacggcgggcacacgacggtgacgggggccacacggctgaccatcgccagcgaggaggacgcggcgctgctggtggcgcgcgccgcggcggcgcgcagcgtggaggccaccgccatgaacgccgcctcctcccgctcccactccgtcttcctgctgtacatcacggggcggcacgccgcctccgacaccgcgctgcacggctcgctcgccctggtggacctggccggcagcgagcgcctggcgcgcagcggcgccgagggcgcacgcgccaaggagacctgcagcatcaacaagtcgctgtcggcgctgggggacgtgttccagagcctggccgccaaagccgcccacgtcccctaccgcaactccaagctcacctacctgctccagccgtgcctgggggggagcggtgagcgggcatcatgcgtggggtgggggaggggggtctggggtggcgggagggagggtactgctgatgggggagggggggcgactcgaaggtttcgaggccggggggggtgtgggaggaggggcaggagagctgcccctgtatcnnnnnnnnnnaagggggggcggctcgaaggtttcgaggcccaggggtttgtgagaggaggggcaggagagctgcccctgtatcagcatggttgtccacagcagctggcgacgcatgccttgcctgaggaggggacggcctgccatgcaccacttttccaaagcaannnnnnnnnnccatggttgtcgacagcagttgttgatgcatgccttgcctgaggaggggagggcctgccatgcaccacttttccaaagcaaaacctccatccaatgtgcaagccttctgagcagtcctcctcacagtgccatccccctccacacccacaggcaagacgctgatgttcgtcaacatcaaccccgagcccgagtctgcgggggagacgctctgctccctgcgctttgccgccaaagtgaactcggtggagacggcggcaaaggggggggcggcacgcagcgtctccaccctgtcagaggtgaggaggggagagggaggcacactgccgggctttggtgatggcagcggcaaggcattgggcatagcaacgttcaagtgcacattgcacggttccaatcaacctcttgctctctcccaaaacacagatgacggggaggccttcgctggccatgggtgagggggacgcggcacgggccaccgccctcaagcggcgagcctcgccacgcgtctccaagaccagcgccagccgcgtcgtcaggcctcggtgtccctgagctggcctgggcccctgccccccccttcccttcacgctgaccttctcgagtgtgttattgcattgccaccgcagnnnnnnnnnnagagtgggaggcacactggcgggctttggtgataccagcggcaaggcattgcgcatagcaaccttgaagtgcacattgtacggttccaatcaacctcttgctctctcccnnnnnnnnnnaggcccctgcccctccttcccttcacgctgacctcctcgagtgtgttattgcattgccaccgcaggtgcatacttcccgggcacatgtagagttccgactgactttctaagggtttcgagggagggcaggatggtctcagctgaaggacggtgttctgcacaagtctttgtgccatgaggcctggtgnnnnnnnnnngaagggcttcgaggggagggcaggatggtctcagctaaaggacggtgttcagcacaagtctttgtgccatgaggcctggtgatcagcagggtaggctggagacacttcctgcatgctctccatcggcacctccctgcacggaggctggtgtctccccagaaacgacgctcaacgatccttccgggactcgtcaggggtggcctgcggctgcccaggggtggcatccctgtccctgggatccatggcgggaggagtggagctctccagcgtcacctcctggggagcggccgggccccgctcgcccacaccgtcctcgacctcttcggctgctgagacaccggccccggcatgcggcgtttcctcctcctccaccgcggccagtgcctcgtgctccggctcctcgtcaatggcctccgtcatctccacctcccgcgtgtaggccggcatcgtggccgggccgacgggtgagcgggacgagggcctgatgcccgagtcctgcctgcgcacgacctgggcgtcgctgctcgcgggctccgcgcacgtgaagctgcccggcccgctcccgtccgccgcgtcgccnnnnnnnnnncggcctgcggctgcccagaggcggcatccctgtccctgggatccacggcgggaggagtggagctctccagcgtcacctccaggggagcggccgagccccgctcgccccccccgtcctcgacctcttcggctgccgagacaccggccccggcatgcggcgcgtcctcctcctccaccgcggccagcgcctcgtgctccggctcctcctcgatggcctccgtcatctccacctcccgcgtgtaggccggcagcggggccaggccgacgggtgaacggaccgagggcctgatgcccgagtcctgcctgcgaacgacctgcgcggcgctgctcgcgggctccgcgcgcgcgaagccgcccggcccgctcccgtccgccgcgtcgccggcgcgcgccgcgccgccctcgtcctcggccaggaacttcttggccgaggccagggtctgatgcacgacgcgctgcagggtgggccagaacttggccgccacggcgagcgccccaggcagcagcccgttggccatctccccctccacatccagctcctgcggatgtgtgtggtggggggtggataggtgggacccagaggcagggggtgctggaatcggggcgcgcggcgggcagaggtgcgagccccagcgacaagcatgacaacatagccgcagtcactgaacccagcagcacccacattgtagacggtgcgtgcgaagaggaaggcgnnnnnnnnnngggtggggggtagatgggtgggatccagagtcagggggtgctggaatgggggtacgcggcgggccgaggtgccagcccccgcgacaacaatcgcaacgtgggcgcagtcactgaacccagcagcacccacgttgtagacggtgcgtgcgaagaggaaggcgaggaggagcaagaggagccagagcgggttgcgcagcacggccatggcctcgttgaagcccagcacagccatggcagcgatggcccacagcggcggcccgcgcgcgccggccaggcggttggcctcgcgcgtggcggccgcctgctgcaccgcgatggccgagtcggaggtgaactggcgccagatcgcgcgcacagccggcgggtccagcagcacgtcctcggggtccacgcctggccactctgccgcggtcagcgcgtccagctcgctcgggggggcaccgggggccgtggctgaagaccccggcgcggtcctctgtccttctacagccagggcctccacggcgcgcgtcaccgcctcggccgcctcggcctgcgcagcggcgcgggggctgagcgcgcccgcgcgcggaaggcgtgcgaccgccagcagggccagca

SEQ ID NO: 27975 - DNA, 266 bp, Chlorella protothecoides
ttgctgccatcgctgccagcctgttctgaatatgacgagctcgtgctgaaaatgccgggtgctcctatttttgtcagctgtaaaggttaatttacatgtctgtggatccggcacgaaagggggtaaaaaagacgtccagccaggcaggaaaacccccgagggagatgcacttcgcatcggacgaccctccccctctaatcctgcacgtgaattgagactcacatcaagctcacaactgtgggttcgccgatcacgccatcatgctg

SEQ ID NO: 27976 - DNA, 61 bp, Chlorella protothecoides
ccagctgcccactttccagcccggcccttcaccgcctccagcgcccggccacggcgctcgc

SEQ ID NO: 27977 - DNA, 199 bp, Chlorella protothecoides
tggcttcttatgcaagaccaaaatatgtatacaactggcccttgtgatgctccttccccttttcaagccgcagtcgcatgcatgcgaactcccaggcctgtcagcacagcgctgagtaaacattctcacctcagcgacacgctcactgcagcgtgtgttgatcagggccacgctggtggacatcctcgcgtaatctgct

SEQ ID NO: 27978 - DNA, 23433 bp, Chlorella protothecoides
  modified_base (1553)..(1562): a, c, t, g, unknown or other
  modified_base (2408)..(2417): a, c, t, g, unknown or other
  modified_base (2625)..(2634): a, c, t, g, unknown or other
  modified_base (4148)..(4157): a, c, t, g, unknown or other
  modified_base (4671)..(4680): a, c, t, g, unknown or other
  modified_base (5523)..(5532): a, c, t, g, unknown or other
  modified_base (6570)..(6579): a, c, t, g, unknown or other
  modified_base (7163)..(7172): a, c, t, g, unknown or other
  modified_base (7229)..(7238): a, c, t, g, unknown or other
  modified_base (7340)..(7349): a, c, t, g, unknown or other
  modified_base (7814)..(7823): a, c, t, g, unknown or other
  modified_base (8618)..(8627): a, c, t, g, unknown or other
  modified_base (9925)..(9934): a, c, t, g, unknown or other
  modified_base (10675)..(10684): a, c, t, g, unknown or other
  modified_base (11194)..(11203): a, c, t, g, unknown or other
  modified_base (11535)..(11544): a, c, t, g, unknown or other
  modified_base (12126)..(12135): a, c, t, g, unknown or other
  modified_base (12958)..(12967): a, c, t, g, unknown or other
  modified_base (15020)..(15029): a, c, t, g, unknown or other
  modified_base (16642)..(16651): a, c, t, g, unknown or other
  modified_base (16805)..(16884): a, c, t, g, unknown or other
  modified_base (17047)..(17056): a, c, t, g, unknown or other
  modified_base (17227)..(17236): a, c, t, g, unknown or other
  modified_base (17297)..(17306): a, c, t, g, unknown or other
  modified_base (18611)..(18620): a, c, t, g, unknown or other
  modified_base (21542)..(21551): a, c, t, g, unknown or other
  modified_base (21816)..(21825): a, c, t, g, unknown or other
  modified_base (22574)..(22583): a, c, t, g, unknown or other
ccgcgcggtcggccggcggcgcctccgccaggagcgcgcgcgggcggggcgcgggcggggcacgccgcgcacagcacacgggcgagcgcttcaagtcggccaaggcgggcggggacgtgagcaaggggcgcaccgagccctacgcctactggcccctcgaccggcggctgatgaatcgccgggcgcacaaggccaagggggccaagcagggtctggacgccgtggtcaacgcggggcggcggggcccgaagaggaccaagacggcgcgcgactgaaggaggggggaggaaggcctggaccggcttgcgccacgcaggcagcccatctcccattccaatccggtggccagagcggccggctcagcaaggcgccgggagaccctgtaagatatctgttccgagtgacactgtgtggtgtatacaaacactcaatcctgaggctcagagcacaaggggccttcggcctgcagcagggggtgacatgcctgcacaggcatggccccgtcacggccagaagataccctcgcgcccaaacatctctggctcgcagagcgcggtcgctcacggcgaaccagggccgtgcatgccctgtgtgacattgcgtacctattcttcacgccgacctcgtgatttctgcctgtaatcctatgcattcctgtggtgcctgagacgcgcaggccctgccagcctctccgccacacttccacccgaacccggacgctccgagacgcatcccccgatcagccccagggatgattcaggaaatgatccaagccctaacccccatcgaccatgcgtaggagcgccagtcgactgctgcagctcacaaagttcctcgaggcggaaaccgcagtcatgacacccgccctgggctggggcagggccgcgaggcccgcaggccccccgcacctgggcccccgagcttccttctctagtctcatacatagaccacccgctcagcctgggacgacggggcgactcctccccacccgccagatgccaggcttccagcgcttgccgtgccgcgtggcctgctccacctcctcctctgccgccgctttcccgccgcccaaccgcaacctgacctcctcggcatccagctggtggacgtccctcaagtccagggaggaggaggacagcctggacacgcgggtggcccccgaggccccgccctcgacgggcccgacggaggcacacaagcgcgaaatgcacgctgtgaacgtggcggtggccgtcaacatcaccatcatgatcgccaagcttggcgcctggttcgtcacctccagcgggtacggggggaagcggggctggagcttttgtgggcaaggtctgctcatcatgcccgatgaacaggagagcctcgggcacacatgcttgtgggccctcacaggtgcatgctcaatgagagcttggtgctgtatgagttgattgcaaggagcaggctgaccctgctgccccagcgcctgccgcactatctgtgcagtcgggcaggtcacgaattcctcgcctcccacctcccaccaacctgcagcgcactgctggctgagaccatgnnnnnnnnnngctatctgtgcagttgggcagattacgaattcctcgccttccacctcccaccgacctgcagcgcactgctggctgagaccatgcacagcatggccgacgtcatgaatcagctgctgctccgagcagggctgcacctctcgcgccgagcgcccacgaagcagcacccctacggcttccacaaggagaagtacatctacgccctcatgtcggcggtgggaatcttctgcctgggggctggggcggcggtggttcacggcatccagtccctcttcgatccgccgcagctggaaaacatggtgtggagtctgggaggtgaggaagcttggttggtgtggtggggaggacatgtgggactggattgccttgctggggatgagaagggagagcggtggtgagcgcccaaaaagtcggggaggtattgggcctatggtcacatgtagctgggtagccagcggctatcagaggcagggggacgcatgctgtatcgccatgtatcagtatgccattggatttgctgacatttgtacatgccccccccctccccccatattatgccatgtagtgctggcggcgtcatgcgcagcggaggtgtactccctcaggatcgccctccagaacatccgcatcggggccaaggagcagggccagaccttttggggctttttgaggaggggcagggaccccaccaccgcggccgtattcgcggaggatgcgggggcggtggctggcctggtgatcgcaggtcggtgcccaggccggggttagggaggtggtggtacagtcatgaatcgttgttgctggtcgtcgtggaggttaacaggcaggtgtaaggggatgctgaacagnnnnnnnnnntcggacttagggaggtgctgttacagtcatttaatcgttgttgctggtcgtcgtggaggccaacaggcaggtgtaaggggatgctgaacagtgcatgtggcccagcagctgctatcctccattgagcgacacctctgacctagactcaccctgtggtaccatccttgtttctcgcccttccccgccatgatccgtgcaggtacggccnnnnnnnnnngcctctgacctggactcaccctgtggtgccatccttgtttctcgtcattccccgccatgatccgtgcaggtacggccacatactgctcctgggtcacgggcctggcctactacgacgccattggctccatctccgtgggcctgctcatgggcggcattgccatggccctcatccgcaacaacatgcgcttcctcaggggtaggcagcgacggtgcggttgggtctgacgcgggaggatctcggctcggaacctcaatgagtcctgccatcagttgtcgcgccgtttacccgagcacacaagtcgctgccgacccgccgtccaacgccaccgcacctgtgcaggccaggccatggacccggagacacatgggcgcatcgtgaagcacctggtggaggaccccgtagtcctcaacgtcatcgaccccaagtcggaggagatgggggacggcgtgtaccgcttcaaggccgagatccgtgagtcggctggtgattgaactggttgatgccgatgcaggagatggagaggctgggaagaggggtgtcctgtggatggggaagtgctgccgcctgatgcggggtcacagccccgctcgacgcggagccaggagctgctcgagggatccaccggtgccagaccctgtctgctcggtgctcttccctcgtactgcatccgaccagcttaccgatcccgtcacacttgcgatcctccccgcgctgcagagtggtcgggggacatcatcgtcaggcggtacctgcgggagcacggccgggccaaggtctatgacggcatccgggcccaggcctgcagcctggatgacaaggagggccggacggctctggaggaggacatggaccaggccatgatgtcgttcggtgcgcgggtgcaggcttggatgtgggaggagagagcgaaggccagtggtttggtgccgcgtcgcggcagtggccggcaggtctcctgcgtgctgcagggtggctgctcggcgcctgcggctcggcatgcagggctcggagctgcactgcaggcggtcctccccaccccaagcaacccacccctctcaccttcacaccacctcagggcgcggcgtcattcgcaccgtgggcgaggagattgaccggctggagagcgagctcaaggccatggtcccgggcctggtgtatgtcgacctggagaccgacaagggacgggccgagaaggccatggcacaggcctccatcgccgtgatggccccgctgagcaccgtgctgcgccccacagaccctgaggcgccgtgagcagggggaggaaagcgcggccacaggtgtctgatgagcaggcgaaggaggggcggcgcgacatcgggggggtgggatgcgccggagggcgaccggcgatgacgacggcccggtgaggctgtgcaagggagcaccctcccccctccccaacactttccttttgcacagcaaccaccgattttgcccaaccacttctggcatacggcatgaatcccacttttgcactgcacactggtagnnnnnnnnnntcagcaaccttcgattttgcccaaccccttctggcatacggcacgaatcccacttttgcactgcacactggtagacacagggacgacggcctgggcacgggcagagcatcaggcaggactccccagcactcagcgcagggagctgtagaagaggatggcgatggccgccacggcgatcagcacgggcgcgatggagacgaggtacagcgcgctgtaccccacccagtcgggcaacaggtccagcgggccggcagcttcctgggaggtgccgcggccaacgggcggcctggggctgggcgaggtgcgccacgccgcggccgcctcctccgccgccggggtcaactggggccgcaggtcctcggtcgtcaccttgcctgtcccgtgcatgggagagggggtggcagcgtcagggtgcatggggacgtgggaggatcacatctcctttgcttgagcaaggaacgagggggggcccaaggacggggtacaccccagatgtagccacaccatgcagggnnnnnnnnnntgcctcctccgccgccggggtcatctggggccgcaggtcctccgtcgtcaccttgcctgtcccgtggatgggagagggggtggcaccgtgagggtgcatgggacgtgggaggatcacatctcctttgcttgatcaaggaacgaggggggggcccaggatggggcacaccccagatgtagccacaccatgcagggcaaactcgtcacctcccgcacaccgggggtagcgtcctcgtccagccctggccaggtcgtcatctcccggtgcagctcctgcagcaccctgaagtcgctggggaccttgccctctgaaatttccaccagcgcagcggccaactcctcgcgcgacacgccgctgctatcctagaaaatggggcggtcatgattgcggcagggaggaggttggggggaggtggcgcatggcgtcgctgaatggagcaggccatcggtgggaggctctgggcgacttccattgtgccgcaaggatgtaggaatcggttgcaccaccaaacacaagggtgtcctccccactcaaacacctgcctctcgcacctccatccccatcaagcgacgctccctcgccctcggatcctcaaccgccaccgtcaacctgacttctgtgagggacatatcgcgctctttcttcaatcgcctcagcacatccacaatgtcctggcagaactgcgcagctgtctgcaaagttgtttcagagatgggagcaagttgaaaactacgatagcaccagcccagaggctgccaaaacgaatgacaaagaacatcgccccccaaactccacggccaagagctttgacttcaacccctcctggccagcgtgccttcttgnnnnnnnnnntaatagcaccaggccaggggctgccagaacaaatgacaaagaacatcggcccccaaactccacgtccaagagctttgacctcaacccctcctggccagcgtgccttcttggggaccttctcctgcacaggtggccctgtggatgtcgctgcggaaggggcttgagcaaggccgccctccttggctgcctgctcctgcatgaacttctcaagctgcttctccagctcctcatcggagagctcggacacagggtcctgcgtggatctgtgcgcgcatcgcggacatgacagggcatgggttctcatcagggacatccagtccatggagttttgcatgcacctgcatatgagtcggaccgggcgccgctcctcttaccgacacaatgtgaatttaatggacgtcctcgtttcattaagagtcgtgcgcggccttgtgagttgtgttgactgtcgcaagccctgtcgttgcatgggagcgaccagggggtaagggcacctggccaccccgcccatcgtcactgttgttctcagcagaaccatggcgtcacgttgaggaaccttcaagaaacgaactctgtagtcgatgctgtttaccgacaacatatgcatgcgtctggcgtcatgatgtggattccgttgcatgcggagagtgatcagatcgaagatatcttgcagttctcttgccccggttgcagaggactggtgtcacacctgcaaactcctctgcacgacccagagaacattactctgcaatgttgccatttatacggatgtcatagttttgatcataccgcattgttcgagaagtaactgaatgcagtgagacgagcgactgcttgttgcatgtgcatctgctgcgaaccttgcccatgctatagaggcatcctgaagccaccctgagcatcatggtgatagctttaaaaacatttgtttcccttatcaaaagctaagcgattgtcagaagctctcgatgcgtgtggaatttcagggacccagatgtgcattcaacgaggtcgccaagttggatggacagggaacgnnnnnnnnnntcgcattgttcgagaagttactgaatgcagtgagacgagcgactgcttgctgcatgtgtatctgctgtgaaccttgcccatgctgtagaggcatcctgaagccactctgagcatcatggtgatagcttttaaaagatgtatttcccttatcagaagctaagcgattgtcagaagctcacgatacgtgtggattttcaggggcccggatgtgcattcaatgaggtcgccaagttggatggacagggaacgtaatgcctgaggaagcctgaggatgcgtcgtagtaatgttgatcattttgagggtgatcgctcgtttgggtggaagacgcggtgcgtcgttgttcatgaggaacaaatggacatgcatgccacaatgcagtgtgcattccgtgtgttgcctgaagtgcctgggttggctgcaatggagcctcaaagatgagttggtagtaaatcctgacgaaggacagcaacaggaggagattgactcgctggctgggatctagagctccactgctgacgctttggccatggccagcacttcaggcagcacctcgtctacagatcctgctgggacggggaagacnnnnnnnnnnccaagaggaaattgactcgctggctaggatctagagctccactgctgacgctttggnnnnnnnnnntcgacctgaaatatgttgatgcagagccgccaccgcgcaccagacaaggcacacctgatgtcatggcaggaagaggccggaagggccctcccacgttcctcnnnnnnnnnncctttccagggagtcacccacatcaccgccaccaccatctccgggcatcctgcaagggagggttgataggcatttgcatgatgggatggccccacgtgcatccggcttgagaagcagctgatgctggtcttggagtggttaaactgggtgtgcacatctcccaaatggaggttggggacctgaaatatgttggtgcagagccgccaccgcacaccagacaaggcacacctgatgccatggcagggagaggccggaagggccctcccacgttcctctaacccctgttggatgtgtgggtagatgttgtgagttgtgcgcctcaccgtcatcaggtgcagacctgttcgcttgtacgtgccaaggcaggagtatgctgacccaggcccacctgctctagggcacgaatgctgtccaggatatgcattactcgctgctgatgggccaggtctgatcccaggtccattnnnnnnnnnnatatgctgacccaggcccacctgctctagtgcacgaatgttgtccaggatatgcatcattcgctgttgatgggccaggtctgatcccaggtccattgattctggtgaagtgatcatgccatcacaatggtctccatcaacatccatctgtgggatctcataaaaaggtgtttgagcacccggtgcactgtctaccaatgcagaaaggcatgaggacgtccgcacagcatatgtgcaggctggagctcgccgctcatgataatcatgcagccaggacaagctgcgtcgtcccgcatgccgtcccctcctatgatacattgcaaatcgcctgaactcactcctgtgtgagattcaaggtcgggcattccttcgacatcatcatccgagtagcaggcggtgaagtttgggtcgaagatgcgccgcatcttgttcatgctcatcaggtagaggtcgtgctcctctgctgacaagggcggaggagtggtcatccagggggagcgtgagaaaggtttgtactgagagatctggtgagaaaggacttcagcatgcagaaactacacgaggcccaaacacgaagccacgcacggtcttcatagctgcccaggcgatcatggaagtgaggccactctttgaagaaccaggcacggagttgctgtgtgcagggtgtggtggaggagggtttgggcttgacagggagcaggcaggaagggagccgggagccagcatctgtaaaggaatgtcaggaccctccttccagttcggtctgaccaaaagcaacatatgacaacaggccatnnnnnnnnnngggagggtttgggcttggcagggagcaggaaggaagggagccgggagccagcatctgtaacggaatgtcaggaccctccttccagttcagtcggaccaaaagcaacatatgacaacaggccatgtgctgacgcacaccttgaagcgatcaatcacatccgtgccatcttccacgccgtcgtcttcctcacaagactgcagggcgccacccgtccctgcatgataaggtggtgggcagagttgtggcaatgtgggtcagcttgctctgagtcaagcatgaggctcgcagcgatgcgcagtgttttcttccgatggcaagctccaggcccaccctcccgatctcataagtcagttggccttgattcaccagaaagtgctccgtggagtctaatcagagtgctgttgtacctctccatgaaggcgtaaggcactcctgtgacagaatgtgaagtgacgtcaggtgactgcatgctaggtcaggtgaagcacacctgtgttacatgcaggtgctgtcatcctttgttacctgctggagaagtgttctcggacccctcttggacatctttggcctgcagctcagaagaggcgtggttagatgaaggatatggactggtcaatatagcagtgcttgagcaaaactcgccatttatcggcatgactgctgaagtcagggtgtgccaccatgccagtgtttggtagctgcactcacaacggatgggaattcatcaagggagatgtcgtcgtccaccaatatctgcaatgtgtgagggaacattaaccaggcatgcatgctccacgtttttgtccaaggatgcaagacaaagactctaaaacagtctgcgcatgcaagtacatagcagcaagaagactgaagcatggatgaagcgcttacctgggagttccagaattcgagatccaggatggtggttggggacaagacatctggcgtgaccacatctggttgatcttgcacatccgtagacaagtctgccctcagacctccctacatccatggagaagcttgtagtatacaatgcagtattattggtgtactcactttagggctgcgtctccctggccagaacatacataccttagattcattgaggttgactgcactcctgggcgtcgccttacgttcaggggcggggaggcatgggactacctgtttggcaggaagggcacctgcatgtaatggttgggagggggggtccagaggcgtatatctggtgactggcaatagaatcgtgtccacgcccatgattgtgacaaccactgcacctgccagtgactcattcnnnnnnnnnnaactggaaataagatcgtacccgcgctcacgtttgtaacaaccactgcacctgccagtgactcattcaatctggacactggagatgaggatgccaaccctgagaaagagccgtgcggtggcagctcccagaccgaggatggatacttctgtctatttgaggctaggaactggagtgtatcatctgagacctccaatactgcaaggatggaagagaaagtggattatccgtggcatgcagacagcaaaggagcaccgcagcatggatttgctcaatgaggtccttgccttgttgcttcagtgatctgcagatgtcgacgacatttgaatttgcagcagtatggagcatgagtagtttctgcacatcgacagccttgatctgtgaaagtgcttcccatgtgaagttgcgccgagcattcctacggtgtaggggattgttgatgagagaccagtagcagcgacacttggcttctatcatgaaaggttgtgagtctcacctgccgaatttcaaggtgagcatcagatcggcgtgaagtgcagcttgcaactcctcagggaaacagtgctgttcttgcttggctcctgaaagtcgtagtgttgctcgaaaaacgttccgctgcagcaggagaatgcacctgattattgcaaaggttctgtgatacctcttgccacgccttcacgtgaattaatgcgcatgacgcctacctgacaatcgacattgttgaagctggaagcccctgtgnnnnnnnnnnatggcgttcacgcccggctcctaaaaatcgtagttttgctcgaaaaacgttcccctgcagcaggagaatgcacctgattattgcaaagattctgtgatacctcttgccacaccttcacacgaattaatgcgcatgacgcctaccgtaaactcgacattgttgaagctggaagcccctgtgaccacttgaattgcctgcagctcctcgacaacctgctgatccatcatgttactgagatcaagagccgcttcgacatggcaatggactcttaccgaatactgtccatatgtgtcccacgcaattgaccactggttctttctacctgaatgtctcacctgctcgaaggtcaggcgattgaggtaatcttgcacctcagggcccatgtgctctgggaggttgaccccctcgaccgttttggatctccggtagtatgctctgtgcacacaaaagatggaaatttgaaaaggcacggcaagcaggcaatgttgatcccatatgccatgatcgtgnnnnnnnnnngatttgaaaagacacggcaagtaagcaatgttgatcccatatgccatgatcgtgcagaaaaccgaagattgccaaccattgcacctgtcatatgcatgagcagcagcctcttgtgaggggtgggctccaaggcggactctgactttcttgccgttcagcgaatacctaaggctgacctgccacgtcctgccgccgttctgtgagctgactcctttgtacgtcgatgtgatcaagtctcccatgttcattaatatcaagcgaggcctgatcgggtgtattcttccgcgccgtcttagcactcgaggctttgcagtatcctctagcaatcacannnnnnnnnntgggactctgactttcttgtcgttcagcgagtacgcaagtctgacctgccacgtcctgccgccgttccgtgagcggactcctttgtacgtcgatgtgatcgagtctcccatgttcacaaatctcaagcgaggcctgatcgggtgtatttctccgcgccgtcttagcactagaggctttgcagtatcctctagcaatcacattacatggcaatttctcatcaccgcgcttgctatcagctccagcggagtcctcagcagtgcgacagggcattcaaacacctgcggcaaagaccccactctttccacttcagtgacagtcactatacgagtaacaatggcaatttgtacattcgaccgagctgaataagctctggttgctattcaatggattcaggtggaagttgcgggttcgagtcccgtcgtcggcgtgtctcctcactgctgacgtggcgcaatggatagcgtgccaccctccggcaacacttcttttggtgttttgccggagtccacacaccccttcgcgccccaaccgtggtgtgaaaccgcgcccgtgctctggctcgcccgactcagcaccctacnnnnnnnnnntttcttttggtgttttgccggaattcatacgcccctttgcgccccaaccttggtgtgaaaccgcgcccatgctctggctcgcccgactcagcaccctactccacgtctacatcgggcggcgggggctggtccccgcccgcggcagcgcacctcgccacgcccggccccacgccgaagcgcgcgcgccccgtggcgtacaacccccccgtcccgctctgccgcgcgcgcaccgcagggtcccagacggcctgcgcccgcgtcatggccgccagcaggtccagcaccccgcccgccacggcggcgccccgcggctccagcacacgcagcgcggcggccaccgcctcgcaggtggtggtgcacccccgcgcgggctccatcttcagtcgcgcgctcgggtcgccgatggcctcgggggccaggcacaccgccgtccctggaggcacgaggtgggcctggctggcgccccacatctcccgcgcctgctgccaggtcccgtccagcgccagcagcgtgtaggcccccctctgacccaggcgcagcgagtgcaggggcccctccagctcggtttcattcgacacgcctgcttgccgcgccgccaggcccggcgcgacgtgtgcgccgtccagtcgagcggccccgggggcggggaacaggaccaggaggggagtgaggccatccctggcggcctggatggcctcagtcaggatgccgtgctccgaaggctgcggatgagcagaggtgttggtcgatggggtgaaaagctggtgtggcgtgagtcatgcgccaggtgtggaggcgtatacatgtgtctcgcatgagtcannnnnnnnnnaggtgaaaaggtggtgtggtgtgagttgtgcgccaggtgttgaggcgtatacatgtgtctcgcatgagtcaggacggggcgtctcagatccccctcaaccggtacagacaagctggctggagagtgcattatttctgggagcatgaagccgccaacatcagagccctccctagcttgacagcctgagcaggcaccagcatctcgcatcaccttgtacttccgtccagtcagcacgtggatgtcctgcaggcacaagcgtagcagggacaccgtgcccaacggcttcctgcacccgaggattgggactgagtgagggccgtgcatgttatagccgtatgtagaatttcccagcacagctggggtcggcacaggcctgatggtatcctcacctggcctcatatgggtgctggagcacgatgaccttcccttccgtgcagaacttttccttggggacgctggcacacaggcaaaccctggctgggcggctgaagaggaggaagaacgggagcgctgctgaggtacctgtcctggtctgagcttcacaaccatcagcatctgaacaagattgtctctctgttctctaccctcacagagtcacaaatgcagttcatgcctgacctgcagctctgacacgttgcccgcttggaggtgggtgctgggctcggctgaactgcggggccctctgcgcggatgctcgtgttgctcaaaggcagcaacggcattgtttgggtagtgaggcttagcaagcttgtctatttctgggtagtgctgctcgtggtactcaaatgctccccctcattcacgtttcgagccgtgctgcgcgcacagcagatttcggcgcgcgatcggaaccacaggaacttgatccgatcaaccaccttcatacctttcgatctacaacattctttcgaccacctccctggtctccgcaacaagctgaaccagtaacacgctgggagaaagtcgtggctgaagggggttacttcaagagaacctggtgggtctcggagtgggagcgtgcgctcctcatcgctggggaggcgcccggcagaagtcgagccatctttagaagctagagcttctcttctgatgttgcggctcagggaggcctgccgttatggcctagcttcaggtaacgtgaatcccaggtgtcccatgaggaacagcttaacttcagcctatcacagagacgaagcaccatggcaagggttcgatgtatgcgacgcatggtgttgtcttggcaccgcaatggagctttcaacaatctcgacacctatttgtggcgtgtatccctgtccttcaccatcacatcaggaccgttgcacgcagggactcgaattccattcagcatccacaatgtgctgcttggatcgtggtcagggaggagagaggcgtgtaactcgaggctcgacagtcccaaacccaccacggtgagccagggattgctggattggactgtgattttaggacattggaattagtctggcaagttgacaatgtccctggttggcgggtgtcttatttgaatgttgagcatgaccatgcaggtggtaatcgagtacggcaagggcgatgtcaaccagttcctcgccttggcagacgagattgaggatgccttccctaaattggtggtagaaggccaagaggtatgcggtctggctcaagtgctgtgtgccctttattgcatgtcgctctgcgccaaccagccattatacccctagagtccacacctcaccgactgtgcagaacttggagcttcaaaagactctcagcgtggcactagagggggaagcaagcatctggcaggcgccgctgccaattccagatgcatctgacttgctcaaagtgctgcaggcagagctggaaaagcccctgccgtctgccggcgacacgagcgcttggactgaaagctggtactgaaccccttttctttgggaaccaagctactgctccgtttattgcagagaggccaccgatccgacgaatttacctcactttacgaaagcttcagcatttcaccacgtacctgagaagtttactgtgcctgtgacgnnnnnnnnnnggagaggccaccgatccgacgaattcacctcactttacgaaagcttcagcatttcatcatgtacctgagaagtttactgtgcctgtgacgcacacgggaattgttgcacatcaagacgcctcccactgatctgtttcgactgctgtaaagtcatgtgtgacagcctgcaccccgaacaagtgtacgggtgaaagcttctgtggcctcgagcaaagcatgatgcgcaatcgcgcgcgcgcccgtcgagcctcgagctcgtcggatcatcgggaagtcgaccatcatcgggacatcgcctccattcgagcacgacattcgagcagaactaggggaatcgaacacttgcaagcaacgggggcatggggcatactaaaacgccgggcgacgggatggaactcacaattctcattttgcctaccctgcccatacgaagctgccccacctccgcaccaccagggccctcttcacaccccgcacacacaacacatccaccatgaagatggcacgaggtgctctgttcgtgctcttcgcctcaatgctggtggcgtccgcagtgtctcgtaagttgcagcagtgagggggacacttatgctcgccggccagcgtgcttgcacgtatgctgctgctcctttgtttggtcccacaggacctatagaacttgcaccccctcatgctctgccatccccttgctctcccaggcaagctcctcgccgacggcgagggcccaaagggtgtcgtcgacaccattgcgaagcacactttccacggcgagctgtccgactcgctcgatgccttcatcggcaacctgtctgaggagttccagggcttcatcggtgagcatggggccagtgagcatgggcttcggggccgtgctggggtctgctccgacccgccagcgcggtcgtgctcgccgagcgtggtgtcggcattctattccacgcactcacgatctgccctcccactcccgtcgcagactctctccatgatggccacaaggacttcttcaagttcaagaagggcaagaagcccatcttcaccctggaccccccggaggtcgagggcccggccgccgagttcgacgactagatgcgagatgcgagaccctgagtggcgtggcccccggatcagcctggagctgagtttcaccgggacaagcccccccaacctaccctccgcagcttcgcatcgtgcctttcatttcctcgcatttagtcaccctgtctctgttcccctttgatgattggctccagcaaagcacccttcccagaatgcatggcgtcctagcacacctgctgctacagatatttggggcccgatgtcctggcgattgattcctggctgatcatggctaccctgaacatgtgtaacatggcgctggtactactcttatacagttgggaccgaggaaaagagaggatgggggctcggtatgatcctgtgtgcttgtcgacttcctctgcgacggcatccaggacgtccctgtcatagggccgcaaccgtttggcatgcaccacatgacgttggggctttaccatgttcgtgtccaatgccacctaacgatccgcacattgacctgcttgaaatggctccagagagaatcttgtggagtaccnnnnnnnnnnaacggcacccaggacgttcctgtcacaggggccgcaaccgtttggcatgcaccacatgacgatggggctttaccacgtttgtgttcaatgccacctaatgatccgcacattgacctgcttgagatggctccagagagaatcttgtggagtaccnnnnnnnnnnnnnnnnnnnnnnnnnnnnnnnnnnnnnnnnnnnnnnnnnnnnnnnnnnnnnnnnnnnnnnnnnnnnnnnncccggagtgctttcccatgcgctgtgaccttgcttccattgctacccatctcgtcctcgtcgcccctgccttcttgggttgtcccacgcctctggctccccagaccccgaccccaaggcctctccccatcacctggggacctccatgaggactccaccccgcnnnnnnnnnngctgggtcaaagcagcggaagtgccagaagccagacgctatgacgtccctggcatgcctgcgcccagcactgcccagccttgcagaccctccaacagcgtgcattactccggagtgctttcccaggcgctgtgcccttgattccattgctacccatctcgtcctcgtcgcnnnnnnnnnncaccactcctcactcccccccactgcctctcccgtgccgaccagagcgtcctgcgttacannnnnnnnnntaccactccttgttcccccccactgcctcccccgtgccgaccagagcgtcctgcgttacaggacacacgcggagcacaggccccgccgccatcgccctactcgtcggcggcggtcagctccgccagcttggccttcagcttctccttgcgcgcctcatacgtcagcttggactccttccaggccttcttgtcggcaggcgccttgcgctccttccgcttctgcaccgggtcggcgcggatggctgcgtgcaccgaggtgtacagctcctccagcccctcggcctccagcccggccttgacgtagcgcgagaagtggcgctcgtacttctccggctcctcctccttcagcgactccatgtactccgccacatggccgcccaggatgtacttgcgcaggacctcggagtccagctccttggtctcacgcgagtagccgacgaagcgcttgtcggagtggggcacgtccaggccgccgtccagggcgcccttcagcgcggcaaagaccttggacccggtgctggtgcgcttgaggcccgtgtccagcagcgcgacgaaggggcgggggccctcgtccgcggcatccacgttgtagtcctcgcccacatcccctgtgttgccctcatacgccttatccagcccaaacttggtcagcacgcggcgggccagcaggaggcccgtggcgtaggcggccgcgtaattggtcaggcccgtggtcaggccgtaggcgggcagctcgtgggagtaggcggaggagaccacgacgtcgccggccagcgtggcgtacgcgatctggcagatgacatcagagttggtgaagcgcacgacaaacctgggcgcgagtgggggagggggggcagagggtgatttgggcatgtgtggaggggaggggggcgctcgggcagcatgggggaagcctgacgcatcccttgattccaggtggcaagatcggccagccgtcatcccccgccccaccgacctgtacttgggggtgttgtacttgttcttgtcctgggtggtcagcctcaggcgggcgcggtagtcagtctttccctcacgcctccggcggtacttgacctgcgggagggggcagcagggtggcatgctgggccaagggtggactccccacgggaagacccagcgagagacatcgctgcccaggcagcagcctgcggccgtgcggcatcgcggtcgcaacgaccacgccattcattgtagcctagccatgcctttgaacgcccgccgcacgggcgcatgtgttcttaggaatgaatgctccgcgctaggcgccgggatacctccggcccnnnnnnnnnnggcaacgaccacgccattcatagtagtctagccatgcccttgaacgcccgccgcacgggtgcatgtgttcttaggaatgaatgccccgcgctaggcgccgggatacctccggccccacccccagagcacgaggccggtctgcgcacctggtaccgggagtagtaggcggagttcttcaccacctgtgtcgagaagggggaggggatggggagttagcgaacgttctgctgctgtcgagccaggcaggcctgtgccgctagtccgatggcgggcacaccttgacggccggcatcttgcaaagagccctcaggccaggttcctacagtctgcctcgcgtgtgcgggccaaagagggttggtgcgccgggccacgggcgtaaacaccacgcccgggtggcatcggggcggcttgggcagacctcagtcgacccgggaacctacctttacagcgacaacacagcatgcgacgctcaagggcgcgagaaggtgtgatgttcaggggtccttgggacagtgcagtccgcaagacaaactgggaacttgtatccagtatgtgaagggtctacctgagtggaagaccaagctatccctgcttggtccttggtactcgtggtggagagcctcggcctgtcacttctgtgctgagctgacagtatagtgcgatgtgtgcagtcgtttgtcttattcaagaggcggtaagaacgaccatcagaccttcggcgccagcactgataggacggttacgtcggccgtgagcagcaactctgaacccagaccagctctgaagctggtgagcgatttgccacatacatcagcacaatcgaatccagaaatagtgttggcaggaattgcttgacaagagtcttcgtacatgccggaggctgactatctttctgacctccaagtgccaatgcgccaaccagaggacactgggtgcacctctagatgttcaggggatgaaggggcttggcatgacaggaggagtgatgaaattacgagggactggaagtgctacactcgagcaagctggctcgacaccgcaagcagtcacgcagttgtgcaatgtcttaacaggagcacacactgacactgtccagtgatcaatcaggcaaagtgccttcacaaaacaatgcagcataaaatatcatcgtttgtagcgtctcatcgccgccatgtgtcagctctggaaacacagtcaccatcctgtagccctctgagcgtgcactccagaggctcgtcagcagcctcagatgaggtggaagaggcacttttcgggctgtgcacgacccagcatagcaggcctttcatcagctgatcaaaagctcctctcctggtacctgtgaagcttgtccatcagaatcatttcggatggggtgctgctgcacaggccaatgcccctgcgccccatgcacgtgataaatttcccgggtcgcacgcatcggggtccccctccatgatggataggcttcagcaacgcccatcaggtcaccattcctcggtccatctccccccaccctccatccaaccatcgtcgacggcatgcaggcgctgtgttctcaccccgcgtccctcacggcgcgtgcggtaccccatgggcgggccagcccagcacaggtacgaggcctcggtgacggggcccccacggccccgatcaggggcgtgggtgcctccggcctcaaccgaatcccagcattactctcatgtacaggacagcgacggggccatgcccgcagcatgctctgcctggcgagccccccttcgtggcacccccctcacccacccacccaaccccacctgccccatgcagcgggtgtctagcgccggtccggcctacaccggcctgtcccggcacaccctgggctgccccagcacccccaccctccagtcccgcgccgcggtccagacccgcggctcctcctccggctccaccacgcgcatgaccaccaccgcccagcgcaagatcaaggtggccatcaacgggttcggccgcatcggccgccagttcctgcgctgcgtggaggggcgcgaggactcgctgctggagatcgtggccgtgaacgactccggcggcgtgaagcaggccagccacctgctcaagtacgactccaccatgggcaccttcaacgccgacatcaagatctcgggcgagggcaccttctccgtcaacggccgcgacatccgcgtcgtctcctcccgcgaccccctggccctgccctggggcgagctgggcgtggacctggtgatcgaggggactggagtgtttgtggaccgcaagggcgccagcaagcacctgcaggcgggggccaagaaggtcatcatcaccgcgccggccaaaggctccgacgtgcccacctacgtcatgggcgtgaatgcggaccagtactccaactccgacgacatcatctccaacgcctcctgcaccaccaactgcctggcgccctttgtcaaggtgctcaacgaccgcttcggcatcgtgaagggcaccatgaccaccacccactcctacactggcgaccagcggctgctggacgcctcccaccgcgacctgcgccgcgcacgcgcagcagcgctgaacatcgtgcccaccaccaccggcgcggccaaggccgtggccctggtgctgccgcagctcaagggcaagctgaacggcgtggccctgcgtgtgcccacgcccacggtgtctgtcgtggacctcgtcatccaggtgtgcctttgtttattttttttttgggggggggcctgggaaagctggggggcgattgggcgggtcctgggggggaataacaagtttgggggaaggggaaagtgcttgtgtggatttgatgacttggagctctcgcacggtgtgctggtctgtgggcagtggtctgatggtctttacctctgccagaagctggtggggttgttaccctaagagtatggnnnnnnnnnnttgggcgtgccctgggggggaattagaagtttggggaatggggaaagtgcttgtgtggatctaatgacttggagctctcgcacagtgtgctggtctgtgcgcagtggagtgatggtgattacctctgccagaggctggtggggttgttaccctaagagtatggatcccgccgtcctggcctacacacccatgcctcctcccccaccccaatccccaaaaagcaacctttccaattcgccaccacagacggagaagaagacgttcnnnnnnnnnngcacacccatccctcctcccccaccccaaaccccaaaatgcaacctttccaaatcgccaccacagacggagaagaagacgttcaccgaggaggtcaactccgccttccgggaggcctccgagggctacctgaagggcatcctggcggtgtccgacgagcccctggtgtcctgcgactaccgcatgaccgacgtcagcagcaccatcgacgccgcgctgaccatggtcatgggcgacgacatggtcaaggtcatcgcctggtacgacaacgagtggggctacagccagcgcgtggtggacctggcggaactggtcgcccagaagtgggagtgagctggaggggcgggggagatgcttctgtcgggcacctggactcgctccatgtcccacggggcccctgccccggcctggtgcgcccatccattctttttgtccgcgagaagatcagacattcgttgccgtacccctgctggatgtcgcatggcatctcaccctgctgtatgtaaggtcaaagcacagcgcgcaaagggatggctactgtgtcgatggtgtttgagcagggttgtgcaggatgggggtggggacataggttgagcagggaccggcgtgctgcggagcgtgactccatgacctacatccaagcttatcaaacagcacccagttgtgaggccagctcacaccccctgctacgacacacccttctgaacaccaaggggggagagcgcctcctcgactccaggggcacatctnnnnnnnnnncgtgaggccagctcacacccctaccacacacccttttgaacaccaaggggggggagcgcctcctcgactccaggggcacatcttacacaattgaatcatcactgtcctatcactggggagccagccggccgggctgcgtcagccctcatctcgtatgcatcacgatgggcatcaacacagagagcagcaacgacggcttgcagggcacgccttcacacatcagcgttcgcagggcatgcccccttccccccgtccaagttcatggtctcagtccttgtagcgcatgtctgccttctcaaagccgatggtggggaactgggtggcaaacgcctccacctcctccttcagctcctggatctggggtggcacctgctcagtgtagggggccgggggggggggaggggtcatgcatgctctgggctggggacaggttctgaggaacacacagccatgccgtcaccattcccctctcccatcccaggcctcacatcggtggccagggcatcacggaagtccttcagcttggggccgtgcttgcccttgagctccttggcaatgtcgactcccctggttgggtgcaagagtgggagaaggggtgggtgggagggcacgacatgaacgtgcagcagcgagctggctcatgtcgagatgcgtcaggagtgcctcgctcctggaactccatcaggtgtgagtgtgtaacacagacagctgcatgccaggtcactcatgcgcactccagccctgattgctgcacgcaacatccgctgcctcatgtggacatctctgccttcatacttctcatccctttctccccctccaacctcccccctcttctcctccgcgccccccc

SEQ ID NO: 27979 - DNA, 134 bp, Chlorella protothecoides
ggctgatcatcggtgaggacgatgggattttgggaggcgggattggtagcccaggagaggagggaatggggtggcgccccatgcctgggcgggggggtggccatctgttggaccggcatcctcggttgggcgac

SEQ ID NO: 27980 - DNA, 122 bp, Chlorella protothecoides
ccaaagccttgtgaggagcacgaggggcggaaaagtagctgctgaccgaccgctgcagcgatatcccctggagaaggaatgcccttgcagcgccgcgccgtgccgcaacccagcgcgcgacg

SEQ ID NO: 27981 - DNA, 79 bp, Chlorella protothecoides
tctgccggcagcagcctccccctgtcccgcgctgccccccccgcccgcctgggagctggagggccctgcgtagtccttg

SEQ ID NO: 27982 - DNA, 135 bp, Chlorella protothecoides
tggaacaaagagacatcctcggtccgccttaaccagaggccaggggcatgtggatgtttcgggacaaacagcctcatgaacgccggcgcccctgcagacccacgtacccatcgaagatgttgagggatgagtctg

SEQ ID NO: 27983 - DNA, 61 bp, Chlorella protothecoides
ggacgtgctgctggcgggggtgagcgaggtggaggccgggtacgacacggccctggtcctg

SEQ ID NO: 27984 - DNA, 76 bp, Chlorella protothecoides
ttccaggtcaccacctgccgacagcttcattcttgttatcccacacaccacgtgtcgaccttgagcatttctcaca

SEQ ID NO: 27985 - DNA, 61 bp, Chlorella protothecoides
gcttgtagtgtttttaaggcagcctgagggggcgtattgagattggagggggataggtgat

SEQ ID NO: 27986 - DNA, 68 bp, Chlorella protothecoides
gtggggtaagggaacagcagttgctgtgttggtgaactgggccatggtgcggttggtgatatccatgg

SEQ ID NO: 27987 - DNA, 187 bp, Chlorella protothecoides
aaaaaggggatgctctggtcctccagcgacagcttgtagatcttgtgcacgtcatacatgatcctctgtgcgatggccggggaagggagggagggcgggacgatggtggcatgaacgagggttgcataggagtgaactagcacatgcgtgggaccatggcggcaccgcagaggcccaggtctcagac

SEQ ID NO: 27988 - DNA, 61 bp, Chlorella protothecoides
cattggagattccatctcaaatatggcagggtctcccatggatggcttttggagaacagca

SEQ ID NO: 27989 - DNA, 1404 bp, Chlorella protothecoides
  modified_base (165)..(389): a, c, t, g, unknown or other
atgtggagggacaggcggcctgcgtgggcacacgcgggagcaatgggtgagggggaggtggtcgatttgggatcaccgactgcggcaatccgaaccacctaaggccgttcctaggctcaagaatgccatttactcacctcagtaagggtagctagactgtgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccgccataatctcagcggggggctgtcatccagcttacaaaagcacagcatacagtctctctgacagtagggacttgaatatcataggacatagaatcgaatggggctggacacatatctgaagtgccctggacgatactgcatccgcacttctgctgcttcactgtgtccggagattgaattctgccatgccgggtccagattgcagacccgcaatacttagggaaataaacatgcgcgcagagatggttttgtaactgtcaaggcaagaagttttactatcagagtatattcgtcagcactttcttggccgtcatctccagtaatcaaagcggtgaggaagcacaatcacaagaagaaacacagtacaaacacatggcgtatgtggagtgtagtgaccgcttcagatacttttgttgactaggtttgcacattagatctctcgaactcgggcagggagtcagctggaggacctcacgatccagatactggatgatattactcattctccccggcagatcgtgccacggtcaaccactcccaactaatccgccattgtaccatgagagttgacacaggcaaaccttctcacctcggtcctggtcttggcgctggtctcggtttgcctagttcccattaccatcctctgacaatggcacagctcctgcctgccgcctttgagaacttccttcacatcctgaaggttggagtagacataggccagtcagaccacagtgtccttgcgtcggataactaaccttcaagctccaatcaacgtaccatagaggatattcgaccgggtaagggctcgccctcactgctgaccatgcgtggagcgcatgctggcaaaggaaggtctgatggaacaattgcggcactttcaaagacacagtgtagcataatagaggaattgcggggacccactagagcagccaatgtttcagaatgtatgaaatgtttgagatcttccagtatccccacacaggcagtgtccccaaagagatcttgagaa

SEQ ID NO: 27990 - DNA, 655 bp, Chlorella protothecoides
  modified_base (86)..(95): a, c, t, g, unknown or other
  modified_base (513)..(522): a, c, t, g, unknown or other
agtggtgagagggcattgtgacaaaatctcgaacttgaggcaacgataaactcggtggagtagatgcagcaccgtgtgcttagggnnnnnnnnnntcactgggaaaaatgcttgaaactgcaattgattactgaaatgtgagggcaccgtcggcaagccacgttagctatcctgacacgaacatcagtggtgagagggcattgtgacaaaatctctaccttgaggcaacgataaacttgatggagtagatgcagcaccgtgtgcttagggcacctcgccgacaaattcctgatcacctagagaggagtgacagtttcattgatgcatctcactctgaatacaggtccttctccatccattcccaagaggcatgcaccagggcggttgcatcctcaagcagaggtgacgattcctctcagtgggtgacagtggtaaccagtatatttgctcccctgacgtctgctatatgtagttctggttgcagtacagaccaattttcgcaatgaggtggtnnnnnnnnnncacagtatatttgctcccctgacgtctgctatctgtaattctggttggagtacagaccaattttcgcaatgaggtggtgttaataaacaccaataggaaggtaggtggcttgcttaggcgccgaagccgtaca

SEQ ID NO: 27991 - DNA, 6761 bp, Chlorella protothecoides
  modified_base (136)..(282): a, c, t, g, unknown or other
  modified_base (1162)..(1171): a, c, t, g, unknown or other
  modified_base (2061)..(2070): a, c, t, g, unknown or other
  modified_base (3902)..(3947): a, c, t, g, unknown or other
  modified_base (4795)..(4804): a, c, t, g, unknown or other
  modified_base (5117)..(5126): a, c, t, g, unknown or other
  modified_base (5550)..(5559): a, c, t, g, unknown or other
  modified_base (5976)..(5985): a, c, t, g, unknown or other
  modified_base (6527)..(6536): a, c, t, g, unknown or other
cggggccggcggcccaggcctctggtggcggcggcggcctgggcccctccacctcctctgagggcgggctggcgctggagccgggcagcaagcaggcggtgcggcgcgagcggcgcatgctgtccaaccgcgagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcggggcagggaggaggcgctggcgcgctgcgcgcgcctggccgaggacctgcgccggcgcgacgccgagctggcggcgctgcgcgccgacctcctgtgccgcggtgggccggatgacggcgcggcgccggctgccgaggccggggcaggagcctgagcgcgcgaggcgcaaccgctggcgaccatgagtccccagatgaccgccaaagttttgtctgtccctgacgagccgtcagagatcagcgctgtactttcctcaaacaggggaatgggcaacccactttttcctgccttttggtgctcgtagtcttgcgcactgtccccctagttcccttcctccccggccaccacacgagctgaacgtcagaaacccagtgcgctccctggcactcccttgatgcgcagcaggcgtgcacccatgccccatcgccgccccgtcatgaacagttttggtgagcttgtgcgccccttttctctccaacccccatgtagttcccccagaccccagtacgtttgatgcaggggttgcttccagggactgacagggagcttacatgcacctcgggcgcgccggccagcggggtcactcctgggcgggttcgggggtgtggaaggctgcgaggtaggggtgagccatggcctccttggcggtgagccgctcagcgtggtcgtatcgcagcagcttgtcgatgaagtccagggtgtctggtgtcaccaggtgctggttctccggcgtcacaaaccgggtccagggcttgcgggagtgcctgggattttgggtaaaggaaagtgggcagagcgtgggtggtggattgattggctggactgccgcctccacccatcaccatgagcctcagtgcggctcccacctctcgcagnnnnnnnnnngctgtcgccaccacccatcacctcgagcctcagtgcggctcccacctctcgcagcctcctcaaatcccttttgcccctgtctcctccctccctccctgccatgcccccaccccccccttcccccccccacacacacactcgcttcttaaataccccactccgcccacctgccaaccatggcctccagctgcggatccagctccaggccatacttggcaaggtagcgatagaagtcgtcggtgcccagcaccttgcagatcttgaccagctggtcgtagttgtcctggccgtagaagaagggttccttgcggaagaccatgccagccagcatgcagcccaggctccacaggtccagcgcatagtcgtagtcctgcaggtccaccagcagctcagggcccttgaagtagcgggacgccacccgcacgttgtactccttgcccgggtggtagaactcagccaggccccagtcgatgaggcgcagcgcgcggcgctcgtggtcgatcatgatgttgtgcggcttcacgtcgcgatgcatgatgccgcgggagtgggagaagtccagcgcgcgcaggacctcgtggatgtagtaccggatgtctgcgtcgcccagcgtggggtaaagcaccttgaagtcggtgttgttcacgtgctcaaagatgagggagggcgtcttggatgccgcatcgcgcaccacgtccagcagaccgatgatgttggtgccgccccgcaggttctgcaggatcttgatctcgcgcttgatctgcaggagggttaaaggttgggtgggtgggcagggggggcgtgggggggaactataaaagggggaggggcggatgaagatgggggtttcaaaacgccgcagagatgactgatgacgaggggggcgaggnnnnnnnnnngggaggattaacaattgggtgggtgggcagggggtggcgtgggggggaactataaaaggtggaggggcgggtgaagatgggggtttcaacacgccacagagatgactgatgacgaggggggcgaggaaggcaggggacggcgggccagactccacacttcactggcagccagagcactgggctgccactgcccagacagcatgcccaggcatgagtccatccaaaagcgcgccgcaccttctttttcttcacgggcttgaggatcttgatgatgcacgtctggttggtcttcacgttgatcccctcaaaaacctccgagtacttgccgcggcccaccttccggaccacctcgtagtcatcctggttcctgcgggaggaggggaagggtagcttcaggccttgcgcatgctggctgttccttttcatgtgcaaatgggcacattgctactcttgaggtccttctctgcatgagccaatcctctcagcctccatgccacccgctcacccccactccacggtgagattctcgtagtcccagtagtccttgggatttttaaggttcgcatctgaggtagagagacggtacagatgggtggctgacaaccagccggctgctgcacagccttcatgcctggagccatgcagtgcctgcctccctggcccctcggacatcgtgggcccttcccacaccgtcatgctgtcgaaatctcaccggcgtagactcgcgcgatgctgctcatggcagatgtctcgcccacgcgcagcgctttcagccggcaaggccgtccagctctacactcaggccgtgtctggcgctgtcgcctcgatgaggcgtgggggcgatccttgacccttccaatgcggtttaaataggcttggagctcgctgtccctttgttcgagaacagtggcgcctgttgcacgctgctgtgggaggaggtatgcacgctgcgcggcgggctgggcacgcacagacagcgccagggtacttcaccccaatctgaatccaggggaatgaagctggctgtgcgcatgcagggtgtgtgttgagcctccccgcccccccgtgatggcccgatgtccgggacgggactgctgaggaggtaggccgggccattccttccaaccttcctttccacaggtcaccgccaccaaatccaccatatccacccaagcaatcccacagccaacaccccttttgaaggttgttattgactgataaactgtcctagagctgagcctgggaacaatccgtctgtgcttggcggtcacccgggaagctgtaggctccctgtcttcctcaccgtaactcactgggtggtgaggctccggcctggtgaacaaacactgtgtggaaccgcttattgaacgtatcgaaatctctggggccaccgcgatgaaaggcacgggcaggggaacgggttgatggtggcgtcaagggcctctcccgaaaggaagcctggcaattccttccacccctcccggtggggaatcaactcctgaaagcttagacgtgtacggttgagtgtgcaaccccctccgtgcgcggaagttgtcgcacgctgccgccttttggcggaggacccgcccagcccctatctgtcggcaggccatgcaggctctcgccgtcgtggctgcctccgcgcaagggacaggtacatgcgtgacacaacccgggtgtgtgcatggtggtgtcgtcccggctgagccacatgcgcccgtgacccgtcggccccgccccccccttctcccagttggtgccgtcgaggaggcccccgccccccggccaaagcgccccgcctccccgaccagctccggcgacgactccggccnnnnnnnnnnnnnnnnnnnnnnnnnnnnnnnnnnnnnnnnnnnnnntccggccgcccctcccgcaagcgcgtggacctcttcccccgcatcccccgcgcggcccggtgcggggagtgcgagaactgcctgaacccccagcgcaagaaggcctgcagcgcggcaagggcccgcctggcggcggcgacgcaggagggcgggggcggcggtgtgaccaccgcccccgccccctctgccgccccggccccaccgcccccagaccagttcatcacctccctgcagaccatcctggccggcagcggcggcgtggtggcggagcgccacgccaccgccctcaccgccctcctctcccgcgccgcctcgctggcgcaccgctccgccctcctcaccgtgctccagctctcctccgacgaagtcctggcggcagtagtgcgcggcggcggcgtcgggcccctcgagcgctggctggcggaggccgtggccggtgtcaagccgcgcgttgtggccaagctcctggcggcgctggcgcgcatgcctgtctccctgaccgtgctgcgggccggcgagctgggcaagagcgtgggcaggctgcgcaagcacccgggcttcgatgccggcgtgcaggctcaggccaaggcgctggtggcctcctggaagatgatggtggatgcggcggggggcgccgccgccgagacagccgcacgacccatggacaggtgcgagtcgcagcggggattctggattgtgtctgcttggtgggttggggcgcgggggggcatccaacgtattggcagctggaaacgttggatggagagggaactgggatgcaatcccatgaagcccctcaatgggatcagaggggcacggcgcaatccggagcgccatgagtgccgcannnnnnnnnntgttagatagagagggaactgggatgcaatcctatgaagcccctcgatgggatcagaggggcatggcgcaatccggagcgccatgagtgccgcactcgaccgagggcctgggtgtcgtttgatgtctgccatgatgtccttgccaagggagaggagcagatggaggggcggggagacctgcaccgccttacatgaaacctgtcaatgccaggggccggcatggtgtctgcgctgcagccaggccccgatgtttgggctgctccccgagcagaggacccaacacgcccatggttgtgcctgcctcgctcatgtnnnnnnnnnngcatgaaacctgtcaatgccaggggctggcatggtgtctgcgctgcagccaggccccgacgtttgggctgccccccgagcagaggacccaagtcgcccatggttgtgcctgcctcgctcatgtgctctcttggcactgctgtttgccatgctgggcggctccagacttcagcccatttaaagccactggaccaggaatgccagagggtgcagaccccataatcctgaaaggcatcgaccccagatatggtagaccacccccacccgctccccatcccgccccccctgcagccagccggccgttcacgcccctgcgccccgacctgcgccgccggcggcgcagtccaggccgctgcccagcctggcaccggcggccgctcccgtgccgaaggcggagccctccagggagggcagcccacgtgcannnnnnnnnngaggtgcagaccccataatcctgaaaggcatctaccccagatatggcagaccaccccaccccgctccccatcccgtcccccctgcagtcagccggccgtccgcgcccctgcgccccgccctgcgccgccggcggcgcaggccaggccggtgcccagcctggcaccggcggccgcccccatgccgaaggccgagccctccagggagggcagcccacgtgcaccagaggccacagacctgtttgccgaggagatggcgcagcgcgcagcgcccgtcaagaaggtggggagcgctggctgggccatgcaaggggtgcagggcaggggccagccacgtatgtccgatcctcaatctggcttgtccgcataccgaattccccgttctcaaaccatgcaggcgccaccgcgggtgacgaccannnnnnnnnngtgcaaggggtgcagggcccgggccagccacgcatgtccgatcctcagtctggcttgtccgcataccgaattccccattctcaagccatgcaggcgccaccgcgggtgacgaccaccgtgcacgccgccacaccggacgataggggtccttcctccccgccctcggccaccgcggcggcggctgcaggggccagcgcctcggtgacctcgacctcccgcgtcgggtccagcccctttgatgctctggactccctgggcagcgtcagcagtcacacctcgtccttcctgggtgaggcgctgggtggttggcgctcaggactggagggaagggtgctcctggtctactaagaaggcatgttccgttcactcgctggaggagagagggcatcgaagctctgtgagaacctggccaccaagcttgatgcatgaaacagcacagtccccacccctttgccgataccccgcttgcgctccacacctacagacagcggggtgggcgaccttccgcgcggggcgtacacgccctacaccgccgcgcagcnnnnnnnnnntgagggaggggtgctcttggtctactaaggaggcatgtttcgtccactctctggaggagagagggcatcgaagcactgtgagaacctggccaccaaacttgatgcatgaaacagcacagtcccccccccctttgccgacaccctgcttgcactccaaacctacagacagcggggaggtgggcgaccttccgcgcagggcgtacacgccctacaccgccgcgcagc

SEQ ID NO: 27992 - DNA, 61 bp, Chlorella protothecoides
tgaaggcggtccagggcgccacaaccgcacaccctggcagccgctccagggccgccactgc

SEQ ID NO: 27993 - DNA, 128 bp, Chlorella protothecoides
gagtggtatgacgaggcagcatgacccaaagctcgtcatacccagcgcagacctatttcaacctgagacatccactgacagctggcctcctgtcctattttgtgctgtacatggcatctacctgtatg

SEQ ID NO: 27994 - DNA, 101 bp, Chlorella protothecoides
gcatacctcgggctttgtggggacggcgggcccggccgaggcctgcgcggggcggggagcggggcgatgagcgctggcagggcacgctgcacaccatggca

SEQ ID NO: 27995 - DNA, 117 bp, Chlorella protothecoides
tcttgcctgtgagccagcactgatccgaggtttgagcctgcatgcggtcctagactcgatctgcatgcccatgtgtgtgctgcctcagctcacatgccaactgtgcctctcctgcag

SEQ ID NO: 27996 - DNA, 98 bp, Chlorella protothecoides
gggttccctcgtgtgtcaatgaaccaaggcttgcaacctcacagggcttgtggctgggcatcaaggatccatcgttgcctcaccatgatcagactcct

SEQ ID NO: 27997 - DNA, 302 bp, Chlorella protothecoides
ggcgcgccatggctacaaggggccgatgctccctcttctttatgggttcaagaaggctcaagaaacttttgcgtaccgctgcttgaaaagtggacagcgtcccgagttgactcgttaactgccaaagccgcgctggcgtgtttcccttactgcgcggactaagtgcggatggaccggagaggggtagcattgtccgcgagcttctcgccgcggcgaggtcccctcaaaaacgtcctgagaagtgggtggtgcgctgatatggaggtcttgtcagtatcgcacgcgttccatatgcagtaaag

SEQ ID NO: 27998 - DNA, 97 bp, Chlorella protothecoides
aggtcggcgaggtggcagacaaggcctctggtctggccgacaagattcccggcgtgtctgagagcaacctgcagaacgtcggtgagtggccatggga

SEQ ID NO: 27999 - DNA, 61 bp, Chlorella protothecoides
tcggtacgtaggactgggttgaatatggaccgaaatgcaaccttccacacccgggcgacgt

SEQ ID NO: 28000 - DNA, 61 bp, Chlorella protothecoides
gcgaggaaattgggcttgggaggcaggtggggtcatgcatgcacgcgcataacagtcatgc

SEQ ID NO: 28001 - DNA, 74 bp, Chlorella protothecoides
ttgtgctcgtcttctgtcgccagcattccactccgcttgcaggttgattgattgcaagccaacccgatgattgc

SEQ ID NO: 28002 - DNA, 112 bp, Chlorella protothecoides
tgtgtgtttgacttgctcattgccgtgtgcaagcgccaggcatggactgaaggggatgccacttgattttcctgccccatgcgcagaggggaagggggagccttccatctgg

SEQ ID NO: 28003 - DNA, 124 bp, Chlorella protothecoides
tcgtaattatacgtgagtgggggcaggcgcgccctgggaagcccgatcccgggtatgctcgccagggagcgtgcgacgctgaaccccggcctactccctcccctttccctgcaggcaacctcac

SEQ ID NO: 28004 - DNA, 74 bp, Chlorella protothecoides
actatcgccaggacctggaggtgggggtgtcaaagggggttggtgccggtggggagcatgccaggccagtggct

SEQ ID NO: 28005 - DNA, 61 bp, Chlorella protothecoides
atgtagaataatcctcagcctgcatttccctcaagtgagctacccatccattcttcctagc

SEQ ID NO: 28006 - DNA, 61 bp, Chlorella protothecoides
gacatccgtccacgtgaagttgttcagcacattggatgcgtcccagcctggtggagtggga

SEQ ID NO: 28007 - DNA, 123 bp, Chlorella protothecoides
tgggtgcgatgcatgtcctgttccttgacacgccaccttaaacctgcagacgcttgagaagatgtgctggtatgcagtgctggcccctgcagactccgaccagatcactctagctgctaacac

SEQ ID NO: 28008 - DNA, 61 bp, Chlorella protothecoides
tggcactgtgccaggccgatcttgtccctgacccgccgctccctcatttggagcgtcgtgc

SEQ ID NO: 28009 - DNA, 76 bp, Chlorella protothecoides
ctgatgtcgagggatctttccacatcgtcaaagttggaggacaccctcatcttggttgtgcgccagtgttgactgg

SEQ ID NO: 28010 - DNA, 134 bp, Chlorella protothecoides
acatcggacctccaccagacgccgcagcggcgccagaacccgcacagcacctatgtcgtggcggtggtggcaactctggccccggtccgtcaacccccatgccccacatctacgtcttgttcacatctgggagc

SEQ ID NO: 28011 - DNA, 112 bp, Chlorella protothecoides
tgcccaccagcacattcagcatgagctacaaggggaaatgaggaagggttgtgggagtgtctgtaaatttgagactgccaaactctcaaccgcgctgccccagctcattgcc

SEQ ID NO: 28012 - DNA, 61 bp, Chlorella protothecoides
atcgggtgcgttgcagggtgggcgcggcgacgcccgccggccgatcaggacgcgcgtatgg

SEQ ID NO: 28013 - DNA, 80 bp, Chlorella protothecoides
acaacctcggggcgccatgggtccgggactccggcggttgattagatctgtacagccgagcatccacggcatttcagaag

SEQ ID NO: 28014 - DNA, 124 bp, Chlorella protothecoides
ttcatcacctggaagccatctgaggaagtagggaggaagttgtattgtcttgatgcattgaggtgatgggccatggcctgaaaccaaggtgaacaggccctgtcgccttcctagagagttgctt

SEQ ID NO: 28015 - DNA, 61 bp, Chlorella protothecoides
ctcaggcctaacagctggcgtgcttgccccacatcccatgatctcggtcagagacaagcag

SEQ ID NO: 28016 - DNA, 80 bp, Chlorella protothecoides
gttcatcctcaacctcacaggtcgcgaggtgcgccctccttcgtgcctggggacgcagggctggcccctcgtcgttcagc

SEQ ID NO: 28017 - DNA, 122 bp, Chlorella protothecoides
cgcaatgttgtaaatgttcttgtccaccgttcccttggtgatgaatcggtagaccgtcacgggtttcttttggccgagcctgcacggtgggtgagcatttgctgtgtgaggccaggacctca

SEQ ID NO: 28018 - DNA, 80 bp, Chlorella protothecoides
gcgcggccgccaccagccgccccgccgccgtcatgacctcgtgcgtgcgagggccgtccacagggaacaccgtggcgtcc

SEQ ID NO: 28019 - DNA, 127 bp, Chlorella protothecoides
tgagcgccctgacctctgacaagtactgatgtgggtcgattcagcgctgcccccccctcggttgagttacatgttgcgaggggatgacgtgtcaaagctgctacagagtgtacagaggagctgggcg

SEQ ID NO: 28020 - DNA, 131 bp, Chlorella protothecoides
ggcacacaggcgtgtgataacgctgaaagcttcgcctgccagccaggcttgcggggctgatactgcacatccatggaagctccccgtccccaccgcctcatccctgctgcaggcacagatcatgatctatg

SEQ ID NO: 28021 - DNA, 78 bp, Chlorella protothecoides
cgggataaggaccatgcgcgagcaaggtaacgcattttcgcattcaatggcacagaaggggtgcatagggcacattaa

SEQ ID NO: 28022 - DNA, 61 bp, Chlorella protothecoides
tcgagacccttcaatcctgagatttgtcgctccctgagattttatgtctgcgcctgcctga

SEQ ID NO: 28023 - DNA, 37138 bp, Chlorella protothecoides
  modified_base (772)..(781): a, c, t, g, unknown or other
  modified_base (1248)..(1257): a, c, t, g, unknown or other
  modified_base (1879)..(1888): a, c, t, g, unknown or other
  modified_base (3287)..(3296): a, c, t, g, unknown or other
  modified_base (3482)..(3491): a, c, t, g, unknown or other
  modified_base (4340)..(4349): a, c, t, g, unknown or other
  modified_base (4801)..(4810): a, c, t, g, unknown or other
  modified_base (5301)..(5310): a, c, t, g, unknown or other
  modified_base (5614)..(5623): a, c, t, g, unknown or other
  modified_base (5969)..(5978): a, c, t, g, unknown or other
  modified_base (13896)..(13905): a, c, t, g, unknown or other
  modified_base (14325)..(14334): a, c, t, g, unknown or other
  modified_base (18128)..(18137): a, c, t, g, unknown or other
  modified_base (18207)..(18216): a, c, t, g, unknown or other
  modified_base (18836)..(18845): a, c, t, g, unknown or other
  modified_base (19328)..(19337): a, c, t, g, unknown or other
  modified_base (19572)..(19581): a, c, t, g, unknown or other
  modified_base (20151)..(20160): a, c, t, g, unknown or other
  modified_base (22335)..(22344): a, c, t, g, unknown or other
  modified_base (22574)..(22583): a, c, t, g, unknown or other
  modified_base (23975)..(23984): a, c, t, g, unknown or other
  modified_base (26240)..(26249): a, c, t, g, unknown or other
  modified_base (27459)..(27491): a, c, t, g, unknown or other
  modified_base (28022)..(28031): a, c, t, g, unknown or other
  modified_base (31484)..(31508): a, c, t, g, unknown or other
  modified_base (31711)..(31720): a, c, t, g, unknown or other
  modified_base (32560)..(32569): a, c, t, g, unknown or other
  modified_base (34404)..(34413): a, c, t, g, unknown or other
  modified_base (35460)..(35553): a, c, t, g, unknown or other
  modified_base (35648)..(35657): a, c, t, g, unknown or other
  modified_base (35960)..(35969): a, c, t, g, unknown or other
  modified_base (36106)..(36115): a, c, t, g, unknown or other
  modified_base (36509)..(36518): a, c, t, g, unknown or other
  modified_base (36789)..(36898): a, c, t, g, unknown or other
  modified_base (36952)..(36961): a, c, t, g, unknown or other
gcatgaggagacatcgttgcgtgtcacgttaaatgagcatgcgagtcgttgtgcaacccttttacaagttcacatgttcctgcaatgatctgattcttgctggacataacaaagctttctcaagtcgagaaacgtaattcggctgttccaactttcgcgaaatgacaggctcctttgctgtgagggcattcacaagccccatttgccaatatctgacgttacacattaatgtaggtacacaccagggtcatgttttgcatagtgcatgacacggattcaagcttggccattcaagcccgactcctgcattgtgcggtatctgtacaaaatagctgtagctcctgatcgttcggtggaagatatgcgggattgacgagacgttcagcataataaacaaacttcaggcactgcccagcttaccttgttgccctgagagcagtggtagagtgttcaggacggcaactcctctttcatttctaccaaccaccacgacgagtcacaaatacttagccaattacaatcctttttgtcaacatcagtgatctcatgaaccgaggaggagctggccacaaccggttgcgttggtcagtcctgcgatgttgatccattagacatccacaggttcaggcgctgtttgggacagcactcaagcctcctcaagccgatagcatagacagggagtcctaattatgacctgcagtcaccattcaccttcctcccaaccagttcgatgaagaggacctctcactgtcgtcaatacctctgtaagaannnnnnnnnntccgaggaggagctggccacaaccggtcgcgttggtcagacctgcgatgttgatccataagacatccacaggtttaggcgctgtttgggacagcactcaagcctcctcaagccgatagcatagacagggagtcctaatcatgacctgcagtcaccattcaccttttccccagccagttcgatgaagaggagctctcactgtcgtcaatacctctgtaagaacctcggatctcaaaaagataatttgggaaatcaacaactgcaagtctcttacaacgtggacacacggcaatgcacttcgcactattgtaagccatgtcggaacctaataactccgtctccagctgctagtgcagaggtttcatgcgacgcttaatctggttgtgatgcagatttctcttagaccagcgaggacgcggtgctcgggtcctggacacaaagcgagttggagacttgatccttgactannnnnnnnnnggatgcagatttctcctagacccgcgaggacgtggtgcgcggggtctggacataaagcgagttggagacttgatccttgactaagcaaagtttctcaaaaccaatacttcgcttctctggaagtgttgtgcgtgcggcttgacaaggccttgcaatctatcagctcgctacaagaagattgtagcttgtccatgccccgaacttcaaggcgaatggcgttgtcggcacctatatcttgctcagtcagtgcctagacctgcctccagcctgagaaaagaaacaactcaacatctggctaatgcaacgtcgtgcattacgggtcggtatttccaacagtcagctctttcgaaacaatcctcaagccattaggtattcctgcagattgaaagcctgggtgccttatatttgcggccattcactgggctccatatagaaagacggaattggctgcgtcgaagtaaggctggagtcgaggagaactcagatcgcctggacgaattccgatgtatatcgcgacagtcactcacagtataagtattcttgatataggacccccaccctttccctaagaaagatttcttcgactccctcgagggcgtgtccttgccatcatgtctgacgnnnnnnnnnnaatacaggatccccaccctttccctaagaaatatttcttcgactcccttgagggcgtgtccttgccatcatgtctgacgcgggcatggcggagaacgtgcaatccctgtcactcgaggagccgaaggtaacaatatatatgtatccgtttactttgtgattatgtgttctcatgcatctccttattgttggggatgagaagcagaggtttttggttcgtccaggtgccctcggaggggaggtccgaagctgagaaggctgccaagaaggccgccaaggccgctgccaaagctcagaaggaagccgaaaaagctgccaaggtacgatggtgtaatgaacacaagcatgcgcgcaggttgtatatcgcatagccaactgagcacgtaccctgccactctccgcaggccgcaagccggggccagaagcaggcatcagtcaccgaggccgacccgaacgatccacttgccagccagtacggcgatgtcgagctggttcagagccagacgatctcggggaatgtatggaccaaggtggagaagttggaccctagcattgaaggcaccacggtgagcgcagtacttatcgaagaagggaccgtcctcgtgcatttgggccaccagcgcacactgaatcctcaatcccatcccactcgaccctggtgcaggtcttggtaagagcacgggtgcagaccgttcgtggcaagggcaagtctgcctttttagtgctgcgccaggagctggccaccgtgcaggccgtcctctttgtcgatgacaacactgtcagcaaaggcatggtcaagtacgcctccgccatcacccgggagagcgtcgtggatgtcactggtgtcgtcgtgcgccccctggctcccgtagagggctgctcgcagtctgaggtgaggggcgagagggattggatgaaggaggattaaaaatgtacatacctacatatttggtacagggagaggtcagaggaaccgggcgtctagagacacatcccattggttgttcatcaagggttgaagatatgttggcgtcaagatgcaggagcatgccgacagctagatgccttcccacaacgtcctgcaggtcgagctgaaggtcactgccattcgatgtgtggcacgggcaggtcccctgccctttgagatcgctgatgctggtgaggcgcaaaaaggcaacgcaccctggtgggagctggggttaccttcccactttgcacaatagtcttatcgttcactcttaaaggcaacacctccttccctgattccagcacgtggtgcggaggccatatccaaggccacggaagctggcgagcaggtcgtcaccgtcttgcaggacacgcgtctggacaacaggatcatcgatctccgcacccccgccaaccactccatcttcagggtnnnnnnnnnnagtctgcggtcacacaggtgcagtggtcggtgtgccttgttttgcttggtatccgtcaggcttgactccatgagagagacaaggctcccccttcagcggcatgcctgacccctttgggggaccctctgcctaccttgtagctattccgggagttcttgctgaaggaggactttgtggagatccacnnnnnnnnnngcaaggctcccccttcagcggcatgcctgagcccttttgggggaccctctgcctaccttgcagctattccgggagtttttgctgaaggaggactttgtggagatccacaccccaaagctcctcggtggtgcctctgagggcggcgcatcagtattcaagctggattatatgggacagccagcctgcctcgctcaggtgaagggtttcgagggagcaaggagtggacaggatggaaatcacttgcaattctaaatgtgctatggtgtggctatgtagagtgcaagcaacactcatatcaatgtcccccatccctcatgcaatgtctgcagtcgccacagttttacaagcagatggccatctgttcagacctgcctcgtgtgtttgaggtcggcccggtcttcaggtgggcaaaaatataccagtgaacgaccaggatttcttactgtgtatgaggctaaagtcacccctcatccagtggtggattgccatgctgacgctcccaaactttccattccattccacgccagggctgagaattcgtacacgcaccgccacctgtgcgagttcactggtcttgacatggagatgactatcaacgagtcctaccatgaagttctggatgtagtagacaggcttttccacacaatgtttgaggtgtgctggggggctgggatgactccgagggtggcatctaaacatttggagtagtctgcttaatggcctctgagtaatgtgcacctcgattcaacctcaaccttcaaagccccgctccctcacgcgcacctctcatccacagggccttaacgagcgatgtgcatgggagttgacgaccatcaactctcagtaccnnnnnnnnnnacttttccacacaatgtttgaagtacgctggggggctgggatgactctgaaagtggcatctcaatgtttggagtagtctgctcaacggcctctgagtaatgtgccacctcggttcaacctcaaccttcaaagtcccgctccctcatgcgcacctctcaatccacagggccttaacgagcgatgtgcacgggagttgacgaccatcaactctcagtacccctttgctccgctgaaattcctgccaaaggcaccacgcctggagtttgcggaagggatcaagatgctgcaagaggctggctacgatgtgagttgcttcccggtgtccgtgattcagttccagcatatctttgtgttttgcagtacttggcactatcatccctagagtgtcgtcaggctgacggccctcgcgccaacctcggtttttcaggttgatccttttggtgatctgaacnnnnnnnnnnctggcactatcatccccagagtcccgtcaggctgacggcccatgcgccaaccttggtgtttcaggttgatccttttggtgatctgaacacggagctggagcgggtcctcggcaagattgttgccgagaagtacaacactggtgcgaggttcaccatgcaaggagacttgctgggcaaactctgggcttgctgctcctagtgtgcgtctccaggtgggctgcccggtaggttttgcaaacaatgccagctacatccagcgtctccctccccaccctgcagacttctacattctgcatcgttacccttctgctatccgtccattctacacgatgccatgcaaggatgacgagcgatactcctgctcttacgacatcttcattcgtggcgaggaaatcatctctggcgcccaggtacatcgcttttgaagttggtttttgtttgtgaatctcaggtcccagttgcctctgaatcgtcttcttaccctaccatgnnnnnnnnnntaagttggttttcgtttgtgaatcttagttcccagtggcctctgaatcgtcttcttaccctaccatgtcacagaggatccacgacccttccctgctggagaggagggccaaggaatgcgggattcctgtggagaccatccaggcatacgtggactccttcaagtatggtgcctggcctcatggcggcattggtgtcggcatggaacgagtggtacgtgtgacctggtacagttttgtggaggtttcacctcgtgcttcatcacaggaggccagatcggcgaagagtgcatgcctggcatttgcnnnnnnnnnnattttgctgaggttttgcctcgtgcttcatcacaggaggccacatcggcgaagagtgcatgcctggcatttgcacccccagctgatctcttgagtctcactcaagctccatcctgctgtgcaggtcatgctcttctgtggcctggacaatgtgcggaagacgtcgatgttccccagagaccccaagcgtctggcgccttgatgagtttgggatgctcatcggtgtgctagtattgcatgactttgtcatgtcagaggccaggggggcatgtagtcgctcaagacttggatatccaagagagagacagaggcaaagtacttgaggacgagcagtctcttgggtcagnnnnnnnnnncgtagtcgctcaggacttggatctccaagagagagacagaggcagattacttgaggacgagcagtctcttgggtcagatttctctacatgacagaccacagtgaatgcacatgagtatagccaatgggccgcagcccccgccccaaagtatctgttgtgagatgtggctgctgtggcacccaaggctcagcttccgtccatccaggggtgccctttgggatgctgatatcagcgatccgtcccccgggcaacctactacccaggggctctcaacaatctcccatcagtccgattgcgcgccttggccagatcccgagtcttcatggctgccgaaagtagctctggatgccaccaggaccgcctaaatggctctgcttgacccgcttcggcggcagtgatccgctgtcattccttggaccggcacgatgaatcccgtcctgaggggtggggtggagtacggtatcccgtgatttcactgatccatgttatgagcctaccactacagggcccggtcaccgcctcacctggcggttactatgcccatgcaggctgcggagtatggtctgcctccctcccattccatctggtccctggacaatgaagctggcatcatcacgggcgcccatgttcacacgatgccgatcgcgaacaaatgaggagcctgctcccgccatcgcaacactgggaccggctcgagccaggttcacatgcccatcgctcctcacgggatgtggttcctgccgtggagctgccatgtcacagagggcctgcggcgcacatcgtgtactgcctcatcgattcagaactgaggacccaggatgtctatgtgagagacgaactccgccactttgcatccccatcagataacaaggctcaccctgtcatggagcaggacctccacctcgtcatcactcgacagacagacgactccttcgccagcctttgtgcttgacacaggagctgtagaggtacatggcgggatttgagggatgagactgatgcgcgccagtccattttatgtttgattccttgaaaggcaactgagatacagaccaatgtaccagcacctgcaagagatggcacagaggttgcaggtgtcggtacacggacgcctggcctcgcactggtccctgtatttgctgctgtggcctgcgtgtggcaagaaaaaacgaagaggggggatggtagggatattttgaagcaagcccaggtccgccacattgaggagccatgcaaccaaattcttgcaaagtctcatcttctgctcacttacgagcttgttacgaagtgcgcaggtctctctctcaagcttgatcagccgatttgtggccttcaagagctggcgattgcgcaggtctagcattcccttgaagaagcttggcgcgggacaatcctgtgaggtacgataaggtggggcaagtgtttgtgacttggtgagggctctttggatacagcaaggcgtccaggcatgctcttgctaaagctgaccaggcagccatccttggcaacacacttgagcatatgaacagacacacttgggggctccctgcacctttttgctcaccagagaggtcagcagctctagctcagcttccagctcagcatccacaatgtgaggagaatctgccagcctgattcgcactgcccgactctcagacaaccttccagcctctttctgtgggaggtgagagttaagttggttgctgcagaacagcaagtgcctagcttgttcccacaagctcggaagtgggaccacctctcggctcaccatggactggacattctgagcgagtcgtttacactccttctctgcgtagatacatctatctcgggcacatgctgcctcgctttgcagagctttgaccctggcatgtcgtgaaggaagattccatgtgttgagtgaaccaatcaatcctggccaaagtggttggcactggcagacttgctgcaaatgccagcctcatcgcctggacgagggcagggcctacgccatcagcacacctttcctttgacttctgcagagcttggtccatgctccctgagagctcctcgatggcaagtagcttgactttgagctgctgtatctccctgtccttgtccagcagctccgccctccaatgatattgctgcacatcactaggtctggcaggagttccctcgcccggatccacgagctgagggtagagacgcctgatgtctctgttgacattgctgatgtcggcctgccatgaaggagcttgggcgctttttagagtgcgttcagacaatcattcacgccttcaaccatgagaacatccactgtctccatccaagggcttacccggcagcagggacagcatttcctgtattcaaggctttgaagcaagcaatttgaatgaaatacatggccgcaagtgacaaggacactccagtcggggcaggtgctctgcgactcgagacatatgctgcactgtagagccatacagaactaagctccatcgactatgacggacacagcacgcaatgttggccttggaagcatcggcatattctgggaacgatgggtgaatgaatctccgaacgaactctgtgttttaatccggccccctccgccacgagctggcgacatcatgcgatctaaattccgaatggatgggacatccgccacaatgcagggaggaggcccccagatcagcaaatgactgcagccaagcccaatgtatgtgagactcgacaagaaatcacagatgccccaaagggcggtgcaacccctcttgggatgttttgaggctgtcgccagcagtccaaaaagcggattccgcgccctcccagcaccacaatgcagcacccaacaaacccacacaaagcgatggccctggcatagtgcagaccgttctccctaccttctccgactttgtttctataaaatggcgtgagtgtgaagggagtagcggctttttgcactcgccgcaaccccattcccatgggcgtcaacacgccggtcagctcccccgccaggtatggagcaggcttatactgacaagagtaaggacatcatactatttgcgtcgcatagttttcatcttacatccaccgttctggctgcagagctgaaccgagccagtctgaccccagaacggcctccaagccaggcgaccgcagaaaggcgtcctctgagaatcagtatgcgtcgtcggttgcgtccacagttgcaggagccctggctggtgctgtctctcgcttcgccactggtcccctggacgtgctaaagatcagattccaagtccagctcgagcctgtctggcatgcggcagcgcagtccggccgaccgctcgtccgctccaagtacacgtccattcggcaggctctcgccaccattatcaaagaggaaggcatccaggtagggaatggatgcctgaggaagggtgtgagcggtctgagcctgtgtcggtcgagagaccaacagactgtcacccccatgaggagttctgtaacaagaccacccgatgctcagaggaccatgtcagagcatttgactggcgcagtgcaggcttggcgtcaatcagagagcaacactccgcacccccccccgggcactcttgccccactttgcagggactatggcgaggtactgtcccgggccagctcctgtctgtcccatacactgctgcccagttcttcacggtccagcagagcaggcagctggcaaagcgatggggagtggacacacatcccgccgcttcgttcctgacgggcgccctgtcgggggctgctggcacggtcgccagctacccctttgacctgctgcggacgaccctggcagcccagggggtgcccagggtgtacaacagcatggccgatgctgccaagggcatagtcgctaacaatggcccggcgggactgtaccggggcatgggcatcaccatcttggagatcatcccctacgcagctctccaatttgggctatacgactacttcaacaagtgctgggaggtgagttttgtatgtggggtgggctcctgagggagcgtgtctggtagaagccagaggtgtcagcgaggtggagggcgcagatacagcagcacacccacaactgccatggcgcgccggtgcattcttggaagtatgagctggcacgtgttatcttcattgagcaaggatggtgtccagtccagaatctcggccatggctgctgataccttgtacctgacagcccccactggcggctccgaactgctgtgccgtcctcgcacgcagtttgaagcacagctggcaagcatggcgtccaccttgctctccctctccctcttgcaacttgtgcaggcacatcgggcccgctacccttccctgcccggatccaaggatgtgcagcacctcgtgtgcggcctggcgtcgggcttgctggccaagctggccacccatcccctggatgtggcgaagaaaagggtgcaggtcgcaggattggcgcgcagcactgcctacggtgagcgcgtggccctggtcgcgacccgctccctgcgaggctgtctggctgacatctaccggcgagagggctttgcaggcctgtacaagggcgtggcaccctccgtgctcaaggcggggccctcggcggcgatcacgtttgcggcgtacgagctcttcctgcgctggctcagcgtcgcgcaggaggccaggaggtccgaggcagcgtcgggggagtgagcttcttgacctcccaagagtggtgccctgctgcacactgatattattacatcatgtattcaagttgattttcaacgagcacaaactcaagttccaatggatggacgtgtcgagaattataaggctgcacaggagaggggtgtttggatctgatggagggctagtttgctgacagtcgagcccagctgcaaggagcacgagacagccacggcagcggggagacaaggttggggatgagtgtcagacggtgacccatgcggcatcgcccaccccctgacatgcagttgggtccgtcctggcgactttaaagacaaggctcccggacgggtgtcagtcctgaatggtgtctggcgggtagaggtcacccatgccatactgactgctatgcatggcggcatggccgcccgacccatgctcctcgccctgttcctccacttccaccccgagctgttcgctgtcattcccgtgtcctaccacgccctcagcattggatgagttgcctgtgggtggtgtgaggctgggtggggactcaatggttcctttaccatgtgtcccggcatgccgagaatatatcagagaacactctcaaggagtaccctaggcacccccccaagcattccagggggaataaagcgggcccagtccctggcggccacaccttcacagatcgctgcccacacaggcagcctcgcacctggggaggatgccggaggatccccccctgcatccggtggcctgaagacaatgcccaggatcagctggcgctggtcattggacagctccgcgcccctggagtgccggcccgggtgcgtcaccagccgcaccaggttccgccacttgtccttcaggtccatctgggtgcggcgttcgttgatgcgaccgctgcggacgtacgcggtgtgtatttgggtccaggacgtccccatctcccgcactcctggaggtggcagcgggcaaggggttggggttgaggggtgtacgcggctgccatggtgttgctccgggacgttgagccggttggggactccaaggacgcgcaaggacggtcgatggcaagccccccgtgcctggcccagccgctcgccttctatgagggcctgcacctcgtccggaccccagcgccccgtctggcggcgattgcgagcgctgaatctggtctcctggctgccgccggcctgcgctcccggctgttcctccccggagatgtaggcggggtccaggaactgtcgccatgtggtgcacaagagggaggagtgggttgggggcagcgtcaggtgggctgcggttcggagcaagcaaggtaccagaggtccttctgtctcgccgctcacactttgtaagcaggtccaggcatgctccacgaaccctgagtcccaccaatcccacccgtctcccttccccctgccccatctgcaccggcgttcatggggtcacctgctggttcaagagaagagacccgtgggccatgggcagattcaggcccatgcccattccctcctgggattgccggggctccaccatggtctgtgccccggcgggcaggtagcccatgcccgggtccacgctctgaagcatctgccggaaggaggcatggccctcgctgtccaagtgcactggggtggggggagggggggttgacaggattggagcaggagggtgcgggcccgatagttccagcgatgggtgtgcattgccgcgcggcagcgccgctgatgcagccatctgcatgataccagggcgggcaagggcaccgcaagcaggcactcacccagatgcaggggcatgtcctgggctgcatgcgggctggcaagaacaggcatcctggcctgccgctccctgtcgccactcgagggtgctgactggatgaagacctcgaacatgccgggggccatgtagccttcgttgaagaggaagacctcgtcgcctgaagatgcacgtggtaagaaaaagggcatgatacgaggcaggggttgcacacagaacagaggggctttccatcggagatggtatgcgtacgcagccgcctgcgcctgcattggaggtgtgagactgcctccagcgcggtcacaggctgcgcacactacagagccatgcgcagcatggccctgccaatcgttctgctacgcgaatccccagcatcctggcaaaggacacatctcaccgctgctggaccgcgacgggatgctgtccatgcctagcacgtgactgccgtccatcacacgcttcctcagcacgaagcgggaggcagggaggtactgcgaggtggggcagtgcgaggcggggatcaatgtagggcatgcagccaaggcccatgtgttggccgcgaggcgtgcccctcaaaccccgagcctcaacaccccagcatggccacagcgatgctgaggcccctccgacataatcgcatctgcctcgcccaccctgctcctccgcgcgcacctcccctcgctgcagcttggctcggaagatgcggcgcttgaggtactccaccgtggcaaactccggcgcctccaccaccatctccgatagcggcatgtaggtgcgcagcgccttcaccacgaagcggacctgcagcccgcgccgggccgacagcagcgccagctcatcgtcgtgccgcatcgcccgcaggtcctgatcgcacgccgccgcgctctgggactgcagcagctggagcgcggcgtcgctcagaggctccaggggccgagccaggctgctcagcggcggtgggccgaaggccggcggcgggccggcgccgtcctccccttgcgggcccccctcgcgggggctcagaggcgccacgtccaccacgatttcggcctggatgacctcctggccggtggagggggctggacctggggatggctggtgctgggtggacggtgggagcgcagggccgccctccagatcctgaggcacgtgcatgctggagcttggtccgtaccccactgggtgcagatcggtgggagggaggccgccctcctgtgtcctcagccgcttgtgctctgagggtcaggggcggagcatcagggtgggaagagcatcagggctaccaaagaatgctgctccaggcatcacggcgtggccgtcctcgccagtgacagctggaggcaggcccacaaggggctcgccctccatgtcaacccactgacatctacctgagggtcccagcatggtattgaacctctcagtagtggctcgggagtatcagcggggggaactcactccacagcatcgagggagnnnnnnnnnngaggggcccgccctccatgtcgacccactgacatctacctgaggatcccagcatggtattgaagctctcagtagtggctcgggagtatcagcagggggaactcactccacagcatcgagggagtccacaaggtggggacaaccaaaaaggtggtggcgtactcagctgacctcagggtcgacttcaccagtttccaaccaggaatactgctctatagttcatcaatttatccgctgcagcgagcttggcgctctctgcgcccgtcgactggcagaaggtttgtctcctcgcctccagagagtggtgcagcatgagattcagcggacgttctggcacgctcgatactaatcgatgaaggcttttcaatctagaataatacctggataatttaagtgttgtccaatctgcgcagggtgacgnnnnnnnnnnacttcagcggacgttctggcacgctcgatcctcatcgatgaaggcttttcgatctagaataatacctggataatctaagtgttgtccaatctgcgcagggtgacgccgatgggccagaacgggtctgtcacgccgtcggcaaatgctgcggtggtggtgcagcaccctagttggggtgcgtcgcgggacgcacaagtcccttgtgcattttctcaaaggtcagggtgctaatttcacggcagcagtgtccccaaaggtacagtggagtgcctgctgtcctcctagaccggggtgtatctcacatgtgcggcgtgaagggcattaaagacgtgatggtgtcaacattatggagcgtgcaatcgatgcatcacctgttcttctcctcaaagaatttgggcaagacactgccatcccatggcacacagatccacgcaagcatgcttggtacagataggtgtagcctccatggcctcctgagcgggggcaccccctctgcttacgttctgtcccctccccctgcgggacaactcccctccccgctcactcggcgtgggaggagccggtggagccggccagggcagctcctgacatgtagctctccgccagctgaacacgcttcacattctcctgctcgcccaccagcgcattgccatacttcatcagcacgtccagggtcatcatgggcttgtcgaacgtcaccttgccctcgcgcgagttcaccagccgcttgccgatggcctcgatgccggtgccggagatccactcgcggaccttgtcgtcataaacacgggcgcgcagggcgccaaagaagtcgatggactgaccggggaaggcgtccaccagcttctcgatctccttcagattgacgtcgtcgtgctggaagatgccgttgcacacaccaacacggtcctgccgagtgaataaagggggggggacatggttgagtaaaaggctaggaggagaagcgccccaaaagtggggcggcggaaggggtggaatacaccaaaccaacaggctcagatccatgagctactgccacccacagactggaggggaggccccctgatcatacagcacacgttgacgtgattgccagctgcagtcagacacagccaagcaagtgcaagcgtggcagagatcaccccagtcgcccacctcccgtgtgggggcccagtaaaacttctccatgcgcccatcgcggatgaggggggcatacagggtggagaagtcattgcccgtgcacacaacgggcacacgggggatctcctcctgcttatacacacccgggagctgcacactgcgggtcacgtgggccgggcgggtgggagcggtggtcagggcagggcatgattcgttttgggtgattcctgaggagaagtgtgccaggctgtgagcaatgggatggtgagcacacaggaaaggcagcatgccaccgatccctcgtgtgtgcttttcacatggtgtcagaacgatgctcgccacaggtgtccagagcccctcccccgcccccacgcacttggtggggttgtcggcgatgttcatgagggtggcattcaccatctggttgttcacggtgtactgcgtggcagagcccatacgtccagcacctacacacagggagaagtaatgtgagcagcatggtttgtcattcaacctcgaagggtgggcattccaagcaaaactggcgacgggcttggaactcgagctcagcattcaggtcgataaaatagactacatctccatgtattggaatggtgatttggtgtacaagcaccctgcagcggtggcctcctcaaaacatgcatctccattgctctatgaatgcaggcgggcgagctctgcaacccaacactatacgtcatacacttctgacagacagcttccatgaacttgcccccctttcccccccccaacacacaaaaagaaagtacctgcgtccaaatcgttgatgaagagcgaggacatcttccccttcttgatggtgtcggaagcctcgcggtagcgctggcggatgagcttggcgggctcccccgcattcccgctctccagctctcccgccgacatgacgatgggcgcgatgcccagcttcttgaaggccaggttgcactggaaggtcttaccctggcccttgcctccccagattcccaggatcaggggcaccttgatcttgggcaggtccaggaagttcttggccacgtggatggacagcttgtctaggaaggctggggagatgtagaagccgtcctcgatgttgcccagagtgcgctgggcggtggacaggtactcctcggaggaaaggatggcgttgtgagtgccgccaatcgcctggcctccctggaacaggctgtccaccatgtcgcgcccgcgctggatgtcttgctgtgcagagagggaggaaaggggggacggcaatgagaatcggagcgacaaggggccttcatcgatccctcatcgacacccacgactctgtctccagtttaactggcctacaggagcttgtgagtagtcgcaggagaaagtactggagaccatcagcctgttctatgctccctgggacctcatgacagccccagcatgtttcccctgtcccacacctggtcatcagaggtatccttgccagcatcaatgtgggaccagcggcccttgtggttgggcttggccatgcagcgaacgctgggacgggcctgagactgcacgggaaggggtaggggagtatggatggcgaacccggccgcgagcatcaccaggacgcaccagggtacctctaacatgagcttaaccctcacccaccatcatgaccgccgagggagggcgctgcacaccacattgggcggtcctacggagttgtaagataatttaatgtgtcagaaacttgaactccatcttgtaaacttccgggtgaccgcctgtgaagaacatacggatacatcccgaccatcaccttcccacctgatcccgttcccggcaacggagggctgagtgacgcgtgcacactgcatggctccgatctgatctgcggatggcacgagctgtgtcaaaagaagttcgatgaggatgcgtgtggccgggacgagggctaagggtgtcaactcatgtgctgattacgtccatgtgcgataaggtgagtacctgcggtacggagcactaccgccaaaattttccacctcgcgaaagtggttctgaatcaggtcggtcccctacagcgacaagagagtcactgagaattacttttctcatcaattcctttcccttcaaccagtatggcggtcgcagacgatagtccctccgacgtggcaaggtgtgtcccggtgagggggctttcggaaatagctggctcattcgacatggaagtccagcttcatttccatcgacctgcaggatcctgatctcaagccagagatcgccaatgacatatttgagcacggcaaaggtgggctgccagggaagtggatccttgcctctggggggaggggtaattctcggacaccgcccattcacacctgtgtacgacctgcatccatccattcagctcatcccgcacgatatacgagcacagagacaccttcagcagcatgggagtgtgcacatcaccgctctgggcacggcgctgagctccctagtcaccctgtcggaggtgctcaagaacagcaagcttgtggatgaggtgaagctcaccacttgtctggagcactttaaggacgaattcaggtatggctgatctttcgtgggatgctttaatccatggatttgggggttctaattgtagcatggccggctggctgagtgatgtcaannnnnnnnnnaaggggttattctcggacaccgcccgttcacacctgtgaacgacctgcatccatccattcagctcatccnnnnnnnnnngttcaggtatggctgatttttcgtgaggtgctttaatccatggattgaggggttctaattctagcatggccggctggctgagtgatgtcaacttccttgcgtcttgcccccaatgctagatccagatcagccaaactcccctgaagcttcttaatgtatcgtgtcatgtgaacagccaatgagcccttcgcgctgctcgtaccccctgcagtgaccgacagaagccaaagatggacatcatgctgacaaagtctgcagcctttgatgaaatcatggcggaagaggcaaagaaacagaacgaccacgcaggtgcggatcctcagtagccatcagactcgttccccatcctcccgtgctaccaataaagaggacgcaatgattcttctcaagcccagtcccctcttttaccatccaccttttcactccatggcgtctcctggggggtgtttgacagcttttcatggtacagttgtgcacggcgtgcaggtgcacttccccagcgagtgagacccactttttgcctttcctcaaaatgaacaggtttgtgtgcctctctgatgcctttaaggattcacgacagtgcatgctcgagtgctctggagccatcatggatgggtggnnnnnnnnnngaaatgaacaggtttgtgttcctctctgatgcctttaaggattcacggcagtgcatgcttgagtgctctggagccatcatggatgggtggtggggtcagcggcctcgccgccatcctccttgcttccctaggcgatgtggggatgaaggataccacgatcaggatggcaactgcttgcatcgggagcaccacgctccttggagccaggcaaatccagtgaagtgagccccttgcgtcagccccgccactcacctcggcagccagctcgttgaggtagtcgtcgaaatcgaggtcgggggtggtgcccgagtctcgctcctcatccatacccctgtcctcctcagaaataccgacctgtggtgattgggtgcgaagctggtcgagcgtgagggcaattcagtgcggtggcgtatggttgagggcatcatcacatgcagtggcgactggtagcgggacacagccaggggattggcagcggcagtnnnnnnnnnnggtggtggcgtagggttgagggcgtcatcacatgcagtggcgactggtagcaggacacagccaggggattggcagcggcagtgtccctcgcggcgctttgtcaaagagtcagatgccccagacagcgctggcccagcacttcccggcacgcccacagcccaccccacacacgcatgtctcggcagacacacattgctaccgcctctcgccatccccaccgccacgtgcctgcagnnnnnnnnnntagacagcgctggcccagcactgcccggcacgccgacaccccaccccacacacgcatgtatcggcgggcacacattgcgaccgcccctcgccatccccaccgccacgtgcctgcaggtaggcctccagatcggggtccacatccaggccctctggcttggcgcccgcccctgcaggcgcactgccggcccctgcgtcccgggcctccacgccgccggcctcgggcccctggcccccccgcgcgctggccgtgtccgccagctccaccgaggcggggcctgcgccggagacggaagtcatgtgggcggcggcctggacctgggaccccagggactggatctgggacctgaagtcgctgaggagggacgacacgggggcggctggttgctcaggcttggggttcactgcaccggggtgtgggatgggccaaggaagtcagggccctttgctggtttacaagaggcttctggacgaacaagtgtaaatgtatccttcaccaccccccacccctgcgtccatccgaaggcaaatcacgtcgacctgccgcaccccatcccaccaaagggtgtgnnnnnnnnnnctgctggtttacaagaggcttctggacaaacaggtgtacatgtatccttcaccaccctccaaccctgcgtccatctgaaggcaaatcacgtcgaactgccgcaccccatcccaccaaagggtgtgtccatgggccacgtcaaagactctgccgggaggtggggcttcatcaggctgaagtatgtgtgccagaagtggccgtcggtcatgtacctggacagcaacaagggtactggaaatgaggtggagctctgcgtgccggtctcacactagagagtgcagagaggcctgccagcaccgtgctcaccaagagcttcccagcaggccctcccacgagaagtgacacgcaggaacaatttaccttgggcacagcatgaatcggagctcatggatgtccttggcttcggcgcacagaagtgtcgcatgctgaatctgccaggggttcagcaggaactcctggtcatccacaggttggccctgtacaggcagtagcttgtcctttggaaaatccctgcatgcagtggggaaaaggtacaagaggagggagggctcaagaacggcaacaggattgggcatgcaagcttccaagcctgcagtaggactcacagaaatggcagatcgccctgcatcttggcaccctccagaaccagcctgcctgaaggtactgaagtgcagctcggacaccatgttaaggtaggagtcattgatgcccactgcagccagctcatcaggcgaaggcttcctctccttcgctgctcgggggccaagcttctcttgcaggccaagcttgccgaatttctttgcggcttgctcagcagctcctcctgccagcacctgccgccccgttgcagcgtagaatcttgagagcgcagcaaaggggtgaattctgaatttctcggaaacaaagccacaacctaccagtccttgctgtgaggcgttcttggcgatctcggctgccttctctgctgcctgcagggctcccctgaagaaatccatgaacaggactgacccttttcttcgcccacctggatgcgatgtacgcaaggggcaactgaattatctcgccgatgtcgatatcctcgcccttgctgcgacacacgactaacagaagtaaacacgactgcccataaccattcgacactctccgggaccatcggcagtaccctcgcgatggttgaatacgaacgtcttgcagcctgtcgaatcctggaagcagttctaaacccctcctcaagagggatgaacggccatccgcacgttaccctaaagtaattacaatagacttgatcaccggccccagttttgtcctgaccgtgcgagattgtctgacgtctgcgtccacaaacggagcccggcccgaatgtttgcgaagcaagcattcgaactggtgcaggaagtactcagctgtcctaaagatgtcatccctccatacaacgtgcgtgtgtgtgcatgtgcaccgaagtctggttcagcttttcgcacatccaccaggccccagatattgacacccccccaccgccaccctaccataggacgaggcctttcgtaacgtgatcgacgaagtgaacatgcagcatgagaggcttgcagccgtgttccagtgagtgcgggttgctgcatactgtatctttgctggagcgatgaggagcatgaatggtccttttgctgtggttgtgatccatgtgctgcagattttggaagatcaccgcgccgtcatttgtaaccccacagtgagtctcgtcggcgattcacggagagccagtcgcaagagcctctgtccgccagcccctctggaaacgatgactctgctgcgtggagagggaccgaggcggaggccacagagatgatagtgcatcacgccagcattcttcgaaacaagcgtctcctcttcacatacatgtatgttgaaaaggtgccagccgcgggaggttcagagtcggcttgtagcagggcattgaggggaactctccttttactcgtgtgcatgcatggttgcgcttccaagcaggatagacatgtgcacctgccaatcaagtagggtgaacgttgatgtgttctttgcctttaattacgataagcggcagtcacccttgttcattgtcctgggcaactctaaatgcttctacaactcctcgcatcccatttgctgcaggcgggaaagaacggaccgtctacnnnnnnnnnnttgagatcacatgcaggctcctgggagagcacccgggtgacatcatcatcacaatggagtctcggagtattcaaggatggagattctattgatagatacctatctccaggaatggtgaacttctaagatcatccatccggaaacggcggattttgaaacttgtgtaaagtgctatcatcacccaagctctcttctgacacctgccctccaacaggatcccactcccccannnnnnnnnncgtgcatgcatggttgcgcttccgagcaggatagacatgtgcacctgccattcaagcagggtgaacattgatgtgttctttgcctttcattacgggaagcggcagtcccccttgttcattgtcctgggcaactccaaatgcttctacaactcctcgcatcccattcgctgcaggcgggaaagaacggaccgtctacaggagttccgatggacccaccggagcctgcccgcacatgtccagaacaaccttagcccactcgagctccaatactttgccggctacgaccagctcctgaacaagtacatgcgttctgggagactgggtgtaggacttgacctaacagcggtaggtgcttgtacaaggtggctgggcatgaactgagatcacatgcagtctcctgggagagcacccgggtgacatgcacatcacaaggagtctcggagtattcaaggatggagatcctattgatagatacctatctccaggaatggccaacttctaagatcatccatccagaagcggcagattttgaaacttgattgtcaaagtgctatcattactcaagctctcttctgacccctgccctccaacaggatcccactcccccagaggaccctttcgtccaagtacgtgttctgagggactatggggaggtcatgttcagcagcggtaaggtggccttgcagcgaggcaagtcccactggctgccgcgcgacgaagcacaccccctggtcatggatggcgtgctcgagttcctagccgccacgtcgtgctaggcctgacactgttggcccgattcagctgaaggacatggtaaatactgccgaaaaggcatacgagggagagttgaagggagcataaggatcgtggagactcagggcatgaggattcaagttggcgcatctagcttctgcgcaactgctgcagagggaaaattactgcatcgcacccgacaattcggcaccccgcacgttgcaggggctggacctgtggttgcattgcactctgcccgacatatttaatgtctgcctctatcacgccggggcatggctgaacgagaatagggacgcgaagccatgcctgccgtccggctttggggccggaggtggcacttcagcaccgacatcgttcccatccccgctgccatcaacggcgccttccattttgtctggatatgcgttctcctcttcggtgctattggatcaggggaatggcccagtgggtgcaatagcgcgactgggcggcagtacgtggcgttgttcgccggcctgtttggggccttcgttcttaatctcatcatcgacgtcctgctctacatccatggaatgaagggtgggtgatgaggtttattctgtactactttttgtgggcctagtacagaggatcgacggnnnnnnnnnncatgaagggtgggtgatgaggtttctgtagtagattttgtgggcctagtacagaggatcgacggtttaagtaggtggccagtaaggctggcagacctagcaagttgcaaaagccctctcccttctccctggcaggatctccattcgaggtgtccaaacggcactgggttccgaccctcctccacatcagcactctacccattgtcgctcagttcgtgttcacaggtaggagtttgggggggccccagcgcgtcgatgtcattaggtgcctgaaggcagtggctaggagaggcccctccgtgcatgccttccgaatcaggtctctcagacatcgcaagctttgcccaaaggagcatacttcacagacaaagttttcgaagttcctgcctcttgatttcctgacagcatttgggacccatgtcgtaaatcagcagctggacgattgctggccggcagacgtgaggcatggcgtgagggtggtggcgcggatcctcgtctactccacctggggcctgatggccatcatcgcgtgagtttgttgggtgggggtggagcggcatgaatgtgttcaggtcatcatctgggttgattgtgccccccgtggattgtgcgttgctgacgtggggctgcggcagggatggttggcccactcagtgctctgacatcccagaatgaatccacccccctccccttctccccttctgcccttggccgctcaggctgggaatcgccatcacgtacaacctgtacccggagcacaagtcgcagggttcctgggagcagcggtgcgagtgcatcgccgtgctgctgtgctgccgcagcaacatgcggcgccggccagcgggcaagcgccccccgctgtccaacatcgcggagctgacctccggcctgctgtcgcacgtagacctggaggccaccgacctgatgacggccgtgatcctgacctccgccgcgcaaaaccggcggcggcgcctgcgcctggccaaggcgctgctgcccgtgtacgaagcgctgcgccagacggggtcgcggagcagccggtcggatcccggcacggccgccagctccgccggcggctccgactcggactccgaggcggagagcggggatgaggcgggggccagcagcgacggctcctcggtgcatgacgtgcccgccagccgccgtctgacgcggcggctggagggcgggcactcggagcggggcagggctgcggcgccccgtgagaccgtgccgcgggggcccagccggttcgacccgggcccggggctggccggcccgcgcagcaggaagatcgtgacctttgagcagttggtgtcgccggggcagccggtagaaggtggggagccgaggccagaggcgccggaggtcgtgatcgacaccgccgccagcctgcccctgaccgagagcaacgtggcgctgatggatcggctggccagcgcctcggtgggcggcgaggaaagcgcggcagggggcggagacgacgggaagcaggaggcagcggcggtggcagtgaccaacgagctccacgacctggctgccaacacggggcaaggtggggaggcgtcggagagtgtggcgaaagggttgggaaagctggccaccagcgtggacgcgactgaaggaagcaaggtgtttgcctgtagtcaaagtgcattgaggccttgggagacaggttatgtgatctttgggcatgcaggagcctcatgcacgtgcatcggtacccagccctgcatccagttgtgacctctttgagtgcctgtcctgcactggatgccaggctttgatactggagtgccagatgagtggcacgtcacccccttactccgttcagcacagcgccccagctcgctcagtccttgtcccgtgcacagacgcgggggaattggccgatgcactggcggatgccatccaggatgagctggaggatctgggtggcggggacatcggggccacccacgaggacgcggttctccaagtggacaaggtgccttgtgtttgtggaatggcattgcacagctgctgatgcagggggcaatcgtacatcaaatgtgcatcgctgtgaccctacagtcgatttcagccgtcggctggctggaggttgtctggcgtgttcctccagtatcctgacgcgacatgggaccgatgtcctccctatgatgcttgcgggatgaagaattttgagaggagctgatccacccccccttcccctcctctcaatctcccacctccaggccccctcgctggatctggcccnnnnnnnnnnagagctgatccacccccccttgccctcctcccaatctccgacctccaggccccctcgctggatctggccctgctggcagacggcgcgtcctccatctggctgaaccccagcgttgcaacgcaggccccctccgtctccaatcagggcgaggaagcggcacccggctctccccgccggactcaggacgccgagttcccggccggagtctctgactccggacccccagactcgccatcagtgccccccgcgacgggaagcagcccctccacccagcccccgccggtgacggtgccggagggcgtggacccgctgccctcccgcgaggccgtggtggcggccaggcaggccggcgcgccggggtcggagggccgcctgccctccgaggccagccagggggcgcgcagcggcagcgtgcgcgacctggccagcgttacgctgcgcttccccaccgtcatcacgccttcccagtacgtcaaccgcctggcggggaaactgccgcccgaggcgctggccgacatctacgctggccggcatgaccgcgtgggggtggaggtcctggaggaggccacctacttcctcaagtacgcctacgctgtctactccctgcagcccaagatcgagaacccctccagcatcctggacatggcctgctggaagccgcccgcgccccaggacgtgagcagaggagaggggagggggggtgggggttgggggagtgttgatttggggtaccagggatggcgctcagccaccgtgtcaagttcccacacccctgctgcgccatgatgttataaactcagcgcgctgctccccttacatgtcctccattcaactccattccaccccaactccatccacaaaccacctgcaggtggttttttcagggttcaatgagctggagcaactggaggatgactccaccatcgagctgctgcacctcaactgctccaatcggatgctggcgcacctgccctacctcatcgctctggaccatgtgaagaaggcggtggtgctggccatcaggtgcggtgaattctgtgagatgggggtggtattggcctgctttggccaccttctgggtcctacgtgtgtgcactcccgcagtcacagcctctccatcagcgccagccatgtcctcaccctccactgatataccctcttcactgatatacttggtccattgatccccccccccccccccccccccccnnnnnnnnnnnnnnnnnnnnnnnnnnnnnnnnnttccgattaggggtaccatctctgccgccgacatcgtgacggatgccatggtcgccagcgagcgcctggagcacctgctccctgtcagcctgaaggaggacgtcaagggcccctgcttcgggcacacgggcatgctggcggcggcccaggccatcttcatggacatgaaggagcggggcatcctgaccccgctcgtgggcagcgaggcggcggctgacgactactccgcgccgcgcggggagggcccgccccagcgggaatcccagtacgacgccgacacggggcccagccccctgcgcgcggccatgggcagcgcggggcaggccattcgcgagggcgttgcggcggtgctgcccgcggggggctggacgggggcgtgcaggccaggggatgccgcaggggacgacatcgaggcacagcgcgcggcggcgagaggtgaggtcagaggggagaggggggtgggtgcttgtacgtcgtggtgcgaggggggagtgctgcatggcatgtcggctgagatttggtgcccagaannnnnnnnnnatacgtcgtggtgcgagggaagagtgctgcagggcatgtcggctgagatttggtgcccagaactcgtcagtaactttagacttggatactaaagtgtccaactgggatttatgcaaccagactccctgcccttgcctgatgaatgcatcccgccggggtcccaacaaacaagcacaatccctgcgcaccatgctagcagattccgacggaccacgtgtcacggtggacaagctgggggcgcaaaagtcgccgggccagaaggtgggggagctgatgaaggtgaagctgctggaggacgactggcagctcatggtggtgggacacaggtgagcgattggtaccggaaggcttgtctgcaatggggatgcttgtgttctggtcaactcctgacgctggtgcgcaactccgcggcgcgctgcaagactcgagcccgcctcctgccatgctctgtggcggttttgaactccagcaatgcatgcctcctccatcctcatacaaacatccatccaaatgcccacagtctcggcgcaggggctgcagcactcatctccctccagctcctggatcactgccccggactgaagtgcctggcgtacagctgcccaggcgcgctcgtgagcaagaacctggcacatgccatggcgagcttcactaccacgggtggggcctgggacgcggttggtttaggtcatgcccgtatggttgagagtgaatgcccattgtttcaggctcaggattcgattcccgcctgcctgtattcgatccctcgtagttgtggtgggcaaggatgccgtgcccagggcctctgtggcaaacctgggcaggctgatggatgagatggtgacgtccctggcaaggtgcaaacagcccaagctcaaggtgatgacatggctggttgctcggcgtaagtgctgtccaacctgtctgcacgcggattgtctgggccacagggccttgcggccctggcatgacccaaggcaaggggaagaaatggggactcgcccccttctcaatctgtacaggtgacattctatccctggtggaagaggaagaagcaggacttcaagaatctgttctgggactatgacaagatcccagaggagtcactggaggtgttgagaggatactatgacagcaggtgtggggaacgcggattggcatgtgtgatactagagactgaactgctccgcagtgggagagcctggccatgcatggcgggtgatgtgcatcagtttcttgcagggagatccctggtaggagggtcatgctgtccgcctctatcatgcagagtctctggagggcagcccatgagcatgtacccacctggacgtctcatattcgtgcggcccatcaagacgcggcgcaagaaggcatgggactgtgtctggatctctccagaggacatcatcggtaagacaggggggcgctcggtcttgccagatgcgacgctgaacagaaaaggactccatcccaccagtgccatgtattcaagttgaacactaggattccctctttcaatagctaatgatttgcatgccgacaagtgccactcgacccctcacacatccattgcacagatgaggggatcctgttatcacctcacatgctgacagaccacttgtgtagtacagcctgggaagcattgcatgcctccctccgcaaagccaaaggtgagcggaatgcgcttgcacaaagaatgttccttggttgtcgtcggcgcgtggtgatgttgtgatcaccttggtcgcctaacattcccctgtccccttacctgacccctgcacagacgaggatgccaaaccatcaaagcggggattcaaatggcaaggacgcctggggaaaagaccccagcagcactacagatatgagaggcagaccagcgagcagcgcagtctgcaccaggagctaattgcagattgattgggcaggtagacgcacgcttccttgtggggttggcctcaggcttgcctgccttattactgaagatcctacgacagctgtagaaaccgacttgtatgcagaatgcgagttgccacttgcatctattggtgatctgccttgaaactcaacgcatgacactaaggttccggcatatgtttgtgccttttcagcaatcctcttgagggtatgagatcgcctttgcccagcttttgccatggaagaccctttgagagaatgaaccaccagatcagcttagtaggtacaaggtgcacccagatttggtgcacaaatagggtgacatgcatggagtttctcaaagatgcccccaggaggtgtccgtcatcagaggaacaggagcaggagctccgcaccggaatcgactgcatgagttcccccccctctataccggttgctgagcaaatgttcgaagccacccacaaacaacaaataattagtctcgcacattatatgtccatcaggtcatcctggcatagaatcctaccgttgtgaccatgtcgtcacagccagacccgacagcgtctgagacaccccgggttttcaaggatgtctcgggcattcgcaattactcgagagagcagcgaaaagcaggaaggcggatcggtttcgtgccgacaatggtaggacggagaatgtaaggggcgctgttcgccttggtcctggatggtgggtcacctgatcacctccagtatcttgaatcttcagctccttctgttgaaagcagctgtcgcactccgacccacccagggatgccttcatgatggccacatctccctggtccatgctgccgggtgagtctgatcaccagggtggtggggatcagctgctacacgtgctcccgacctggtgacttggccgccgcacatgcaactcaaccactgcaacatcttctcgccatctcccaccatttacatttctctgcaccttccaggtcccgatgcgacgtggtcatcgcctccatatatgtcaaccccacccaattctccgccaatgaggactttggggtgtacccccgcagcaccgagcgcgatttagacctcttggccaaggccggctgtgtggctgtcttcatgccggcggccttgtaccatccagggtcaagctcgctggggtcgggtgatgcgagcatggtggtgggtgcagctcagggcgaggctgcctcggacgcacactccacctgggtcaatgtggaggggctatcccagggtctatgcgcgggctccaggccacacttcttcagaggagttgccacggtgcgcatggttagtgtggaggggggggaaagtttggcagggggtgcagtctcttgtagaggtcctgcacactgacccacaggagagggtttcgccacacatcaacaccctgtccctccaggtggttaccaagctgttcaacatcgtggaacctgacatggcattctttgggaaaaaggactaccagcagtggcgcatcctcgaggtgggtcggggtatctgcggcagggtggggttgctnnnnnnnnnnnnnnnnnnnnnnnnnaccgttctgcagacaggtctcattctctgtacagggatgaatgcatgggtacctgccggcataccaaacctgtcgccgctctctggcatggtggccaagcaccccctgcctttactttgctgtgtcttgccccctttcaaattgcgtgccacaaatctgcaccctgccaccatgcatttgccccgtagcgcctcgcccacgannnnnnnnnncctggcatggtggccaagcaacccctgcctctactttgctgtgtcatgccacctttcaaattgcatgccacaaatctgcaccctgccaccgtgcatttgccccgtagcgcctcgcccgcgacctggactttggcatcgaggtagttggcctcccgattcagcgcgaggcagatggtctggcgatgagcagtcgcaacgtgctcctggcacccgatcaccgcgccgcagcccccggcatctacaaggcattgcgcgccctggaagcggaggtcgccacgcggcgccgcgcaagtggcactgcgtcggtcctcaccgtccaggaagctcagcgatcggtgtcgaggtcgctcgaggctctgggcggggcggtggactatgtccagctggtggacgcggccagcctcaggcccctggccgccggcgctgacctggcggccgggccacctatggtgctgctggccgtggccgtcgtctttgggcgggtgcggctgatcgacaacctggagatccagggacgggcgtgaggatgccagcaatgccgcaggcgatttatggccataagttttgctgacatgcatggatgggggaggtgtggaggttggcagtcgcgcctcccttgccctgcccatcactgcttcctcgctcgctgctcccacccaccctccccagcactgtttgcttgctgctccgtcccgccgcctcggcctcacccgtgatgagtgtcacagtaattcattcaaagaagcaggctgcgaggctgccccagtcaagcgcagcgtaatcgctgggcgggcaggttcaggcgcgtgaccgtggtcacaggcagggcaaacaccgggnnnnnnnnnngaagcaggctgcgaggctgccccagtcaggcgcagcgtaaccgctgggcggccaggttcaggcgcgtcaccgtggtcacaggcagggcaaacaccgggtcgatgggcgccaggcccggatggcccagtagggacaaccctgccaggccaaagaaagtgtggaacacgtccaccgcatcgtctggacgatcggaaataccgcccagctccaggtcctggcagcccaggatgaaggcagtgagggcgggggcgtcgatccaagccagccgtcccagcgtactcagcgccgagagcgcccaccaggagtagcagacgtcctgcagcttctctggccggccgttcaggccgccgctcggtgtctggcgctcgctgatcctaagacaagggtccagtgtgggcgagtgggagtgagcagggatgaagggtgacctgaggggtgttgtggcacagtgggccagtcgccgcaaggtcgcagcacgtcggcatgtacaagaccaatgtcgccaaacacctcggagccccccccccactccccctcctttcagcatgagccgccagcccacaggcccatctcaacaggctcaccaccatcccagcaggtcggcgtcgacgacctcgtccagggccccggcgatgctgagcgcggccacgcaggtgaacacctgccccgcatgagactcgcccccgggctgcgccccaaacccgccgtcaaagttgcggcactgcctgaggaagtccacggccgcgggcacgtctgccgcgtcaagccgtcgtaggagtgccaggctgtacagcgcacagtaggagaatctgcacaggggtgggcaggttgtagggtgcggttgggtttggggagcgtacagaacggctccaggctctcggtcaacgcatggtcctggcatggcatacctggtatcgatttcaccccactcatcccccgcaaacgagccgtctcctctttgcaagccggccacatctgcttgttgagggggacagcattgcgattgtgtgctaggaaggcaagaagccatccgatgcaaagactgaatgcataccgcttgtcttgacattgcaccaggcgggggatgtgcgaatgagcaatgcaggttcccaccccttcaccaaaactcagccccactcacagccagccacttgggacgcatccaccaagtccaggctgtcgtacagcgcaaggatctgcagagcgctgagcgtgtacagcaggtgcgcgtcatgcttctcgctgccggcgaaccctccgctgggtttttggcaggacatcacccatgctatcagctgggccttgtccagtcgctccggctggcccaggatgtgcaaggcagtggcgccccagtacaccccgctcatccgaaagtgctccgtggcgtggaactcgaagctggtcagatcctgcagggtagggggtctgatccagtgtgggtctggggtcgggtgtgcccgaagtgatctgtaccggaaatgtgtcgaggaagtcaatgcgagccgtttcgatgagggagcatgcacaatcagcctggtgttaccttgctgactttctcgatataggcagcatgcttctccgtcgcgagggcgtcgggttccgctgatgccatgtcccttgcgccaactcgcgattggatggtgccgccagaacaaaactcaatctctgacttccctctctttcggtgattcagagagcaagtaattacacgggttagaagtcaggcatggatgcatggcggagtttgtgcggagtttgtgcgggcgtgtggggccctgctgggcctgctggccccccccccggacccctcagtccatgcagcaccgctgcagcgnnnnnnnnnnggaacaaatctcaatctctgacttccctctctttcggcgattcagagagcaagtaattacacgggttaaaagtcaggcatggatgcatggcggagtttgtgcggaatttgtgcgggcgcgtggggccctgctgggcctgctgccccccccccactcccctcagtccatgcagcaccgctgcagcgccgggtccaggaaggtgaggctgatgaacagcgcctcctccgtgcggatggtgcggctgccctggtggaagcaggtgttgacgtagcggtcaaacagctgcgccacatcccggtacttggccgcccaggcgtcgccgcgcaggcaggcctccagccccgccggcccgccgaacaccagcagcgcgtggcggtagggcctgaactggagctcctcggcgggcgtgcactcgccgcgctcgctggtgcccacgcacaggtcgtacccgccctcgaagggcgaggcctggagcagggcctggagggagggcgccacgcgcgtcaggtagccccaggcccgcccctccttcgcgcgcgggtcggtgggcgctgccaggctggcgcagtgcaccgcctggccgtgcacctggccgagctgcggcgctgcgccgacgtgcagcgtgacgcgcgtcccgggggccacctgctccgggatcagggcgtcgtgctccaggccgatgtccaccaccgagccgtcgccgggggcgctgtgccgcaccacgccctcgcggtacgtcccccactcgtgcgtgcgcaggtggtgggtggcgtccaggggcggcatcagccccgcaaacttcaggtcggggtgcatgggaatgagcgccctacgagagcgtgggggtggcgggtggggggtttggggggtaatgtgagggcaggccttgggtgggagggggagggtggggggtgatgtgacaggagatgcagggctgggaagagtgtggccagggcaaactctttgggagctgggctcgggccggcaagcacgagcgaagtcggcgtcgagtacttcctggaggaacgaagatacaccttcccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggctgggaacgtcgcggtcggggcgctcgacgtcgtccagcacgatgacctcatctatgttaaagatggcagcggcacgcgcgatctggctgnnnnnnnnnnatgggagctgggctcgagtcggcaagcacgagcgaaatcggcgtcgcgtactccctggaggaacgaagatacaccttcccggcaggcccagcgcccatgccttccccccagcaagcaagcaccacctccatgacccacccccaacctacttcctgaggtactggggcgtctccatgaactgcaggatgcgtgccagcagggcggcagcggggctgggaacgtcgcggtcggggcgctcaacgtcgtccagcacgatgacctcgtctatgttgaagatggcagcggcacgcgcgatctggctgnnnnnnnnnnggtgagggggtggagagggaggaaagcgggtctcatggggaagcttgagggtccctcagcatttgttccaactgcaccacgccattgcatggaaagcggcaccctgccccaggcctcactctgccaccgccgacggnnnnnnnnnngccagcagggaggccagctgctggttctgggtgttctctatgcaggaggcacccaccgccatggaaatggtggaatgccgcttgggagccctgtcgtgaggggatggagagggaggattgcgggtctcatggggaagcatgagtgtccctcggcatttggttcaactgcaccacgccattgcagggaaagcggcaccctaccccaggcctcactctgccaccgccgacggtgtcgggcccgacgggggcgcctggcgcttcaagctcatcctatgattgaatttatgggatttaaactcgattcatataccgctttgtgtagtatccgtcgttcgctgcagctttgcattcgcgaagcccggctcctccgagctcgcgcccaagtccacccctnnnnnnnnnnaggccaggaggcctcgactgacgctaccacccatttctaaatagtattagggaggtgggttgacggacaaagtctgcgttggtggccggtgtaagtacagagctgaagcagaagccagggaggggggggagtacctttctttcacaacattttcgccccccagggacaagtcacaactcgcacttctaacaacatttacccctcaaacattgccaagtaagctctttctagaactttagatgcttgttcgcggtgcgagaccccctcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcggtccagaggggggggtgccaggggagggcagtcccctcctctcgcctgcnnnnnnnnnnaaatatcattggaacggtacagtatcgagtgcaacggcgatggagctttgtctgcgccagttggtcgtgcccggggcgtccgcccgtcgaggcctcacgcggcccaaaggggggggtgctaggggagggcagtcccctcctctcgcctgcccgtccggaggcactgccgccccgcac

SEQ ID NO: 28024 - DNA, 61 bp, Chlorella protothecoides
acacccacatgggttccatcaaggggttgcccagcttccgccttccgtttttgcccggaga

SEQ ID NO: 28025 - DNA, 66 bp, Chlorella protothecoides
attgcaagtcagggatgtttgaggagagtgcaaagcatgcatgtcacggaggcgctcacagtccag

SEQ ID NO: 28026 - DNA, 61 bp, Chlorella protothecoides
tggagtctcggcctgcagagcccctgcttgctgcaaggccgccacggcttttggtgaccga

SEQ ID NO: 28027 - DNA, 125 bp, Chlorella protothecoides
tgtggggaggtgacctcgagcattgatgcactggtttcattgcaacagcacgatctcggcatccatgccccccacccgacctcggagccctgagaccgtcagatgcgcatgcctgcaacacaccc

SEQ ID NO: 28028 - DNA, 100 bp, Chlorella protothecoides
gctgccgggctgctcggcggcgagatacgtcggcgagcacgaggctcaggtggggattggatggcatgcccggggagtggggagaggaggggtggaggga

SEQ ID NO: 28029 - DNA, 61 bp, Chlorella protothecoides
gcgacgcacggcggcggggaggaccaggcgccggtggccccctcccccctgggcgacgtga

SEQ ID NO: 28030 - DNA, 76 bp, Chlorella protothecoides
gtgcctctggtgtcgtctgatggggaggtgtgtgtgatgaggggcaatctacttgtttgtactccatgtggcatgg

SEQ ID NO: 28031 - DNA, 122 bp, Chlorella protothecoides
cggcaacatcctggtccggctggagacgccagggggccgcgccgtggcgcgcgccgtcgacgccgcgcgctccttcctcaaggagacgggggtgagaggggggggtgggggtgggaggagag

SEQ ID NO: 28032 - DNA, 113 bp, Chlorella protothecoides
aggaatgtctcttgtgcagagtcgcagcgcaggtcggcgtctcactggaccgcccgttacactgccgtgtccaaatgcacaatcccacccccacaccccttccccgcgagcac

SEQ ID NO: 28033 - DNA, 80 bp, Chlorella protothecoides
gatgcagaagaggacccgggcctgaggcccagccatgcgacgagctccgggccgcccgcccattagggaggccatcatcc

SEQ ID NO: 28034 - DNA, 61 bp, Chlorella protothecoides
cggggtcctgctctacggcccccccggcacgggcaagacgatgctggccaaggcgcttgcg

SEQ ID NO: 28035 - DNA, 189 bp, Chlorella protothecoides
gccagcagagcttggcgcacgcctcgagcacgtcggcagccatgggagcctgccactcctggccctcccggcacatgaggaacctgcaataatgacgatgcgggtcaaggagtaaaaattgacggccattgacattgagcaggtatcaaggaggtcatacaggccctattgaagtcgtggactgcgctc

SEQ ID NO: 28036 - DNA, 61 bp, Chlorella protothecoides
gcagaggtgtcttgcagatctacaccgcgaacacaggccactccttttattttgtagtcgt

SEQ ID NO: 28037 - DNA, 153 bp, Chlorella protothecoides
gagcgtgacggaggagaccctgcctgcctcagggcatggttatgtcagcgccggaagctgggcagaacctgctggtgcctgccctcccacatgtgcagcggccgacccccacttcctcccgccagacgcacaggtcaaggtgtgtttggaaag

SEQ ID NO: 28038 - DNA, 61 bp, Chlorella protothecoides
agatctggcagcgcgagcgtgttgcactggaacccattattgctgatagcgacgtgttgcc

SEQ ID NO: 28039 - DNA, 130 bp, Chlorella protothecoides
gatgtccttcttcagaccgtcctgtaatgataataggcagcttgttcatcgagaaagggctgggcaccatgccgacagccttatggacaggtcgggtccccttcggagtcggtgctgacctgtcctgcct

SEQ ID NO: 28040 - DNA, 68 bp, Chlorella protothecoides
cagcctcccgcggtgggccaccccagcctgaaaaggtccaaaccagggtcgttacccctccccattcc

SEQ ID NO: 28041 - DNA, 364 bp, Chlorella protothecoides
ggtggtatactgcgcatgctcaaaatggattgtgagtatgtctgcagggtcatgcttcgaaccagagattgtctctcatgggattccagccacatttccatccaaatatactgtgaatggcattcaagaagggttcaggcggtctccacctgtcagtagtacgtccttgtccctcatgtcctggatctgcgtcggacattgcatcgtgctaccccgagatccctggatgtcccacggcgagatcccgaaactcacacaccccgcaggccgtttcagagaagaaaaacaacctcaaatgagaaaccggtatcataatcaatatccagtcacagtccgcagcttttccgcgatcaccaactcctct

SEQ ID NO: 28042 - DNA, 147 bp, Chlorella protothecoides
ggggcctcagcaagggtgaaccctcacaggacaggacggcgcacccctggccctctcacaaggaaggaggcaccgtgagaccccggtacatgacactcacccgaccaggcggtggcgtaacaggggctgaggaccacggtgttgaac

SEQ ID NO: 28043 - DNA, 72 bp, Chlorella protothecoides
atcgctcttgtccattgagactgaggacttgccctgacaatcgctgtttcagtaacttgacaccctgtgcga

SEQ ID NO: 28044 - DNA, 262 bp, Chlorella protothecoides
gggggggggggggggggggtatgagggttgggccaggggtgctccagtgcaggctgtaagagtgaatggcatgcttctctcccccgtgccatatggagagggtgatgcatgttcttgtgttcttgcaacgggattgctgtgcaggtttacccgggctctcctggccttgtggtgatgccatgtgccccacccccccgcgcgcccggcccctcccgcttcaacctctcctacaccccccccatttctccccccccccccccgt

SEQ ID NO: 28045 - DNA, 115 bp, Chlorella protothecoides
cctcaggtcgagatggaggctgcatctcccttcgagagtcatgatgtatggatcctggcccccaaatcaagaatctgccctccatgccacctacatcaacgtgggccgtggaggc

SEQ ID NO: 28046 - DNA, 72 bp, Chlorella protothecoides
gcaggtgcatcggatgttttactcttttgtttgagaaggattgcattggggtgattctccaggacaccgagc

SEQ ID NO: 28047 - DNA, 117 bp, Chlorella protothecoides
ggtagtgggtgtaagtgtgcttaccgccttaaactgtcgcatcctgtcatgaacagacaacaagacccgaatgttcggatttcctaagttcgacagaacggctcaccagcgtcaaaa

SEQ ID NO: 28048 - DNA, 89 bp, Chlorella protothecoides
gtgcaagagtaagccaagggcagcctgcgcaagcatggacaaacgacacatgccatcggggtggctacctgtctcccaggcctggctga

SEQ ID NO: 28049 - DNA, 61 bp, Chlorella protothecoides
ccacccagtccatccgcaatcagggactgtttgaactcggagcagtgatttcggtgagtat

SEQ ID NO: 28050 - DNA, 169 bp, Chlorella protothecoides
aaagcatgcccaggcttgggcaatggatcggtttgccacacagaaggcgctggcagtgtcagcagctggctgagggcatgtgccccacacatcatctggaacaagagccagagaggccgtcaccagtacacgcgcgctcctctgccccattcccagcgccacgacaccc

SEQ ID NO: 28051 - DNA, 70 bp, Chlorella protothecoides
cagcggaacccggcacgcgcgtgtggtgggcccatcgacacatgaggaggatgtctcggacgtgaaagag

SEQ ID NO: 28052 - DNA, 61 bp, Chlorella protothecoides
gatccgggtacggtgggcgggggagcgctgtgcggtgtgcgacgccgatgctgacaccgac

SEQ ID NO: 28053 - DNA, 61 bp, Chlorella protothecoides
ccctcttgttgccttgaacctgcttgaaaagtgggtgcctcgcccagacgccaaggcctcc

SEQ ID NO: 28054 - DNA, 61 bp, Chlorella protothecoides
ggcatccccattgcatgcaatgggagcggtgaggttgcagggcctcctgtacggcaaccag

SEQ ID NO: 28055 - DNA, 61 bp, Chlorella protothecoides
ccgtttcaaaatatgttatccgcgtgtttacttcgagcataaagaggataggcacactacc

SEQ ID NO: 28056 - DNA, 97 bp, Chlorella protothecoides
tggaaatgtgaggagtcggttgccacgccctgctgtagaccttgatggttgagatgaacacgatataattggtcgatccatattccatcctgtcgag

SEQ ID NO: 28057 - DNA, 144 bp, Chlorella protothecoides
acgaggcccggcgctggtcttcacgagcggggtcctccgatctgccgcgggcagtctgtctggcgcgggcccttgacaaaacgagacgatgcgggcaaggaggtgggcgcgcgccgggcgcactcctccccatccccttttccc

SEQ ID NO: 28058 - DNA, 61 bp, Chlorella protothecoides
ggatccttgagatggctgggagagggtgggtgggcgcactgcgacggcctccagcggctcg

SEQ ID NO: 28059 - DNA, 125 bp, Chlorella protothecoides
tgggatgccatggagcagctctggctggatgtgacgtacaggtgactgcagcactgagggaccaagttcatggtggaatgcttcgccatgctggacaggacccgccattccacatctcctgtctg

SEQ ID NO: 28060 - DNA, 75 bp, Chlorella protothecoides
ggccacctggtcgcgagtggtcgggtgagtcacaagagggggctgattggcgccttgggagcgattgcgttgaga

SEQ ID NO: 28061 - DNA, 137 bp, Chlorella protothecoides
agggcagcatccatgtgccagcagcagcaaacacccctagcctggtctttgtcccaatcttgcaggccgttccccgttgggtccccactctgcttcaaccccggacctcacctccgccattgggggagagggactcc

SEQ ID NO: 28062 - DNA, 124 bp, Chlorella protothecoides
agctttggcaagcagtgcgtggtgtgttcgccccctccgacaccattttgagtccgggtcatgagctgttctgcccggccccagccccttcgggcagccagtgtgcagatctgccccccctaac

SEQ ID NO: 28063 - DNA, 164 bp, Chlorella protothecoides
cccagccatcagcgtcctgtgacaagggggagcgggcatggttgagggcctgcttttgaggggcagtctcctctctcatgattgcctagcgcagatacacctctggctcgatctcgcatccatcgcacacattgaacttctccagattgccacacgtgacacag

SEQ ID NO: 28064 - DNA, 61 bp, Chlorella protothecoides
gtgtttggggtggcatcctgtatgggcgggtgggaaaagcagcgtggaggttgttgcagaa

SEQ ID NO: 28065 - DNA, 344 bp, Chlorella protothecoides
tgctggaggtcatgcagcagcgcactcgcccggcaaacacccgtggactgccgctccgcgacgcgccgcctgcaagacggagtgccctgaggcaggcacagcaggcacagaggcagccctgatgtggagggggtgtatgcggaagtgcgacatgtgactgcatggcttggcagggctggagagagatccatgccagaattcctatggaactctcccctgggcaacttcttgttaacaatacgtctttgcgcgcaggcaagtgcaccatccacatgagttttccagtaggtttctttttgctcaacactttgtaatgtgttgttccctggtagtcatcactagtg

SEQ ID NO: 28066 - DNA, 163 bp, Chlorella protothecoides
aacattgcatcccatgtcctaagcataacacctacctggaaggtcgcatatcgcaataagatcctggagcaatacagcatccttgctgctgctgaccttctgtctcttattttgccctcctggtatcaacggaacaggatgttatggtttcgtgatcgattga

SEQ ID NO: 28067 - DNA, 155 bp, Chlorella protothecoides
ctcaacgagagcgacgagaagcaggcaagttgtcgcaggggagttgaggggggggagcagtgcgcagtccctggatttctctccacgggtggggcgttggttcctcgtcgtgcactgggccagtgggtatgttgcttgcggctcatggagaccct

SEQ ID NO: 28068 - DNA, 61 bp, Chlorella protothecoides
ctttgacgtgtccatcctggagatctccggtggcgtgttcgaggtcaaggccaccaacggc

SEQ ID NO: 28069 - DNA, 93 bp, Chlorella protothecoides
aaggagaacatggagtctcaggtgggtgggaaaggtatgcgggaagggatgtgcatgggaatcctggccttgggtttatgtagtgtgaaggta

SEQ ID NO: 28070 - DNA, 164 bp, Chlorella protothecoides
aagtcaaaaaaggtctcctccaccgtcctcatggacgcctgggagttgagagaggtgccaatctggttgtcggaggtccgggcacctagaagagaggagttgttcaccacactccccgaccccagatgctttcgcgtgccctgtccccgcccaccatggtgtag

SEQ ID NO: 28071 - DNA, 61 bp, Chlorella protothecoides
agggcggcgcggactcagccgatggcgagcgcgagcggcgccagctggcgcgggacctgct

SEQ ID NO: 28072 - DNA, 79 bp, Chlorella protothecoides
ctgccttgcagctcacgcgatctccttgttggtgatcgagcaatccctttggtgcagatttgggtggtgttgctggaag

SEQ ID NO: 28073 - DNA, 12344 bp, Chlorella protothecoides
  modified_base (887)..(896): a, c, t, g, unknown or other
  modified_base (1585)..(1594): a, c, t, g, unknown or other
  modified_base (1850)..(1859): a, c, t, g, unknown or other
  modified_base (3158)..(3167): a, c, t, g, unknown or other
  modified_base (4687)..(4696): a, c, t, g, unknown or other
  modified_base (7790)..(7799): a, c, t, g, unknown or other
  modified_base (8031)..(8040): a, c, t, g, unknown or other
  modified_base (9182)..(9191): a, c, t, g, unknown or other
cccccccccccccccaagccttcatccccactctcatgcctcttgggccgccggcagcttcacgcgtgccaggttgcgtgccgagctctggtagctggccagcaccacgatgtcggccacctggacgtggggcgggcgcgtcgccgcgtagagcacgttgtcggcgatgtcggcggcgcgcagggggtcgatgccggcgtagacggcggcctcggcggccaggtcgcccttggtccgcaccacgctgaactccgttcgcaccgcgcctggatggcaagggggcagggtgtccgagagcgggtgttgaatgatggctagatgaggatggaagagggtgtcggcggtaaacgggggaaggcatggcacagccagctctctgtggagcaaactggacaggtgcaggccccaggtgagaccccagagggggccccattcctgcagtcaagttgctcgtggctgatttctggacatggggctcccggtgccaacaatgggaaccacaaaccagccctgccaacaacataccggggctgatggaggtgacgcggatgtcagtgccgttgaggtcgtggcgggcggccttggtcatggcgtcgacggcgtgcttggtggcgcagtagccgctgccgcccacatacgcctcgtgcccggcgatgctgctcatgttgatcacgtgcccgcgattacgctgcgatggggtgagcggtggctgaggggttggcaggcggactctggcgctcaggtgggtggcggagcacttgaaggagggattctggcagggtggcagtctgggcatggcgatcacgagtcacaccccgcccctcaggcttccgtgcgttcgatggcacgcagacaaccccacatgcacctcctcaccttcaccatgnnnnnnnnnntcaggcttccgtacgttcaatagcatgccgacacccccacatgcacctcctcaccttcaccatgcccgggatgaaggttctacagaaagcaagaacggagagaatgttggtgttgaccatcgtggcgacgtcctccagcaagttttcgtggatggcgttggagcccagagccaggccggcattgttgaccagaatatccactgccttgaagtcctccggcagccgatctggcagggaggtgatggcattgatgctctgtacatccaaggactcaacgtagatgggcacctgggatgcgaggggggtaagaagtccgagcgtgagctttcgtgaagatcccaggtacttgggtatcaggcggcggcgcaagggcacacaccaccgccttgggttcatgattcccgtaccccccagcaacctacaagtcatcaccgccaacacacgcaaaccttgcattcttgagtcagcttgtctttcaaggcttgaaggcgctccaggcggcgtgcgaccaggatgaggcggcaccctgcctcagcaaagcgccaagcacaggcctccccaatgccagagcttgcccctgcaccccatatgcacgtgtggaagcatatgaaattcccagatcaaaggttcgatatgcacctcaaatccaattttgaactatgcatgctctagagactcacccgagatcnnnnnnnnnnggggttccaagcatatgaaattcccagaccaaaggttcgatatgcgcctcaaatccaatttaaattatgcatgctctagagactcacccgagatcagcaccgtctgatcgcgaacgctgtaggacttatacagtgcggacgccatgtcgagtccaaggacaaagaatggagagggcttgtctgaggtgtggatcacgtcaagttcaaaattgtgtaacctcagagttttcttcggacccccataaacaagggttgnnnnnnnnnntgctgtaggacttgtacagtgcggacgccatatcgactccaaggacaaagaatggagagggctcgtctgaggtgtggatcacgtcaggtatgaaattgtgtgacctcagaattttcttcggacccccataaacaagggttggttgacgtcttgatctgcgaaggagatggtgatgggtggcaagagcttgcttcgcgtgctgggacctgttcatgggttgtgagaagcactcggcgtcattgtcctgcacctcttcgcacgttgcgaccagaacttgtatattcgaatcgtctctcttttctagtactgtcgctcctgtcctcctactcgccctccgctcgaccttgcgggcaccaccacgggacagcggggcgggtgcctggctgccatgacggtgtcgacgtcctgcacagcactggggcggtccatcaccagccttgcgcggttccagctcgactcagctgcgtgctggagcttgcagcaggtagcgcactacgccaaggcctcgggagggtctggtgggggtggccacgcccagaggacgaatcgcctgctcaaggtcctagagccgcagcagacaaccgcagtggcacgaagtctcgaggagctggaggatgcaaggcagcggtgcgaggggtttgggcttaggctgtgtgtgtcactggcacccaggctgggtgagggccaaggacattgctgtggaccctgccaatcctctgacgcccgcccgttttcgctgccccaggtcacgggagtacagccgtctcaagatgcggcagcactgcgcctggcaggccgacctgtcaggcaagctgaagctgaagcaggccgcgctggcggccctgcccgaccacctgcgggcggcggccgaggtccccgacctctccctcttccccctcaaccgcaacgtgtggagggagaccccccccgcagaggccaaggtggtcaaggccgcggcgcacacctcgcggacgcgcaacatcggcaccaagcgccagggctaggcggcgtggaggttgctgacaaatggtgaacgcttttgggctggctggcctccatggatgttgcaccgcgaatgtcataggttcccgccacatgctccactgcaacataaaccgggtcctgtatcttgacatgctgcaaagaacaagcaagagctttacagagcgtagagcaggggctggggcggacagatggtgtgttgctagaggtcacgctcttggcttgcacttgcggggtgagaccctcccgccaggaagggcctcacatcgcagcagcgaggactgcctgcacccaaannnnnnnnnncgatgtgttgctggaggtcacgctctgggcttgcacttgcggggtgagacccgcccgccaggaagggccagtcacctcgcagcagcgaggactgcctgcacccaaaggatctccttggaggccagagctcgctccctctccaccccctctcgaaacaaacaagtccacaacacactcaggtgatgacggtgggcttgtcgcgccccgtcagcgcgggcaggtccgacagctccagcgcggtggcgatgatgcccgccagcacgtcctgcgcgtcgcggtcgaagtcggcgggatcgtcgcggtaggtctccacgtacatgcgaatggtggccccagcgctgccagtgcccgacagccggaagatgatgcgcgagccgtcccggaagacgacgcggatgccctggccctttgccaccgagccgtcgatggggtcggtgtaggcaaagttgtcggccgtctccagcacgcggccgcccagctccgtgccgggctgcacgttgtcgatcacgctctcggtcaggtgcgccatgaccttctctgcacgctcgctctccacgccctcgtagtcgtagcgggagtagaagttgcggccgtaggtgcgccagtgctcggtgaccacgtcgcggacggagaccagcgccgcgccctccccccgcccctcgttcttggtcgccaggatgctgagccaggccagcaccgcccagagcccgtccttctcgcgcacgtggtcggcccccgtgccgaagctctcctcgccacagatggagcactgccccgcgtccatcaggttgccgaagaacttccagcccgtgggcgtctcgtggaagggcaggttcaggcgcttggccaccctgtccagggcgccggaggtgggcatggagcgtgccacgcccttcaggcccgccgagaagtaggggatggcggcctgggcgttggccgcgatcaccgccaccgagtcagagggggtgacgaagaaggagcggcccaggatcatgttgcggtcgccgtcgccgtcggaggcggcgccaaagtcgggggcgtcggtgccgaacagccgctccaccagctcgtgggcgtaggtcaggttggggtcggggtgcccgccgccgaaatcctccttgggcacgcagttgagcagggcgtcgggggaggcgcccagctcgtcgacaaacagccggctggcgtaggcgccagtgacggcatgcaacgcgtcatacacaaagctgaagcgggggttggcgaagaagctgcgcagcttggcaaagtcaaacacctcctgcggaaatgggggggaatggtgagttggggtcgggaggatgggtgggggatgtgtggctgctgatgtagcagagaaggcttggagatgggcacaggtcaggaaaaggaacacaccattcgaggggtgtgtgcatggcatgggaactgagaccatgatgcatgccccctataacacccgctagccgatgcaggaccacaccctcaccctcaacccaacccaccctgagctcgtcaaagtagtnnnnnnnnnnggaaggcttggagatgggcacaggtcaggagaaggaacacaccattcgaggcgtgtgtgcagggcatgggaactgagaccatcatgcgtgcccccctagaccaccccgcgagccgatgcaggaccacaccctccccctcagcccaacccaccctgagctcgtcaaagtagtcggtggtgtagtcgatgacctccacctcaaagtccccgaagctggtggtcccaagcttgctcaggtccacgtccgggaagtcggcgatcttcagctcctggatggactgggtgaagccgtagatcttgtcggtgatcttctccggcgcgggctcccccgcgctgtagttgaacttgatgccccagtcctcatcggggccggcggggttgtggctggcgctcatgatcaggccgccatagagcttgcgccggcggatgatggccgacatggcgggggtggcggtgatggcgtccttgcccaccacgaccttcttcagcccgttgccggcggccagcttcaggatgatctgcaccgcctccttgttgaagtagcggccgtcgccgcccagcgcgatggtcttgcccttggcctcctcgcctagggccaggaagagggactggatccagttggccaggtagttctcgctctggaacaccttggtcttcttgcggaggcccgaggtccccgtcttctggccctcgatgggctttgtgggcttggacaccacgctgaagccctgggaaggagggggtgtcggtgggagggtgggccagggcacaccctggcgtcggagggaagctattgccggtgctctccgggtcatgagatggcagcgagacccactcgcacctgggtcgcggcggatgccatgacgaagggtttgtttgatcgatgaggccggagagcggagcgacgggtcgagtgcggtcggggcccggttgagaaggcaggtgcacgcgatctgctgagcaccaggagagaggggatcggagcgggacgtcaaatgaggacgcagccggtgtgatgtggggtttgaatatgccgggtatgggtgggacaagtgctaccatgtccaagcaagtgtctgggccgggcggggatgcaacatgggtgcgtgatctcactttctacacccaggcatcctccaccccgagacaagccaccaagggggaggctgtaactttcatggaccagcgtggcagggagtgtggctgaatgaaaagccactgttgcaacgcaaagggccctgctcacgccctctcgagagtgtatgagaccggtgcacaaagctggaagaaggaggtggcatacagcgccttgccagcaggatcctgccccgacattgaagcaccctcaacgtaacccacctgcaagttaagcgcgtatccaggattttgacaccagcaattgcagcgctcgtattcacgagagcctgcattctcatcggtggctttgtgcccagcgggcgatggccaaagcttcagcaaattattgaggagtaactcaaactcgtatcgagcaatgcagtgcctgtatatattgaaagtactatgagggtatgtatgccgtgacggccaagaaaacccgtgtcggcagggcctcggtgcattgagttcctcagggacgtttcgctgacgcaacccccgagcgcgcgcgttgatgggtgcacacaggataaccctgattcaatttgagccaggggcaagattgaaaccccttccgaccaagcctgtgtcacttttgctttgagtgctgtatattggcctataaaggaacaccttcaatgccgtgcggctcaagcacactcgcattcactgagcaaagcacctgtcccttggtatgctgtcctcagcctctctgctttctggtctgtagcagtcgcctcctatgcctctccatcttctccctaacccgtcgggcaacattggtggaacttcctccgctcgaggataggaggtggccagagtccagtgcttggtcgccgccaggatgggagggagcgatctccttccaatgctctgtgagagctcgtactgctggtgcagctttgacggcgccgctccagtctccaacttgactgcctgccgcaaccgacgtggcgcatcgggcagtgcatgggccatcgtccgtttggatctgcgcatcccgcctcagaggggtcaggcaacactggacgccaacatctgcagggtgagggtgttcatgacaggacggattggacttcacaaacttgtgggaggagaaacaagcagaaccttgctccatgctgcagaaatccaggaagatactgtgttaacatgaatgctacatacctcgggtcctgctcactgcagttcgagttacagcgtccacaaccgtcgccatgtcctctcgtagacccttcacaagctgagaggaggagcatggatggaagtcagtgtcaatgggagatatacttgacatgggacagagtgatcttcagggagagaaggggtgacttgcgtgtttccagagatccagcgacgtagatgccagtcattgcaagcccctccatatgtcacagcccggttctacagatcccagcggacctcttgcaggtcaagtcccatatcttgcagagcacccaatccctccacagctgcacatgtctgctcgttggccttctggaagtccttctcaagacgctgcacatgctcctgcagggagctcagctgcgcactggtggtatggtgggtgggtaccgtgttggcaaaggtactgattgtgggagtgatcagtcgctgtcctgatcggtgcacattctgcatggtgaagcaggcatggattttccaggtgccaggcggagattgcacacctgaggctcgaagagagacctgtgtccatgagcccaagattagcagaggtattgcccaatgcccttgcgactgcggctgccagcccctgaagaaaatgtcaagttgagttgcagtcagggtgtgcacgcaacactgactgcaacccgaaatggcagcagacatcagaaccttgccgcacagtacaagcgaaattgtcattgctacgctatccaaaagtttgtcgccaaggcgagcactgatgtcacctgggaaccttgtcgggtctgatnnnnnnnnnngcttgccgcacagtacaagcgaaattggcattgctaagctatccaaaagtttgtcgccaaggcaagcactaatgtcacctgggaaccttgtcgggtctgatggctgtactcttgggtgtccgctcccataatggcgccagggtgatccatgtcttgagattgctgccgtgagggtgcatacgatggaatgatccttagatttggtgtaaggtacacacactctaagagcacnnnnnnnnnnggattgctgccgtgagggtgcatacaatggaatgatccttaaatgtggtgtaaggtacacacactctaagagcaccgaggcctagaggggtagactcaccggcatgagggacatgggtccccctcccgttggctgtgaatagctgtggttcatgcagcgcaggtacttggccgcgctcgagggagccggcatcggctgcatggggatagagagtgactggttctgactgttgaaattcatgccaaaaagttcatgcgactcgtctgccgcccctgtcccaccttgcttgctgattcgaggcctgtcgacgtgggaaccggaccccagtccctgtcgggctgggagagaggctgcgactgggaggtaatagcaccatctagacggggccctctcatcggtcgctgtagccatggtcgcagaggaccatccatgcctctctgtacgacaaggcaggcttatcaagtaaagagcggtgactcgtcgacaacgaaagaatcacgacccagccgatggaggtttttgaagggcaccgaaacctgcacccactaccagcacattgcgggacacatgtaatgtaatgactacgttgctcgtgcaccctccttgagctttaatcaccttttcatggttgatatgcgtatgtgaggagtgttaactgggactggaaaggatggcgtgtaccaccatgcggcccagtatttagatgctcatcaagacatctgcactgtgttaaacgcatgagacggggacaattcgacaatgtcacgcagcggggatggacctgctgtatcagcgcctgttatcgacgaggtatgcggtcttgccacgtcggggccaggcgtcgctcgtcaggtcatcacaagtccatacgcacaactccgacgcagaaggacatcagcgcctcgctcaatgatgtgctcctcgagggcatatatgccgcaataatggagcagcttgtaccccgctcacaagctctgtctgagagtctcaagggcctgcaagccacatgctcatcggttgacagagcagcaggtcaggggagatggttgggtgaatcaagattatattcagagcggtgggaaagggaacaccagcaactcagcacacacttagctcctatcgtctgcagcggaggatcttcnnnnnnnnnntagagcggtgggaaagggaacacctgcaactcagcactcatccagctcctatcgtctgcagcggaggatcttcatgccactgagacagaaatgcgtcgattggctggcttggtcgagcagtgcaggaaggagctggatgacgtgctgtcgaaaaaatgagaccccctcggaatcaatctccgtgctgcgtttccctcagtccggaacactcgaattatatagccaggcatacaacaaacagtccgtgaagctgaactttcatatgtgccatgtaaacaaaaccccttttgcgtccagacgaggcacatgtccctctcccaatgccgacagcgctcttgcgtccttatgggcatccttcgcagagtaccttctccaccatgcgccccgcacgagttggtccctcgataaggaccggggttccctcatgcacattacggactcctgcggcaggtaggaagggggcaatgcccttgccaagtctcgaccagccttgctttgcaccgtcacaaaatgcatggtccccggcacaccccgagcgcaggtagccagcctgtggacatccgcttcgccatccctttcaagtgccacttcggccagcatttggcggtgatcgggggacccaggcagctggggcaatgggaggccgctgcggcgctgcccatgacctggcaacagggcgatgtctgggcggcctccctcgcatggtgcgccggctgtatggggcagactgccaggcaggggtttgacgaagcgaacagcttcagccttgggagcgccatgctggtagcaaaccccatgcgggaagttgttgcgtgcgtcgctcgggcattggaggagcagtttcatcgcatgaaccgcaagattgcccccccttccccatttttggtgcgccccgccatctccctggatctgcatccccaatcctgccatgcactgacccgctcgattccttagggatgatggcggtacgctggagtacaagtatgtggtgcggaacgacgacctcacggtggcggggtggaaaccagggccaaactgcgagctgcagctgcccaccggctctccgctccgcgccgtgcgggtgtgggacacctgggacgggggctgccagacggtggaggtgtgctgtgtgcgggtgtgggtggtggtagtggtggggtgaggcgctggaccagtgacatgcttgaccgccccgtgggggtgggcagcccggcacaggcagcgctcagcctcgcaagactcccacccactgccctgctcacctcgcttccctttgcccccctctcacacagctcgaggtacccgaggcaggcacgtccaagccagccctgcgcaggcccaaggcgagcggggtttgccacatctggtggcgaggtccccgggctggggagggatcccgcggcagccgccgaccccagcataccacagggcatggatggccccttcgccggggctttggggcctgtgcacctccaatgcccacccctcgcccttgctgaaggccatcgcgtcagtaccataccccaaactcaccaaccccatgtgacagggttcgctgggcgtgctctccaaggagaccctggtggcgctgcagcggctggccgacgcgctggaggccggggaggcggcggccgccgccgccgaccctgggtcgcccgaggcgctgagggccgacgccgagctggccagcgcgacgcagcatgcgctggccatgatgcgcgctgaggaggcgctgggcaggctgccgaggcgcgggaaagcgcagaacgggcggggccgcggccggggggcggtgtgaacccgcgcggcggtgattcggactggcgtaccattccgaggcccatgagaccccagctccagccatggatctctctggctgtgcccgcctggcatcagccaggcctgcccttgcgccatgcaccctggcgccgacctcgccgaggccgccaaacctctgagccccaccctggcatatggtggtactgagtcattctacagggctgtcagaccagccgttcactctggaacactgcacaaagggggatgaggagggccggaggcatcgggcggggaaaagctctgcatcctggggccccaggacgtcaagtgggcgggggagggtccgctgtcacatgccctcggtcgcctcttgaatctcttgcagggtgatggcctggtcctccccccgaaagtcgttgtcctcggtgaggaagagcatgcagtggcactcctgcgggtcagggcgggctgggcaccggtgatgcaggcagacacacgaaacgcctgcccatgggcacaggccctggaaaaatcagacccggcgcatcaaaggtagggatcggcagcggtacaggccctcccttggccacccgtcacaagacgcgaccaccgttgcaccttgcgctcgcgcatcggcacacacggacagttccagaagccctgcgccacctcggcggccttgtcatcgtagtgccggcaggggcacaggggggcgccgtagtcggtcttgtgctccgccagccccttgatgaccacagcggtcacagacttgtcagaacagaagtaggtgccggtgctgtgcgtgcaaagggaggaaacgttcccgcagcccgagggtgggcgagccatgccggtggcaggtagagatggacggcatgtagcatgcagccccccgggaggccatgacgacggacctcgtagtcagcatggcccctcctccgtcacctcaccgtcgtgcatactgttctgagaacttccgcatcgcctccaggttcttccccggcttggcatcgctcacctctgtggtggtcgacagtgcgaagggagtgggacactgtgcgccgagcaacagatcatgcaggcttgggcatgtcgctgcatgaggcgcaggggtgctcacctggctccgattgggcggcagcagccctgatgccgtgggtgagaggggccctgcgctgcgagcggaaggcctgcccgaccttcacggggcagggcttcagcgagcaggggctctttgttcctaaactggcgacgttcatgatgcaaaaattcagtctgtagagcacttgtatggcgtgggtgtctacgttatggacaagccaacctcctcaaccgatgttgtggcttgtgcgcgctagaaagcggggttgattt

SEQ ID NO: 28074 - DNA, 6381 bp, Chlorella protothecoides
  modified_base (1052)..(1061): a, c, t, g, unknown or other
  modified_base (1698)..(1707): a, c, t, g, unknown or other
  modified_base (1906)..(1915): a, c, t, g, unknown or other
  modified_base (2109)..(2118): a, c, t, g, unknown or other
  modified_base (2386)..(2395): a, c, t, g, unknown or other
  modified_base (3008)..(3017): a, c, t, g, unknown or other
  modified_base (3358)..(3367): a, c, t, g, unknown or other
  modified_base (3873)..(3882): a, c, t, g, unknown or other
  modified_base (4416)..(4425): a, c, t, g, unknown or other
  modified_base (4938)..(4947): a, c, t, g, unknown or other
cccccctcccccctcccaggaccctgtcccccgccgcccgctacctgatcgcccctggcctgagtttcattgcgggcctgactgccgcgagcaactccgtgcgcggctggctggcccgcaacggcctgcgcggccccatccccctgcccgtgcccgtgatcggcatcgggtccctgacctccgtgggcacgggcaagacccccttcgtggagttcctggcgcggcactatggccgggcccacgccacgccctccctcatcctgcaggccggccccggcgcggccgacgagatcaagttcctggccgaggtgctggacgggcagcccgccgacgcggcgcccgtcgcctcgcccggcgaggcgcgcgcggcgctgaccgcacaccccgccgcgcgcctggtgctgctggacgacggcctgcgctcgctgcgcctcctgcgcgacatggaggtggtctgcgtcaactgcctggagccgctgggcaacgggcgcctgcgcccgcgcggcacgctgcgcgagcccgcacgcgccgcgctgcgacgcgcggacgccgtcgtcctgcaccacgccgacctggcgggggaggaggaggtggggcgcgtggagggcacgctggccgcgctggcgccgcggcacacgctcttcatgcgcacgcgcatggcgccgctgtcgctgcgcagcctcatcccacccgccgcctccctggacatgagcgaggcgggggggttggggggccacgtgtccctggcgcgcctccacggcgcccacgtcgtatgcctggtcggcgtggggctgccggcctccgtggaggcccacgtccgggggctgggcgccgcggccgtggagggcgctggggaccacccggaccaccacgagttcgagctggaggaggtgcaggccgccatcgcgcgcgtgcgggagctccaggtgaggggcgtcagtcgttgaaggggggtgggggcgaggtcgaggagcgggggtgatgcatggagaggcggcacacgcagtggtctgatggagcgatcactgggtgggtggctttgtggtatcacnnnnnnnnnnagagtgggggtgatgcatggagaggcgacccacacagtggtctgatgatggagccatcactgggtgggtggctttgtggtatcactggaccaggcagtggctgggtgtgtcatgacctgcaccaggacagctgcggtgtcggctctcccccgctgatccctgtcccggaccacattgcacccgcgcccctcaagagtttacccctctcccctcactcctgaaaatcccccttccccccaaaacaatgcacaggggacccccggcgtgcgccacgcctgcctgatcatgacggaaaaggactacgcgcggcagcgagaccttttcgaggccatcttctcgcagcacgcagccgccccggacgtgaccagcgggccgctggaggagggcgcgccgcgctggggtgcctacctcctccagtccgggctggaggtggtgcagcacgaccgccgcttctccggcaccaaggccgtgttcaacgccgtcctgcgcctggccaacgacaacttccggcagtgagtcgaggttttggaaagggtgcgggggtggacaggggggttgaagttcgtgtgtgtgtcgaggtggggcgtggggaggaggcggcgatggccccactgtatgacaacccacgctcaagcgnnnnnnnnnncgggtgcgggggtggacagggggtttgaagttcgtgtgtgtgtcgagatggggcgtggggcggaggtggcgatgaccccactgtatgacaacccacgctcaagcggccggggcgggggggtggacacgcacgtgcctggagtcccactcctgctctgaaacccttgcatgcgtgcacgctctggggttgcaacccttcnnnnnnnnnncgacacgcacgtgcctggagtaacactcctgctctgaaacccttgcgtgcgtgcacgctctggggttgcaacccttccagttacataaagggcggacaagagagaccgcgcgtgttccgcccgagtttctacaatgtgtaccaaaacaattaattgcatggcccccctccgcaggcgaaactacgtcttgtgannnnnnnnnngaggcgggcaagggagaccgcgcgtgttgcgcccgagtttctacaatgtgcaccaaagaaattagttgcatggctcccctccgcaggcgaaactacgtcttgtgaggcgggccgcaggccccagcggcggctgggcagaagttggctgcctccctcaggaggccatccagttttgtgtcttgcttgctccgtgctatatacactgaggcacaacaaggggatgtagatggaggggaaggcaggggacgtggtggtacaaagcgggaannnnnnnnnngtatacactgaggcagaacaaggggatgtagatggagaggagggcaggggacgtggtggtacaaagcgggaaaggggacgttggggttgccggcgcccggccgggccggtggggtcactgccgggccggtgccacccccggggcctgcgagccgatgggcgtcgcctgggagtccgccgtgcgcgcgatgtcgccgtactggatggcgcgctgttggaaggcatgacctccgaaagccgccgacaggaccgcgacatcgcgggaggtgcgcgcagcgccgtgcatggagtttagtaatccagcctgctggggactgctgctgatgggaaggtccagctcgaacgccatggaaatagggtcggtacgggtgtgtaatgaccctccagactggcctccgacacgatttgtggctcagcacgtatccccgtgaatcgcgtggtggcaggttgcgcgccacgcaccggggggtctttcccctgtgctttgtagtatgtacatgcatctgttgctccgttgtaatggctgaccctcgccaatccaataggctggttgattactgaccagatcaaattcacagaccatgtgcgagaaagcattcatggcagagagtcannnnnnnnnntgcacgtatgcccatggatcgcgtggtggcaggttgcgcgccatgcaccggggggtctttccccggtgctttatagtatgtacatgcatctgttgctccgctgtaatgcctgaccctcgccaatgcaacaggctggttgacgactgaccagatcaaatccacagaccaggtgcgagaaagcattcatggcagagagtcatgtaagcaaccatggcctacacagcttctgtcgcagccatcagcgctgtgccaggatctcggggaatgtcatccaaggaggcaccacatcttttcccaattcgttcccctgacagactttgatcccttcctttcgcacagannnnnnnnnngtgtcatctaaggaggcaccgcatcctttaccaattcgttcccctaacagactttgatcccttcctttcgcacagagattcacgcctctggggatcaggggtgctagggtatcgggacaagaccacttacctcagtgacgcacacccttaagaaagtgcagaacgtaagccagggacagcatcacagagtcaggtggtctctcagccggtgaaaaccacctcattgccagtgtttggcagcagcgatgcccggggcttttcgtccggagcatcgccgcctccgaccagacagcttgatgctggtgaaggttggcgatagcttatggctcgttgaaggtacatgatttgatggatcatgcgaagggctgggtgtgacatcaggctctggactcttggccacccgacaggatctcgagcatcaccctgggccctttatattccaccacgacacgcccctggcccgggcccatacgactcttcgtcagacgaagagcctctcgatgagnnnnnnnnnnggcttgatgctggatgaaggatggcgatagcttatggctcgttgaaggtatatgatttgatggatcatgcgaaaggctgggtgtgacgtctggctctggactcttggccacctgataggatcgcgagcattaccctgtgcccattatattccgccacgacacgcccctggcccgggcccgtacgattcttcgtcagacgaagagcctctcgatgagatcagcaaggagcagcagcgactggcggatgccgccttaaaagagcgaggcgaggagacgtcggatcgcgagaggcgcaagcccataaaccgagacccgacacagaaaaccaccctgaactcgtccgagaattacgaggtatctcctttccacttctccctgtgggacgaagttcagtgtggtatcccgtgtagggtgtcggtatgtggggcgcgcggccccattctctcctccggctcatcgccccactggctcacgacggcatctcccagcgccgctctgcgtgcatgacctcaccgggaggctcttcgtctggtnnnnnnnnnngaggaccagcagcgactggcggatgccgccttgaaagagcgaggcgaggagacgtaggatcgcgagaggcgcaagcccatataccgatacccggcacggaagaccaccctcaacgcgtccgaggattacggggtatctcctttccacttctctctgtggggcgagttcagtgtggtatcccgtgtcgggtgtcggtaatggggcgcgcggcctcattctctcctccggctcatcgcctaactggctcatgacggcatctccagcgccgctttgcgcgtatgacctcaccgggaggctcttcgtctggtgaagagtcgcatgaggcctggaccatggtttagtggtcattgaaatacggagggcacagagggtgaagctcatgatcccgccagatggccttgtatcgttcacagtcagatgtcaccccatgctctacgaatgaagccgtcatttcgagtacactgtcagcaggccatgagctatcgcccacttccactggtatcgagtcacctnnnnnnnnnnggccccggaccatggtttagtggtcattgaaatatgcagggctcagggtgaagctcatgatcccgccagatggcttcatgttgttcacaatctgatgccaccccctgctctacttacgaagccattattttgaatgcactctcagtaggccaagagctctcgcccacttccactggtatcgagtcacctggtcggaggaggtgccgggtcgtgacgtggagggctcgccgatgtgcacggaatctcgacatgggattcgtttccacacgatactctacgtcgggatgagcacaacagctgaggcgtcagagaaatagatttattgtcgcgcgataaggactaatatctcgaagccgcggatatacgatgagaaacacatccacccgcgagactccattctcacttccacacgtcgacgacaattcctcgtcgggttcgacggaaccttcctgcggcttctaccctggatgttcctcgtcagaccgtcctataatgagagggggaagcttgtccattgggaaagggatgggcaccatgcctgcagccttccatgtttgaacgcggtgatggacaccgatccgtagcacgcagccccaggacggcggcatgacgatcgcccaggcaccacgcgtagttaacccgccggggaacacaccggaggcagccctgacgacgccaaccgtccacgacgggatctgatcacctgcgcatcgtgccgctcgtaccacggccacgcccatggccacggcgttggccaaactcgcccagcccggcgccgtcctgacccagcctggcggaatggggcagtcgccaccccttctcacggtcgacacgcggatctacccccccgccccgcagcagatggagatgtcgcaggcaaggctccagctcctggcatcgagccaccagaccgcctcgaccaatcacatgtgggcctggggctgctgcgcgatgctggggtgtcctacggcggtttttctcggctcgaattatggtttcacgctgtgcgagggcggctcgtgctgctgctgcaccggccccacagcgggatacgcggttggctggggcgtgggtgccggcgtgccggcgctcctgctctgcgtcgtgccgtggctcctcgacgcccgactccggcagctgcggcgcgcccgcatcgcccgcgcttgggagccggtgcacgccgaggcggcgcgccaggaccaggctgcgctggccgcgtgggcgggcggcgtgcatgctgcggccgtgcagggcgaggcggcggcacagcagcaggccgccgcccctgtatgcgctctgcccctgcagccctgccccgggcccgccgggccagggcccggggcctcagccagccccatcgccgcccccgccgacttctgggtcgccgtgcgggacgacgacggcgaggcggtgcgccgccacctggccgcccac

SEQ ID NO: 28075 - DNA, 114 bp, Chlorella protothecoides
ccatgctagtgcactggttcagtggagaagagcgtgctggggcattcggtatgcgctctgcatgcccacaggcccattgtacatgagttgaaccaattgcggcccaatcagcgt

SEQ ID NO: 28076 - DNA, 78 bp, Chlorella protothecoides
tcaagtgggaggtctgtttgtgatggaaaagtggagtgggataggtcaaggggaatggacacagagtgcaggacgaca

SEQ ID NO: 28077 - DNA, 368 bp, Chlorella protothecoides
  modified_base (98)..(245): a, c, t, g, unknown or other
ccaggaccctcttgtaggattgtggcatactagatcaccttcaacaagaccatttaacatctaaatcatcacaagctgcctgcaagtctacctggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtattgcgggagccaatccgattcggcgcaggctccttcggctcgtttagagtgaaatgtaccgcgtcactgaagcccactcccacccacaatcaccgcagatgtcccggactcagaaaaa

SEQ ID NO: 28078 - DNA, 78 bp, Chlorella protothecoides
agtagctctacatgttacatgggacaattgccccacggcatgagctttcctgctgccatctgaggcgcagccgacttc

SEQ ID NO: 28079 - DNA, 62 bp, Chlorella protothecoides
cccctgccaccgtcatccccgccaccgccgccagtccccagcccaccccccacgccccttgc

SEQ ID NO: 28080 - DNA, 152 bp, Chlorella protothecoides
atccttggagtgttgctctgtgcagcgccgtgtgggatctggacggtatgggtggcaacctctgcctgaagagtagatcctccgtctatttccactcctggcatccccaaccatgatctgtccagcacctctaccccgagctgggggtagag

SEQ ID NO: 28081 - DNA, 10285 bp, Chlorella protothecoides
  modified_base (514)..(565): a, c, t, g, unknown or other
  modified_base (8933)..(8976): a, c, t, g, unknown or other
  modified_base (9401)..(9443): a, c, t, g, unknown or other
gtggccgacagcgggcgcgccgcgtgcctgaagcgcggctacgccaaggcgcactcgcgcctggccaccgcgctgggcgaggtcgggcgccatgccgacgcggctgaggccctgcgtcgtgcgctggcctgccgcggtgcgacccccgcggagaagaagggctaccaaacgcgcctggcggcggcgcagcgcgccgccgcgccgcgctcaaacggcatgatgcgccgcggtggcgagggcgaggcgccgccgccgccggaccactaccgcctgctgggcctggcggcgaactgcagcggtgaggaggtacgccgcgccttcaagcgcctggccttgcagctgcacccggacaagacggcgggggcggtgcggtgccgcgccagcctgggctcctgcggggtggtgatagaggaggaccaggagaccgagctgcgccagagcctgcaggaagcagccacctggctcttcaagtgcttgagtgcgtgatggggggtgaaagggggggggggggggnnnnnnnnnnnnnnnnnnnnnnnnnnnnnnnnnnnnnnnnnnnnnnnnnnnntgggcaaaggtgggtggagatccggcgcggtcggtgtgtttgtggtgtacggcagtcaccagggccatggtgccatggaggctccatctccctgccttgctggtaccctcatggtccgcgtcgcaggaggccctgcctcgtgtccacaccccgtgcatcacatgatcccgtcacacctccctcccaggcgaggcgcacgaggtgctgaccgatccggctgccaggagggcgctggaccgcgagctggagggaaggtcccaaacgcccgtgcagcactggcagggcgggcggccccccttcgggcccatgggcacggcctggacgcagcatgcgcagcagggctggcgcgccgagccctggttccacaggcagtacgaggaggaggacgactcctttttcttctcctccgcctccagcaactggtcctcgcgctggaggaagccgggcggcttctgaagggtgtccatacggaggggagggcgctacgtctgaccctccctctgtctgcgggtatgacccagcccactgtcgtactcgagtccattttcctccttctctgcaatgtattgcttccatctgttccttgtatgctcagagcaaacggctgcgacacacagtacatagtagctgggaagggaagggggccgatccccggggtgtgtgcacaccggccaggccctctgccacccgggcatcccacgttgctatttgcggcgggccgcggcacgggccacctccgcaaagctctccagctgggagagaaaacgggccttggcccgggggttcagggcctggggtaggtcggcgaccaggctctcgcatgccacagaaaccaggcgctgggatgagggggatgggaaggggtcacaggcattgtttgtctcggaacaggtgcagggaggtgctgaacatcaaacatagtgtgacacccagagtgtgtgaggcagccaatgctctgtacctcccatggcagagaagctggtctgagcaggccaggacccaagcaccagcattgatcacaagatctcccaaccccgaacgcacacccacgtcctgcaccgacctgctgctgggggtcctcgatgccgtgcacaaggtcagcccggaaaacgagaacagcctctggctctgccatgaccagggggagcagggccggcgcggctgccgccaccacgcccgcgccgcgctcctcaaacacgacgcgctgcagggcgcggaccagcagtgcagccagcggagagtggcagccagcccattcccgacctgagggcggggtgtgggaaggggagatgggtctgagcgctggatagacgagagcggtcatggagaaacagcagcgttggcctgctcacagagtccagcccagccctcggaccccccgccacctgggccgggtacattgctgtccctgacgccctttcctcccgcaagcgcatccttgacgtggaaggtggccagcgcggccagaccgtccaggaccacctgggtcagagctaggccgccccccgccatgcccaggccctggaatagggtgcccatcagggcgccccacacgtgcggcggcaggctcgccatagcgccgggaaaggtctgtggtgggtgggatatgggactggttggtgggtgtgctctatcaaaggttagggtccgctcaaggggtggggacaatgtagtgcagcagagagcggcccccagtgcagcactgcctgcacaagggttctcaccacacttcactgacctcgagcatgaatgcaacggtgtcgaagaaggagtggcacagcttggggtgcgccggcaggtccgggggaaggagcggcatgatggtccccagcccctcggctacaacctgagaatttgttgaggaggggtgacagagagaggccctcatgatgattccaccatgcaaatggtcatgccatgccaggtgcaggtgtgcaagcgcaacaaaatgcatgcagtgctctgccgccccacctggacaagctccgtctctgctgcaggcccggcttctgccgacccactgcgcgccatggccgccaggagctttaagaaagcgcgaaggtcccgttgcgcctcggtctgacgcacactcagatccgagacgccctgcattgcacgtgtgtgtgtgtgtgtgtgtgtgtatcgggtgtggggggctatttgctccctaagaggagggcacacgctaatgcctggattgccaactttgcgatggtgatagatctgggcatgtcagcgggacaggcaagcatgcacagggaacagagtaccctcacgggtgtcgggcactgcaatgctgatggaatggagtgacagagaaagcaggctcaagcagggtcacatgctcgtcaccagcttgcagcaggttcctgcagtcttccccttgcgtacctgagcatgcctcgcatgggtgcgcaggagatccagtccccaggatgacagctgggacgccacctgggcctgcatgagaaagggagccacggccaggagatgagacttcagattgctgaccagtgccatgctggatcccagtgccatgctggatcccagctcctagcccatcccacccgttttcccagcctcactccccatcaccccttcccgggcagcggcaggcatgccgcgctcacatccgtgacgaggggcagcaggttctcgcccaccgccgccgccagcttcaggagcgcagtggtcacctcgctttgaccccggtacgcgggcagcagcagggagaggggcctggccagctgctgcgctgcgccggtcagcggcctgacgctggcagtacaggtgccctgcattgcccccctcacgctctccagccagaacaggacacggggcgtgacatccgcgcgccagagcacgtcccgcctgccatcaccggccagttcctgggtcagttttgagggggtgaggatgattcacgggaatggcatgctcgtggcgggaagttggcgcttgtgaatggcgcgtctcccggccccttcaacatctcgtcggccgggcgccagcgggtgctccaccccgaccgacccacccccagaaggaccccctgcccaaccccaaaccacctgcaggcgatcgacgctgggctggaccaggtggcggacgtaggccgcggccccctcggcgtcgtcccccttggcggccaggcacagcgcgcacagcagcgggcgcgcgacgtcggcactgaccagcagctcctgggaagctactgcccggcacaggtccagccaggaatcgcagcgcaggagagtggcggcggcaggggcgctggtcggcagcgcgcgcagcaggcggcggctggccttctgcgacaaggcgggtgcaggggggagggtttgagcttgatgagaagggcgcggatgggagaagagagcacgagggcggaaaagaatggcaaagagagtgcgggagcgggagaaacacggggggcaagcctgcggcgcgcacctgtactgccggtgtatgggacaagcgcagcatgttcactcccgcagaccctgtagagtgcgccagcatgtcaccacataccttgtgcagggcggtctcccctgggtacgcaaggaaggccgtcctcgcgagctggacgagcagctgcgccacgtcagcgtcctgcgccccgctggcgggcggcaggctggcctcggtggggaaccaggtggctgcccaccttcccaggctcacgcatgtgacctccagcagcctgtggtgtgtggggtgcgggcgggaggtcaggccctgatgaaaatgagctgttctgtccactccccaggctggcagaggtgggaaggcatcagactgcctcggcccatccggcactgcactccccagcctcccgatcagaaagcataccgggggctcagggcgtcgtgcccgccgtgcgtgacgcagagctgggcgacagccaggagctgcatggaagccgccgccgccgcgtccctcatcgcatcccaggccaggggcaaggcggggctgtccccggcgtcggcccccggcgcgtcggccagcagcgcggcggccacctggagcagccagcacagctgctccaggggaaccgacgggtcgctcgcggccgccaccgccgcctccagccgggaccgggcgtccaccagggcgctcgagacggcggcgagcacgggggcgccggcgccccggccgatcgcggccaggcacgccaggtcgtgctccagcgtggcggcctcggcgtgctcgccggcatcgtctgggcggacgggagtatggaagacaggagggaacggtggtgagaactaggaccattaccagaggatgcttggtaaggacatgggaatagctccgaggagcaccgcgcagcccgcacctctcagtaaattaaacaacacttgcagcactttagcagtctgcagacaatcagcaggaggtgggacgacgcctcgcacagaaagccatgcccggccctcaccgcaatcacgcacgcaccttcgtcctgggtggcctcggctgcagcaagggccaggcccctgcgcaggccggcctcgaagaccgcagccgcggcctcagcgccgccctggacgccctccagtcccgttgcgagcgcggcccaggcgtccaccagcgtccgcccagcctcggtcagccaatcgtcgcgatgagggtccgaggccagcgtggacaacacggcacgcgtcagctccgccgcggcggcgatgcgggtctgggtcccctcgccgggctcgacccagtcccacagcctgggggccgagaccggggcggcggcggccgcagccgctacgaccctgcacccgtccaggaactcctcctccgtgccttgctcggcgcggtccagcgccgcgccgggcggccacagccacgcctggaatgcgaggcgcagggaccaggcggtgtaggtgggcgcggggcggtggggccccaggggctcgctcgtctgtgccaggtgcaccgccagctgccgcagggcgcgcgcagcttcccggtcgcatgctggcgggccgctgcgcaggatgttgtggagtgatcggtgggggaagatgaaactgatgcaggtctgccctctttggttcccgtgctgaggcggcccgcttgtgacacgtaagacaggtgcatggtcgcgtcatctcccggcggggtagccatggagcattgtcctacccttgacaatgacaaggtacaggcgacatgtgatggggccactcagtggtacctgagcagctgctatgccctgccaccccccctcatgagatgcatcctgtctgagcatgccaagctaccagaacctacgaggatcttccccccccacacacaacagaaaagcatcctacctgagcgcggccgagaggtgcagacaccagtccagggcgcccgggctggaaagcacggcatgcacctcctgcgacagccggttggggcccctccggctcccatccccgccaggtcggtccccaagctgggtgctcacgtgcatcatcagggcctcccgcccagaggcaaagccccagctcagcacggcgcacagtgtggtgagcgcggcggccgcgacgccctggtcctcgtaggcagcggcggcgggcgcggccgcggcaccgacgcgcagcgcgcacagcgcgacctcggcgagggcgccgcgctcaaagtcctggcgagccttgtcgtgccagctcctgtttgcgatggtaagagggagggatggggcctcgagcggagtggcacaggctcatcattaggatgcgcagggctgggacaaagcgaccacaggggtgcccaatctcccaacgctgcatccacaaggcaggcaggccacctcaaagttccacggttcagcaggtgcagggctcaccagggcttctccatggggctggccgactgcgggttgcactccgcggtgagtgcggtcagcagctccaggcacgtgcgctgctcatgcaggtcccgggtggagagggctcggtgcacgatgccccgtaccaggccctccagccccagatccgattggctggcatcaccgtgcccgcgcttgaccagctgcgcggcggtgaggacgcactgggaccgcaccagggacagggactctcgagacctgtgcagggcctgttccagcacgaatctggtgacgccctggcgctctggggcccccagctcgggccagagtcggaggctggcgtctcgcagggtcaggaccgcctggaactgggccgccggcacgctggagtggctgaggatgtgctggcaggctgcgaggggggaggggctgcagcggaagtccaggagcgtgcgctctgcctccagacgcgtgaggggattctcgagggcattggaggccgcttcgatcaccgtctggatggaggccaaatccatggcaccggcgtgtgcgcctccctcgccccgccctgggggtcctaggcacgcccaccacgagctgtgcctgcaagcgcagaggagaatagactgtttacatattcaatgcgacggagtattacagcacacctatggattgcaaatccctgcatgtggctcgcaacatgctcacatatacaaccttcatggtcgtggtttgcgtgctgtcggaccgaaaatcaccgagcagttgacctccggtccctcgggagagcacctctgcggtctggacggacaggggccgctgagaccgtgatagtgaagggacacacgccgagcgcctggcacggtcagaggctcaccaccttgcctggctggcctaggagtgatcgcaccgggatggcggacggacgcttcttctccaccaccaagaagggtgcgagatgaggagatgacgcggcacatccctgatcacgccccagaatcgctttgcaggggcgggacggggcatgaatgttggggtgggatcgctggcgctgagcagcggttccgccgtgtgcagtggggccctccacccagcccgagcggccctctcattgcctcaggggaggtggcggagtacaagaatgatctccacagcctggatcgcaagtcccagaagaacgcggtcaagcgcgtcattgccgcgatgaccgtgggcaaggacgtcagctccttgttcccaggcacgcatagtaggggggaatcctgtctctcaggcctgcctgtctcgtcatgagaggatattgtcagaagtaatgttcgtgttcgacccccaatctcgccgagttactgcattgcttggttccctggcgcttgtcactgatctctgcctgtccactgccagcctttctcagccctgcgcggaatccttctgtgcgatcttcatcctacccttccgccccttgcactgcacagatgtggtgaactgcatgcagaccgaagacatggagctgaaaaaactggtctacctgtacctgataaactacgccaagacccagcccgatctggcaatcatggctgtcaacacctttgtcaaggtgggcgtgccgtgtgacatgtgtaggtggtgcgttgattcgtcactgtgcgagacagcaggcgcgcacccgtctttgatcctgatccccaccctcaaccagccccctccatccccgcctctccttctctctccaggacacgcaagaccccaacccgctgatccgcgcactggcggtgcgcaccatgggctgcatccgggtggacaagatcaccgagtacctgtgcgacccgctgcagcgctgcctgaaggacgaggacccctacgtgcgcaagaccgccgcggtctgcgtggccaagctgtacgacatctccgccgagatggtggaggaccgcggcttcctggacgtgctcagggtgtgcctggttgcttgtgggggggtgggaggctgggcaccgagtgcagactaccagcagggtgccaaggtggctagtagtgtggggttcaggttctgccacccctctccatggcatgggcctggcaggcaccatgccatgcccacttctcctgtcggccgctctcaaaccccacccaccctctccttccatcccgaccgctccatggcaggacatggtgggggacgccaacccgatggtggtggccaatgcggtggcggcgctggccgagatacaggcctcctcctccggcccggtctttgtcatcgacggcgcggtgctgaccaagctcctccgcgccctcaacgagtgcagcgagtggggccaggtcttcatcctggatgcgctggcggcctacacccctgccgactcgcgcgatgccgagggcatcgtggagcgcgtggctgcacgcctgcagcatgccaacggcgccgtcgtgctgtcggccatcaagctcatcctgcacgcagccaaggtgagctggctggctggtgggtggtagtgttgttggcgcgggaaaagggtgagggggggggattagcggcggtggagtggggggggnnnnnnnnnnnnnnnnnnnnnnnnnnnnnnnnnnnnnnnnnnnncgtcgagcatggtccacaccatggactgtggaaggctgagatggggagttcatttctcatgcccccaggcaccttgaatcttgcccacaactccctccccatccctcctccctccatgcacaccacggccatgcgcagtacatcgacgacgccggcgcgcgcgcggccatccacaagaagctggccccgcccctggtcacgctgctgggcgccgagcccgagatccagtatgtggcattgcgcaacatcgacctcatcgtgcagagcgtgccgggcattctgtcccacgaggtgaaggtcttcttctgcaagtacaatgaccccatctacgtcaagaccgagaagctggagatcatgatcaagctggcggacgagaagaacatcgaccaggtaggggtttagggaagaggggggggggggggggnnnnnnnnnnnnnnnnnnnnnnnnnnnnnnnnnnnnnnnnnnngggggggaagggaggcttcaacctgctggttcaaccctctccctgggatccctctgggctcgtccaaccccatgacatgctgccaccccctgctcttcatcatccccagccccacccatctgacaaacctctgaaatcccaaacctgtaaagatgctgctggagctgcgcgagtatgccagcgaggtggacgtggactttgtgcgcaaggcggtgcgcgcggtggggcgctgcgccatctcgctggagcccgccgcggagcgctgcgtgaacgtgctgctggacctgatccagggccgcgtgtcctacgtggtccaggaggcggtggtggtcctgcgcgacgtcttccggcgctacccggggcgctacgagcgcgtgatcgcgccgctgtgcgagtgcctggaggcactggacgagcccgaggccaaggctgccatggtgtggatcatcggggagtacgcggaccgcatcgacaacgccgacgagctgctggagcagttcctggaggggttcccggaggagtcgcccggggtgcagctggcgctggtcaccgccacggtgaagctgttcctgaggaagcccagcgagaagccgcaggccctgatccagctggtgctgtcctacgcgacgcaggagacggacagccccgacctgcgcgaccgcgcctacatctactggcgcctgctgtcggccgaccccgacgccgcgcgcgacgtggtgctggcgccgcgccccgtgatcgaggccgccgccgacggcgtggacccggccctgcgcgccgagctgctgggcgagctgggctcgctggccagcgtcctgcaccgccccgccgcggccttcacc

SEQ ID NO: 28082 - DNA, 71 bp, Chlorella protothecoides
gggcgtgcaggcacatcgctgggagtgaggggttggcatggagacactgctccttgcgccatcgccggggc

SEQ ID NO: 28083 - DNA, 73 bp, Chlorella protothecoides
atgatctccaggacgtccagctggagtgagggagcgcaattggaaatgatctatagtctgctaacttacatct

SEQ ID NO: 28084 - DNA, 61 bp, Chlorella protothecoides
caccacgagcgcggcggagagggcggcctccaggtctgccaggcggggcgtccagccggga

SEQ ID NO: 28085 - DNA, 175 bp, Chlorella protothecoides
aatgcacacatggtgactgcctccctcaccgagaccccgtactggggccgtcaagatcctcgcgcatgaaattaaactcactccaccccgccaaccaaccccatctcccccctttcccccacccgacttggcggtgtcggccagtggtaagaggagatcggtggccaccatgccg

SEQ ID NO: 28086 - DNA, 70 bp, Chlorella protothecoides
tcctcccagaacctccttgctgcttcgctctccttggctcggaactacctgtacacagcaacttcacgag

SEQ ID NO: 28087 - DNA, 168 bp, Chlorella protothecoides
cgtccggcggccggctgctgtgcatggcctgtgagggatgtgtgatgacgaaggggccttgcatcgcagggtcgtggagttgccagactcaagcttggcggcggaaccagacacccaggacctcatcctcaccctttctaaagccccacctccagcacctccccctgg

SEQ ID NO: 28088 - DNA, 74 bp, Chlorella protothecoides
cgcacgctcttcccagctgggaaacaaggtcagcgagtttgggtggtaggggactgccagccccacagcccgcc

SEQ ID NO: 28089 - DNA, 80 bp, Chlorella protothecoides
attccttgatgctgcggcgggcgacgctgcggcggcggctgggcgctcagcccccggcaccccggcctgagcatcacgcc

SEQ ID NO: 28090 - DNA, 81 bp, Chlorella protothecoides
tctgagcaatgattacacaccggcgtccaaaatcatgacggatcgcgtgccgcccgaatgtgtcgcgaccagatcatccct

SEQ ID NO: 28091 - DNA, 233 bp, Chlorella protothecoides
cgcgggtgcacctgacgtggatggtgggttttgttgcggggagatttgtaggtggggttggccttgtaagtccgggaacccagcggtgcaggctggggccgagatgggctggctttcgcagtgccatgccaatgcacgtgcctgctcctaccccaggttgggcctctcgaagcctctaggacccctgacgtccctgttccctggcaggtgccgtgttctccgctgtgttcagg

SEQ ID NO: 28092 - DNA, 1657 bp, Chlorella protothecoides
  modified_base (380)..(389): a, c, t, g, unknown or other
  modified_base (612)..(621): a, c, t, g, unknown or other
  modified_base (920)..(929): a, c, t, g, unknown or other
gagggtctgaggtttcagcgattggcagggaaacgtaactcttcggtacggctgactgtggggaagtctcttacatggcaagggtggcaggggacgacccacctcactggaaaccactgcaaggcgaggtgtgttcagaagggagcaggctgattttaaggagcaaagtatccagggtggtgcccgcaggcatcaccctcttatcacgaccacgttggatctggctgaaacacgactgtctgggtactccacagtgaccgaacacttggtgtctaccgtgcttgggtaggtgtcggctggggtgttggcatagctcctccctgctacctgggtccacgtatacttcaagacatcatcaacataggcatagactttgacannnnnnnnnnaccacagtgaccgaatacctagtgtttaccgtgcttgggtaggtggcggctggggtgttggcattgctcgtcccagcttccatggtccacgtatacttcaaaacatcatcaacataggcatagactttgacaaaggcctgtgtggatgtggtgatgaatgtgtatgtcccattagggttctgtttcatagacagcgtcggagttggaacatctgggggaggtnnnnnnnnnngtgaatgtgaatgtcccattagggttctttaccatagagagcgtcggagttggaacatctgggggaggtggggatgacggaggaggagatgggggaggagacgggggaggaggagggctgggaggtgatgggggaggaggcgagggaggaggagatggggctggaggcgagggaggaggaggcgagggaggaggcgagggaggatgaggcgagggaggagggggagagggaggggaaagcgaaggggaagaggtagggggaggatgtaaaggggaggagggtgttggtggaggaggtgnnnnnnnnnnaatgggggaggaggcgagggaggagggggactgggaggcgagggaggagggggagagggaggggaaggcacagggggagagggaggggtaagagaagggaaagagggagggggaggaggggaaggggaggagggtgttggtggaggaggtgatctaatgggagggagtggcggggacgccttcttgggaggtgggggggatgccttcttgggtggcggcgggggggacaccttcttgggggccggcggggatgccttcttgggagggaaaggcggcggcttgtcgtagttcctgagcacagttttgcgaagttccttcacattgcagaagttgaggatcgtcgtccgttttccaaccgcgtcgttgcaccgcagatttgtgcccttgttgttgagaccccagttgaggatacccgtgttggagttccctgcacagtaagcagtccaaatgtttcgggggtgggtggtgggggatgccatggccatgcgtatcacacttttgtctcaacttgtgcagcaattggaccccaggaccactcaactacttcccacatcctgctcaccgatgttgttgttgcccacattattgttgccaaagttgttctttcccttgttcccggtaccaatgttgccattcttgtctgctgtgcacgccttctgtccggccttgaggcactcgacggccaccaaaatcttggtggatcgcgccgtgatgacctcaaagggacg

SEQ ID NO: 28093 - DNA, 61 bp, Chlorella protothecoides
tggactgcaggccgtggcgccttggctggtacagatgcagacaaaggttcctgatccgcct

SEQ ID NO: 28094 - DNA, 204 bp, Chlorella protothecoides
gtgccagctggccttgtacacagatctgcatgtagttcgtgtgtgtgctgaggtggcggcgtgcacgggcagggtctcggcacctgggacaacggcccggcctgacacaacacccgcacccccttcctcgttatttgcggtaatcaggttctattgccccatgccgcgaaaaaaaacagcccagcgccggagctcacccgctgg

SEQ ID NO: 28095 - DNA, 77 bp, Chlorella protothecoides
taccatccttgattgccccccgtaagctcgcgtactcctcgttcccaggctgggctcccattcgaacccagacctcg

SEQ ID NO: 28096 - DNA, 67 bp, Chlorella protothecoides
cgctcctcagccgccactgcctccttgtggcttgtctgccgccaccgcgagtaccgccggtacctgc

SEQ ID NO: 28097 - DNA, 90 bp, Chlorella protothecoides
agagaggacggggtgcaggagattcccctgaggaagaatgacgaagtgggaaggcacacctggagacaccccctgacaccactctttggc

SEQ ID NO: 28098 - DNA, 78 bp, Chlorella protothecoides
agtcatgaagatacagttcctgacggccggcgacatcccggaccccggggcgctgttactgttccgccctgctggctt

SEQ ID NO: 28099 - DNA, 61 bp, Chlorella protothecoides
acgtcaatccttgcaaaacatttatacaataataaagcctacaatcacaagtaggtaggat

SEQ ID NO: 28100 - DNA, 192 bp, Chlorella protothecoides
gcatgcactcccgagcccgctctctgccgaattctcaggggactatctgccattccttgatgtggaagaggtaaaagagggcgtgaggaatgcccgcagccagggtatcactcgttgtatcttgatcgtcttgcaggtatctcaatgcggattgccactccgagatgcccttggatgacggcggcgcgagat

SEQ ID NO: 28101 - DNA, 80 bp, Chlorella protothecoides
tgtatccatgaccctaacctgacttgtacaacccccctgcttctctcctagcaacgcccgcttttcctatttctggttgt

SEQ ID NO: 28102 - DNA, 70 bp, Chlorella protothecoides
caagaggggcgatggctgatcctgcacaccaactgtcattctacccaccctcctctcctgcagaggcatg

SEQ ID NO: 28103 - DNA, 114 bp, Chlorella protothecoides
catgctcaacattgggtccatgtgcacgggggcacgagtcatcgcggtgagtgggcgggccgggtaacaacgcttgttatgcggcgatgaggcgacggcagagcctgcagtggc

SEQ ID NO: 28104 - DNA, 125 bp, Chlorella protothecoides
gaggccgtaggagacgtcggtgcgctctgtgaaaggagccaaggcagggaatgttgaggagggggaagggggttgggagctttgtggaaggggagtgggagtcgatcagaaactgacagaaggct

SEQ ID NO: 28105 - DNA, 76 bp, Chlorella protothecoides
gagggagcagctcttgatgcactcgtggcgtgatatgctgcccatctggatcagaagctgtcaccagggtcttacc

SEQ ID NO: 28106 - DNA, 61 bp, Chlorella protothecoides
acctcccccgcagggacggtgtgtgccgtctcacgtagcctgcgccaagaagaacatccat

SEQ ID NO: 28107 - DNA, 61 bp, Chlorella protothecoides
ttgatgccatacatgcgctgactgggtcgcacgaggccatggcacgtattgcgcgggaggc

SEQ ID NO: 28108 - DNA, 70 bp, Chlorella protothecoides
ctgcacgagggttaaatgctgtggcatatctgccagaccagagccctgtcgagcattcagagggttgatc

SEQ ID NO: 28109 - DNA, 177 bp, Chlorella protothecoides
aggaccagacgagggaggggtggggaatgtgctgaccctctgggctgcagtgacccgggaagcaaggccatgcagggctctccctgagggtcagcggctgctttcggatggctgctggcacaaaatccccaaccccgcccaccccctctcctgcagatggcgagtcggagccgtacc

SEQ ID NO: 28110 - DNA, 61 bp, Chlorella protothecoides
tgaaataccaccctttctatattgtttttccaagcacagcaacagcgtatagtgggtagtt

SEQ ID NO: 28111 - DNA, 72 bp, Chlorella protothecoides
gcgggtgggtcgcaccagggcacctgcaattgaagtctaatagtgcgacattgtgaggtagcatgttcatcc

SEQ ID NO: 28112 - DNA, 78 bp, Chlorella protothecoides
gaaagtgtggttggaaactcgaggtctatcgacccaaaagcaatcccgacaaggcaccttgttgtccttggccgactg

SEQ ID NO: 28113 - DNA, 70 bp, Chlorella protothecoides
agaggcacgattgtatggtcaggcggcagggataggtttagcccatcaacctcccccccactcatcttcg

SEQ ID NO: 28114 - DNA, 77 bp, Chlorella protothecoides
acacgcttgccttctagggagtggagcctcaaaggaactgtggtgcacagccttgatggggtcccaacatgcccgag

SEQ ID NO: 28115 - DNA, 61 bp, Chlorella protothecoides
cttcgtgacgccatatgccgtatacggaggtgacttgctaccaagctgacgtatagccggc

SEQ ID NO: 28116 - DNA, 121 bp, Chlorella protothecoides
gcaaacaatgctccatagattgaagcgcccgagccttggccctaaccgccaggtacggccaagggcaccgacgcccactgtgctgcccaatctcctgcttccttccagctgccggctgcat

SEQ ID NO: 28117 - DNA, 96 bp, Chlorella protothecoides
cggtgcagcctcatcacgtcaatgagggatcgtgttgcccaagtaacaagacaggttgaagccctgccctggagtggctgcctccgagtcctgaag

SEQ ID NO: 28118 - DNA, 220 bp, Chlorella protothecoides
ccggactgtggcctctccatcctacacaactaggtcgacctgacgcgggggcagtgcagggccgaggtccatcaggagggccagacaggaataggctgggagggcaatacgcagtcactcgaatgagagtggaggtgcgccgccacccctcctgctctttttctgggtcagagatgcccttcccacctagcctgccagccccttgctgcgtacgtggcct

SEQ ID NO: 28119 - DNA, 68 bp, Chlorella protothecoides
ggaagcacatcctcacaggcacccttcccagcaatagcttcactggcaccagtgtgccccagccacgc

SEQ ID NO: 28120 - DNA, 138 bp, Chlorella protothecoides
gtgtgtggggaagcagggggacagcccctcggtatgcgcagcgcaagatcgccaaaggatcagcctgcaagcccaccaaatcacccgctgacccgctggggtgtgaagccagtctcctgccccattcatgagcatggt

SEQ ID NO: 28121 - DNA, 65 bp, Chlorella protothecoides
ttcggcgcctaagaacctcgccaccaaaaccaacctggtgttattaaacaccacctgattggaat

SEQ ID NO: 28122 - DNA, 99 bp, Chlorella protothecoides
gagaggcagtgtcctgggcttccccctggggtgtggcgattgatgatcctcagcgacgcccctgcatgctcctgctgtgtggaagacccaggccctcaa

SEQ ID NO: 28123 - DNA, 61 bp, Chlorella protothecoides
cctgggtgtacaggatgccgtcgatctcgtcgctgctcatgtacaggctctggtaccgggg

SEQ ID NO: 28124 - DNA, 166 bp, Chlorella protothecoides
ggggaggaaccagcggcgccccgcctcgaaggcactccaggcaacgcattggaggggccagcgattgccctcctgcagacgagtgtgagggcccaccaagcacttttcatgctcatccccccccatatgcaccgcgttcctgctttcctcgccaggaacgcactgc

SEQ ID NO: 28125 - DNA, 200 bp, Chlorella protothecoides
gctggaggtgcgatgggcggtggctaacggtctttttggggtgggtgggttgggcaagtgcatgaggttcccaatggcctccgggggcccccatgctggcaggttgatgatcaccgctccttccctcttcccaatgatgcttgcattcataggtatcccctccttgcatacaaacaggtcacggggccttgggcctttgg

SEQ ID NO: 28126 - DNA, 74 bp, Chlorella protothecoides
attcccgtgcggtcctgggcgccacaccggcttccataccggcagtggagccggcatgcgacatgcagcagttc

SEQ ID NO: 28127 - DNA, 63 bp, Chlorella protothecoides
gcatttggtggcccccctgcttccccttcccgccctcccacccccccacccctggttcgccga

SEQ ID NO: 28128 - DNA, 68 bp, Chlorella protothecoides
gcgcatgcgtagaggatcgagggaggccccgagcccgcgcggcagcgcctgcgggcacaccctggtca

SEQ ID NO: 28129 - DNA, 61 bp, Chlorella protothecoides
tcaggactttaacaccggcacgcctgccttacgcaacctttcaattgtctagtcagagcaa

SEQ ID NO: 28130 - DNA, 61 bp, Chlorella protothecoides
gcctctccagggcgcaatctgctgcattgctcctgccagtagagctacattgtttcggcta

SEQ ID NO: 28131 - DNA, 78 bp, Chlorella protothecoides
cctgccagtagagctacattgtttcggctagcggccgccacattcaccgtggcggtaagaaagtccacccccacttca

SEQ ID NO: 28132 - DNA, 61 bp, Chlorella protothecoides
caggttcttacagtcttgagacttttaatcacccgccgagcatggcagagtcttgggatcc

SEQ ID NO: 28133 - DNA, 89 bp, Chlorella protothecoides
gcctggccgcgggaaggagggtgagctgggttggggtgcgctggaaatcatgcacccgcacgaagagctcttcgcggccctctggtcat

SEQ ID NO: 28134 - DNA, 118 bp, Chlorella protothecoides
cgagggcccagcatctcatggctaagccacaagggtgctggccatgcaggctgcatgggctggcggacgggggcatggacgtcccaaaccccctactcatgcctccatgtcatcacac

SEQ ID NO: 28135 - DNA, 89 bp, Chlorella protothecoides
aattcggcgcactgcgctggggattgtaatttattcagacctttccaaagagaacatgagagctcggctatggcgcctttaggtggctc

SEQ ID NO: 28136 - DNA, 73 bp, Chlorella protothecoides
gataccgttttggcgtcacattcgagctcgtcttgcttatacgatgtgcagtgcaaggaccggcaccttgaaa

SEQ ID NO: 28137 - DNA, 108 bp, Chlorella protothecoides
tcgggggtggggccgtccactgcagagggggcgatttattataggggctgggggtctgctgtttatccgtgaagcgcgtcgttgactctttgggcactcccgatgccc

SEQ ID NO: 28138 - DNA, 2854 bp, Chlorella protothecoides
  modified_base (387)..(396): a, c, t, g, unknown or other
  modified_base (965)..(974): a, c, t, g, unknown or other
  modified_base (1202)..(1231): a, c, t, g, unknown or other
  modified_base (1476)..(1485): a, c, t, g, unknown or other
  modified_base (1559)..(1568): a, c, t, g, unknown or other
  modified_base (2059)..(2068): a, c, t, g, unknown or other
  modified_base (2143)..(2152): a, c, t, g, unknown or other
  modified_base (2322)..(2331): a, c, t, g, unknown or other
aaagtgcccgcccctgtggggctgccactttgcgatggtcttctctcgccgcttggaccctgacatggtgttgtgggggcgggctggcccccacaacggtggaccgctgtatatgacctgaagtaggaatgttacagacgagaccccgaatgcagtgtgatggtcgggtttcataggcgtcgcaaggaggcgtggactcggggccgagctggaacatgtgggaagtggggaaagggcccggtcaaggggaaaccccacaacacctaggcaatatatgtacatcgagtttgttccactactatctgcaccatggccggcgctgcttcaccctgagagtgttgcagctacccatctggtgcaagaggttggattgcgataaccacaaannnnnnnnnncgtacatcgagtttgtttcataaccttctgcaccatggccggcgctgcttcacccatagagtgctgcagctacccatcagatgcaagaggttggattgcgataaccacaaagcctttcaagtgcacgtctgatgttcccctttccctccacatattgctccccatttcgaggacttccctaggcgctcgcagcctgtcctgttgactcaccgtggtgaggagaaatacagcaccagttagtccctccaagtatgcatgcatttccgcggggcaagttcaccagcgaggcgcagtatcgtccaatcttcgtgcaaggaaaaagagcaacctgcgtccatttccggtgtccttcaccaaatctggacaggtcgaggcgtccggaacacatcgtatctatgccagctgccgtcctccgaccgatcccccacccgcggtctgcgcgcgactcactggaacttcgcaacgaattacctctcatacctgtccctcacgttgtcgcagccccaatcggatgctaccgagatatcgcgatttccccaaaggtcagagcagtctcctcaaagccggcnnnnnnnnnnttcaccggaacttcgcaccgatttacctcgcatacatgtcgctcacgttgtctcagcaccaatcggacactaccgagatatttcgcgatttctaaaaaggtcagagcagtctcctcaaagccggctcactccgccgagtctcgggatgcaaggactaccgggagcccttgccgtcctcagaggagtaattgtcctccttgctgtgacccacctagtacaggtaattcnnnnnnnnnnnnnnnnnnnnnnnnnnnnnnactcgcaccgttttttcgtcacaggcggactgtgacccgagcattgcgttcttcagcctgcccaccatagagtgagtctaattcacagacagtggtgtcgtcatatgcgcgcagtcatcctctgcgccaatgaagcggactgttccttgagtgcgcgtggcatcgctgaccagggtcactttcgtttggcagggtcgacggaaccttgtacttgctcagtcaagcggactcgggtgacttctgcnnnnnnnnnnctaccgtggaagatgtggtttgtacgcttgcaaacagctgaggttcctcgcgtggggatgtcaggcagatcgtnnnnnnnnnnttaacgtggaaggatgtggttcgtacgcttgcaaacagctgagtttcctcgcgtggggatgtcaggcagatcgtgctcgcaccatattttcgtcacaggcggactgtgacccgaggattgcattcttcagcctgcccaccatagagtgagtctaattcccagacagtggtgtcgttatctgcgcgcagtcatcctctgcgccaatggagcggaatgttccttgagtgcgcgtcgcatcgctgaccagggtcactttcgctcggcagggtcgacggaaccttgtacttactcagtcaagcggactcgggtgacttctgccggtgagatggagcggtcaatttcttatggccgcttacctagcgtctaggactgatgcagcagcccgaacatgatccgagcgccatctccgttacctggaccctggcatgcactccaaaatcccgtggtttcttcctcgtcgttccgcaggatgcatggatacgagaggatgnnnnnnnnnnataatcgagtgccttccccgtggggtggaaacatgcgcagatcgctggactagcatcaacggtataggaacaggnnnnnnnnnncctctcatatctggaccctggcatgcactccaaaatcccatggatttattcctcgtctttccgcaggatgcatggatacgagaggatgggctacatctggccaaatagatttgaaacaaagcccttattatggcctaacgaccccttcccgttcaacatcagcacatacnnnnnnnnnntaaagccctatttgtggcctaaagaccccttcccgttcaacatcagcacatacctccccggcctgagaaaggtctgcaccccaaccaatgaggagccctgttacttcttccaagtaatcgagtgccttccccgtggggtgaaaacatgtgcagatacctggactagcatcaacggtataggaacaggaaacgagctcggcaccaactggggtaactacaacaaaggagacaacaaccgaggtgagtttcccacctccatgcgcatcccaacagcatctgaggtaatcgaaaacacaacccttggcgccgcctgccctgcaggtagttacaaccgaggcagaaacaatatagggttcaacaacactggagagggcatcatctgcaacaatgttatcgaccacagagagtgcgtgtacaccgatctaaaaactgcggagacggtgatcgtgaccaaccctccacctccctctccccctccgcccaaccctcctcctccctctccccctccgcccccctctccgcc

SEQ ID NO: 28139 - DNA, 71 bp, Chlorella protothecoides
gcctgaagaaggcggcggggcctccgcagggccctttggccacctggcaagctgccgctgaagaatctgcc

SEQ ID NO: 28140 - DNA, 76 bp, Chlorella protothecoides
ctcgtcttacaggggagtgtgtccagaggatagtggttgggagaacaggtgcaggtcacctcagagcaaggacatt

SEQ ID NO: 28141 - DNA, 65 bp, Chlorella protothecoides
accaccgtgagccacgatggcgacgcatgctcctgcgcagttcttgctttctagcagcgcacgta

SEQ ID NO: 28142 - DNA, 753 bp, Chlorella protothecoides
gcgatgcctcgcgctggagctgggccgccgcatagcccgcggggccgggccccagcagcgcgccggccgaggggtcggccagacgcgccgccgcctcgcccacccaggccggcgccgcgccggagtcaaaggaccaggcgcgggacagcgccttcaggaaggctgcgttggcctcgcgctccccgctctcgcagccggggggcaggaagtcggcctcgcggctgcgtagcgactcgggcaccgaccgcgcgaaggccgtggcctggggtgagcgtgtgtgttttgtgtgtgagaggtggaggacctcgagtccgctgggtgggatgcctcggagaggaggaggaacacgccacatggggtgagtaggtatccagccccgtggggggcctggtgcgccggatgacacgcgcggcagggcgtcccgctcgcagccttccccgcacctcccatctcctctcccacgagacccgctctggccactggtcgggccgtcttgcgaggagcctacttccctcggccccccatccctcgtccccaagcccccgacaccctgcccacccccctcgaccactcacggtgtccacgagcccggccacccaggccggcggatactgatccagggcccgcacgtcctcccgcagcgcgtcgcgcatgccgcgcacgtggcgccgctgctccgcggtggaggccaggctgcgccacgcgtcggccagcgcggcgtaggcccccagcacgcccgcgcccgggccgccg

SEQ ID NO: 28143 - DNA, 61 bp, Chlorella protothecoides
gatgtgcctggtgggtcgagggggcctccgagcacgtgggatctctggttttcgtgaatta

SEQ ID NO: 28144 - DNA, 61 bp, Chlorella protothecoides
ccggcaacccctcccactgcctgctgcatggcgaaacccctgcacccactttccagcactt

SEQ ID NO: 28145 - DNA, 224 bp, Chlorella protothecoides
gctgcagctgctgtccagcgtgccccaggacggcagggggatctgattcggaaacgagttcgggtagggattgtcagaaggccattccggcacacctcatactcgctttgaatcattcaatttgagagttcggccatgatacttgcaaagggcgcagtgttacacgccatacagcaatgctccccccaaggataaattcccctatcaaacccgagcatattcac

SEQ ID NO: 28146 - DNA, 61 bp, Chlorella protothecoides
aggagcgcggcgcgcttccttccactggcacgggaggagttggcggggtgtaagagcggag

SEQ ID NO: 28147 - DNA, 105 bp, Chlorella protothecoides
acctccggcgcctctggcctcggctccccaacttctacctgctgccccggcgacaccagctgctcaaaggtcacaatcttcctgctgcgcgggccggccagcccc

SEQ ID NO: 28148 - DNA, 64 bp, Chlorella protothecoides
ccaccatgcagtggtcagcctgattgccgaagaggccaacgtgaccgtcagcaccagtgacatc

SEQ ID NO: 28149 - DNA, 65 bp, Chlorella protothecoides
actgaggtgagggcgggctggtggcaggcgagcatgttgtgccgctgacctgcatcagtgactgg

SEQ ID NO: 28150 - DNA, 182 bp, Chlorella protothecoides
gtgcttgggcagcattggccagaggtactgtaaggaggtccatctgtgtttggcatgagtcgcgaaaccctccgtttgatgttcgtgtatcgccctgcatgataggtcaagcccgagggtgtgcagcgcgcgctcgtcggcgaggtcatcaagcgctttgagcagcgtggattcaagctggt

SEQ ID NO: 28151 - DNA, 74 bp, Chlorella protothecoides
cgttagcttctgaatagagtatgcacgacgttaacaagaaaaacgcctttgatcaatgtatataacgtacactt

SEQ ID NO: 28152 - DNA, 125 bp, Chlorella protothecoides
cttaccattagctgagagccagcaatataacacatagtaattcaacttctgtgactgaagatcccagtcacccagcaacccaaagcacctcggggcatacgcgttttcggggcaagggaacactc

SEQ ID NO: 28153 - DNA, 62 bp, Chlorella protothecoides
ctgtcttataggtggggcacctgtgggaagaggggggagtttgaggagggggtttggtacag

SEQ ID NO: 28154 - DNA, 183 bp, Chlorella protothecoides
ctactccaacgtcctcctgacaggttcagaccgggatggtggctgctgtccaggatcacggagtttggctcgtacttgccattgccgcagagcagggacgctgaaatgatgcaccgctgtgaagtctgattcaccagctcgcattacctccttgcacgatcacacaccagggggaacgacgac

SEQ ID NO: 28155 - DNA, 86 bp, Chlorella protothecoides
tctcaataccaacgccccacccacacctcactcgaatgatcaacgcgcaggtgctccaacctggaggatcaggtgctgctgaggct

SEQ ID NO: 28156 - DNA, 61 bp, Chlorella protothecoides
aaggacgcatgtgggcaagtcaagcgcccccccccacatcctcacttgtgacgtcataaac

SEQ ID NO: 28157 - DNA, 63 bp, Chlorella protothecoides
gtcaacttcctcatccacattctctacccaacacaggcgagtgccaaggccgttgcctccacc

SEQ ID NO: 28158 - DNA, 61 bp, Chlorella protothecoides
ctctgagcattcggttgtggctctgctgggtgggttgggactcggtgctagggtgaggtgc

SEQ ID NO: 28159 - DNA, 71 bp, Chlorella protothecoides
ctattcaaagtcgttctgcatggttctgcagggatcacatgagcctgatcctctcctgtataccctcgcaa

SEQ ID NO: 28160 - DNA, 117 bp, Chlorella protothecoides
tcacgtcacctggtctggcccctccactccagcctcgctcgctgagaggataggacccgaatccagaataatatgttgggggtacactttcgacatgcgctcctcatggcagcagcg

SEQ ID NO: 28161 - DNA, 127 bp, Chlorella protothecoides
ggaggaatgacgtgccggcgccaggctggcgtggacaccaagcggagcactctcgcgccctaggcctggcgcggcagcgtcgctggccagccggccgcacagcacccacatccccagggtgtctgct

SEQ ID NO: 28162 - DNA, 73 bp, Chlorella protothecoides
cgagaagctagaggtgtgtgtgcaggaaatagatgtgataaatatgtatgccttactggcagcccattgcgaa

SEQ ID NO: 28163 - DNA, 71 bp, Chlorella protothecoides
ggctggtacatctggcccatcacccaaacgaacctctcatttcgacgggaacgaatccccatcccccactg

SEQ ID NO: 28164 - DNA, 118 bp, Chlorella protothecoides
gcaggcacccagtgctctccacgagcgcagcgccagaccctggcgctggctgcacgagccttgagtgcctcccctggccaaggatcagaacccgtcgccatccctgacgctgcatacc

SEQ ID NO: 28165 - DNA, 66 bp, Chlorella protothecoides
gggaggccggtgatcaggtccagcgtcatggcctgccaggggtactccggcgtcggcagaggctgg

SEQ ID NO: 28166 - DNA, 61 bp, Chlorella protothecoides
ctgacaggcctctgccagaggcaggttgggtcctcaaaggaatggcactccagcgggcaaa

SEQ ID NO: 28167 - DNA, 238 bp, Chlorella protothecoides
cgctgaggaacgaggatgagcaccctgcgcgggctcggcagcgtcatgaaaccttaccttgcgatgcctcggctcgcccacatggcctgggagcagctggattggcgtgcgctgacaagctgctgcatccgggcgtgagcgtccagcggcgtcgcaggacatcgttcctgcctcttggtcgcctggttgatgccacgaaccccaccttaccccttgaccctgactccttgccggctga

SEQ ID NO: 28168 - DNA, 73 bp, Chlorella protothecoides
gggggagctctggatgggacaacagtcgcccctgatgtccaccatggcatgcaagcagatcggtgctgatcca

SEQ ID NO: 28169 - DNA, 70 bp, Chlorella protothecoides
gagcctggagaatgtcttaaggcagtgctgtagggaggaagcagctcccagcatgcccggggcgtggggc

SEQ ID NO: 28170 - DNA, 90 bp, Chlorella protothecoides
cggactggggctgggagacgggctgggagaggggacggggctgggggacgggctgggggaagggctgggagatgggctgggactgggact

SEQ ID NO: 28171 - DNA, 78 bp, Chlorella protothecoides
cggggtgtgccggggggtggtcagtgtgtgtggggttgtggtggggaattgtgaaagcaaagctcagggattccacga

SEQ ID NO: 28172 - DNA, 67 bp, Chlorella protothecoides
gttcacccctccttccccactctgcgcacaggtgacaccggccatcaccatgaacttcatggagtgc

SEQ ID NO: 28173 - DNA, 63 bp, Chlorella protothecoides
tggccgtgaagtggcagactacctggtcgcacatgttgatgacatgctgatatcatgaaccag

SEQ ID NO: 28174 - DNA, 121 bp, Chlorella protothecoides
gctggatcctgcagcggttgggtttgaggagtggattgcaaacatcacccccaacccttcttgaaggtggtagcatggtctcgaccttccacggggaacgaaagagctccacatgcgatgc

SEQ ID NO: 28175 - DNA, 130 bp, Chlorella protothecoides
gtggccaggactgcggatggtccaaagccaccatcggcactgtgcaccctgttggcgaacgggtgctgcagggggagcgactcggggtcgaccgagggagtcgcctccatgtcattcagcagatcaaact

SEQ ID NO: 28176 - DNA, 79 bp, Chlorella protothecoides
ggtcaagtccctggtcgagaacctgggattaccattcaggagctccgttagcttgtccatcacccaggaagacagacgg

SEQ ID NO: 28177 - DNA, 91 bp, Chlorella protothecoides
gccatggtcgcagaggaccatccatgcctcactatacgacaaggcaggctaatcaagtaaggagcggtgactcgtcgacaacgaaagaatc

SEQ ID NO: 28178 - DNA, 74 bp, Chlorella protothecoides
gttcaccttgacgccctgagggaggcaggattcttttacttggaagactgggcaattttgatcctcacgtgtac

SEQ ID NO: 28179 - DNA, 61 bp, Chlorella protothecoides
gcaggtgcctcctccctcgaggctgtccacgtccgctcccgacaatgtgtgggaagacctt

SEQ ID NO: 28180 - DNA, 602 bp, Chlorella protothecoides
aagccataatagctgatttcatgagggacaagaattggaaggagagagctgctcgcaagctgcttagagaagatatgcaagcatcagggaaagtgccactccactccttcccacttcctacagcgaacctgtcaccgccgtctaggtacatagcgtctcaagcagaatagttgtgaggctgggtcgggctcatcaaggttgtacatccttgccacaagcgctcacaccaccaaccaaccaagcatgtagctcctttacccaattgcacactcaatccctgcagtgcgcgttctgatccaccttcagagtttacgtctgaagcagatgacattgatgaggtgagcaatccagctccagcctatgggcgtgtcgggatgtcaaaggtgcaccgcctggatgcttgcactggtgatggttgatttgtttgctgatgtatgctgggcccatgttttctgtacacagttgcagttgacggcccacgtactctgttcactcctctttgatgcattcaaaaccacccttctctgctacagcatccggtccagcagccaccagcttcccatatgcacccaatgccttgcgtgccatccctcgtgtcccag

SEQ ID NO: 28181 - DNA, 78 bp, Chlorella protothecoides
cctcttgggagtgggaggtggactcctcttgggagtaggaggtggactcctcttgggagtgggaggtggactcctctt

SEQ ID NO: 28182 - DNA, 74 bp, Chlorella protothecoides
ttgacgcaaaggcagggcgagcctgcccaaacgagcctgatgacggcgccgagctgacgagggcgcaagccatc

SEQ ID NO: 28183 - DNA, 64 bp, Chlorella protothecoides
gcagagcgccctcctggtgagctgggggaacgctgggcatggcaccctgggcatggcggcaggg

SEQ ID NO: 28184 - DNA, 149 bp, Chlorella protothecoides
tttgtgtgttgttttggaggggggtggcctggaaagtctctggagggggggcctaggagtgctgacgtccgcccatccatgttatcgcatggcatgacgcacaccctgcaactcccttgaaacacccacggcccactgccgtctcaggg

SEQ ID NO: 28185 - DNA, 61 bp, Chlorella protothecoides
ctcggacggggggacgaataccatgtgtgctcccccccccaccccctcccctctctacacc

SEQ ID NO: 28186 - DNA, 129 bp, Chlorella protothecoides
ctcttcaccacgatctcccccagctgcgacctggtctcccccggaggcggcagccagtactgccggtaggcctgccgcgccagcgcggcctgcttggcggccagcacctcgggcggcatgccacgcagc

SEQ ID NO: 28187 - DNA, 61 bp, Chlorella protothecoides
agagggcctggcgccgagtgtaccgccagctagagggcctggcggagcccatggcaccgag

SEQ ID NO: 28188 - DNA, 959 bp, Chlorella protothecoides
  modified_base (250)..(440): a, c, t, g, unknown or other
taggccgcagccgctggttgtccgtggaccgtgccgtcaccagggttgtcgtggaaaatggaaaacttcgattatgcgagtttccggaaattttcgagctgaggaccccgccatatcgaaacttttcgggctatgttacatcaggcacttcatgcaagggggagggggggcgaggaggtaacatgcttggccatatgagtgtttttaactgcatcaggtagcatgccatcgtccaggagatactcatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgctgcgctaattcccacacttgctcagtccgcccacaccattctcactgtgcgctgggtgtgcctggccccgatgggctactgccatgtcagctcgaaatttcggagtcgaaactcgaaaatttgatgtccccgaatatttcgcgccgtttacctcgaaacccgcaatttcggtaaccctggccgttacggtgggcaggtcggcgccccgagcgcagtggaagtacgcctttgcagtccaattctgcgccacacgggaaggatagatacaatgatgcggttttggcaagcacatactcttgcaagcccggctgagagcagcacacgcaaggtgtctcgattttgaattcgtaccctgtcaggacggcgattctcgcagttgaaggcggtcctgtgcttgcggctctcgccgcgcagaaaagtcatcaatgcaacttgtggggatccttgcttgtgtagagggggctccttgcggcgcctgcggcagatgtgcagggtggtggtggtggacgagcaca

SEQ ID NO: 28189 - DNA, 153 bp, Chlorella protothecoides
tcagcgtgtgtcctcgatcggaactgggattgcaccctagcaggttgggtgttgtaggctcttgtggcggtccgctcaagcaagcaaccttgccgggcgtgcagggcgcagacaggccagtaacgctggggagtggtgggggacactcgtcat

SEQ ID NO: 28190 - DNA, 61 bp, Chlorella protothecoides
gctggtggaggcagtagcgctctccacaatcacagaaactgaattgaccggcgaaacgcga

SEQ ID NO: 28191 - DNA, 61 bp, Chlorella protothecoides
caagtcagacacgatcgcgatcctcagctcttgacgctcgtctccgtcgcggctccccccc

SEQ ID NO: 28192 - DNA, 80 bp, Chlorella protothecoides
agggatggcaaaaatctgtgtcaggggcagtgtggcataccaggtcacttccacaagagtgccattcaaaagacttgata

SEQ ID NO: 28193 - DNA, 114 bp, Chlorella protothecoides
cgcggcagaggcgcgggggagcgaggcgacagggacccaggggaccgaggtgccgagccctcccggaaccgcggacggcggggtctgggccggggtgggcgggctggcagagcg

SEQ ID NO: 28194 - DNA, 79 bp, Chlorella protothecoides
aaggcctggcatactgagtggtgtacatgtaacataaggcctggatcacaatcatcctgatgtctgggcgccagctgaa

SEQ ID NO: 28195 - DNA, 103 bp, Chlorella protothecoides
ttgtcagatactcttgtgacaagctctgatgctgacccctcgcccaggcaagtgcatatccctccacctccctggtcatggcacaaagggagttttgcatcac

SEQ ID NO: 28196 - DNA, 65 bp, Chlorella protothecoides
gacagcatgcacaactttccaatcacggaattatgtttcgaggtatgtgactggaagcccacatg

SEQ ID NO: 28197 - DNA, 63 bp, Chlorella protothecoides
tccaggccagctcgatgcctgcatttgtggtaatttttttttttggggggggggggggggggg

SEQ ID NO: 28198 - DNA, 70 bp, Chlorella protothecoides
gtggccatggcccccttcttcctcagaacgctggcgctggcgacggcacgccaggtgggtgccgcttcgt

SEQ ID NO: 28199 - DNA, 63 bp, Chlorella protothecoides
aaatattgcgtgtggaggctttcaacccttcacaatgtccatgtatacaccttgactccgccg

SEQ ID NO: 28200 - DNA, 138 bp, Chlorella protothecoides
gatggactaaatcgtctctcttcagttcctcaaatcgctgcaaactcgtacgacccgccttctcatcgtttgaaacttttatctgcggcatgcaaaaccccagcatcagcattcatcgacggcgattatggcgagaag

SEQ ID NO: 28201 - DNA, 76 bp, Chlorella protothecoides
tggagagggacccgaggggatgaagaggggaaatctccgcaagacgtccgccctgtccttcgatgacgaggatgag

SEQ ID NO: 28202 - DNA, 70 bp, Chlorella protothecoides
acctggtgtggatcccatattagtaaacgactggatcagcattcagacaggcagtgtataggaagggggg

SEQ ID NO: 28203 - DNA, 70 bp, Chlorella protothecoides
agcgaaatgcaatcagggcgggcaaacaacaaaaagccccccgccatgtcgctgcggtattcctgtggct

SEQ ID NO: 28204 - DNA, 74 bp, Chlorella protothecoides
aagagctaaggatgggggaggcccctgggccaccaggagccacccgggcacgaccgatgtgtggtgacggcgtt

SEQ ID NO: 28205 - DNA, 68 bp, Chlorella protothecoides
cgccgttcaaaagggggtgaatacctgggttcgcaacatggctgtggtgtactgccgccagaattccc

SEQ ID NO: 28206 - DNA, 67 bp, Chlorella protothecoides
tttaggagggtcaggacccagaggcagcgtccagggggggggaggcatgagtcacggttccaagcac

SEQ ID NO: 28207 - DNA, 80 bp, Chlorella protothecoides
tgttgccgcatgagcttgagcaggtctgcatgaggggtgcacagtgtgagtgccggggaagggatggcactccaagagtg

SEQ ID NO: 28208 - DNA, 172 bp, Chlorella protothecoides
tagattgcatcctgcgggtggatgcgatagtgtgtgtgctggttttgcaaatgaggaagtggatacgtttgtgtgatgagaaggaagagggacgggagcggcgctgccctgcttccaggggtattaaatcgaactgcacttctagccttcacacaccttcttacttactcac

SEQ ID NO: 28209 - DNA, 63 bp, Chlorella protothecoides
gtcgggtcatggatctcgctgttgagcaccgcgcgcaccgctcctccacccatcaccgccccg

SEQ ID NO: 28210 - DNA, 107 bp, Chlorella protothecoides
ccttccgcttcatatatccatttgactgttgatgggtgtttcgattcactcagtctccgttgctctgaccatggggccatgagcccttcccgccttttctacagagc

SEQ ID NO: 28211 - DNA, 61 bp, Chlorella protothecoides
gtgcgccatgcaggacaaacctcttgcatgaccagcctctgacaggcggacatgccttcgt

SEQ ID NO: 28212 - DNA, 61 bp, Chlorella protothecoides
gttgcagataccaactttaagaatcacatcttcactccgccacagccatgcctgtcgcaca

SEQ ID NO: 28213 - DNA, 88 bp, Chlorella protothecoides
cgccctggcctttgccggggtcgatcccgcggaggtcaacgccctgtccatgcatggcacgggcaccccgctgggcgaccccatcgag

SEQ ID NO: 28214 - DNA, 136 bp, Chlorella protothecoides
gcagggtgtctttggatgcggaacagcatgcaggggatgtcagctcctgcaggttcttgagtccctgttatggaaagtacacccacttcctcagttcacattctcaaaattccatccccaaaggaccctggcacgg

SEQ ID NO: 28215 - DNA, 147 bp, Chlorella protothecoides
gcgatggggctggagggctgcagcatcacacaccctgcagatgtgggcagggcagagctcttcggtgatgctcgacactccagatcgacaagtcccttggggtgatggtgcgggcccccagggcactcctccgtacccacctggatc

SEQ ID NO: 28216 - DNA, 61 bp, Chlorella protothecoides
ttccttcccaaccaccgacacctgataccttacagtgaccctctcccctccttccccactg

SEQ ID NO: 28217 - DNA, 61 bp, Chlorella protothecoides
ttcgtctgttgtccatggtgcacgctgaataccagggcaggagtggcaaggggtggcatag

SEQ ID NO: 28218 - DNA, 112 bp, Chlorella protothecoides
tggcttggccgataggggccaccaggggccatgggagctgcctgtgcacaggacttctccacctcatcttcactctcatgcccccgtgcagccttcatccccaagtcccgcc

SEQ ID NO: 28219 - DNA, 73 bp, Chlorella protothecoides
gcctgcttcggatgtcttcagggaacgtcccgcctctgacgttttcagggagcgccccgcctctgacgtcttc

SEQ ID NO: 28220 - DNA, 62 bp, Chlorella protothecoides
tgcccctctaggccagtgtacggaatccgccgcatgggtcgggtgcccatgacttggaaggt

SEQ ID NO: 28221 - DNA, 77 bp, Chlorella protothecoides
cacccgcaactgccacacttcaattcagtgttccgaaatatggacttgtcgacatgacgtgtgttgttaccactccg

SEQ ID NO: 28222 - DNA, 74 bp, Chlorella protothecoides
gctactggcgcagagtgggcctgactttgcaggccgatggaaaagcgggatgcagtgcatcctgcgtcgaccac

SEQ ID NO: 28223 - DNA, 76 bp, Chlorella protothecoides
gtgcaggtttcaaggtggagccctgcggcaccagcttttccgagccggatggtggcacagcaggcgccaaacccag

SEQ ID NO: 28224 - DNA, 274 bp, Chlorella protothecoides
aacactgtacatcgatatacaaccagctgatacgccgatgggaatccagctaggattagccagctcgatggcaactcgtcgtggacccctcaagacgctgggattccaaggaaaattgagcgccgcggatagagcttcacctcctgctgctttagacttgataccggggggtagtatcatagtaccctgaacgcctgaacgccgaatgccgatgttgaatcatcttcccgcgcatatcgaagtttgtagaactcacccgcgaggttgctccctt

SEQ ID NO: 28225 - DNA, 10111 bp, Chlorella protothecoides
  modified_base (2652)..(2661): a, c, t, g, unknown or other
  modified_base (2714)..(2725): a, c, t, g, unknown or other
  modified_base (2786)..(2795): a, c, t, g, unknown or other
  modified_base (2989)..(2998): a, c, t, g, unknown or other
  modified_base (3246)..(3255): a, c, t, g, unknown or other
  modified_base (3887)..(3896): a, c, t, g, unknown or other
  modified_base (6109)..(6118): a, c, t, g, unknown or other
  modified_base (6444)..(6453): a, c, t, g, unknown or other
  modified_base (6864)..(6873): a, c, t, g, unknown or other
  modified_base (7147)..(7156): a, c, t, g, unknown or other
  modified_base (7416)..(7425): a, c, t, g, unknown or other
  modified_base (7629)..(7638): a, c, t, g, unknown or other
  modified_base (7816)..(7825): a, c, t, g, unknown or other
  modified_base (7954)..(7963): a, c, t, g, unknown or other
  modified_base (8347)..(8378): a, c, t, g, unknown or other
  modified_base (9010)..(9019): a, c, t, g, unknown or other
  modified_base (9317)..(9326): a, c, t, g, unknown or other
  modified_base (9918)..(9927): a, c, t, g, unknown or other
ccctcataccagccagaggtctgcaaccagctgctctacgatggcgagttctgctccacctcccagcccgagtggtctgccttccgggagccgtcctttgggcactccgtccttgacatcctgaacgacacgcatgcgcactttgcctggtaccgcaaccaggacgccgacacatgtgagcttgctgggggagaggattggaggggcgagaggcctgggctggagtctgggggtaccctggtgctaacggcttcccctgcatgccttgccatgattgttacagccttccctctgtgcatggctgcggatgatcgaccctgggatgtcctgccaggtgaagaggtttgaaccgaagctttccctcttccgaatgatcctcctgcaacccatttctccctcacttgctcctctgctgcagccatcgcggatgaggtcttcctggtccgcaacccaggggagtgtgggatcccgctggatggcctcaacaaccaggcttattgaggcgctgaataaagagggaaggcatcgctcgcctgcctacattgatgaccaacctctgatggtcctaggagtaatctgcaagtgacagtcgtgacaccaggcttgattttcggagacacccaagccagccaagctccctcgacatgtactcgagtatgctgctaatcatcccacctcgctcaagtgttcttcagctgcaggataataatttgcatagacatcagcacccagcaatactcctgaccacgcacttcttctcgacccatccatttgtgaggcttgtgcagtttgaaaggtgaagcagcaacgacctgaggctccagcgcggcagtgatcagtcctcgcccctatctgaaaagtgtcaatggtattcatctcgaccgcagatcatgataaatttcgtgggaaagcgggatttattcagtggcagagaaggatgcaggggcgacttctttgagatcgggtctggggcacacttgagttcatggtgccctgccaggttgacagaggcagttgctgagagacttgcccctgggagattgctcgaagttgtaccgcgtcctgtcgccagcaaccccgcccgaaaactaggcaccacagaaagagctccgctgtccctgcactgctgcggcccgccaactcttgctgccatcagggcggcggagtgcacttggcatggaggcgctccaagcagcccggtgggccatcaattcatgaccctccagccctgctcggtgtttctcaactccactctggcggcacagagggtagtctacggcctgtcaatgggtccccaggggacagcggcaacgatgagagaagcgtatgagggcggaagggggatggaggagcgtagctgactcggaatcaagcaccaggtggacatgaatcacttgtcaaagtcgaaaatgcccttaatttttacgtctagaaaatggacagatggcgtgcctgagagtgattttctgcgggctccaagttgcaagccctcaaagtatgacaaggtgcactcttgctgggcttagagcctcggccagtcaatgccctccaagtatgtcatccagtgatggctgtcccagtgacctccgggaagcgactgaatatgtgcagtcccaggccaagcgctgcggcgctggcagacgcaatgctggccaatgagcaccagtcagtggcgacgccattcctgaagtctggttgcacactatgggctcctttggagctaggctatcggtgaagatgtatcaaatcttgccagtcaaacacatcaaatacataacacgagctgctttctagtaaggccagaaagctcttgaggggcagagtaaccgatgaagatctctcccgagactcttgtcattcccccaagcaactgcaggtggcacacacgtccggagcactagtatgtgcccacgaagtgccttcgcaaaggaatggaagtctcccacaaaatcgattacctgcctgggtaacccaagaactcaatcatcacaaggtatctttcatacagatactgctgtgcattgaatggagaagtgtattgcggggaagacagaacccaaccacgaagctgtccagacgaacggtcgtagatcctgcgacgagtcaaattgtggcccagcttgtgctctcagcacgcggacagactggcgagacgaaacgcactcaataaggcacttgatagcaacctacgcagatatgccgaagtttgtggacctggctttgaatcggtatcacgcggcccaggggaaggtcgatcaagatgcccaggacttgagtccctcctctcgaatattcgcgccaagccaccggggagatggcagctgcatctcttggagtgaccctttaaaaccgtgcctaaacgctcggatttgttgatgcaggtttgggttcgtaattcaacaagcaaacacccagccttcagcgcgatgggtcgtgctggcattgccggcgtggtgatgtgcgccgttatgctgcccttcgcggcagcccgctccatgatcgagctgaccacggcggacggtggcccagtcagtttgattcccaagaccattcagtacgactgggcggacaccacgcctgatggcatcttgcgggggagtcccgacctccccgcctccgaaccccgcctgcagcctgccctgcaggggtacnnnnnnnnnntcggagggggagtctcgaccttcccgcctccgacccccgcctgcagcctgccnnnnnnnnnnnntagcttaggactgattttactagtctagaccacaatctcaacgcgcaggccaatcccagannnnnnnnnncggctgggttacaggtgagggcgccgctgtgtacagcatcggggattgcatctgcatggagcaagctcgcggaagcggattgcggagtccggctgaagaatcgccgcgctcaaccggagcgacccctgcggagtgcccacctccagcggatgggtggggcagccatgggcgtcgttctccgagggtgagggtcnnnnnnnnnnaggctgggttacaggtgagtagggtgctatctcagctcctgggagtggtgtgggaagggggaagcagcccacagggcggaacgcggagtcccggacgaaccaacgcggtccgcaactggagctgcggagtgagcacctccagctgatgtgggagcccactgtttgcgtcggttctcgaggatgatggatgtggtacatgatcgctgtacataatattgagcacaatctcaacgcgcaggccaatcccnnnnnnnnnncagcttaggactgattttactagcctagagcacaatctcaacgcgcaggccaatcccagaccggctacggattcctggaggggtatcctgacagcagcacgagcaatgtgcagctgggacttgcgcccagcgcatacaccgctgttctggaaggtgtggagtgggggaggcacatgcacagcctatggaccgttctggtgtcccaatagctcagaatgcgcatctgcagtgccttcagggaaggaggagggctcgtgctctacgaatgccccaggagggtactcttgctcactccactctgcttgtaccattcaatcactgcttcatgtcgttcccatctgcgatggccgtcaacttctccttgcatgtccaggaacttcctcccgctacgactacatccactacggcttcaagggggctatgaactatgcaagccccaaattgcactccgtagtcgccgaggacctccgccccaacaccacctacttctatcgtgtgggagatctgaagacccagtactggagcaaggtactgttctctgcaagcgcgccctttttcaagatgtgcaaagagagccaagtttttgattggcaccccctgcccaggcgatggaatggagagcacctcccaannnnnnnnnngaggtgaatttacgtgcacttgcacccgtgtgcggggtgcacagaaggagccagggtgggaatcagcacatcccacccgggtaatggaatggatcacgcacaagctgacacgccccttgctccacgtctggcatgcaggagcacaacttcaccacccctcccgctggcaaaagctaccccctccggttcggtcttgttgctgatgtgggccagacttacaactcgtccgacaccttccaccaccttgcagccagcgagccccaggtgctcttcgtgggtttgtgtgttacgtaggaccagcagcccatgggaagggttcatcatccatgtgcgcatgagtgtgtacattgtcccttggcatgcacatctcataaagtgggttctctgaacatgtggttgcaatgacagtggcaacgacgaatctcccaccttcggcattgctgcccgtcagtcactggtccaaaggtttccccaagggcatgggacacgtgctgacgccatgggtgccccctcacagatggtcctcttcatcggcgacttgtcgtatgccgacaactatgaggccaacgggactctgtacccctcaaacttcaatatttcataccctggagagaacgtcttcattcccttcggtgtctatcatgggtccttccaaccgcgctggtgagctggtgggaggcagagtatgtgaggacctatcctggaatccagtggatgctgcaacggtgtggagcagtttctgcctctccaggagcatgtcagccttcctgaaatgacataccaatgataatgtgtgccccacaacctccgaagggacacatgggcgcgactggcggagcccgtcacctcttctttcccattcttgttcaccgttggaaatcacgaagtagagccccagagcgacgggcgccagtttgtgtcgtaccaggtgggggccggagggtggtggtggacggagcgggggccaacgctgcttctgtgcatgggcggcaaactggggttcgagtccagctccctgatcggtggtgtcttaccagcaacatgctggtaccggtcgacgggcgatgggcagaacagtgcccctagccacgcggccctcggcaggcgtcgtgttgaagccatgccccattgcagctggccacgtagagttcccatccttggaggccccaggtatttccttcccattcccccctgaatgagcaggcccggtacccacccaaccacaaagccagtgggagcgacaatcccctctggtactccatgaatgttggccctgtgcacatcgcattcatcacttcctatgccgactacgaccaggaatcccctcaggtaggtccagccttccctttgccagctgaacatctgggaccagggacatgggcgtgcgtacctaatgcattggtccaagccattccttccagccatgctcggctcccctgactacaaaatgaagcgaaacaaactgctttaactgcctgatgcacctgcagtacaagtggctggctgacgatctggccaacgtgaacaggacggagacgccttggctcttcgtgagcttccatgccccttggtaagagcatgccgtccatgcaaacttgagtgccaatgatcgcgtgcccgcccattgaattctcttgccgctaaaagcagggacggtggtagaacctcccagccccacagttgccaacctgccaatgcctgctatcgtgtgcactgagagcgactttcatcaagcatgcaggtacaattcgtacagcgcacactaccaggaagtcaattgccagaggctggcaatggagccactgatctttgagaatggtgtcgacattgtcctcagtggtaaggcagaggctccctgcttggctgatctgctgccctgatggtatggagattgttgtcgaaggtatttccttatgtcaatacgccgctcggcccaggtcggtgaacgtatgcccaccaccccaattgacgctcaggtcatgtgcatgcattcgagcgcaccttccctgtctacaactacaccgtgagtggtggggtttggggcattaaccctcatactttcttccagcatcccgagttcgcacatagcaagtagtgaatcgctccccactcacatctttgcttccctattgcaacacagctgaatgactgtggccccgtgcacctcactctgggtgatggcggcaacattgagaagtgagtgtgcctctgtnnnnnnnnnnaaggaaagatgtatcctgattttctcgacattgtgggcagctccccctcagagccttgccctatcgctgatggctgaccggtgtatcattttcaaagaccctcacagctcctgtgttccacccccgctacacatgagcaggcccggtacccatccaactacgaggccagcggcagctccaatgccctctggtactctgtgaatgtcggcccggcccacatcgccttcatcacttcctatgctgattacgaccaggattctgctcaggtggggctggctttccgtgcaccaatctcaaggctggcctctggcactttaacctttgcnnnnnnnnnngaggattctgctcaggtggggctggcattccgtgcaccaattttaaggctggcctctggcactttaacctttgcatcggatcctgttgcatctcatcacggcatcctgtgcaagggtgagtggagcgctcaggttcctggctgagacgatgtcacactgttcccattcaccggagcacctgcagtacaagtggctggccaatgacctggccaatgtcaacaggacggagacgccctggctcatggtggccttccatgccccttggtgcgcgcgagtcgtgtgtgtgagcgggagtgcctgcgctcgaatgcctcgtaccactgggggcaggaaggcgaccagaatgccgagccccacgggtcccagcccgcgctagccattacccctgtgcatcgaggatcccgtttcccnnnnnnnnnngatgccgagccccgcgggtcccagccgcccctagccactacccctgtgcatcgaggatcccgtttcccaaccatgcaggtatacatcttaccggtcccactaccaggaggccaactgccagaggcttgcaatggagccgctgctctttgagaatggcgtcgaccttgtcctgaacggtgagagcaaggtgtcttgaaaggagcaaaggggctgcgtggtgtctgcgagccggctcctcaccacgccctgtcttgccgagacatcccctcacccnnnnnnnnnnatctgcgaggcggctcctcaccgtgccctgtcttgccgagacatcccctcacccagctcctcgcccaacgcccaccctcttctatcctcaggtcatgtgcatgcctacgagcgcaccttccccgtctacaactacaccgtgagtggcagggcggtggggcctgagcactagatccaaatcttctgacggatctttgcgcgcaagagtcgcaaggagttatctggtcacgactcactgcctttcttctctattgcaacacnnnnnnnnnnttcctcgcccaacgcccaccctcttctaccctcaggtcatgtgcacgcctacgagcgcaccttccccatctacaactacaccgtgagtggaagggctgtgggggctgagcactggatccaaatcttctcgcggatctttgcgcgcaggggtcgcaaggagtaatctggtcacaactcactgcctttcttctctattgcaacacnnnnnnnnnntggctgcccgttaccattcccagctcaccctgttcactgcttgcagtaaataatcgatgggtggggataggaactgacctcatcatcctctcattacctgccatggatgtgtggtgcaagtgcgacaagcctgatcactgaaacgcgccccccttcacgttcctttggtgctcaggcnnnnnnnnnntacctcaatctgggtgacggcggcaacattgagaagtaagtgtgcctctggtggctgcccgttaccattcccagctcactctgttcactgcttgcagcaaataatcgatgggtggggataggaactgannnnnnnnnngcgctgccagttgccattcccagctcactctgcgcactgcttgcagcaactaatcgatgagtggggataggaactgacctcatcatcctgttattaccttccatggatgtgtagtgcaagtgcgtcaagcctgatcaccgaaaccctccccccttcacattccttggtgctcaggctcgaagctgtatttgctgactccccaggcaactgccccgcagtgcctgtgcacggaccctctacccagccagaggtttgcaaccagctgctctacgacggcgagtattgccccacctcccagcctgagtggtccgccttccgggagccgtcctttgggcactctgtccttgaaattttgaacgacacgcatgcgcactttgcctggtnnnnnnnnnnnnnnnnnnnnnnnnnnnnnnnngaggtggggagctgtggtcgagagatgggccacccctggtctggatggctgacccatgcacatcgccacgagcggtgaaccctcacctctgtgcatgaccgcggatgatggactttgagatgttttggtgggcaatagggtatgaaattcgggggctcctgctgggtcttggggtgtttgccccagggtttcctgcagggtggaggcgtattgaccgaaggttcctctctcagtaccggacctcctgcgaccaagtcctttcgtacatgctaccctactacagccgtcgctgatgaggtcattctggtccgcaacccagaggagtgcgggatcccactggagggtctcaacagccaggcctattgacaggctgcatctagtgaggaggccccacccgcctcccgcccggaagaccaacttctgaagaatcaaggaatgacctgcacgtgactgatgtgcaatcaagctccagtgctgcaacttcctagggtcccatcttgccagcctacctcattcgaaatgcagtctggtgtgctgcacccctcccccgccccttgccttgatagtaaccccattgctgaacggcttgatgcatagacaattgcattctgaaatgcttccaccagaacacnnnnnnnnnntccccgccccttaccttgatagtacacccattgctgaacggtttgatgcatagacagttgcattctgaaatgcttccaccagaacacatgctcttgaccttttccatgtgtcagacttttgcaatctgggaggtgcagcatcagtagacgagggggtcacagggcggcatgatcagtgctccttcccatgcaatgcgtgtcagtggtaggaagattgccctcggatcatgcctatcacgtgggaaagaccgtgttcagttcagtgatagagaaaggtgctggggagcttgctttgttnnnnnnnnnnggtgtcagtggtaggaagattgcccttggatcatgcctatcacgtaggaaagaccgtgttcagttcagtgacagagaaaggtgctggggagcttgctttgttctgaagaaatgttgacattgcacggaggacaaagctgcaccgagaaattgtgcgacggacggccgcagatcgtgttgaagagccacacagcagccaagaaagtgctcgcggcgcgaagacagaccggcagggcaaaagtgctcacaaacatggtaccaatcagaacccgatggggcacgtagacgtttgggacgtggctttgagtgggttcaaagatataccggaggaaggtcaacctactcaacaaaaacccggatgttacccctttcgagcatattcccgggcaaaatgtgagctggccccggattcctacgacgtagatccttcatgaacggtaccttgtcatttcggtgcttcagtccatgtttaggtttaaaacgccaacaaacacacaacaaaagctcagcacgatgagtggcgctggcaaggccagcgcgctcttgtgcgcctttgtgctcttgcccttcgcggcagcccgctccatgatcgnnnnnnnnnntggacggtggcccagtcagcatgattccagagactgttcagtacaactggtcggacacctcgcccagcggcatcctgagggggagtcccgacctccccgcctccgacccccgcctgcagcctgccctgcaggggtacccggaacaagtcagtgtcacctactatggacccacctctgttcgttt

SEQ ID NO: 28226 - DNA, 104 bp, Chlorella protothecoides
aatttactcaggtgcacactagccacataaacaactagttacttgccccacagagcttaggtcagaaacaagtctgagaaagttgcaatacaaacagtcgcaga

SEQ ID NO: 28227 - DNA, 61 bp, Chlorella protothecoides
ggcctcgctggtggacgcgcgggccaacatcctggtcccaggcttctacgacgcggtgcgc

SEQ ID NO: 28228 - DNA, 74 bp, Chlorella protothecoides
aactcagcccctgcataccccatcgcgccaacaaagtcatcacgtcaccttgctgctgaggatcctcggcgccc

SEQ ID NO: 28229 - DNA, 61 bp, Chlorella protothecoides
gtgtagggaataatattgttcaatgcttacaccttcacgttgatgtggggtgcgtcgaagc

SEQ ID NO: 28230 - DNA, 80 bp, Chlorella protothecoides
ccttcctctccaaggtaggtcgtggctggcagcccgggtggtttgctggggggatgtgcactcccggccctggcatcctt

SEQ ID NO: 28231 - DNA, 4123 bp, Chlorella protothecoides
  modified_base (471)..(480): a, c, t, g, unknown or other
  modified_base (677)..(686): a, c, t, g, unknown or other
  modified_base (760)..(769): a, c, t, g, unknown or other
  modified_base (1196)..(1205): a, c, t, g, unknown or other
  modified_base (1578)..(1587): a, c, t, g, unknown or other
  modified_base (3232)..(3241): a, c, t, g, unknown or other
  modified_base (3302)..(3311): a, c, t, g, unknown or other
  modified_base (3387)..(3396): a, c, t, g, unknown or other
  modified_base (3599)..(3608): a, c, t, g, unknown or other
  modified_base (3732)..(3902): a, c, t, g, unknown or other
gcaggccagcggctcgccgcccgcgctgaagcccagcccagacagcaccacgatgctgccggccgccagctgcgcggccaccgaggcggcggccacgtggcgcaccatgcccgtggcgccgtggtccaccccgcccaccacgccccggcgcttggccgccaggtagttgccagagacgacgctgaggctgggcgtgtgcacggtggggggctcgccccgcttgccgcgcgtgtggcgccgggccagggccaccgtgggggcctggggaggcggcggacgggcaagaggggggggtggatggtagggtgtttgaggggaaggggcatgcgtgcaggtgcgagtgttgggcacggggacgccgcaaagcatgtcgcacggagcctttctcatcgaaaggtcaagaagcatgagtttgtcagggatggacgccgggtgggggacaatctggggccccgccaatcaaggatgccnnnnnnnnnntgggcgggcaagagggtggggtggatggcggggtgcttgagggggagggcatgcgtgcagatgcgagtgttgggcacggggacgccgcaaagcgtgtcgcacgcagcctctctcatcgaacggtcaagaagcatgagtttctcagggatggacgacgggtggggggcaatctggggccccgccaatcaaggatgccnnnnnnnnnnatagggggacgttgtgtcggagacgggaggggcgggggtgcctagcacgagcacgagccggacgcccagacctnnnnnnnnnncctccacctggaggcgagccaggcccgctgcctggatgagccgctccatggcatcggagtcggtgacggggtagggtgaggatgtgtcggagacgggaggggcgggggtgcccagcacgagcacgagccggacgcccagacctggggtgcagcggattgggagttaagcacgcacggtgtgcatgtggcgacgggaaggacgtgctcgagtggggtgggtgctcagcaaaagagtccggcacgacgcttgcagacttcttgctggggaacgaggaaaatttgaaaaggactcgaagctggcaggtgtgcccctgacgggaagctgcctttgggtgacacgggacagaatacctgcccctgcccacaacgatcgcttggagtcatgaggacgctgcgccaaagcccatgcagtcgccatcacacaagnnnnnnnnnnctgggtgacacggggcagaatgcctgccctgcccacaacgatcgcttggagtcaagaggacgctgctccaaagcccatgcagtcgccatcacacaagatcaacagttaagagacacgcgctggcctccctgtgcctcgacccaccatgcaggagcgcaatgtcctccagcagggcactcagttgactccgattggagaccacctacatcgagggtgggcaggtggatacaggcagctgtgcacaactgccccatcgcgccggtaatgtgtctggtgcgagggtctcagaagaaggtccgccacctcctcatgctgcattccagaagaaacacatccggctcgcccttccagcaccaacaccaggagcagtggnnnnnnnnnncatgtctggtgcgggggtctcagaagaaggtccgccacctcctaatgctggattccagaagaaacacaaccggctcacccttccagcaccaacaccaggagcagtggagcgatggctccacacactcacgcacctctccaggaatgctgatcacgaaggttcgccccctgtggccttcaatgtagggcgaggcctgtcgaaagaactggacgaatagcccgtactgcgttcggtccagggcaccatagtcccgcccgggcaatcccctggcagggaccacggcatgctgtgggcttggagcctccgcagaggtcgaggcggtgccattggtggtgctggacgggggcccagttgggcctagccggtgggtgcaagtcctgacgcggtaggtcagaggagatgtgcaccgcgcaggagtcaacgaaagggtgctgcagcccctcatggcatggcgacagctctactgagatcctaaactacaggccatggggttagagtgtgctgaagctgggactttgaagagggaaaacctcagatcaccaccccttacatgggggcgcgaagatgaaaccctagggggacccccgcagcgcgcccgcgggccaagattgcaggggtggaccagatgcaacgactgggtcgtgcggtcgggatcgaggtaggaatattccgaggaggcttcattgcaatggtcaggagcgtgcacatagacgccggggttgaggcctacgcacagggctgcacccggctcgggttcagcctgcaggtgcggacatgccttgatgagggtggtgcaaggggatgggagttgctccactgctcacatgggtgatgcaggagtggatgacagccctggcgtcccaccacccctgcaccaacaggtgggcttcatcctgggccggccacagcctggtggcaaggacctgctgctggccctcatccccaccccagactgcgaggcgggccctgcagcgaggctggatggcaagacgcacatcaccctcgacgccgactgggtggtggagcacgccctgcagctgtcgcgcatcctgatcggaggtgagaagcgcggtgaggtgccgcggcgcaccgccctgcttgccagtctgatcccggcagcccccaccgcccctggccccgcaatacacgtgcaggcatccacgtgctgggtatgtttgtggtggcccccgcggcagtgtttgaggccagcagcacaatcgtggcgggggtgctgcgggatgtccagtcggagctcagaggtgggcgggacttggtgaggggggaggaggaggtgcacggagagcagtggaggggctgggtgctcccgcagatcccccacaccagggtatcgccagacgttggtcgcccgcccgacgctgcccgggccctctccatgttgcacgggactcgcccaagcgctcccctgtccctgccccccttcctcacaggctcccatgcctcgctcgtgctgcacgccgacgcgaccagcggagcgctcacggccagggatgcgagcgggcccggcgccctgaagccctgcgaccaccgcgtctccgcgctggcagagcagatggtgacgctgcagacccggtgggccggcgtcgggtggtgtgcggatgtgggtggtgcgcctgccaagctgggnnnnnnnnnnaggactcgcctaagcgctcccctgtccctacccccttcctcacaggctcccatgcctcgcnnnnnnnnnncagtcccgtgaccctgtgctgggggtgcagcagcttgcatgcttgccttgcgcgccatgtgcctgtcgccctccgnnnnnnnnnntagtcccgtgaccctgtgctggggtgcagcagcttgcatgcccaccttgcgcgccatgtgcctgtcgccctccgaccaccctgtgaccccggggcatgctttctgttgcctgcgcgccgtccacaccccacccccccccgacaccccctgcaagcactcctcctgaacccttcagtaagcccctccatcctcctctacaacannnnnnnnnnttgtgaccccgcggcacgctctctgttgcctgcgcgctgtccacaccccacaacccccccgacaccccctgcaagcactcctactgaaccctacagtaagcccctccatcctcctctacaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggggcggctgctgccccccggcgccgcctcgctggccgaggcgggcgcagcggcgggactgacccccgccggaccctggaccctggccctgcacgggccaggtggcgtgcgcgcgggcgcgcctggagtggccagcctacgaggcgtgctggacgcacgcgcctgtgtgggccggagggagggcgtggcggcggcgcgcgacgcgctggcggccgacg

SEQ ID NO: 28232 - DNA, 125 bp, Chlorella protothecoides
acagcggctgcagctcgggcagggcatgggatgagggcggcatggaagctgaggaatgcgaggcggagcctgctcctgtctccacgctgtcgccgccccccgccagcacacggacggccctgccg

SEQ ID NO: 28233 - DNA, 62 bp, Chlorella protothecoides
accctttatgccaccaacccaattcagatcaagcctggggagttggtctgctgcgttggacg

SEQ ID NO: 28234 - DNA, 123 bp, Chlorella protothecoides
agggggaccaggcgtcccggtgagtgaggcttgggtgctgcagacaaagaggagggagggtgtttcaccttcagggaggaggagtgaagaggacctgcgcatgcagggtggtgggggtcccct

SEQ ID NO: 28235 - DNA, 251 bp, Chlorella protothecoides
ccgcaagtcgattatgggtgggaaggacggtgtgaggaacctgacgcagactgcaggtgcgcctgggctgggtggggtggccttcgatttccagggaccgcggagtgacgtgcgagtgaccagagtccatgtgcaggagcagcacagatttccgaactggcttgttggcgcacacaccgttccttggtcttatctcatgcgatccttcgtgcctgcccccgacaggcacgcgggcggtgctggagaaagct

SEQ ID NO: 28236 - DNA, 80 bp, Chlorella protothecoides
cgcgggacggaggggaagtaggtggggcgcagggcctggatgtcgtccagcagggtctgcgggtcgccgcggaagaagcc

SEQ ID NO: 28237 - DNA, 792 bp, Chlorella protothecoides
gtgcgcggtaaggaaacagcttgcaagggacatcaacccaactttcaattccgctctgggctcattcgggcatcgtcacttattccaagccggacaagtcacccgatggcgattgcagcttctaacccccctcaacgtcgcctcaagaacagcatctccgcgtccggaagaacctctgccatgcgtcaggtcacgcggagcatgatcgtacatgaagaatcccaatgcacgtctcgaatcgatcactatcgcccacgaattttgcaaacaccggttggagtggccaccatgttatcactccataggtttcacgtcgttgtccttgctgttgaggaaatggtgaaacatccaccgctgaggactcttcggctgatgaggccaagtacagtttcacaagcagaggcgaactaagcggcagagagatgggtgctagcaatgactctgaatcttgatactgtcccaatatatgcatatgaaagtatccgtggtggagtaaatcactgaggttaccaaagtgtagggagacagtgacctcactaacactgcgaggcaggagccccctgttctgcagccgttcgctgcctgggatgtcggcatcgaggatcagaggcagatgggtttgaaacactttgttgcgggtgggcaacttgatcgccatctattcttgtggtctttgcaaggacattcataacctattcacgcacaaagatgaatgccgagaaatagcagcaaactaccaggttcaccatttcagggtcaggacgtttgagctcccgcctgagaacttgaggg

SEQ ID NO: 28238 - DNA, 119 bp, Chlorella protothecoides
gtgagcatgcaagatccccctggaatttgggctcctcctggacctccaatgccatcctccctatgcacacctgttcccattctgaacctacccacagggtggatgcctttgtctggtat

SEQ ID NO: 28239 - DNA, 122 bp, Chlorella protothecoides
aggggttctgccagcaagaaggatacctcgttaatgggcggcaccatgcctggcagaccatgcgcactccctaccaggcaccgctgaccatgttcatgctcaggcctcccttccccttctac

SEQ ID NO: 28240 - DNA, 61 bp, Chlorella protothecoides
atggccagatgtgaccaggctggtagcgtctaaaacctgggagcgcagaaggacacccgaa

SEQ ID NO: 28241 - DNA, 69 bp, Chlorella protothecoides
ccgcagagtcagtcccttgaaaggtctcctggctgacggtcgtccttcaggctccttgtaaagctgcac

SEQ ID NO: 28242 - DNA, 61 bp, Chlorella protothecoides
tcgtccttcaggctccttgtaaagctgcacccccacaattcctccccccctctctcctcta

SEQ ID NO: 28243 - DNA, 117 bp, Chlorella protothecoides
ggctggccagtgcgaccagctgacatgcataactatgaatttccttcaatactatttcctcatccaggcatgggtcggatggttttgatctgggagctcaaccccctcctcaaagta

SEQ ID NO: 28244 - DNA, 107 bp, Chlorella protothecoides
cggcatgcgagtgtaatgagacgtcattttaacaaagggtgtcccagaccaaagaacgcctgcggtatcaacgctgccaccgccagcattgcctgtgaccagcttgc

SEQ ID NO: 28245 - DNA, 80 bp, Chlorella protothecoides
gtatggagagaactgggttgacggtgcaggaatgggtgtcaagggacccagtctggccgcgctcaagcacgtctccgcag

SEQ ID NO: 28246 - DNA, 123 bp, Chlorella protothecoides
accgtgttgttctgcaggtggtcatgtgcgaggtgggtgctggggtgatgctcaggtacgcgatggggcgcccgaacaggcagcacagcagaccccattctgcacaggacaggggatgccagc

SEQ ID NO: 28247 - DNA, 79 bp, Chlorella protothecoides
gcgggtgcaggaatcgggggttggggagactgagcgccggtggtggcgttggcgaccgtccccgtgccgggggtcggag

SEQ ID NO: 28248 - DNA, 67 bp, Chlorella protothecoides
gggctgacaatgggccgtgggctgggtggggggacaggtggaggggaaggtggaggcatcaggatca

SEQ ID NO: 28249 - DNA, 61 bp, Chlorella protothecoides
gcggaactgggcccgatggaaatgcataccgtattccgctgcccggcctggggatggtgtc

SEQ ID NO: 28250 - DNA, 61 bp, Chlorella protothecoides
tgccggcaccgacgaggcgctggcctctggaatctttggggacaatctgacgcgagtgagt

SEQ ID NO: 28251 - DNA, 66 bp, Chlorella protothecoides
tcagcgcctcgcgcgccagcttgcgcagctcctcgtccgcgccggtcacctccagctgggattggt

SEQ ID NO: 28252 - DNA, 99 bp, Chlorella protothecoides
gacgcgggctcattgagagctgatggctccaggtctggggcctttggtgcagcagttccttccagagaaaattccgactccgaagcgggaatcagaggc

SEQ ID NO: 28253 - DNA, 61 bp, Chlorella protothecoides
ttgggctccggcagcacgcggtagacgcggaccatccagtgctcggaggtgaatacctcct

SEQ ID NO: 28254 - DNA, 120 bp, Chlorella protothecoides
ccacgccagatcagctgcgagctcccagagttcagcaagtgtgcgctcatcactgagactctggggccaggcatcacacccaccacccaatgccacaccatgtagaccatgtcccagtcc

SEQ ID NO: 28255 - DNA, 65 bp, Chlorella protothecoides
atagtcggcaagggagtcaagatcggaccgtatagtctgtttccttttcgtgcactgattccccc

SEQ ID NO: 28256 - DNA, 61 bp, Chlorella protothecoides
ggagtgggaagagggctggggcacggcggggagccctccaggtcaaccgcgaggcatgtga

SEQ ID NO: 28257 - DNA, 61 bp, Chlorella protothecoides
aagcacaggccagctgtacgacctccccgtagccttccgctttgtccagctctggctggag

SEQ ID NO: 28258 - DNA, 68 bp, Chlorella protothecoides
gccttccgctttgtccagctctggctggagctgggcccccgcatcgcctgggtgaacgaccacgcggc

SEQ ID NO: 28259 - DNA, 73 bp, Chlorella protothecoides
cttggagggcaccaggtctccgccacgcttaagatctgtgtgatgtgtgtggggggtcctctgatggacgggg

SEQ ID NO: 28260 - DNA, 61 bp, Chlorella protothecoides
ctggctggaaagcgcgtcgcccagcaggtattctgccatgcgcgcgacggcgggggactcg

SEQ ID NO: 28261 - DNA, 97 bp, Chlorella protothecoides
atgtcacccctgccctgtgttggtcggggttcctcgcatctcagcagatgtccatggcatgtcactaccgaccctctccaccctgcacggcaagtgc

SEQ ID NO: 28262 - DNA, 71 bp, Chlorella protothecoides
ccaggggcccattccgtgtcaagaaggggctcctgcccatacctggctgctgtggttggtacggttgtcaa

SEQ ID NO: 28263 - DNA, 63 bp, Chlorella protothecoides
agcgggggtgggggggggggggggggggggccctgcgataccaatcagcatgtttggtggggc

SEQ ID NO: 28264 - DNA, 70 bp, Chlorella protothecoides
ttgtgggggccagcccgcccccacaacatctgggcagcgctggcgacggacacggtgtgcgtcacatgat

SEQ ID NO: 28265 - DNA, 119 bp, Chlorella protothecoides
ctccaaggaggtcgtgctggagtatgtggttcccactctgggggctgtgacaggtgtgtggagctttccgagggacgtggattgcgtagttgggccctgaatcaatttccatagctgcg

SEQ ID NO: 28266 - DNA, 79 bp, Chlorella protothecoides
tcaaagggatcgctgcaccgccccgacatccaacccaggcacagctgaaggcacccagatcaccttttttctctctgca

SEQ ID NO: 28267 - DNA, 61 bp, Chlorella protothecoides
gaggagggccggctggcagggcgcagggcgacgacgaagcagcgcaagtccctcctggcct

SEQ ID NO: 28268 - DNA, 77 bp, Chlorella protothecoides
tatgtggtgctgcaccggctgatgggatcgggaccggtattttgtccagccaggcgcccatgggcaccggacgttgc

SEQ ID NO: 28269 - DNA, 61 bp, Chlorella protothecoides
gatcacaaaaagggcattaagctgcgcagcacagccactgcaagcgggcaaatagcatgac

SEQ ID NO: 28270 - DNA, 216 bp, Chlorella protothecoides
acatattggaggtattcgaatgccagaagataaataacctcactgcgtgaagttcttgtcagctggaagaatcacactgccttaccacgtcgaacatcttctcgcaagccttctgcacatactgctcgtccgtgaggttcacaagttctggggccttctccagatccctcttcatctgtgctcagtaggtagttgggcaagaggcatgtcatgagt

SEQ ID NO: 28271 - DNA, 61 bp, Chlorella protothecoides
gccgcgcaggcccgggaggtcggcggggtctgggcggaagccctgcaggctcaggctggcc

SEQ ID NO: 28272 - DNA, 61 bp, Chlorella protothecoides
ttaccatgtcccgtcgggatgcgaacgcgcaatgcatggcagattgctgtgtcaaaatatt

SEQ ID NO: 28273 - DNA, 73 bp, Chlorella protothecoides
agagtggaggtggggtggtcagaagcagctgtttgcactgacagctatgtgagcagcaggtgccaagcgcatg

SEQ ID NO: 28274 - DNA, 133 bp, Chlorella protothecoides
acgggtacccgaggtatggagggcttcagtagctctgtcgagaactatgcggggtaagtttgctgatgtactgctcgtttccacagagacaatggctttagcgacctgacagcagacagtctacatgcactga

SEQ ID NO: 28275 - DNA, 91 bp, Chlorella protothecoides
ggtgagcagggcagagcgggcctcggatctgggccgtgaggttgagggtcccgtgccgcagcatcccgtgacctgcaaaccgcccagatgc

SEQ ID NO: 28276 - DNA, 64 bp, Chlorella protothecoides
acaagacagcaagttgctattaggagatcctcagccagcagcatgaatgtgtctgtaacggcac

SEQ ID NO: 28277 - DNA, 140 bp, Chlorella protothecoides
ctggcgtgggcgaatatgtacagggattggtgagacctgcacaacaccttctaaccaatgtttgccgggatgttgagatcacaacaggacccttcaggctggtctggcaccttgtgccccgtttgatactgcccatcccc

SEQ ID NO: 28278 - DNA, 69 bp, Chlorella protothecoides
cctgggggagacagaaaagcatctgtcctcgtggcagagatattcttgatagcacggctgcatcaagca

SEQ ID NO: 28279 - DNA, 84 bp, Chlorella protothecoides
gcgtgctgctgagagggacctgcgtggcatcgtgacttgtagcgcagagtgatcgtggtggctgctcctggaatggcgacacgt

SEQ ID NO: 28280 - DNA, 62 bp, Chlorella protothecoides
gtccgcccggccagcctgcttccaccgctcgcactcctccaccatacggatggcgtgaaagt

SEQ ID NO: 28281 - DNA, 61 bp, Chlorella protothecoides
gatgagaaagggaaggtgttaagtctgctgttgaggcaccggcgcatccgtgcgatgggaa

SEQ ID NO: 28282 - DNA, 160 bp, Chlorella protothecoides
catcaaacgcacccaggggctggtggagacatgcacctttgatcgcaaggtgcctgggagggggtgggtggtgggcgcagagcagcgtgcagagcacaaagaggctcgggtgggtgggtgctccaagtacctggatgctgccggccaaactgattggggg

SEQ ID NO: 28283 - DNA, 71 bp, Chlorella protothecoides
ctggatgctgccggccaaactgattgggggaaatgctcccagcagcgtcagagggtcttgccttgcctcat

SEQ ID NO: 28284 - DNA, 72 bp, Chlorella protothecoides
gtgccaccgctaatcgaccccctctgagaccgttcactacgacagacatgatggccgccgaggccacagtcc

SEQ ID NO: 28285 - DNA, 87 bp, Chlorella protothecoides
tcacatcgtcggcgaccaccggccgtgggcagcagatcaactcaagcatgtaccttaccggtcgaggtcctccgacctacctgaagc

SEQ ID NO: 28286 - DNA, 137 bp, Chlorella protothecoides
ccgcgctgcaggccgaaatagagagcctgagggacacggtggcgcacttgggcaccctgttttacaccgccgacgcgacgctggcggcccagaccgccgcccaggaggtgtgtgtgtgtgtgtgggggggggggggg

SEQ ID NO: 28287 - DNA, 110 bp, Chlorella protothecoides
gatggggaacaggtgggcagcccctctccctctgaggtgtggctcgacaggggttgggaccagtgggcggtgggctggcaaagacggcctcagacacccagcccacgggc

SEQ ID NO: 28288 - DNA, 61 bp, Chlorella protothecoides
tcaatggctgcaggcatgggcttgcccggggcgcagactggactgcgatgggagcagccag

SEQ ID NO: 28289 - DNA, 310 bp, Chlorella protothecoides
tctcagggtaggggtgctcattgccagcataatgcttctacagaaccagctcttcacctctgcagcactatggcagctgacaccatgcgtgcttgggatccagcatgagtgtgccgtctgggcgatgtgaactctcccccttaggccagagcaatactgccgtcactcctgcagattgctctcggtgtgggagcagacatgtggcgacggcatacaggagtcagaggttccagcggcggcagatcctgcctggaagtgcatggtcgaggtgcacagtgagtccaacaacaaaaacatcaatgtgtggacg

SEQ ID NO: 28290 - DNA, 111 bp, Chlorella protothecoides
gagcaggatggaggcgtacatcacaatcaactccttggcacctacacagaggggagagaggagagagcggtgctctggtgggtgccttcaggatgcagagagctgatagct

SEQ ID NO: 28291 - DNA, 77 bp, Chlorella protothecoides
gggaaaatactcccgaatggcgtgctgggagccaggcagggtcccaggccagccacgagtcggctctttttggtctc

SEQ ID NO: 28292 - DNA, 68 bp, Chlorella protothecoides
gccagccacgagtcggctctttttggtctcttgttctttctgaaggccttggcgagtgtattcaggtt

SEQ ID NO: 28293 - DNA, 145 bp, Chlorella protothecoides
caggtcctcccagaagtcggtcttcttcacgatgctggacaccgtggccaccttggccaggttcttcaggaccgtgcccgagttcaggccctgcaggtaggtcgtgagggcggaagaggcattggtggtgcccaggagggaggag

SEQ ID NO: 28294 - DNA, 79 bp, Chlorella protothecoides
acctgggcttgctgggactgccattatctaacccctcatgactgggagtccagcacatccaattcagccttgctacgca

SEQ ID NO: 28295 - DNA, 118 bp, Chlorella protothecoides
cgtttgaatcattcttacgtgtgtctggtaaatttgcatcacctggtgtggccttccatcctacaggtcttggggttggaggctcaacccgaggcgcctcactcaaacggctcccacc

SEQ ID NO: 28296 - DNA, 61 bp, Chlorella protothecoides
gcagaacctttgtgtgtggggaggggggggagaaagggggatagaggactctgaagcctgg

SEQ ID NO: 28297 - DNA, 443 bp, Chlorella protothecoides
  modified_base (225)..(374): a, c, t, g, unknown or other
ggtagtgctcgtcggcaattcccctgccctttggggcgcccaagggcgcccggctgcggtcgcgtttgccgctggtctttggggtgtcgggggggcggggtggggggtcgccggtccggggaggccctctctgccgccgcagggtgacggagacgctgtacccgtttttgtgccagtgcccggccaagtaccagccacagccctcaaagcggcgaaagttgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctcgtccgtcttcttcttcccccgcttcccctttgcgtccacctgatactcctccgcctttctacg

SEQ ID NO: 28298 - DNA, 196 bp, Chlorella protothecoides
gagcctgcactttgcatggatgtagccaggcacagtggtgtgcagcgtgtcctggtcttcagtctgtgacgctgtgcgtgtgcgcttctgagtgtaccacgcagcttggatacagcgaccgcagaggcagtgatcgcttggggtccaacatcggcaccacccaccgctgcacaccaacgccagtcccactcaccgg

SEQ ID NO: 28299 - DNA, 79 bp, Chlorella protothecoides
gccgcaagaagcggatccagggccccggcgtgggcccccgcatgatgctccctctgtcctgggccgaccagttgcccac

SEQ ID NO: 28300 - DNA, 76 bp, Chlorella protothecoides
gagggccagcgtgggcggcggcgtgcgcgcgtgtgccggctcggcacggtgccgggcgtgggtcagcatggtggcc

SEQ ID NO: 28301 - DNA, 203 bp, Chlorella protothecoides
gagcagaacttcgcaacctcgggcccacctggggggttgggaagggggtgggtgggacactcgtcaggcgggcctgtccaaggtggatctcacagaactggccaggggcagttacatgagtgcagtgcacctatcctctaagggtacgacaacgcacgccccagggcccctgttggggctctcagcaccctccctgtcttctc

SEQ ID NO: 28302 - DNA, 92 bp, Chlorella protothecoides
tctctggcgggggatggcatgagccacggaagccgcacacttcacagccaacccccaacccaattgtgcaggcgtggagatcaccaagctgc

SEQ ID NO: 28303 - DNA, 89 bp, Chlorella protothecoides
tgttggaggtggaccccaccacgcccgcgctgcggcgcgaggcggccagcgccagctcgaacatctctcccggcacctcgaagtgcgcg

SEQ ID NO: 28304 - DNA, 62 bp, Chlorella protothecoides
acaagctggccagcaaccacatctagagcacaagaatcactcgtccggttggctgggctcag

SEQ ID NO: 28305 - DNA, 191 bp, Chlorella protothecoides
cgcatcaatcgcgggtttggaaaggacggcgccgcatcttccgaggatggcagcaaggacgttctccacgtatgtgggtgtgcggtggctggatgcaagcacttcaggcatggatgcagcatgtgctgactttggaacacaccctcctcagctgacacctgtgtaccctccccaacgcgcagaatctgagt

SEQ ID NO: 28306 - DNA, 169 bp, Chlorella protothecoides
tggatttgagaggtggcacaggcggtcacctgaggacatggcagggcaggccttatggactgaggaggtctgaaggtaatgggcaggaggggaggtgaccttctgacaagagaaagtgtggcagcaagtggtgatggattcctcacacgccaaggtctcatcagtgacg

SEQ ID NO: 28307 - DNA, 107 bp, Chlorella protothecoides
tcggtagtgtcctgcgatgagagagaaaggaggaacagaggggcaattgacaatcatcctgggcggctagctcaaggatcaggtgccgcatgccctgctggagtggc

SEQ ID NO: 28308 - DNA, 78 bp, Chlorella protothecoides
ggacaggccctgcaccagcagcaagcgtccagacacccgcccaccttggaccagctcatgctggctgtattctccagt

SEQ ID NO: 28309 - DNA, 128 bp, Chlorella protothecoides
tcttgggcgcctccttcttgggcacctccttcttgggcgcctcctccttgggtgcctcctccttcttggcaggggcggcaccgccctcactctcctcgatcaccgcaaagagctggcccacggtgacc

SEQ ID NO: 28310 - DNA, 72 bp, Chlorella protothecoides
ccatcacagagagaagctcaccccaatactcttccctgaacatgagatgctgctctgccttcctcccccacc

SEQ ID NO: 28311 - DNA, 103 bp, Chlorella protothecoides
cgacggcgcctgccagtgtaggggtggggggtgagctggatctgtgtgggcaggctcgatgcgtgccgaatgcacaggggcatgtcttgagcgcggcaaagct

SEQ ID NO: 28312 - DNA, 61 bp, Chlorella protothecoides
acaagggggcaaggtatggctagggatggggcacaacttgcacttccaccccgccaaagca

SEQ ID NO: 28313 - DNA, 117 bp, Chlorella protothecoides
taaggcaggcctccatatcatgcatttgacgtgaccccacatgcaatgcatgtatgggggaccacgaggaaggcctaatctagccacaaccagatcctcctcccaagcattacttcc

SEQ ID NO: 28314 - DNA, 87 bp, Chlorella protothecoides
cctgggaggtgtcgagatggctcgtggctgattgagaacagtgtggctatcactcatacacaggcaacttgggaagaatcacccatt

SEQ ID NO: 28315 - DNA, 105 bp, Chlorella protothecoides
ctcctttctcccttgccctcaccggcagggccgaatcaggagggaaggtggcggcgtggccggggcaccgtgcgtccgtgctcgcccctccccctcgttccctgg

SEQ ID NO: 28316 - DNA, 61 bp, Chlorella protothecoides
ggggaggggcttgacgcgtgaccgtatcaatcaacgaagccaaggggaccagagaactggc

SEQ ID NO: 28317 - DNA, 80 bp, Chlorella protothecoides
gagggctgaggccaggcacgcgccggcaacaaggtagagggtgcgcggcgtgaccctggagcgcaaatggggtatcaggg

SEQ ID NO: 28318 - DNA, 148 bp, Chlorella protothecoides
ttcgtgtcgcatcccatagcatgagctaacgtcatctctaccatgggatattgggtgtagtgagtctgacgccagcgccgtcctctcacggggagctaccccttcgcactatactagagctctgcatggagcccaccgtcttcctctg

SEQ ID NO: 28319 - DNA, 286 bp, Chlorella protothecoides
gggtgggcaggcatgctcatggtatgagttcgcaatgatggacccgccagggctgcctcgagtgagtgtgaatgggccgccataccataggcgtctccccaacgctgtggtggcttcgagacatgatgtcaaaactcaagctgtgagttgctccatgtcctaggccctggtgactcacacatcgctccaccagcctcacaccatgatcaagctcccgtcctgctttcccataccagctttccctccctcacacaccgcccacatctgcccctctccaccttgtagt

SEQ ID NO: 28320 - DNA, 119 bp, Chlorella protothecoides
gcttgcagctgttggctccggcaggcagagtgcacgctcactaccactttcaacatgtcaagcctgctttcactccctgactggaaaagtatgagcggctgatgcgaattacacagacg

SEQ ID NO: 28321 - DNA, 77 bp, Chlorella protothecoides
gtggagggtgggatgagtcagctctgctggtggcttgtagcacaagcccctgacagccttcccacgagccccttccc

SEQ ID NO: 28322 - DNA, 149 bp, Chlorella protothecoides
gggttcttgttgtgggagtcgggatgtggatgtcgggtcctggggcgttaggacagctggcaaggcgccgcaatgacacgagcaaggcattcccctgaggttccttccccccacacgcacctggttgacaaagaggtcgcggaagacgc

SEQ ID NO: 28323 - DNA, 69 bp, Chlorella protothecoides
ggtatgagttcgggtcgcaaggatgaagcggtccttgcctgccaggtcgggcctgatgtgaacgtcaga

SEQ ID NO: 28324 - DNA, 61 bp, Chlorella protothecoides
aggtacctgtgcacggatactctgcgggggtggcaaccccatcaatgtagagtgatcccgc

SEQ ID NO: 28325 - DNA, 28657 bp, Chlorella protothecoides
  modified_base (157)..(166): a, c, t, g, unknown or other
  modified_base (595)..(604): a, c, t, g, unknown or other
  modified_base (893)..(902): a, c, t, g, unknown or other
  modified_base (1414)..(1423): a, c, t, g, unknown or other
  modified_base (2035)..(2044): a, c, t, g, unknown or other
  modified_base (2250)..(2274): a, c, t, g, unknown or other
  modified_base (2487)..(2496): a, c, t, g, unknown or other
  modified_base (2849)..(2858): a, c, t, g, unknown or other
  modified_base (3272)..(3429): a, c, t, g, unknown or other
  modified_base (3510)..(3519): a, c, t, g, unknown or other
  modified_base (3613)..(3622): a, c, t, g, unknown or other
  modified_base (3844)..(3855): a, c, t, g, unknown or other
  modified_base (4069)..(4078): a, c, t, g, unknown or other
  modified_base (5213)..(5222): a, c, t, g, unknown or other
  modified_base (6482)..(6491): a, c, t, g, unknown or other
  modified_base (6547)..(6678): a, c, t, g, unknown or other
  modified_base (6741)..(6864): a, c, t, g, unknown or other
  modified_base (7194)..(7203): a, c, t, g, unknown or other
  modified_base (7832)..(8027): a, c, t, g, unknown or other
  modified_base (8085)..(8094): a, c, t, g, unknown or other
  modified_base (10425)..(10434): a, c, t, g, unknown or other
  modified_base (12368)..(12377): a, c, t, g, unknown or other
  modified_base (12914)..(12923): a, c, t, g, unknown or other
  modified_base (13885)..(13894): a, c, t, g, unknown or other
  modified_base (14594)..(14603): a, c, t, g, unknown or other
  modified_base (15305)..(15314): a, c, t, g, unknown or other
  modified_base (15517)..(15526): a, c, t, g, unknown or other
  modified_base (15993)..(16016): a, c, t, g, unknown or other
  modified_base (16652)..(16661): a, c, t, g, unknown or other
  modified_base (16781)..(16790): a, c, t, g, unknown or other
  modified_base (17486)..(17495): a, c, t, g, unknown or other
  modified_base (17960)..(17969): a, c, t, g, unknown or other
  modified_base (18203)..(18212): a, c, t, g, unknown or other
  modified_base (19591)..(19600): a, c, t, g, unknown or other
  modified_base (19906)..(19915): a, c, t, g, unknown or other
  modified_base (20352)..(20361): a, c, t, g, unknown or other
  modified_base (20645)..(20654): a, c, t, g, unknown or other
  modified_base (20853)..(20862): a, c, t, g, unknown or other
  modified_base (22001)..(22010): a, c, t, g, unknown or other
  modified_base (22247)..(22256): a, c, t, g, unknown or other
  modified_base (23085)..(23094): a, c, t, g, unknown or other
  modified_base (23337)..(23346): a, c, t, g, unknown or other
  modified_base (23698)..(23707): a, c, t, g, unknown or other
  modified_base (25683)..(25692): a, c, t, g, unknown or other
  modified_base (26593)..(26602): a, c, t, g, unknown or other
  modified_base (26705)..(26714): a, c, t, g, unknown or other
  modified_base (27000)..(27009): a, c, t, g, unknown or other
  modified_base (27073)..(27082): a, c, t, g, unknown or other
  modified_base (27294)..(27303): a, c, t, g, unknown or other
  modified_base (27484)..(27493): a, c, t, g, unknown or other
  modified_base (27843)..(27852): a, c, t, g, unknown or other
  modified_base (28266)..(28353): a, c, t, g, unknown or other
gggggcgggggcgggggcgccggtcaccaggtccgggccccagccggggggcgggtgcatggagtgaaggcctgcgagtgcaggggaggggggagggaaggggtggctttgctgatgcaggcgaggtgcgtgaaggggccgcggggtggcaggcagnnnnnnnnnngtgcatgggaggggggagggagggggtggctttgctgatgcaggcgtgttgcgtgaaggggccgcggggtggcaggcaggtggaggtgaggctgggcgcgcggcagcgcgctgctcgatgcaggcacctcgccggcaggacagccgtgtggtgtccaccagcctgcacttcctgccctgaggcagctgggctcaagcctcgacgcgatcctccctggcgctcatgcctgcgggagcgccgggccccagcacgcccagtgggtgcccgcctcccacacacacacatccccaccgtccaccccccgccaccgctcctcacctgcgtgggagggcctggcgccgggcgcggcctccgcctccagccaggagggggcctggggaagctggagggacatctccgcgatgcgcggggtgaggccggagctgtgcnnnnnnnnnnacgtgggtgcccgcctcccacacacacctccccaccgtccaccccacgccaccgctcctcacctgcgtggggggccctggcgccgggcgcggcctccgcctccggccaggagggggcctggggcagctggagggacatctctgcgatgcgcggggtgaggccggagctgtgctccgacccctgccgcgcctcgggccggggctcggtcctgatgggggccggggcctggtccccagccccgtgccaggtgcggggcaggctcgtggcatggagcaggtggtgctgggannnnnnnnnngcggggcctggtcgccggccccgtgccaggtgcggggcaagctcgtggcatggagcaggtggtgctgggaggggagggaggaggggtgcagcggctgccccacccgcgccgctgccgcccagtcggagccgtcggtggggtgcgggcccggctgccagtccctggcgggcatggaccccaccgactgcatagtcacgaacccgtccgcctgcttctggggggtgcagggctctgtgaaacccatgtaggagcccgaggcgcgaggggtggtctgtccgatgtcgagccggggggcctgaaggggaccaggggaggtggtctgacaaggaacaggaagagaggggcgccagacgcggcagcggccgtaagagttggatgtctgtccatgatgctttcgaacagaggggggggaatgagcggcgtgtcgctgcccaaccccaccgaggcaggcgcggcacccaggaccgcagcacccaccccacagtcagccctgcaaccgcaccttgggaccnnnnnnnnnngcggggggcctgaagggggccaggggaggtggtctgacaagaaacaggaagagaggagcgacagacgcggcagtccatgatgctttcgaacagggggggggggatgagcggcgtgtcgctgcccaaccccaccgaggcaggcgtggcacccaggcccgctgcacccatcccagtcagccctgcaaccgcaccttgggaccatcccagcaagtcagatggccataatcttggtatgccgaggtatggaccagggcatcgccatgctcaggcacggagtacatgtggctggctccacacctgcgccatggggtggcatgggcatgggccagggcgctccaccatgcaaagcatcagcaggtaccaggtgcgggtgatcagggttgcgacgtgggggacggggcgcgcggccagggcggggcccgtagctcagcgtaccgtcgtggctgagggggagcgcaaccctactccgcactcttggcctccaagggaagggccggcgaacccgctgggatctcgtcagcaagagcggctcagtcaacacgtcaaagcacgatctggtagagcttgctacagcgtgcagaccaggagtaccgcgcgtgcgagcagagtgtnnnnnnnnnnccaactcgtcaaagcacgatttagtagagcttgcttcagcgtgcagcccaggagtaccgcgcgtgcgagcagagtgtggtgctctcgttcgtcgactccactctcgctcagcagcggccagggcgaagccttgtggaccgggcacagaaggtcacccacaacaatgtaatgtgcgaggtaaggagagacggtctttcaggctgggnnnnnnnnnnnnnnnnnnnnnnnnncgggagtccgctcccccgtcccgtccgggagtgctgcaggcgccgagagcagtacatcctgctgtacaacgttcgcgtcttggatgcgacctaacggctcgtgcgatttaaacgtactcttgtcctttgctggacaggacttctttttttttcgaatcagcatatagttgagcctttaattcgtgcttgcggcgcgccaatctgctggcactnnnnnnnnnngtggatgcgacccaacggctcgtgcgattcaaacgtactcttgtcctctgctggacaggaattcttattttttcgaagcagcatatagttgagcctttaattggtgcttgcggcgcgccaatctgctggcactgggttggacgatcaccctagtcgccacacgggcactgcgggggacatcacagcccagatattcgtgacgaaacaggcacagtgagttttggcaaggcatcgaaatagcaagctgcgtcgctgcaggagaagaggcgatctgcggatgcctcaccacggtcgagcccttccttcccccgcagtgtcccggtcgtcactgaatcgcggattctacgcaccannnnnnnnnncatcccctccttcccccgcagtgtcccgatcgtcactgaatcgcggattctacgcaccagatgtccctctcaacatagtgccggaagtacccctggacagacaggagcgtgcatttgagcagtatggcaacacctcgacatacaacctggagaacgtgctgcggcaaaacatcctgacctccacctactaccagaaaacagccgtccccatcgagcagtggcaggatctggtggatgagatctactacaggtgtggatcgcatggcgtgcctgcgatgttggcgtgtcgtggcagtcgagtcctggtctttatgccatctgacgatcatgtatgccgccctggacctgcgccccaggcacccaccggggccccctcaccctcaactcccgcagcgtggaccatgtggagccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgacatggttggcgtgagggcaggatcgctgcaaagggcgtggagaccttgaggtccccacaaaggccacagtggctggnnnnnnnnnntgcgagctggttggcgtgagggcaggatctctgcacagggcgtggagaccttgaggtctccagaaaggccacagtggctggtgtgtctgcaatnnnnnnnnnnttggacctgcgcccaggcacccaccggggtcccctcaccctcgactcccgcagcgtggaccatgtggagccctggatgagcgggaacgcgcgagggccctccacggccttcaacctgctgtaccgactgggtcaattgaagcccacccccaaggagctgcgcatgatgctggaccacaaggactcgccctacatcagagcggtgaggtggcagatgcgtttnnnnnnnnnnnncgctctttccacacccttgtccaggtgggattcctgtacctgcgctacacatgcaacccccggtacctctgggagtgggtcaaggactatctcgaggatgctgaggtaggccatgcagtgtgttgtggcagattggcctgatcctgtcctgatgcgaggtaggggctgatggaccgtaatctatagtggttgggaagcgcagtgtccctcaccnnnnnnnnnnagactatctcgaggacgccgaggtaagccatgcagtgtgttgtggcagattgacctgatcctgtcctgatgcgagggaggggttgatggactgtaatctgtagtggttgggaagcgcagtgtccctcacccgcatctacacagctcctccttccccaacgacacatcttacaggaattcacacccagccccccagggtggggccactcggtgaccatgggctgcttcctccgggacatccttcttgatcaggtacgcgtggactagggttggcgaggaggtctgggattcgtatgtactggctggggtgacgtcgataaaagacatcatgcaagtcgtcacttactctgttggaagtgagcacagaggggagaggtccatcaatgtttcagccctgtcctgacgcatcctccctcgacttcccccactccctctgaggagcgcaggtagagagcatggccgtgagagcgtgaggccccccttgtcttgtgccgcctgcccctcctctcaatggtacttggcttccacctgcttgcgtgcatgccactgtgcatgtctctcaggacccgagccctcccatgcgctcgcccaaacatgctcccccgcccccgccgcgccgcagtactactttgagaccattttcccgcgcatcccgaccaaggtcaccgacgaggtgctggcggggctcaaggcacggggcctgccgtgcaaggcgctgggcaacgcggggcagggtggcgaggaccggcgcggcatcgccgagtccgccgcgcgccccgcctcggtgaagcagtcgctgagcgtggccatgggccagcgcgcgcccaaccgcgcctcggcccgcgagctgggccgcgggacgggggccgacctgcagctggagcaggtgatgaagaggaaggagagggcctcccccgtgcgcggggcagagaggagggaggccaggtcgcggtcgcggtcgccgcgcggcgcacccgtccccaggtgcgctgggcgtgcagcgtggggactggcggcgtcgtgctgccggggatgtcacccaggggatgttgagtcgctgatgagcggcagcgtcggggcttctgcggtgcgcgggcccatgatccccccctgctgagtaggactgtgtcgccgtnnnnnnnnnncgagtcggggatgagcggcagcgtcggggcttctgcagtgcgcgggcccatgatcccccctgctgagtaggactgtgtcgccgtcgatcctgatggcgaatgggagggtgcgctgcccgagccctggagccaccatccatgcatgctgactgctcttcctaccatccacaccaccatgggcagggcggagcgtggtggggatgaccggcggcagcctgtgctggagagcaggcggcgggaagccagtcgcgagagcgatcgtcgccgcgagcggagcgtggaggacgccaggaaagggcggagggaagtggaccccccgagggaggaccggcgtcggcgtgacgaatacgatgacaggagggggattgaccccccgagggatgaccggcggggacgggattacatcgatgacaggaggggtcccggctatgactccagggacagcaggcgcggctattacagggatgaggacgagcgccggcgtccagccccactcagcaggtctgcgcacgacgagcgccggcgctcacccctgcctccgctgcacgatcgtagtccggccagcaggcggggcccaggggatggccgccccgccacagacgtcttcagggagcggcctgcttcggatgtcttcagggaacgtcctgcttcggatgtcttcagggagcgccccgcctctgacgtcttcaaggagcggcctgcttcggatgtcttcagggagcgaccggggagctcagggtacaggctgtgatcccgtgtggcattgagcatggtgatcgctgcatgagcacgtgccgttcatttgccctgcgataggccacttcatgtggactagcacatgtggactagtcgccgagaatgttgcagcggcacccatgggaggagcatgacggctttcagaagcccgtgtagtatccgcccccgtcgtctgagcggtaggcccagagcagcagtgcgcttgccagaatgaagccacattggagcacagatccctgcgcgtatggagaggggcgctttgagacaggaggtggtgctcgcacgaacagctctgccagcgtgctgtgtgtgcggcaggattcattgagcaactgatccacgatgcgctgtggataatgggccgaagttgcaggatcccttgactcctcgtgcatccagtgcagaccgagggccacatccatcataccccacgagtcatacacgcaccagacctcacaggacgcaccactccaaccgacacgaactgggactgttgggtgcatnnnnnnnnnnaatatgccactacatgtggactgaccgccgagaatgttgcagcggcacccatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattggagcacagatccctgcgcgcgtggacaggggcgctttgagacaggaggtggtgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccttgacccctcgcgcagccagtgcagaccgagggccacatccaccataccccacgagtcatacatgcaccagacctcacaggacgcaccactccgaccgacacgaactgggactgttgggtgcattgaatgagcactgcaacgctgccacccacggctgcaaaagccgtgaggaagctgaagagaagccagagccgtgctcgcaactgcttgagcggtgcggatggagcaggagggtgggggcatggagccgcctcacagtgagaatgccacattgctgcgctcagcctttgcaaagcccctgccaactgcagagcaggcacctgnnnnnnnnnntgcatggcaccgcctcacagtgagaatgtcacattgaaacgctcagcctttgcagagcccctgccaactgcagagcaggcacctgggctccatgttgccctcacctcgacgccgtcctcgatgctctctgctgcctctgccagatctttccttggcaaggcattgatgagcagcagcgctagcgtagcgactattcccggccagttgtatctgaatgggtaggcccccgactccccagtgctgacctgcaccagtgcgtcagcccagcaccaccatcctggcgggaggacgtggtggaatgtgagcaccagaagtggtcgacccaatctgggcagaacgcagtacgatgaagtccagctcctcacctattccaaagagggcgccagccaccaaggggccccattcttgtagcttggcattgtacagatcccaatccacctcccctgcgcatgaagagagtcacgagtttatactgaggtctcaaagccgattcctgattctcgaaagactccagattccgtaccatatatgaaccagtcagcgatcgccttcatatattatactctgcagtgccgttcaacctccgctgatctgattacaaggaagctgtgtcaaagcaatagcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccctcatacttttctcccatcgttattgtcgtcccttctctacgcactgggtgccnnnnnnnnnngttatactgagcctcaaagccaatccctgattctcaaaagactccagattccgtaccatatataaaccagtctgcgatcgccttcatatattatactccgcagtgccgttcaacctccgctgatctgtttgcaaggaagctgtgtcaaagcaatagcacaccacttcttgcaaacagtctgagtgcaagtcgacaaggtgtatgttgaggggtttcttggattcccgaagtcttggctgaagttgactaggcgctcccacatgcacgccgggttccccacccccgcgcgtgagactttccggcagggtccatggccatagtccggcacgcccccatacttctctcccatcgttgttgtcgtcccttctctacgcactgggtgccctcccagtgggtccacagcgaccccaactctgtcctcggggttccaacaccgcgcaaccccccgattacgcattcgcagctgatcactcgcctcggatcgtattgatagaacctatcgaggcctgtgtctgttgctgcagctcccattgtggatgggggagccatgacgaaggcccgggaaggcaagggggtggctagcccccacaagggcataggcagagcctctgcatcgggggatgaagcacccagctccgtcaagcgcctgtccctgacacgctggctgtcccagtccagccagaaggcgctgccagagaaggagagctccagctcggacttttacaaggaatggggaataaccaaggagaaggaggtgtgtagtgtccgagcccgagggcatgctggctgattggacggaagctacggcagagttgatttggccgcagcatccgtccgagtgctcctctgatggaggtcaaccaagatgagccgatccccgacggcgtgctgcccctgccttacctgcgtgtccctgttgcccttcgacaggccgagctcctgcaagactttcggcgccaggtcgagcaggacgtggggcggctgcggcctttcttcgacgacttctacctgcgacgcttccttcgggcgcgggggcacgacctgagcaaggccaaggccatgttcctcgcccacctgaagttccggaaggactatggggtcgacaccgtgctggaggactttgactttcaggttggttgggtgaggtcagcagggggcaaagccgctcatggagagctgctgcaagacacttcatggtggtggtccgcagcaggtgtgcatgcaggaacaggctcgcaccctcccgctccctaccaaccccatgcacacaggagcgggatgccgtgctttctatctacccccaagggtaccacaagaccgacaaggaggtgagggtcggggtcaggccattggcccgagtcctgaggggtagagatcccttcccgtccttcctagctcctcccgcttgcattgcaacagcaccccagccaggggttcactgtcctcgacagacccacaaccaacagttctcgtcccaatgcattccctcctttccaccgacaggggcgccccgtgtacatccagcacctgggtcaggtgaacctcaagacgctgaccgacatcaccaccgaggagcgcatgctgaagtaccacgtgcaggagtatgagcgctgcctcaaatacatcttcccggcatgctccaaggtgcatcgcgggggcgtggggcttgcaggagatcttctgggtgaccgaggtggcctggtggaggttttgtgccctgagacgcgcacatcatgatgggaatgtagggtttcgagggacctggtgcagggcttcctgtctgtgtgtgcgaagtcgcaccaaccttgattcttatacctcctcctcctcctccttccacccctctcataactcagaccctcattcataccccgcgccccccccttcccccaccaccacacacaccacgacccacccccctttgtccaggtggctggtcaccaggtgaacaccacgtttgcgatcctggatgtcaagggcgtgggcctcaagcacctgacgggggagacccgccggatactgagcgagatagtggagattgattcggtgcgtggctgttgattggtgaggggaaggtcgaggaaagttcctgggtatgggaatgacacgtgtcacccagaccatgggggcgaaggcctcgtggactggagcaggctgagtgtccatgtgtggcctgggacggggctgcacatgattcgcagagacctggcctcggacgtctgctgcacactcgcatctgcggatggcatgcgcccaatcccccccttcccatctgcccacagaacaactacccagagacactgggcaagacgttgatcatcaacgcgcccnnnnnnnnnnggcatctgcggatggcatgcgcacaatccccccccttcccatccacccacagaacaactacccagagacgctgggcaagacgttgatcatcaacgcgccctccatgtttgcggtgctgttcaaggccgtcaagccgatgctggatgcccgcacgcaggcgaagatcaaggtctgctccagcagctacctgagcgagctgcggaagtatgtggatgacgagaacatcccctcttacctgggaggtaggatcatttcagtgggtgttggggagttgcatcaaaccattcgcaagggattcatgccatgggcgttgtgcatcgcggcatcatgccgagggtcatgaagatgcagcagccgctccggctctccggaagaccggcaagaggagggcagtctcaaaccttcttgtgctcatgtggcaggaaagtcaaaggggtccctggtggatgacgtggggccatggcagcagccgcagctcattgccgagatcaacgcaggtgggtccactggtcctggtggaacggagttgtgtcggcggcgagggggcagcaaagatgtgatgtcccgagtggccacttgcagcggggtccgccctgcactgtggacggtgatacgagcatgctccattgccacccttgtgaaaaactctcaatcacagaggtggcggccagggacggcctgccgccccctcccggccctgtgtctgcggcttcggtggaggcgccggccgcggcgccagagcccaaagtccccagcgaggatctggtcgccgcggaggtccccgcccctgaggccagcgaggagggcggtctgacgatgggcgaggaggtctcctccaccacgacataccaggtcacctccgcctttgccggccagtccggtggcgagttcctgcggaaggagtctttctacatggatgcggaggactactacgatgccagctcgaggcgggggtccatgacatcatgtacgatggccccgaagaaaggcgggggtgggtggggctggggtgcggggtgcaaaagcccagatgcgaagcacgatcgcgtttggggtagagcgcactgcctgccgccggccctgcgggcctccgtgctcctccctatgggatggggcgccaggcgcatcggccatggggtgctgggtgtcgacgaatctgctggcgcagcgttagcgtcgcgctttaaccctttcaacctgcgtgggcgtcttggctctgtgccttgaccacaccccagcctccgctcccctgaccctcactcctcttggcgctcctctgatccaggctcacacccttgccccacttgcagatgtatctggggacgagagcacatacagctccccgcgcatgggctttgcgagcgaggccggcagtcccctggtcaggctggggacggacgggccgggcggcgccatccccaccgtgcacgagggagaggtgctgcccgatgtcctggccaggccttccgtgtccatcgggagccgcatccaggaggacggcctgcaggtgggcggcgcgggaggggagcgcccggggtgcatgcctgggactgcgtgcatgtacaaccctgccgagccgcaccccttgctctgcgagcgcaggagctggcgggcagggacagcgaggggcaagacctggtgctgaaggcgggtctccagatacccatcctcggtgcggcgattgcctgggaggaaggcagtgtggcagggcatgggaaatgaggctggagcacctgtgccctcaggcaacctgccgcgaagctgtaggctgggctgtgccatgcccccacatgtgcagtaaatccaccctccccatacaaagaatacctgctggtccctcatcgtgccccgaccccaaacccacacacatggacctcccgaccccgcagcgcgcgtgcgagccctggagcagcgcttccccgacgtggagaagnnnnnnnnnnaattgcctgggaggaaggcagtggggcagggcatgggaaacgaggctggagcacctgtgccctccggcaacctgccgcgaagctgcaggctggggctgtgccctgcccccacatgtgcagtaaatcaccctccccatgcaaagaatacttgctggtccctcatcgtgccccgaccccacacccacacacatggacctcccaaccccgcagcgcgcgtgcgggctctggagcagcgcttccccgacgtggagaagggcctgcgcaggcagctcagcagcggcgacaacctgcccagtcggtccatcgggacgggcaccctgctgagcagggtggtggcgttggagagggcgatggacaccctcctcgtcgcccaggtgggggatgagtgcatgctggggctgtgtcgctgccagatggggtcaagaggttgttgtgcggggctcctgtgctggacctgcgatgcacgggcaggccgccctgcattccatcgatcaaggaccaccggctccttgccactccatgcgcccttccaggagnnnnnnnnnnaccgccagaaggggtcgagaggaggttgtgcggggcgcctgtgctggacctgcgatgcacaggcagtctgccctgcactgcatcgatcaagaatcaccggatccttgccactccatgcgcccttccaggagactgtgctggaggaaaccaggagatcaggcgcagtgcagcctgagaacccaggagcatgcgggtgctgcacagtcatgtaatgctgcagggcgctgggctgccggccttatcggaattcgaggagaccgcacgaggaatcgtcgtgaggacagtaccaaggtgatcatcacccgatacaccattatgtagcgttgtgtaattgcaaatccaataccgtgctcgtcatgcggtcgggaagcacctgaacagtgcagtgggtctctggcacctccacggcctggttcgaactcgacggcaggcccgatgagcacggcccggctctgccaggcgcccctgcttctgacagcgcgcctcgcgccacgaacgcgctcgtgtgcattgcaatgtcgcggcatggcctcaatcaggcggatcagggagggggtggtctcccaggacaccccagctgtggaggtggtgcagggattcctggaccgcatccatgcgcagaatgcctctctgggagcatttatcaccgtcctggacaagtctgctctggaacgagccgagcagattgatgctgaggcgcgggaggggcgaccccttggccccctggcgggggtcccctttgccgtcaaggacaacatctgtgccaagggcgtgcaggtgcggcggggcagcttcatgcggaacaagtggagatgcagtgcgctgatacagcagccgcagcccaatgagtctggcttgcactcgcaccgcctgagcgaacggccacttcagcgccggctgcctgagccccccccctcgtcccctcttcccatcccagacatcggccgggtccctgctcctgnnnnnnnnnnaccacttcagcgccagctccctgagcccccccctcttcccctcttcccctcccagacatcggccgggtccctgctcctgcgcgggcacctgcccgcctacgacgctacggcggtggcgcggctgcaggccgccggcgccatcctggtgggcaagaccaacctggaccagtttggcatgggcagcaccaacgagaactccgggtacggccccgtgcgcaacccctgggacgcgcggcgcgtgccgggcgggtcctcgggcgggtcggccgccgcagtggcggcgggccttgtccccgccgcgctgggcagcgacacgggcggctccatccggcagcccgcctccttctgcggcgtggtgggggtgaagcccacctacggcagggtctcgcgctcgggactggtggcttatgccagctccctggactgcctgggcgtgctggcggggagcgcggcagacgcggctggtgggttgtgcaggtgggggtgggggggcgccgcctggcaataatctgcaggctgcacccgcgtcctcccgtttgcttgctggtgggtgccctgccatgcctggacagcaggcgtggtggggtctggactgcccagaacccttggtgtcgagtgccgtccaaccaggcggcgaagatctcacccggggcttcacgctcacacaagcccctctccccctcctccccccccccccccnnnnnnnnnntgagtgccttccaaccaggcggcgaagatctcacccgaggcttcacgctcgcacaagcccctctccccctcccccccacccccctcatgttcagagatgctggcagtcatgtccgggcatgacgacctggatgccacgagcagccaccgagaagtcggggacctgcggcccgccgaccccgcgccctccgacgcccggccgctggcgggccgcagggtaggcgtcatcgccgagacggtcggcgagggcgtcgacgcgagcgtggtggaggcgctgcaggccaggtgcgttgggtggtgtgcagaggggggagggactggagtcaggtccagccaaacagtgcacgcggagatgtgaggggcggactcagcgtctctgtgcttgcggcctccaaggagtgtcgactcaagcccacagtgccctgctcgagcgtggggcagacgccgcctggaacgctgcccatcccaccacgcatccacagcgccgctcatctggagtcgctgggggccaccgtggagcaggtgcacctgccttccttcgcctcggggctgccggcctactacgtcatcgccctgagcgaggcctccagcaacctctcgcgctacgacggcgtgcggtatgggcagcgcgcacagcgtgaaggtgagagatgcgacggataaggtctgattttgtagggttttgcaagaggcaagcttggtnnnnnnnnnncgggcagcgcacacagcgtgaaggtgagagatgcgacagataaggtctgatgttgtagggttttgcaagaggcaagcttggtcagagctctgggctgtgtttttcatggctcggcgtgaatacctggcccggcacgcacccacgcccgaccaagaagaggcccactcccgcggccttgagcagacccagcctgggtgctcacnnnnnnnnnntgctcggccaagaagaggcccactcccgcagccttgagcagacccagcctgggtgctcacatcgctcctgttcttcaccccgtccatgagcattgcccaggtctgatcccccctttgccatgcagagctgcgcgagatgatgcgggccagccggcatgggggcctgggcgcggaggtgcagcgccgcatcctgatgggcacctatgccctgtcggccggttactacgacgccttctacctgcgagcgcagcaggtgcggaccctggtgacgcgcgagctgcagcaggccctgcggcgctgtgacgtgctcctctcccctgcggctccaaccccggcttatgagctgggccagactgccgaagatccgctggccatgtacaagggtgagggggcggggcccgagagggtcatgctgccctgatgcaagctggctgctgggagccagttggaaggaggggcggggtggnnnnnnnnnnnnnnnnnnnnnnnncggttctactcccccttggaattttgtaacgagatactcatactgagtggggccggtgtgcgcgacttgcatgcactcactgcttcccatgctccaccacatcccatgcttcgacaattcttcccccctttccctccctcccaggcgacatgatgacggtgaacatcaacctggcaggccttcccgcggtcaccgtcccgtgcggttgggcggcggccggaggcgagggaggcgccaacgcacaggccccgctgcccatcggcatgcagctcattggacggcccttcagcgaggccagcctgctccagctggcccacgtcttcgagctgaccaacccggaacgggcacggcacactctgccagatgcagggcggtgacgccgcgccttggctgggcaacagcagcggtgcatgctgctgtgtccccctggaatgtttacatctcagcgaggtcagagaatgcaaggtacactctagtgatcccatgtctgggccatggcgtccttggctggaatgtggtgtggctcctcactttcccaatcgcaaccctcttgtgcctctgctgtgctgtacacaatggcttctctatgtgaagctgacaaggggattccagacacaggtgggccaggaaggacannnnnnnnnnaagcagcggtgcatgctgctgtgtctccctggaatctttccatctcagcgaggtcagagaatgcaaaatacagtccagtgatcccatgcctgggccatggcgtccttggctggaatgtgnnnnnnnnnntgaaaaagtctgctccggcctcccgcttcaactgcgcccctgcgtccttccccatagctaccgcgtcctcctctgtggcggggccctcacgcgtggtctggaacagctgcttcccctctgtgtcggccaccaggcccctaaaggacagcctcccatccgcagtcttctgttgttgggcaggggagggagagagagggacggggattgcttgtgacgacacacaatgcatcagagcctcctcagaaagacgtttgcttctccaggtaccgacaggtcctgcatccatgagccaagcaatgccaactgccacaaaaaccgctcacctgtgccagccccgcgatgggggtgcggcaggagccgtccagcgcggcgaggaaagcgcgctcgcagaccactgccaggcgcgtgtcctcatggctcagcgtgcgcaggtactccagcaccggctcgtcgccttcccggcatgcgatgccgattgcgccctgtggaggggtggggtgatggcgggggttggcgtcaggtgtgagattgtacagcgtggtagttgttggtatgccctgcaggagaacccctcacatcgctttccccctgacgaaagtgcaatctcccctccaccccacgcacgcacctgtgacacggcgggcagcatgtcctccagccccaggatggaggtggccttgtcctccagtcccaggnnnnnnnnnngcctcactttcccccggatgaaagtgcaatctcccctccaccccacccacgcacctgtgacacggcgggcaacatgtcctccagccccagaatggaggtggccttgtcctccagtcccaggcgcttcagtcccgccagggccagcagcgtggcgtcgcaggcgccctcctgcagcttgcgcaggcgggtctggacgttgccgcggaaattgacgacgcggaggtgggggtaggtgtgcaacagctgggcctggcgccgcagagaggccgaccccaccaccgcgccctcgggaagctccgccagggaactgtagcgcgcggagatgaagacgtcgcgcgggtcctcgcgcggcaggttgcagggcagcaccgtgccctctggcaggtaagtaggcacatcctgggggattaggaaggggaggggggttgttagatgtaagggtcatctacgcacccaagccatgannnnnnnnnnataagtaggcacatcctgggggattagtaaagggaagggggggttgttagacgtaagggtcatctacgcacccaagccatgacttcagtagtactggcagtgcagaaatgttgactctggttgacagcaagcaagctcaaaactcaaattcatagcatgagcctttggaagagggatgtgggtactcccaagtacaggacaagccccccatcaggctagccgagacgattgccnnnnnnnnnngtgacagcaagcaagctcgggactcaaattcatggcatgagcctttggcagagggacgtcggcacccccaagtacaggacaagcccccccatcaggctagccgagacgattgccttccagtataacacacgggggcatggttgacaaccagtcccccaggccctcaccttcatggagtgcaccccgatgtcgattcgaccctccaaaagggcgtcgtcaatctccttggtgaagaggcccttgccgccgatgtcggccaggggctggttcaggaccttgtcccctgtcgtcttgatgataaccacctcaagggcaccgtcctcttgcaggtgcgggaaggcagccttcagcaggtcgcgggtcaggtacgcctgggccagggccaggggggaccctcgggtgcccaccttcagggtcttggtcccgacagaggcgctggcgcggaccggggcggcccggctgcgcctctccaggcgaggccgagtctgggaccagagctgacgctgtgacaccctgacgtccctgcagggggaaccgataggtgaatatgtataacaaagaatgtgtcagcgtcatgtgatgctgcgatccgagccatacctgatgcccaagggctgggcgaggaccccggcagtcatctgggccttgatctggatgcgggcggcacgatgatgcggtggatacccagctcgcaaccaatcagtgtaatatgatttccactgcaatctctgcttgggttgtcagtcggatacacacttgtatgcgggcctcgctgcaggaaaaatatcggaacacatcttatcatgtttgccagctcaccaagatttgcgcgcggtgtctgtcacccgagacccacgcacacgcacccaacccttcgatgtcgaccgcatccaaacctttcaatgtcgtcatgggtgcagccgatctggatgacggtcccgttgtgcccgagatcggagaagagtacatagccctcgctctcgctgagcggcagaggattcgaatcgatgctgaatccgacaccgtggctgggaggcaggagtacctgtggaggcctcctcctttcgttgtgaactggctccggcgcagcttggtcgaggagcgagatctccctgcagcattcatgctgctgaacctggcaacaacaaccctccccgccgccctgctactctggagcactgggtgccgcagtcacctgctgggcgctgcctaccttatcctcacctatgcggcgttcctccagaggttcatgctcaccctccacttcacggagcaccgacccctcttcaaaccaggtgggccagtgcaggcgggcagctattcatatatcgcatctgcataacttggtgttgaccaggccatcttacgatcgcagatgnnnnnnnnnncgggccagtgcaggcgggcagctgttcacattccgcatctgcatgacttggcgttgaccaggccatcttacgatcgcagatgactcgtactggcttcacgactcaccttgcctgcgatgccaatgacagttactcggagggttcatcactcatttgttgggagtctcccgcctcactcaccgaaaccaccttccacatgcagggtacaggctgttgaatctcgtcgcccccctggtcctggctccgctgctgggggtgccccccggcatgtaccacctgcaccactgcatcatgcaccactccggnnnnnnnnnnatcctggcccccctgctgggggtgccccccggcatgtaccgcctgcaccactgcatcatgcaccactccgggaacaatcggtggtccctggacgcctcgtccaccgagcgctaccagcgagacaacccgctccacttcctcatgtgcgtgcccgaggtgctgtacaaaaggtgtaccccctcggctgggcggcacacccagcttgcatccccacagccggcctgtccccacctgtcactccgcggctggggccccggtccctcaggtccacaaaaagacatgctcgtctccccagcctcccaccacccgccttgcaggtactgggcgcggttcgctctggggagctggttcgagctcccctgggtggcggcccgggcggggcgctgggggttgctggccgcctgcctcgcctgtgagactggctacctggcaggggnnnnnnnnnncgggccagccccgtcgtggcgctctggacgctggccctgccctttgcggtctcctccctggcgctcatgctgggcaactggtcgcagcacctgtttctggagcccgcggcgccccgcggcagcctgggactggcctacaactgcgtggcctgtgcggacaaccagcgcacctacaatgacgggtaccatgccgtgcaccacctcaactccaaggcacggtctttggcatgcaattgggcttagctggggggagcagttgagggttggaaggtgggtgaccgctnnnnnnnnnncgacgggtaccacgccgtgcaccatctcaactccaaggcatggtgcttggcatgcaattgggcttagctggggggggacagttgagggttggaaggtgggtgaccgctgatcattgcactgagcagtttctgttgtgtgcgaatccccactccccccttggagtcaaactgcagcccagcacttccctctgcacccctnnnnnnnnnncgtgtgcgaatccccgctccccccccctggagtcaacctgcagcccagcacttccctctgcacccctctcaccccagcaaccctaaccccaccccgccccgcacctgtgcaacagacccactggacagagctgcctgcgcaattcgtggcaacactggacaagcaggctgcggcggggacgctgatcttccgggggctgggcttctttgatgttggggtagcggtcttcacaggcaactacgacctccttcatgatcaccttgtcaagtacacccctgcgctggccgcagccgggaggtgtgatgtcgaagccatgctgcgacggcgcttggcacccataatcatgtcgtgacgtcgggaatttgaaggtgtccagcgagatagcccaccatgtatcggaggaagaccaggcacgatgcgactcaagaggaaaagatgcatgcccgcatggacattatatgtaatagtatacggagctcctgatcttgttcgatacgagcgtcgctgacggcgttcttgtgtcgtcacccccccactccgttctgcacctcgatacatggtcacacgatcgatttgcggccctggcttcggaccatggacgaagaacctgtgacgacctgtgatggggagcgggtacttgcgcaggaggccaggcgatcggcccgcctatacttcttgcttggattcctagcgctgccctggctctgggcctgcagcgtttggttgtacctgccagcacttcggcagccacacggcgaccccgtcgtccgtaaatgtacgtcattgccgaattatgttgaggaggagctggggcgctcggcattctgcagcatgatgttggctggcaggtgtagctgccaatcccacctagcaatacccctccccactcttctgatcagacgtgcatcgatccgcaatctggctaggcatctacatgacggtgttcttagcctggttcctcatgttccagataggtaagccgagtttggtggccggagtgactgatagaggagtgtgggtcccgtctgtggacatttatcatcaagaatccctcgatctcgagtggtctgattcgtgtcgattcacttgtgcaggcgggcccggtctgctcggcaaaaggctgtatgagaagctggacnnnnnnnnnntaagatccctcgatctcgagtggtctaatttgtgtcggttcacttgtgcaggcgggcccggtctcctcggcaaaaggctgtatgagaagctggacgtccgaagcatagggccaatcagttttggggcttcatactgacacaggcagcatgcatgaagtcatgacaacaaggtagatggggagcagggctgttcggctcgagttacggcacacaggcctgccagcctcctggatgcgnnnnnnnnnnactccattgttccctgcatgtgatgttttgcgggtgtcagccttccttgcacgacgctctcactgtagagtgacaccaccacggtacagcaggctccaaggacactcaccaagaatgaagccattgttgccatgcgtgaacttgatctgatacaggttagccgccacgtcgtcagtggacctctcgcgcttccaagaatctccaccatcctctgtgccgatgcaaggggtggcaacaggtgaatatgatgatggaacgaccatctgctttcacaccagcacaaagaggtgtcaacgtctcgctgccaacacctatgaaataatccacacccgaagccacacctgtcttgaagaggctgccagaccctccacaggcaaacccaaccttctgattggcaaagttcacatccaggatgccaaaaccgcgggaccccagcttggcctgctcaaacttggactgggtatccagatctgtgtagtacaggtcacctcccttggtggtcagccagaggcgctcagaaggggtgaaacccatgttctggaggcggcgggtggcgggccggttgtggggtgtccagtatgcctggcctgtggagggaatggccaccaggtttgggtgaagaggccactgcgatatgctcagatttgtgcatagagtttgcaggcacctgccatctgatgcagacacggtgccgcagagattctggcagaggttcatggcatgcggctgtgcccccactgccaccttcttgcaagcctgggtctggagattgacaacatcgtgcactcaacacacacccttccccccacaagattcacctcccacctgnnnnnnnnnngagattttggcacaggttcatagcatgcggctgtgcccccactgccgccttcttgcaggcctgggtctggaaaatgacaacatcgtgcactcaacacacactcttccccccacaagattcacctcccacctggcctccaggtcataaaaaagttgccgcgcgaggagacggccacataggaccctcggtttgagcggctgatgttggagaaggagccctcgtagtaggatgccccggagatgnnnnnnnnnngaagaagttgccgcgcgaggagacagccacataggaccctcggcttgagcggctgatgttggagaaagagccctcgtagtaggatgccccggagatgccagaggagatgaccctgtgtgttgaggggtgcagcgacggtcagcgctccacaggcggtgagattaatgcccaggccagcaaggccacattggccacatgctgcacacctgttcagggtggcatccaccgtctccttgactgccgcggtccagttctggccgccattgtccgtcacgtagatggcaccctgtgcatgcgcgcggggtcagcaaccatggaaatgttgagcgcacaaaggagccaggcaggagannnnnnnnnntgtcacgtagatggcaccctgtgcgtgcgcgcggggccagcaaccatggaaacgttgagcgcacaaaggagccaggcaggagatgtgaagtagggtctgagcttgaatcccactgcatgctcaacaatgatggtctctgctgagcatgctcagccacgccaggcgcccagctccaggtacctggtcggtggtcagctcagccgcccccttgccctctagcgcggttatgagaacgggggttcccggcagcttggccgacagcggcacccgctcccagttggtgccgccgtcggtgctgtgcaacaggatggccggcttgccaacgatccaaccctcatcacctgtgcacagggtcgtggtggcgtgggtcaggaacatcagggaagagtcgagtaatgaggcttcagccacatgatgtggtagacagactccctcgctccccgcacggcagatgcatgtaagatgccctccatacatggacatggaatctaccattgggagggtcggaacagccaatacgatcatggtgcctcggcgagtccacctccccgcattccccttgcccacttgccctggaaggagatggaattgaaacggtagttgaagccctcttcctgtgcggccgcgacgctgcgtggttcccagttacgaccgccatccttggtttcgagcagggtttgccttgtgcccagcaggaagcctgccggagtaaatgagtggcatgaggaagaatgaagtcgcgccgtgtgaccttcattccatggatgcttggaatatgcacaatgtgagccccaccagcttttgcactcctgggtctactgcatggcacctcccctccacctccagacatccatacatcattcaccatggttggggtcagaggatgtgaaatcaacgtccagaagaaccacgcccgggtctattggcaggtctacaatggcccagtccttggaaaggacggggccagcgctggccggaccgggcataggcatgctgagtgccgcacccaccgcgaggccaccaagcatggcagagcgacgatgcacggccgcttcacttccggtagacacatcattgccggcttggcacctcacagccgagcggcatggggcctggagacgttgcgagcgtggatggctcggccttcctccgcatgagtactctgtgcccgtcgcaggccgctcgaggccatgcgcattgcattgaagggcaaatggaggcatacggatgacgttacggggttgaaatgagcaaatgcagttggatctgtgtttcggtggtggcttggtccattgaatggtggtgcatgaaccgcaccctccccccctcagattgagcatggcgcgcggcgggaaacacaactccgcgcccaggaggcgggggtttgcatgcatcatgcccccctgggaagggagcctgccacataccttttgatacggagccactcttggtgttcatatacacaactcgcgataatctgcgcgctatagaagcgagctctacctccagtgcagccccgtaccggcgacgtcagcgtgccgtgtccgtccctcgcccctgtactgcatttgatacattgttaaccgggttccctgacgagaggcgtgggttgcacgactcatccttgttgaggaccggcctgacgcaggagctggtcccatgcggccgctgacggaggacgagacacggcaagtgttcgagaaactccacaagtacctcgggaaggccatcaagagcctggtggacaggacagacgacccattttgcttcagattgcagcgcaatcgggtgttctacgtccgggaggatgtcatgcgaagagccacaaacgtgagtggaggggggggtggggggggcttggggcacctgggcgtgaaacgccttgcactccccttcaagaagccttgctggtgtgccctctcgctacccaaacgaaagctttgctcgttccatcaggttgccagggacaagctcgnnnnnnnnnngcagctgggcgtgaaacgccttgcactcccctccaagaagccttgctggtgtgccctcttgctacccaaacgaaagctttgcccgttccatcaggttgccagggacaagctcgtggccctcgggacctgcatcggcaggttcacccacagcggcaagtttcacctcaccattggagcgctcgacatcctcgcccagtacgccaagtacaaggtgcgggaggtgcctgaggtggggcatgtggccacaccgtactatctcaaacgccgccagatgatgcatgcttcaaccttcagtcttcaacccgacacaaacactggggaagcctggggtggaaacacctccagtaaactttgctgatggcacggcccatggcagcatgcgtgcacgctcgctgattctgcgatcccgctctgcatccttgatccagagcgagggccccgtcacctgctgcacaacctgccatgctggcaatccctgtggtcttctcctttcccattgggctccctcccccaactccccagcaccccatcccccctcaggtgtgggtgaagccctcggcggagatgcagttcctgtacggaaaccacgtcctcaaggctggcctgggccgcatcacagaaaacacccccggctacacaggggtggtcgtgctctccatgtccgacgtgcccctcggctttggggtgacggcaaagagcaccgccgagtgccggacggcggaccccaacggcattgtggtcttccaccaggcggatgtgggcgagtacctcagggcagaagacgacctctgagacatgggtgtggtgggagagtggggccgcggccgccgcactcctgtaatcctgcactcccgagggccggctggtctggcaggatggcctcgaccaaaaggcgcctccnnnnnnnnnnatgtggtgggagagggggggccgcggccgccgcacagctgtattcctgcactcccgagggccgtctggtcttgcaggatggcctcgaccaaaaggcgcctccnnnnnnnnnntgcacactgtgactcggaatcacctgaccggtgcggaaatgcagccttccaggatgcacagtctgtgtcagcaaccctctggcaatggtgcttacaggagagcggcaagcaaggctccgaggggtcagggggagcgacagtcaggaggcctgggcaggggatcgggctccccaccccagccaggtataaaagcgccagggcgttggcgcgtgctggtggtgcggctcagccttcggcgctcgtgacgtgagagcctgcgggcgggcactggacatgtggcacacannnnnnnnnnggcacactgtaacttggaatcacctgaccggtccggaaatgcagccttccaggatgcacagtcnnnnnnnnnnctggcgcgtgccggtggtgcggctcagcattcggcgctcgtgccgtgagagcatgcgggcgggcactggacatgtggcacacactcggcacccagagcccaggtcagaggtcgacgtggggcaggtccaggtcctcggtgccgagacctgcgaaagggtcctcgacgtcgaccccgggcggggccacctcctcctcggcgtcgtcatacagnnnnnnnnnncgcgaaagggtcctcggcgtcggccccgggcgtggccacctcctcctcggcgtcgtcatacaggtcgtcgtccaccgactccgaggcggcctcgtcgtcgtcgtcctcgtcctcgtcctcgacgtcatcagcggcgtccagcccctccaagaacttggccatcagctccgggtcctccgcnnnnnnnnnngctccgaggcggcctcggcctcgtcgtcgccgtcctcgtcggcgtcggcagcgtccagcccttccaggaacttggccatcagctccgggtcctccgccagcatggcgtccaggtcgatgggggcgttcagctcctcctgcgtcagcgccgcgctgccgtcgcctcccagcaagacctcgctcgtgggaggcggcggcgtcccggccggcaggacgacgtcgatgcggcggcgcagggccgccgcggccaccgcggccgcctcgcggtcggtcgcgttggggtgggtcgacagcgtcaacgacagcgcgtccttcacgctggtcgcaaacgcgtcgccgtcgacctgtgtnnnnnnnnnncacgtcgatgcggcggcgcagggccgccgcagccgccgcggccgcctcgcggtcggtcacgttggggtgggtcgacagcgtcaaggacagcgcgtccttcacgccggtcgcaaacgcgtcgccgtcgacctgtgtgtatgcggggtcgaggggtgcaccatggtgatggagggaacacaacaatgggggggtgggcactctggcctggacgccttgcagcggcatggttgctggtgcctgggagggaaacagggcatgatccaagagaatgcagcgacagggttgcgccatggccaaacacgcacggaacgcagttccgccagggatcagcggacgccacaccccaggcctcgccaagaaatccccccgggctcaaagtatacgcagcactcaccgcggccagccagtcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagccgccgccttcggacaacgcattcaccagcacggggacggatgccggggggagctgcagtcggggtatgggggcggtttggagggcgagggggtcagactggggcggcgaaatctcgcgaaagtcatcgccccgcttcaggcactggaggcggggacgtgcggacagcccctgcgagtttgccgtcatggcagaccagctcgtaagaacaaggctggggcacatcagcctgcgcctcaccatctcgacgcggtgcacgtggaagatggtggagggctgggcggtgaggtcgttggcgagc

SEQ ID NO: 28326 - DNA, 62 bp, Chlorella protothecoides
ttgtgtcactcaagtgtcgaatcagcctgagggtcggagaggagacgacgaggcgaagtgcg

SEQ ID NO: 28327 - DNA, 105 bp, Chlorella protothecoides
gagtgggtcttgctgccctcgtgaagccacggagcatgcattgcattttcttaacctatcttgcactccccatttgcgcgtacagagatgatgaagggcgtgaag

SEQ ID NO: 28328 - DNA, 61 bp, Chlorella protothecoides
gccaggggtactgccatcgtcgcatgtgcaccctcaagagagcaggctgccctgatgcagc

SEQ ID NO: 28329 - DNA, 173 bp, Chlorella protothecoides
gttgttccccagaagccatccactgctattcgtgaccgagtcttcagcattagcttcgaggccttcacttctgttccaaaattctccaggaactgcatggaattggatagcgaggtcgttgtgattgagggggagctctgcaatgggcgtatgaagacacggtgagagcaatt

SEQ ID NO: 28330 - DNA, 167 bp, Chlorella protothecoides
tccacgaagtccattcctcctcaccgacactcaatcgagcatcgtctcaacatgagtcccatcaacctttccctcttgcagcctactacgaccccaagtctcggtcgatgcggcaagaccccaaccccgataaggacccctcccagaaaacgtttgcgggggacaac

SEQ ID NO: 28331 - DNA, 71 bp, Chlorella protothecoides
ccggcgccagtagctagtatatgttgcgtgcttttgttcaagcacgaaatgaatccgctttagcctgactg

SEQ ID NO: 28332 - DNA, 143 bp, Chlorella protothecoides
gttgtccatcttgtccaagtgagcgtgtgtgtgttttttgggggggggggttgaacagtggatcaggggggtgattattcaaggggaagtcggcgagaggatgggtacctgcgggtgggttgcaaagcccgtggagggacgtg

SEQ ID NO: 28333 - DNA, 79 bp, Chlorella protothecoides
ggggtcgggacctctgtgaggttccacgcggtgaaggtctttcccaccaccccctcccccgccgccacactgcacgccg

SEQ ID NO: 28334 - DNA, 65 bp, Chlorella protothecoides
gaaggaggaggtgcacggagagcagtggaggggctgggtgctcccgcagatcccccacaccaggg

SEQ ID NO: 28335 - DNA, 145 bp, Chlorella protothecoides
caaggctgaggagccttccgaagatggggcggctcgcctgcccagcagtgaggaggacgatgagaccgacgagcagtccagctcaagctccgaggctggcttggagggtcgaggcgcgccagacaggcccggggttgcagacagg

SEQ ID NO: 28336 - DNA, 413 bp, Chlorella protothecoides
  modified_base (104)..(319): a, c, t, g, unknown or other
cttctcccaggtcgccaacagcaagggcaaggaggagtgaggggatgggccatcgcgacggcttcgacatcgcggccgaaattttgtgtactgcgctgcccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatgtgtgcgaggtcgatgcaaccagtcgacaacatgagtccagccaatgtgtggtggactagtgactgcactgaataatccagcgagcatc

SEQ ID NO: 28337 - DNA, 62 bp, Chlorella protothecoides
catgtcgagccagtgggacacgacgggaaagccccacacccgtggcgccgccggaacaaggg

SEQ ID NO: 28338 - DNA, 118 bp, Chlorella protothecoides
caaactcgtctcagggagatggacgcctctttgagtccagggagggcccctgatcgtgtgcagcgcaggatcacggcgccgcctgctcgctgagatgctgcacagattctttctcctc

SEQ ID NO: 28339 - DNA, 143 bp, Chlorella protothecoides
catggggggaacgtgcagatgataatgtggttgggaggcccggggcaggggaggtcggctgtagagtctcgtgggcgtgctgcacatacccctgcatgcatcctcgcgcgccgtggaccgacctccgacgcccttgggaaccc

SEQ ID NO: 28340 - DNA, 61 bp, Chlorella protothecoides
gccatccaaggtcgccagctggtgtacctgtggtgggcagcagcgtgcatgagcaggcgcg

SEQ ID NO: 28341 - DNA, 116 bp, Chlorella protothecoides
atcgatgactcccgacgactcccggcgtgccgagagatatgccgcccaactagcgaacgcctacatggcttctggagcgggcagtacttctcccttcacatccaatagcagcaatg

SEQ ID NO: 28342 - DNA, 3668 bp, Chlorella protothecoides
  modified_base (1055)..(1064): a, c, t, g, unknown or other
  modified_base (2080)..(2089): a, c, t, g, unknown or other
  modified_base (2661)..(2670): a, c, t, g, unknown or other
gggggaagggggggggaagaggggcctgtcatagtaatgggcctcatcaatgggaaagcagcggggtgaggggcaggcgtgggagcactagggtgtggtgcctgacgaggacgacgggtggtttgccggcagcgcatgcctgggcccaacgacaagtcccccgtccgcacccggcaggccccggccatcctccagctccagcacgttgccgcacatggccgccatctggtcgcgggtgatgtcgacgagcgtgtggtggcgctccagcgcctggcgcagcgcgcgccgctcgccgtcgtcggccacgctggccaggcaggccacggcgaggtcggtgcccaccgccatcatgacgttggtgtggtacactgccccccccgccccgtcgccggagctgaaggcgacgacgcggtcgtagcccaggcggcgcgcccagtcgtccgccagcgccgcgtcggcgcgctccgacagcgccacgtaggccacgccgttgacgcggtccagcaccagcgagccggtgccctccagcacgcgccccgcgccgcccgccaccgcgccctcctcgcccgccaggttcacctccgcggcgtgtcccagcgcgcgcagcacgcccacgacgtcctcccgcgcctccgccgcgcggttggggcacttcatcgggtacaggaccagggaggagggcgcggcgccgccgccctcccccgccgcgtgggtggagaaccagttgttggggaacacggcgtcgggcgtgccatgcgccagcgagtgctggaacaggttcacccgcaccccggctacgtcggccagctcgcggtgcaggcccgcgaactcgcgcaccacgcggtgcgtcacgctgggacctttaggaaaggggggagttgatgtgtgtgggtgggtggggggggaagggcaggtgaggagggcgggagatccactttcgggggtcatggagaggccggagtgggggccgcgggggaggatgtgcaaacagcgagtgggcacccctgtaccacgccagggcacctggcacgcacagcccacctgcgtctgaggcnnnnnnnnnnagtttcgggggtcatcgagaggccggagtgggggctgcgggggaggatgtgcaaacagcgagagggcacccctgtaccacgccagagcacgtggcacgcacagcccacctgcgtctgaggcggcgcctgccccagtgtgcatgaaggtgttgtcctgcgcggcctgctcgttgaagccaaaggcggtgggcgccaccatgagcacctcgttggtggactggcgcacgcctcgcgcccccgaggccaggcagttcaggcgcgccgcctgcgcggccacggcggggacgtcagggacgtgcagggggcggatgcccgcgccgcgcagcaggtggaacaggtcgcccgccaccgtcttgagcgcgtggtcgccgccggcggcggggcgctcgtacacgtccaccagcacacgcgagtgccagtcggccgcggccgcggccacggcggccgtgcaggggctgagcgggtggatgagctcggccagggggcggggggtctggtcgtgcgcggcccaggcgtcgcgcagcacggccaccgtggcgggggcgtcagcgggaagggaggaggcggggagggtggcggtggcaccccagggacgctgggacaggcgcaggagcaggggggcggtgggggacaggcgcaccgtctccgcgatctcgctcgagccccggactgcggacgggttgggggggtgggcttgtggtgatcaggctggggggtgcaagagacacaccgcggcgtagggaggaactatgtggtgcgcatgcgcactacgaccattgtatccctcatcatccattcaccttgctctgcgggaagagaggccagcccgcggacggtggggtttcgggcaacgacctcagccgcgcgcctgccgcaggacagcatgcttccgatctgctcaatgttgtcacgacaaaatgtagtttgagggattcttccttgtgcgagcctcagaggacgctgaaagaattgcatctcgggtccagcatctggcctgccccgcgccctggttgctnnnnnnnnnngggacgcttaaagaactgcatctcgggtccggcatctggcctgccccgcgccctggttgctgagctggcatccccccgcggctccacccaaaaagcagccgacaggctaggcgttcatattactggaattgcacatgattgcgcttcaggtcaaacaacaactggatgcctttcagtagatgggaacccagcccagcgtgatttacttggtgcccttgggcggcgttggacttcgacagagacagagttccagcgacctggcatacaaactgcaacaccagcacttatgtacttcccataagagaaagaggtgagtatggatgtccatcaagccctcatacagagggcccctccagcaacaccaccatgcacgggtctggagcaggcgagggtaagtgagaacttgatatcgcagagagggatagcgtgcgctgatccatagggtcgccgcactccaaacggagcttgacgcatatatattctattcgcttcaacaacacagtccttgaaagtgttgggcaaccactgaagaggcatgtattgcgggaccgtcgcactatttcattcgcacnnnnnnnnnngcgtaggttgacgcatatataatctattcgcttcaacaacaaagtccttgaacgtgttgggcaaccactgaagaggcatgtaatgcgggaccgtcgcactatttcattcgcaccggaggcgaacagagccctgatgtcttacgcactcattctgatagcaaaagtcgagaaatcgcatcaatcttccatcgccgatcgctggccgcctgcgcagcaaaggatttggaactggaatcgggcgaccaagcctccgcgctgaaacagcaaggcgctcaaggacaaagacttccgattgagggtgacgactccaccattccaacctattgagttacaagagtgttcttgaatggagaaaggaacaccatacgtcgtaggctccgggaattggctcccgacgcgggatcgtcagcgaggggccccagggaggaaaatctcgcgatccttcttgcagagcaccccggacggcggaggccagcagcatggggcatccctcatgaaccctcccggtggaatcatggaaatcatggattatgatacaagtcgtaaccctcgagcggcctcgttgttgtgccatgcggcctgattcgccgtcccgcagatctggtcgatcgggtcgaccccggagatactgaagataccggcctctcccaccatacaagtccagaaggctcgccgggctgagcaagcatcatatagggcacgtcaacgtacggtggtcatgactttggcttctggccctcgcccctgtggctcgctgtagctgaagagacggaactcggccattcgagaggctccgtgcgagcccggcaccaaccacgccggggtccacctggtggagctctaccggggatggatgcatcccggcgacctcccgagtcctcctccggccagtcttttcctgatgtattcaaccaggtacggggtcgcgagcccgggagtgcctcacttcgggcgagctgtggttcgaggtgaccccccccacccacccccaccccccc

SEQ ID NO: 28343 - DNA, 61 bp, Chlorella protothecoides
gatcaacaggtggatccgagtacttgacccaccccccacccgcgatcaccgctcgacgtcg

SEQ ID NO: 28344 - DNA, 63 bp, Chlorella protothecoides
tggagagaggcggatccgcgagttacaagtgtaaagcaccgctgctggagcgaaatcaatgaa

SEQ ID NO: 28345 - DNA, 466 bp, Chlorella protothecoides
ctgtcttgtagggcgggcacctgcgggaaggaggtggggagtttgagcaaggagattatacagttggagcgatgcgaggtgtcgtgacacagtgcctgcccctgtggggctgccaatccgcaatgaccccctcccgccgcttggcccccgacatggagtggaattccttggatgagcaggatgtcacgttggcgtgttcgtccaccgcggtgaacatcttgttccgccccgggtcgatgcccacatacatttgtatcctggcctcctctggaggggggtcccgcctgcaatttttttttttttggggggggtgagtcatgttgtgggagcgcagcaagtgtgggtggttggtgggagggtgggaaaggtgggtgcacctcgctgctagtatacaccacatccacagacactcccaggcggcagggcgggcacagcgtccgagtcttctgtcggcgccagagggttc

SEQ ID NO: 28346 - DNA, 135 bp, Chlorella protothecoides
ggtcggcgccgcttcttggcagggagccgtccgcttcccctcgacagctctggggcagcaaggcggacgagtcattgacgcatccagtcctcagtccccattcttcagcttccaatccacattcacgctcaccct

SEQ ID NO: 28347 - DNA, 110 bp, Chlorella protothecoides
tcctggggacggaaatgagccagtgctcggaactgtcggctccatcgtccgacaagtccaagcgaatgacctcaggggaagtccgcttgctgtgtcctgggcctcgatag

SEQ ID NO: 28348 - DNA, 61 bp, Chlorella protothecoides
cggtggtcccagcaccctatgtccacgctgaatatcagtgaatgatgccttccggacgacg

SEQ ID NO: 28349 - DNA, 80 bp, Chlorella protothecoides
ctgaagatggacctgtgggtcaaagaccagtcccccgttcccgtccagcacccgccgacccaggccgcctatgaacggag

SEQ ID NO: 28350 - DNA, 64 bp, Chlorella protothecoides
tgggatgcaggtgggggcaggaaggagcccttgcgctgtggggcaggaaggccatgaagggctg

SEQ ID NO: 28351 - DNA, 123 bp, Chlorella protothecoides
gacctgctgtcgactgcatccaggtcttggagtcagagcgcaaacccaatctgtccttttaggaactgatcaagtgaccagaggcaaaaaggcgtcgttgttaggcgagtactctaaccaact

SEQ ID NO: 28352 - DNA, 367 bp, Chlorella protothecoides
caaatgctgagatccgcgccgcactggcagccctgaacaggaccttcaccatacgatacgccgacattccaaaactcactgacagactggtaggtcacccaccaccaccattaccaccaccacacacaaaagtccttttacgagcaagctcctacaatatatctctttacagcctcgcctcaatgcggcctccttgttacaggactctgcactgaagagagttaccgaccagaacgccattgtgaaggtgactggtggctgcatggcacgggacacgggtcccgtcggacattgacgcgtctgggatatgtgcctctccttgtaaaggtcccagtcaaggttgaggtgccagccgaaatatctacta

SEQ ID NO: 28353 - DNA, 61 bp, Chlorella protothecoides
gatcttgatgcccttgcagcaggcgcgcagcgcgggctccatgctctcccccgaccggatg

SEQ ID NO: 28354 - DNA, 101 bp, Chlorella protothecoides
gaggtggcgggggaaagatgtgtggatgtgcacgagttcctcccgcaagactactgctcagctcaggtacaaaaaggatgcttggatcatggttattccca

SEQ ID NO: 28355 - DNA, 61 bp, Chlorella protothecoides
cgaccctcgtgttgccatgactgaacgccttagtcagccgtgagtgtgatactcttatcgt

SEQ ID NO: 28356 - DNA, 89 bp, Chlorella protothecoides
tccgcggtgcaagccttctgtccagccttgaggcactcgacagccaccaaaatcttggaggatcgcgccgtgatgacctcaaagggacg

SEQ ID NO: 28357 - DNA, 75 bp, Chlorella protothecoides
gtcctcaatgtgtgagagagtgtgtgactggacggcacacacacttatacagggggtgaggcctgcggagtgccg

SEQ ID NO: 28358 - DNA, 382 bp, Chlorella protothecoides
gctatgctttgccatcgctaatgaactttccgtcaatctaagcttgtctgtattacatgaaactggtcagattttcttgtataggcgacactggtgccaacgcctgaggctcggccagccgcaagtagtccgtgctgatcccttcaacaagttccgcaggctacaaagtctataagacaaagcaaatagtatacacctcgggcaggtagtggaagacggaggaccattcaaccttgcaggacctcggagtagaatgcgcaacaagtcacatgcaagagccgtttcatcaccctgtcctcaattatccttgatggagtattgcaagccctcccatcgtgttattcctctatcaacacgaaaaaaactcatgaatcagcagggg

SEQ ID NO: 28359 - DNA, 138 bp, Chlorella protothecoides
ctcgtcggtcaagggcaccccggccgacattttggctgcatgaggaggtggaggtctggccgtggcaaggtgagaagctggtcgacggactctgcccctgcgctcaggagctccagagtgacacgtcgggcttgggca

SEQ ID NO: 28360 - DNA, 72 bp, Chlorella protothecoides
gacacccaaggagctggagaatgtccagggtgagtgattggaggataacttctaggcatggacctgcatgtg

SEQ ID NO: 28361 - DNA, 121 bp, Chlorella protothecoides
cgagggcatgcccatccacggccggccgtatgagaagggcaacctttacatccactttgcggtggagttcccagaccagctggcgcccgaggcggcatccgccctgcgctcgctcctgggg

SEQ ID NO: 28362 - DNA, 118 bp, Chlorella protothecoides
cctgcagtgtaggcaggcaacatagcacctttcccagctttcccccacagccaccttgacatccaccacttagaacaccgctcacccctctggactcccgctggcaggcgaagcggaa

SEQ ID NO: 28363 - DNA, 102 bp, Chlorella protothecoides
gcacccggctacctgtcctttgctcagcatagtacagctctacctgcttcactcacgatctcaggtgtgcacccctcctgcgcattgtggggagccggttgc

SEQ ID NO: 28364 - DNA, 175 bp, Chlorella protothecoides
ggcgctcctcagtaccctccgctctggtggattttttgtgtgtgtgttgggggtggggggttgcaggcatcagtaccctcaaacggacgtggagccgcatgcaccacaggaccgccccccatcctccctggaatttaactccagctgaccccatcggcacccttgccaccataca

SEQ ID NO: 28365 - DNA, 61 bp, Chlorella protothecoides
cgagtaggcggggaggcttcccaacctcgtaaaaggaacatcaagcctctgcacatgagct

SEQ ID NO: 28366 - DNA, 61 bp, Chlorella protothecoides
cctgtgccgcacacttggggacaggagaccacccaccaccaaatcccctgcccacctccat

SEQ ID NO: 28367 - DNA, 77 bp, Chlorella protothecoides
cccccccccccttctctcccaaaacctccccacatcagagcatcaaactaggcatggtgtgcatgaaagcaggcgag

SEQ ID NO: 28368 - DNA, 73 bp, Chlorella protothecoides
ttgttgatgatctcagtgttgccaccagcatggtatccaccttcgtacctgcgtcacaggcgctccggaattc

SEQ ID NO: 28369 - DNA, 113 bp, Chlorella protothecoides
ttcaacaagactgggaaccggaaggtcattgacgactgcagcctgcttgagttccgtaagtatgcatgggtcctcgattccccaccacctccctccaaaaaggcctgacaacc

SEQ ID NO: 28370 - DNA, 61 bp, Chlorella protothecoides
cagcccagccatgcgtgatgccacagctgcgaaagcgcctcacagtgcaactcttgcccac

SEQ ID NO: 28371 - DNA, 61 bp, Chlorella protothecoides
gacagggcagaggatacagggctggtgtagtatacagacgccaaacaaagcagggaaggct

SEQ ID NO: 28372 - DNA, 61 bp, Chlorella protothecoides
catgtgactgcatgcaacaacgtgctgtttccttcccagctccgaccgtttgcacgatttg

SEQ ID NO: 28373 - DNA, 74 bp, Chlorella protothecoides
tttgaattcattcgagggatcctccttgcgtacacgtttgtcttagaccagctgctcctgtagcttatcttaca

SEQ ID NO: 28374 - DNA, 67 bp, Chlorella protothecoides
gtgtgtgtgtgtgtgtgtgttagggtaggggccgtgagtgggcaaggtacatgtcgggaagaaagca

SEQ ID NO: 28375 - DNA, 110 bp, Chlorella protothecoides
ctccccgcccatcccgacgcccgtgcggcccgacctgcagcaggcgccgcccggtggcctcgccggcctgcgcgcctcgttggtggccgcagcctcccacatgggcgccg

SEQ ID NO: 28376 - DNA, 80 bp, Chlorella protothecoides
cgctccagctcctcggccgagaagctggggcctgtgagacatgtggatcgggggccaggggtgtgggagagctgtcggcg

SEQ ID NO: 28377 - DNA, 61 bp, Chlorella protothecoides
atgatgagatcccagaagtcgctcctacttcgatcaggacatttacattccagcagcattt

SEQ ID NO: 28378 - DNA, 81 bp, Chlorella protothecoides
cgctacgctggtgagtgcatgtgtcgttggttcattctgtccgagacacagacttgcaagttgtccgttattgaccctcct

SEQ ID NO: 28379 - DNA, 142 bp, Chlorella protothecoides
caccactgcctcccccatgctgcccagcggtcctattcaaacctgcatgagcagaataataaggtgcacccgattaggggtttggatcgctgatccctcgcatgcatgcgatcttcatgcggatcgagagaggtgtgaggtc

SEQ ID NO: 28380 - DNA, 61 bp, Chlorella protothecoides
tcctcgtcctcatcctcagcagctcgggtcatctcatccctgcatagtgatcaaacgtttg

SEQ ID NO: 28381 - DNA, 61 bp, Chlorella protothecoides
ttcattccctccagcacatccactggctggtagatgacgatctcaggaccttgaacttcct

SEQ ID NO: 28382 - DNA, 76 bp, Chlorella protothecoides
gcctcaccggcgccggggtcgcatgtgaccgacggcctgctccacatctgacatgcttgaccgagcaagtgtgatg

SEQ ID NO: 28383 - DNA, 70 bp, Chlorella protothecoides
agcatgccccatcagccatgcacacccaggtagccaccggcgcctacctgccggcatcaaacatgaagag

SEQ ID NO: 28384 - DNA, 61 bp, Chlorella protothecoides
tcgggcgcgctgctgcaccagcagccgcgctagcaggccctgcgtctccggtgaggccggc

SEQ ID NO: 28385 - DNA, 80 bp, Chlorella protothecoides
attcttatcaattgtcgcgaccatcacctccaaactctgccctgttcctctccctgccgtccccgaggaccgctcaagcc

SEQ ID NO: 28386 - DNA, 64 bp, Chlorella protothecoides
cccccccccaaacctcgcaggcaccctgtacaattttgccaacgtccgcgcgcagaatgccaac

SEQ ID NO: 28387 - DNA, 106 bp, Chlorella protothecoides
ggatcactacagggtgagtggggtgggaggcccattgctctcggtcgagagcagggcctctgggcagatcgtacggggtgatgccccaagccattcccgtggcccc

SEQ ID NO: 28388 - DNA, 80 bp, Chlorella protothecoides
aaaattcatacacaactacatcctacggttcaacaaattactttgggaagtacagggctaatcctccaccatactcaatt

SEQ ID NO: 28389 - DNA, 77 bp, Chlorella protothecoides
cgcctcttccgagatgcgaggatcaaggcccaccggtcccccccccgctcctgctctgtcgcagggtggaggatctc

SEQ ID NO: 28390 - DNA, 98 bp, Chlorella protothecoides
ggagagacttgagccaggcaaaggggcatgtacggtgtgggtgccgcgcccacatgccttcctttctggcactcgcctggaggacctgctggacgtac

SEQ ID NO: 28391 - DNA, 72 bp, Chlorella protothecoides
ggtcctcctttctctggatggaaatggggcaagggttactgccaggttacacacagctgcgcgcctgtccct

SEQ ID NO: 28392 - DNA, 116 bp, Chlorella protothecoides
ggcggaggggggtgcaaggggtgtcagcaggcagcgattcgtgtatggatgcagttgggggatgggcatggggaagtctcagtgccgggggggtcggggcaggccggatggtgggg

SEQ ID NO: 28393 - DNA, 523 bp, Chlorella protothecoides
  modified_base (247)..(317): a, c, t, g, unknown or other
cagccccgcggccgccccgggctccgcgacggccagcgcggccagcgcgcgcgcggcctgcacgcgcgcaccctgtgccggccagcccaggcatgcgagcagggccgggctcagtgcggccagcgtctccgcccccgcctcgcccaggagctcgatgaccagcgccacgctttccagcagcaccacggcgacggggacgaggtgcaggccggacggcgccggcggtgcgggggcctccgtctgcgtnnnnnnnnnnnnnnnnnnnnnnnnnnnnnnnnnnnnnnnnnnnnnnnnnnnnnnnnnnnnnnnnnnnnnnntactaccctctcctccccctcctccgaccagcagcgccgtcaggcggcgcagcaggctgcgccggcctggctctgccaggcgctcgatggcggccgatcgcagcacgcgcagcgtgcacgcctgcaggtgcggccgctcgccggaggcggccgccgcgcccaggtcgggtgcgccggggaagggccccggctcgggcggcgcgccg

SEQ ID NO: 28394 - DNA, 67 bp, Chlorella protothecoides
tgggtgagacatgggtggaagcatggaagataatcactgcgacctgacgtcaccagcgctcgcacaa

SEQ ID NO: 28395 - DNA, 61 bp, Chlorella protothecoides
atgtgcatcgtagatcctatcgagagaactgcaaaaagggttgtaccgctctagctgcttc

SEQ ID NO: 28396 - DNA, 180 bp, Chlorella protothecoides
gacctgcttgctgacaggagcaccatccatggcttgcgtcagcatgttcaagcagcgtcactaccacacctgcccctcctgccactgctcgtctcaggtgttcacctacttcaacgttgatgcctgcgtcgaggaggaggtccgccccggtatcatgctctccaaagcggtgtgtgcatg

SEQ ID NO: 28397 - DNA, 61 bp, Chlorella protothecoides
ccaaggctgcaccttctacacccccctcgcgccccccccccccacacacacctgacgctga

SEQ ID NO: 28398 - DNA, 73 bp, Chlorella protothecoides
gcgctcatcacgagctggcagtgagtacatcctgcaacttcctgatcgctgatcaagccgtcgtacaaaccat

SEQ ID NO: 28399 - DNA, 123 bp, Chlorella protothecoides
ttgtcattgatcatgaagagtctctccccgcctccctgagggatactgaatgaacagcgtgcaggaatggcatgcacttcttgaccaaagagatgtgaggcatatacacaacatcacaaatct

SEQ ID NO: 28400 - DNA, 77 bp, Chlorella protothecoides
tgcacaggcattggacatgccaataaggtggtcctggcaagggctcctgggccgcttgccgaatggcaagggctgag

SEQ ID NO: 28401 - DNA, 68 bp, Chlorella protothecoides
gaagcgtcgaggaccctggtcattgcaacacgatctggagccaggtcgaggcccagactcagtgtgtc

SEQ ID NO: 28402 - DNA, 117 bp, Chlorella protothecoides
ccagcatgcggggcccgcccaccgaggctgcagcgctgaggagactgcttccccaccccgcacgtcctttcttccccaccctccaaaccatccagcaggtccacctcgctctggcca

SEQ ID NO: 28403 - DNA, 122 bp, Chlorella protothecoides
acactggaggtcacttcaccattaatggtgaagtaaacagggatccgagcatgctgccacctctcacttgtgcacacagtgctcttaaagatagcttgacgatacagtgtcaaagtttgccc

SEQ ID NO: 28404 - DNA, 75 bp, Chlorella protothecoides
cgcagaggccctgtgatgggagattgggaatatgcgtgattacataatccaggtgtaggtgataaattggaggga

SEQ ID NO: 28405 - DNA, 73 bp, Chlorella protothecoides
accctcctctgcagaatgtgcttgccctgcctccgggctaccatgcaactgtacaatacatacaagcgacact

SEQ ID NO: 28406 - DNA, 2090 bp, Chlorella protothecoides
  modified_base (341)..(350): a, c, t, g, unknown or other
  modified_base (650)..(659): a, c, t, g, unknown or other
  modified_base (791)..(800): a, c, t, g, unknown or other
  modified_base (890)..(899): a, c, t, g, unknown or other
  modified_base (1637)..(1646): a, c, t, g, unknown or other
gcggcgcccgacgcggcgcccgccgacgggccgcgcctggccgcgcagcagtgtatggccgccgcgctgcgcacgctgggcccgcgcgctgtgctgagcgtcgcgccgctgggcctgctggaggggttgcgcaccggggcgcaggcgcggacgtggatgctgccgctcctgcgccagaatggcggcgcgggggagctgggcttctgggccgagcagctcctgcccaccgcgcaggccatcggaaagcgcggagcagtggccaccaaggggtgcgtgggttgtgcgagtggacgggggggaaggggggggaggggtgatgagtgtgattggggtgatgagtnnnnnnnnnnattgtgcgagtggacgggggtggaaagggggaaaaggggtgatgagtgtgattggggtgaagcggttggtgatgtgggtctccccccatgaggtcagatcttcaggcagggacctggcaggcttctttccaatgcttggcaggtgtgagactcctgattggacctgcaggtttgacttgttgtcaagcacgagaacctcctgaatcgcgcccccccgccctcaacgtcctgtcctatcaatcaaatacacgcccacccaacccctcacacgcgcaggaagaaggacagggaggcgcagcnnnnnnnnnngaggtttgacttgatgtcaagcacaagaaccccctgaatggccccctcgccttcaacctcctgtcctctcaatcaaatacacccccacccaccccctcactcgcgcaggaagaaggacagggaggcgcagcnnnnnnnnnnttgtatcagtctggttcaatcgttgtcctttgagggctggggtgtccattgcagctcttctcgcaccgcttcccgatccaaccacccccnnnnnnnnnntgtgcgcgaccctggagtcccagctctgggcctgcctcccggcattcgtcagctgggcagaggatggcggcgcggtgtggaggtgggtggttttaggtgtttggagtggcactattgtatcagtccggttcaatctttgtcctttgcgggctgggacgtccattgcagctctgctcgcaccgcttcccgatccaaccacccccaaattggccgatgacgattccaatgttcgttgttgagaaccgaaacccagatgtggattcttacattttgtcactaccactgaggccggggggaggcgctcctgcttgtgcattgctgcattacgctctgtttccccgcaaccatactgccctgcatttctggcatcaggggccaggagccaatcttgttttatcattagccacccctgcctactatcctacccggcgcaggcagctggagaaacccctcctggaggccttccatcgcaacgagcagtaccggaacattgtctgcaactccttgaccacactgtgcaatgacatcagccgcacgtactctgcagcaggccaacaggtgagggtgttgaagggaagtttggaggatgtgatggagtgtccaaggaacggagcatgagacatcggtgctcgcagagaaatggcgcaagcatgctgaaccgcatcgaatcgtcaattccccgtctacaagccatcgcccctcctcctgatattgccgcagctgggtcatgccaacccnnnnnnnnnntagagaaatggcgcaagcatgctgcaccgcattgaatcgtcattccccccgtctacaagccatcgcccctcctcccgatattgccgcagctgggtcatgccaacccagtggccgctgcggccacacccagcggtcacgatcaggagggcctgctgatggacgaggagggcgccgacagcgcgatccccatccctgcccactacaccctggcggctgcccaggcggggctggcggagctgcgcgccgcctccgcggcctggctgccccagctgctggacggctttctggccgcgccgccggcccagcgcggaaccatgcaggccacgctgggcgcgctggcctgcgtggccgaccccgccgcggtggcgcgcctgttcaagaccgtggcccagcagctgctgaaggaggcggcggcggcggcggcagcgaccggcgctggtgcgg

SEQ ID NO: 28407 - DNA, 221 bp, Chlorella protothecoides
tcgcaaagaagcacctggtcagcatgagcatgttgactactacgtacatgttacggtttacaacatggactttgcagcccgttttggtacaccgcttggtgttccacatctctatccgctcctccacgccgtcgcagacctgtttgtgctggtgggcatgcagggaggtgtgacagccgcagcacagttgaaagtcctgtgctcgtcaaccaccaccaccc

SEQ ID NO: 28408 - DNA, 124 bp, Chlorella protothecoides
tcaccaccattgcctcgacgcactatgagcaaccacagatgcagtaagtctctggggattttgtatttattgcacttggcgaaggccacactgtttcattgcatcgttttggagtttgtcctcg

SEQ ID NO: 28409 - DNA, 86 bp, Chlorella protothecoides
agttcaaggcactggagctggtaagcctgaatagaagggtgggcgggttttcgagcgcttgcacccacctcctccaccctccttgc

SEQ ID NO: 28410 - DNA, 79 bp, Chlorella protothecoides
cacccctctactgtgcaatgccacgctccaaaatttgccccatttgatactcccagcacgatcgtcactgttccaatgc

SEQ ID NO: 28411 - DNA, 137 bp, Chlorella protothecoides
agcagcaatgttaggatgagcgattgcatggtgacaactccagcaaggatagttttttccaccgggccgattgtacgacttctctccctctgtcaaatgtcgcgatacaggtgtacgtgtcatcaccaacctaggca

SEQ ID NO: 28412 - DNA, 64 bp, Chlorella protothecoides
cgccctgggggagtgtgcgacgagcagacgtccacctgcctctgtccaacgccaccaaccacgc

SEQ ID NO: 28413 - DNA, 132 bp, Chlorella protothecoides
cttccgtgagcgtccccagggctcttcaggtgcggttctcccttctcacgtgaagctttccggcgcaatccatacacacgttagattggtgctgccgttcttctcatcggaccgaggctgcggtgacccctt

SEQ ID NO: 28414 - DNA, 70 bp, Chlorella protothecoides
cttccgacctggctgctgcctcaccttggtcggaccaagctgttgccagtgaaggcggtggcgtgggccc

SEQ ID NO: 28415 - DNA, 73 bp, Chlorella protothecoides
ctcctcccctgcccctcccctcctgacctccgcagctccagcgcacctcgcagccgaggcggaggccctggcg

SEQ ID NO: 28416 - DNA, 61 bp, Chlorella protothecoides
ggtggtccaattccgtcgggtcccggtgccccagcaccgcatgacccccttgaagacaagc

SEQ ID NO: 28417 - DNA, 73 bp, Chlorella protothecoides
ggtccgctggctgtctgccacgttccgcaccgctcgcatgacgatggcggccgccctcgcatccaggcccgac

SEQ ID NO: 28418 - DNA, 69 bp, Chlorella protothecoides
cgcaagcggctgagcattgcagtggagctcgtggccaacccatcggtggtttttatggagtgagctaca

SEQ ID NO: 28419 - DNA, 175 bp, Chlorella protothecoides
cattctccagcctgccgaccttgatggcggctcgaatctccagcgccagcctcgacccggccgccaggcgagcctgccactcggtcccgctttcttcattctcgggcacggcatcgcccgccggcgacggagtgcacggcacggcacgcaggtcctggacgcgatgccgcgagtc

SEQ ID NO: 28420 - DNA, 75 bp, Chlorella protothecoides
cagagcttctgttgagtggccatcgacttacaacctccattgtagactctgggatagagccttgtcgccaatgga

SEQ ID NO: 28421 - DNA, 73 bp, Chlorella protothecoides
ggtgccgcaagtcatgtgcgggtggtggtggtgttcccaattccctgtcagctgaactatgctcagcgtgtgc

SEQ ID NO: 28422 - DNA, 128 bp, Chlorella protothecoides
gagcctaccatcccagcccatccattctcatggtaatcaggaggcatggcccagcctcaccatccaggttgtgtgcatgggggtagaagcggcgggcattggacagggaggggtggaaccgaaactcc

SEQ ID NO: 28423 - DNA, 71 bp, Chlorella protothecoides
cacacacactacctgacgttgctgccgcgcttgccccgcgccaggcggcgcagctgcaccgtgatgcgcac

SEQ ID NO: 28424 - DNA, 70 bp, Chlorella protothecoides
caggagaacgcggtccccggcgtccttgaccacccgcgcacggtaccaggaccccctgccctgcagtacc

SEQ ID NO: 28425 - DNA, 75 bp, Chlorella protothecoides
tgtagaacatgggtccctgggaggagttgccgcttctgagatcctttgaactctccagcaaccttcttgacactg

SEQ ID NO: 28426 - DNA, 661 bp, Chlorella protothecoides
ggcgccaggccgcgcgcgaggcgcggctggccacgctgctggccgccctgctgcggcgctgggtggagggcgacgaggcggggttccgggagtccatggccgccgaggcggcgggcctggccacggcctcctacggcgacctcatgctggccaccatcggtggggtgtacgcgcagcaggccgagatcgcgctgggcgggatcatcgacggctccgtggccgccctgcgcgccaagggccagaacatcaagagccaggttggtgggggactatgtgtctcttgggtgggaagagggggaggttggcctttccagtaggagcgcagggaggagagggaagtacccctcatgagggccaaggcgcgagggcatctcggagagcagaggcctgcgctgctgcgcgagtctggccgcgcctcgcccgcaccctcctcgagcactcacccaacacgcacaaccccccatccacgcccagttcgcggcggccaacctggcgatgaaggtgtacaaggcgcaggcggcgctggccaagctggagggcagcgaggcggcggccagcgcggcggcgaaagagcggacggcgaacggcgcaggcggcgacgcccccgccgacgaggcggcagtggatgcggccgcactggcggcggccgcggcggccgcgg

SEQ ID NO: 28427 - DNA, 135 bp, Chlorella protothecoides
gtgaaaagaggagggtggccaaaatctgccacaacaagcacagcactgccaggataacaaagagcccatacagctccattgcacctggatcatctcaacaccatctacatactcaagcaccattcactgccccta

SEQ ID NO: 28428 - DNA, 61 bp, Chlorella protothecoides
gtcactacgacattgaatctgaggtgccagtctcgtgggaccgcatcgacgaggtgggaat

SEQ ID NO: 28429 - DNA, 1889 bp, Chlorella protothecoides
gcggcggccgcgcctcggcccgccggcagccgctcgcccagcacgagcatgcccacgcccacgccagagagcatggcgcccacggcggccgaggtgcagaccaccaccgtcgcgccgtccttcaagcccagggtctgcagcgcgaagccggtggaggagagcgccagcgaggcggccagccccagcgcggcagccgccggtccccaggcggccgccagcgtgaagcctgctcgagggaagggggtgtgtacagggggtgtgtgttgcggcgaagcaccgatgcccgcgtcaagggtctggtccggtgtgtgctgggaacgaggggggtgtggaggtgccatgcaacgaggctgctcagcttcgttccacaagcgggggagtggggcatccccccgggccaggcacgggggggccactgacgctgggccgcaccgaatatcagggcgtgcccatcttcacaacccccctcccaaacacagaaacaatcctcgtccgcggcacgcctgatccctcgcacccgtcttgcaagcccccgcggacagaccgaagcatgccccggcctgcaggcccagggccgcgccggtgggccgggcgcggcggcccttggcgccctgggcctggcgggcgggcgcggccagcatgaccgccagcatggcggccatgccgcccagcacgcccagcatgcgcaggggggatggggcgtcggcgcccgggccccccgtctcgcccccagaggcggcccccagcaccagggtgccggccgcggccagggccgccgccgcccagtcccagcgggacaggcgctccccaagcacggcgtgggagtagaggctgagccccaccaggcccactcccgacacgggctggaccacggagacaggggccagggcgaaggcggccacctggatgacgcccccggctacgtccgtggcgaccccggccagccaggtggggcaggccaggtactggcgcaggaccttggggtccctggaaaaccgaggcaggcccagggtagcctgtttttgcagggccttcccaatggaggatgcggtggaggccaccaccgttatcaggatggcgagccacagcatggcgcaggccccgggccccgccgaggctcaccccggggcaatcacgaaatcatgcctggagcaagggtggtcgtgtgtgggtatggagcatctccactcgtccctgcggacgtacatctgcggggaccatgtgcgcgttgtgaaatttgtactcattccaaccgacaggtaggcccgcggcaaggaggatgcatggagcgaccgaagcactgcctatggagtgaactggtctcgtagacgggaggattatagctaggttcattccctgcagccgagtcatggtctatctacggtagatcctcctgatggcaggtttgggtgtcagccttgccgctgtcattttacagatggtaagatactgcattgcagacaacgaagagatcaccctgacgcaaggaggctccgcgtgttacaagggggacggccagaagctccgagtctcttctttggcgacatccatccgcaaagagagtgttacaggagattctcctcatgcaacataaaagatgtactcctgggatgtgagggatatatccgtgcctgtggggtcaacttcaaaatgccatgattgatcgtcgctaagtgtataagacttttctgtgatgtatgtggtgtcgtgggaaccagaccaatcccaatggtactgctcaacgccactcaagaaggccttgacagtgccagacgtgtagtttgggatgctgactacaaatgtgatgaatcccgtactactgtcccaagagatgctggcttcggggagggcgggcggtggagggctgggagggggtggggggggacgag

SEQ ID NO: 28430 - DNA, 61 bp, Chlorella protothecoides
cacgcctgtcggagctccagtcacaattctcacacccatggcgacattcaagcgcatcgta

SEQ ID NO: 28431 - DNA, 80 bp, Chlorella protothecoides
atcgcactccagcagggaatacatcacgaatatatacaaatatatagttctctgaaatggaaatactctctgtatgtaag

SEQ ID NO: 28432 - DNA, 63 bp, Chlorella protothecoides
cttcccacacttgagacatgagtctctatacatcgcttcctgtaccgtagagaagcgggccac

SEQ ID NO: 28433 - DNA, 77 bp, Chlorella protothecoides
gcgccgttttcctcgaaacccgcaatttcggtaaacctggtgaaggaaataaggtgcaatgacctgacatcagagtt

SEQ ID NO: 28434 - DNA, 61 bp, Chlorella protothecoides
atgcaagcctcattccattggcagggctggggctccaagcctgcatgggcaagcagagcat

SEQ ID NO: 28435 - DNA, 77 bp, Chlorella protothecoides
gacttgtcgtttgcaaaaatctgcactcggactttttttgcaaaaacatctggaaactcctatgttctcatgataag

SEQ ID NO: 28436 - DNA, 64 bp, Chlorella protothecoides
aaagagcaggagggcgatggcgggggtggcgaccaccgggtccagggacagcgcgctccacacc

SEQ ID NO: 28437 - DNA, 161 bp, Chlorella protothecoides
gacgctggatgcctgcctcatggtgatgagaatggggggaaggggttggggtgtctgagtttgggaggaggttgtcggcgggggtactgcgccgcggatcaaacagaggcccaccagcgtggtccccagaggcgatgcaatctggatgcttcttgagtgcg

SEQ ID NO: 28438 - DNA, 64 bp, Chlorella protothecoides
gctctctccatccacggatctatggaatgagagactggcgcaggggcaggcctggagcaggggc

SEQ ID NO: 28439 - DNA, 796 bp, Chlorella protothecoides
  modified_base (213)..(222): a, c, t, g, unknown or other
  modified_base (404)..(413): a, c, t, g, unknown or other
ccgccgctccaccagggccacgcccgccgtggtcaccagggcaaagcgcgtggagggcgcggtggcggggtgggggtgggggggcctggggccgtccggcggtgggcccgccaagtgcctatcggaatgtggtttgaagggagtggtggagtgtcctggggcgaggaaactaaaacacaaacggtcaccctggcatcggtgggctgcagagtnnnnnnnnnntgagaaaactaaaacacaaatggtcaccctggcatcggtgggctgcagagtgagtcgagcactcctgctcgggtgctcacgcacagcacaacatacgaggcacagcccaaacaaaggaagggaaacacggaggctgcatacaaccacgggcatgttcctgtgccctcgcccagaggatggannnnnnnnnnttgctcgggtgctcacgcacatcacaacgtacgaggcacagcccacacaaaggaagggaaacacgggggctgcatacaaccacgggtatgttcctgtgccctcgcccagaggatggagtgtgctgcagcaaagcggctggtcatccccgcccccctcgtatcgccatgccagcacccacacagtcgactcctctccccaccaccaccgacgccccccccacctgatggcgcaggcgtcccccggcacgcggcccggcagctcggccacggtctcacgcaggccgtgccccgtcagcgaggcgccggtggcggtggcgaggggcggcagcgtcacgtcgcgggcgaggcccacgaggcgcgcgctgccgccctgcggcgccgcc

SEQ ID NO: 28440 - DNA, 78 bp, Chlorella protothecoides
aggtgcagctcgcgccctcggggccgctgccggggaccgcagccgccatgtcctgcgccgtggcgcgcgtctgatgcg

SEQ ID NO: 28441 - DNA, 91 bp, Chlorella protothecoides
gctcgggcccgatggcgcggagctcccattttccagcctcccggagctggagatctccaacctgctcacctgcaactcaccccagggcctg

SEQ ID NO: 28442 - DNA, 113 bp, Chlorella protothecoides
gcatgcagcgcactttttaaaccacaaagtatgatgaagtataacataaccgtcgcaaaccggatcgagaggccctccccacggcctccactcaccgcaggtccatggctctg

SEQ ID NO: 28443 - DNA, 61 bp, Chlorella protothecoides
cacgcagacaccgactgcaaaccccagcacacctgccgcgatgcaagccctcacgggccgc

SEQ ID NO: 28444 - DNA, 19361 bp, Chlorella protothecoides
  modified_base (13301)..(13332): a, c, t, g, unknown or other
  modified_base (19113)..(19122): a, c, t, g, unknown or other
ggggacggcacggcgccgcgcccggccggggtggcgggcgccagccggcgacggcctggcgtgagcccggcccggccgggagggggagggggagggggcctaggcacgacaccgagcgcaacgacggcggcggcggcaggccaggggcgcacgctcagggtctgcagcgagggccgcgccccgacgtccggccaggtatcaggagtcgcgggccattctcggtcagagggtgggagtttcagggtgcctcggtctgcagtcgcgcagcgctcacggccgacccgctgtccatcaccgcagagtcgacggcacccggacggcgcggggaggcccggtcctccacgccgcccaggaggggccgggagcgtgccgggtcggaggagagggccccggcggcctggagccgcgccggcggcgacgcgaggccaggggcggggtcggcggcgcggggtggggacgcggcgccggccggctcccccaggacggcggcgaagcgcaaggccggacctgcagggttgccgtcgcccgagccgaggtgggtggtggcgatggggctgcagcggacctcggtgcctggcggtgcatagggatgcgagggtcgggcgggacgagcgagcgaccccctcccccccgccggggtcctggcatgccatgcgatccagactcgagcgccgtgccgcctccgcgcgatcgccccgcaatgtcagcccggcgtggccctcggccgacggcacacctctttctcagaccattcaaacaggccccacgctcctcccccaaaccaacctccaggcacgcacagagggctgcgcccacggcaccctggccctacgccgacgcgacgctgggccacgcccagctcgtcaggcgctacccccggctggccctggagagggactgcgtgcgcgtggatcgccacttcccctcggacgccgacgcggtggggggcctgggcgtggccgaggcgctgtctctgcaccgggcggtcccggtcagccacggcgtcgcgccggcgccacaggtgctggcggcaggggtgtgtttccgcgaggggcatgaggaggggggagggggtccgaggggcctggcgtgcaggtgtgggccccgtgcctgcgacgatcaatgctgcccagtcaccccgctcgatgctccagcccgcccaccctggaccgtcccgtgccaggacgcggcggaggggggctacaccatggcctcggcccccgcccggggcgtcccgcgtggcgcccagctgcgcagcgtgcgcgtcgtgttcagcaccggcctgtccgagcaggcgcgtgccgcggcgctccagggcgcgggcgcgaagcagggggacagcctgcggcgcctgctcaagtttgtggtggcacggacaggtgggcggcgggtggcgcgaattctttcgccgagagggaggtctcggggactcggggacgcggtgggcaggagtatcctggatgtgtgggtgctcgggtgtgccttgaagccgcaatcaccagcgcacgcctcccttggccgcccctgcagaggagaagggacggcgcagcgggatcatatgcctgggcgggcccgtggacgccgcgctggatgggtgtctcgtggccgagaggtgggcgggtgggcggctgtgctggggggctgcagcgctttgggcgggggcatgaactggtttctccgtccaacctccacctgacaatccgtgcgtggtgtacgagcagcacgacccagcctcagcccctccatcctgccagggacgagaacggcgtgctcaggagggcggcacagcggcactgcaggatacaggtgtgcatggagagggtggggagcacactggcactgctctgagcttttgctgggctttgccagtcacacctcccccccctgattctccaggccggcgtcgacctggcccccaccgacaagtggctgcggctcctggatgtcacctaccaggtatgctctgggaaggggggattcctggggtttgagaatgatgctttggcaatgtttcctcagtccaggtatggccagcgctctgagatacacacccgcagcgcctgcaccttgcacgtctccatcgcacgagacttggcttgtgtgccaccttgctcccgcagaggctggatgaggaggggctggagcaccacacagagatcgtgtccatgttcctcgtcgacgcctcagcgtgagtgcttggggcccgatgcgcattgttcacccggtgctgcggcgctgacacggcgccgcgggcgcggtgtgccatctggggcgtcgctggacatgcaggccctgcaggctcactcctgatgagcccctcatgctgcacctcgacatgcctctgcgtggccccgctgtgcaggtgcctgccgaatcaagagagctggcctcaggtctgggcagaggcccaggcggcccggcgactccagacccccgacgcaggaggagagggggcagccccgcggcccgggccagaggccgagcctgagacggcgcggggtgaccccccccccgcaaccaccgtgcaaggggaggccgcgaccgagcccggcgaggcgctcgccgcagggtccgcggaggaggacttcatcaggctgctgaacgagcctgccggggagccggcggaggctgtcggggatctcacgcaggcgctggatgcggggctggaaggggcggacgctgctgccgcactggcgccctctccaaagtctgataccgatgtcgtttccctggcagccgtcccgcaggcctcgcctgggccggaggcacgtgctcagggaggcgcggcgctcccgcccggactggcccagtccaccgtccctggcctgacaccgagcgatgcgccggaggcggtcgacgcggtgctcgaggcagcaatggattcatcccccgtcgaacggaccgcggccccagattctatcgccacggatcccgcggcgggccccgtcaccaccgccgctgccgccctcccgcccagccccgcgctgtgcacgctgggcatgcacggggccggcgtgaggctacgcacgctgtccatctcgctggacggcctgctggactacaacctgtcggacacgggggcgggcaccttcgagctgtccctgctggcggaggcgctggccgacgcgctagccctgcgctacagcggcatcatcatcggggcgctgcggcgggacggccaagcccgcacgcgggcggcgcgcgcgcagcgcaagcgcgcgcgcgcaggcgaggaggccggcgcggggaagcgcgaaagggccgagggggcgcatgggacagcggagacggcggcaggaggagggaatcctgaggccgaggccgacctcgacctgaacacgccgccgctcgcagaagtgacggcagtgctagcaactgagcaggtgcacgtgaacgcaggctcgcatgcgaaagcgggagcagccgcaaaggaggcgtcgatcgatggggcggcagccgatgtggaggcggcgctgcacgcgaggacggcacccggggcggaagtggggcctgaatcgaacgaagcacccgctgcagaggtggcaacaccggcagagctgcccctcccagtgctggtcgacgtcgggcccgagtccagcgagcctcttgccgcactgagtccgggaccgtcgccactcggccctggtccgctggcaagcgagctgcccagcggcgcggaatcgggcgtttggggtgtaacccccgcatctccgggcgcggtggagctcgaagtggaggcacccggagacaaatccacgaccggcgagcccggcgggtcggacctcggcggggacctggcaggcctctttcaggacgacgatttcgtgtttgcggagcggctgcgcagccagggcgggatggaggtcgccgccgaggaggacgccgcgtccgcgccagtgcagcccggcgagggtggaaacggcggcgcgcacttgaacgaccaggacctcgccgtctccctgaccatggccttccgctactttgacgctggagggaagggctacctcgggtgggtggcggactgggggtgggcggctgagatcgatacccctgggctgggtaaaccccggtatacatgcgtagacagggccgaagctcacgctggtgatgagatgacactatcttaaaatccgtgccaccttattcgcggggtccatccccctcgcattcaggacggaggagctggagggcatcgtcgcggcagcgcagcccttcctccaccaggacctggtccggtcctgggtggctggcgtcagcgatggcagcagcctgcttggaggccgaggcagggtggcgtacatgcctcgattgtgtgagcggggtgccggcacagcgccagcggaagagtctgccccataatcgtcggatttcgaagctgcgaggaacccgcacggtccttccttgtgcccagcgttgccttgtcgcacacactccctaaatcgactccaagaatcatcgtcaaattttgagcttgagccagtgtccaacgagggctcggtgtcaggatggctgaaaggcaagtaggccggattcgggactcctttgacatggctggggcttacgatgagcgacatgatgccgccgcctcagcttacaggcactggatgcaattcagaattcacgaatcctgatcctttaagcccctcccgatgcgtgcaggaaccaggatggcggggcggagcacgaagaggtgcttctgtacgtcccggatccggatctaaggtcggagtgcgccaatccccaaatagatgcaggggtgcttgcatctgacgcacattcccctccgagctgcgagaagccgcgagggggaggcagcagcaggataggagcggtaggcaagggggtgacgcaccaggacgtcactacacacgaagcggaggagcttagagccgctggttttgacgtataatgtaaccgtggctctaaaaggatatggtacaggctggacgggcattgcaatggcagtttcttatcgtaagaggctgtactttgcaacacgtccggtccaagaaagtcccgacgggaaagtcctgggcgcgggtgtcaggaccaattttgacatctaccgactcagtggatcattgactttaaagcaagctgtaacttattgtcagagtgtgtacattcgtgacggcatcgttctgcgaacgcgttgttcagtcagggagcactgtgacacggccataaaaattgctcagaaactccctgtatatcgaccgacagccaccccgagccccaccacctgcgtctcctccctcagagtaatcaacgccactggcccaagacaacgccgctgctcgggccatgcgcgagtgacccgagacccaaccccgtctcagcgtgaatggatcccggctcttctccatcgccgaacgcgttcccctcgccctccccctccccctcccccccttcgccccaaaattactatgcctggggcaccgctgtgtacgccaccctcacagcagcggccatcgtgctgtcggtcgcggcatgcctggtcatgttgaataggtcgtactggaggcccaggcgcatgcgtgcagctgccgcagcagctgccgcgaccggcaggcagggctatcccccagatggtgcgttgcatgagcatgtctctgcatgttccgggcgttgttgtggaggctgggtaggccagaaggataatggctggtatctggccgatatgctttggatcgactgcaagggcgatgagatgcagcctgcttctgcagcatgtgccgggcatgctggaacgcctgacctccctgcgcaggtgtcgatgatgcagaagagaatggtctggccccgggaggtccctcggcctccaagcagcctgtcatcgtggtccagccgggagggtgtgtggatcttgccatcaagggcggcgcggaggaggaccgcgcccccggcggtcacgcgcttgccgccagccaggacctggaggctcagtcgactggggcgggtgaggcgagggcgccacgtcagcggggcacgggcggatgggtcgccccctctccactggcctcgcccagcacgagcgtgcagatgatcgtgcgacccctctccagctggtcacccgccagtcgtccccaggtcctgatggcgtggccgtccctgcagctgcatgaagtgaccccccagccggccatgtactaccccccgccgcgacgaccgcagcgaggtgggtggatgtctggtgcatcttgtggaaaaggggggggggggagtccaaagctgggcatcaaagaccagctcatgtcagagctggtgcagagcaggtgtgcggggcatgatgtggtggggcaggtgcccgcaagcacagtcattccctgcaagaccccatcgcgcacacctgacggcttcccgtgctgctcccttctcagggcccatgctgccgtttgtggaggtgagcgtggatgtcgctgacagcgacgaggagcgcgaggaagacaggaaacaaggggtccgcacctctcgctgacactatacagcgccgctgaatggaggtgccacagccctcagtgcatgcctagctgcacgttgcatgtaatcttttggttgaaagaagaatggtcgcttgcgtggaggaagagggtgtcatggagatggaattcttactaccgtgctgtgcctgcggtgtacaccaaatcggggtggtcgctctcggagatcagagagagtccaacatccacgaggtcgctggataccacacaacagcaatccttgtttcagcttgaatttacaatcatcgcgtgcaatgacgcctgttttcgcgatctccagcctcgcagggtaaggtcgagcatggaggggtgtcggtatggtcggagaaacgcatgcagctgtactcacaggtcgaaacccacacctgcaggaggaatgtcataccgcctggagtgcacggcaatgcgacatggagtcccagggtgggtgcattgctgtgtgcgcccctggagaatggtggtgctctgggcatggcttctagcctttactgatctccattcatactcctcaaagatgactgctcggggaggcgagcatcttggttgctcaagctttaagacattcaaggtgagtgtctttggtcgttttggggcttggaagaccgaactacaaggattttgatcgagattcgtggacccatgcccctccatcggatgtcaccacctgccttgccttgcactcaccacagggaggccatggagcgtctgtgcataagtcgccacccaggagggcacatcgaccggtgattccatgtgcaattctgactgttcaggagccctcgactggagtggagttccccctcgtacaaaagttctggtgggcggggggtggtggcagggaacaggctcctgtaatgttcaagcacttgtgacttcccggtgcctggaaatctgcccttccaaggtgtggcactcgctcaccacccctctcgccaggctgggagaggagatgcggtgcatcggggccggcgtacgcaccaagaaagtggccttcctgggcatcaaggtgtatgcggtggcggtgtacgccgaagccgagaaggcggcccgagagctgggcatccgagccaggcaaggattgatgagggaaggagcggtcaaactgaatcttatataccagcctttcatgttggaaagttgtttcctgttgaccccacatcttgtggccaactgccacatgattacatttgcatcatcccatgcaggggtggcttctttgagagcgacgacgattactgctctgctctcctggatggtggtttccacaaagcactgcaggtgtgccgtttggagcaagccggccgactgactcctgtattcttcaagtatacaccttcaaaagtatcagaactgaacaattgtgtcaccagctcactccacaccgcaatcgctggctcatgcatcgcccccgcacccactgctcctcccgcacagatccacctggtccggaatgtggaaggcacccagtttgtcgaggccctggccgaggcattaacgccgcgaatgcgcctgtctggaggtgggttgcctggggcctggtttaggttgtggagggagatgtcaaaagcattctgctgactgctccggggtcctccgcccactgcttgtctttgtgcttgcaggtgcaagttgcatgtgagcctgtgcattgctgtcaggcagcgcagcgcctgcagccactatggcgatccacgagtacgctcatgttctggccccgtcggcgctttccctcctcgcagagatggagaagctggagaccttctcctccttcttccaaggccaacaactgagcaaggggtccgtcatcaccctgctctaccgcaccgacgccacgctggacgtcgctctttcctccccggagcggcctgccgacctggccgccgcccgggccagtctgtgcatcaagtctgcctccctgtgcagggcgctgtttgagaccttcctgggggagtccagcgtggtgccagaggcacgggctgtctgggcggccggggctcggcagttgctggcctcagatgaagtgcgccgcgacacgaggcggggggggagcggctgaaggtgtgatggtatgatgaacctagcacagcacgtgccctgtttccatgatgcatgttgttgaacctgcctgcacacctcttacacggagcggaagtggccagatggtggtgagaagggacggatgtacagtaacaggggtacatatgtgagtgctgtgaccattacccggaagcgctgccgcatttagcccgacaaggcagtgccacggaattcaattctccccggacactcacatcgtataacatggcactatctatcttgtacttatcacttaatttccatattcaatccgtgtctgttcgatggtgtcattacggccccaggttggcgacagcatgagatccgccggcgcggtcgcccgccggtcgaccgagccttgggctggtcgtctcccggcatggaggtccccgacctgccgcctcgatgtcatacgctgcgttctcggtctcgaaggggacaaggtgttgttctcgaggccttgcagcggcaattaacatctacatcttgtgaagtgcctgcacaccactccctgtcctcttgttattctctgtccggaattgtgtgggaaaccgccccgccttcgacaccatgaagtggaccgtggccttcctgggcctccttgccctcaccagcgcggctctgggtgagacaactcacaaccgtcgcagcatcacgggggatgacgtccagcatggtgagtttcgctcgcgtcgcagcggcaggtcaatgaaggggtcaaacagccgtgaagccgtactcgaaacgagcattaccggcccaccctaccttttcccattccttgtgcagccctgaccgacttcatcaacagcattcgcaccgagctgcactccaaggacacgcatgagtcctcccgccgtcgcctgcagagctggacgttcgcagaggtgagcctggccgcacaccgtcgggggttgtggtccgagttgctgatctcccggtccgcttgagccagtgcgggagtcattggaggtcgtggtcgttcctcccaattcctgcagaacattcatgccttcttcaaggacgtcctggggtccgcatgggacaagtttgtgccagacgcatggaaggatgccggtacgcttggattctgacaaggaggggtgatgacgcagttgtgtgctgtgcgcgctgcttggtgacatcagctgaaccgtagaccacccctttcattcacagcaccaaagcatggcatttctgttgtgtgtggctcagcgccacagcagctcatgccagcaacacacgcctgtcgcaccggtggtgccccctcaggacccctgctttgagctcagaagccccctcttcccactccaaccaggcttctcatggtccaagctgggtgactttgagtacaccagcaacctgcagacattcctgtcggagaccaacctgaacacgcttgccaagccgcagaccctggcccagctgcacagcaacctggagaagctggaggagaccttctgcacccccgaggagtacgtgtgtgggctcggttgggaggaagctcttgcgtctggggaggtggcgggtgccatgtaccccagtgccgctgcgataacctagccccaaacttcctgtccgattcgctgcaaccccatggttccccctccccacccaggtttgtgcccccgtcactgacgcccagctcctgcaccgggcccagcatcaccctgtcctacatccccaagaagtgcgttgtgaacgacatcgccaagcagatcctgtgcaccacacccaagctgatgctgtacaagttccccggctcctgctcccacaagcactggacccccaccacctggaccgggaaggagtgcaagatcgcgggcaaggtcggtttcacccaggaggtgatcatcgggggtggggagtacaccctcccactgtccggcgaggacgacgactagatgcgaggagcggaagccccaggcgcgatgcggcggacgtgaccatggtttgcggggcgcagccctctgcccactcttcaaccctcgccccatgagacctggccacaccatggattttatttcggtgggatcatcccaaatagcggcctaagagaccgcacaggcatgtaatgagccattagctctcgtacagggggagcagggaggcaggggcagtcaaggaggagtaagtattggcacgtgtgaccagagagccccaggcctgggttggtccctcacactgcagggtcacaacagacagaagggtctccaccccgctcatcgcaagccagacgccagggcctctttgactgctgccacggcctcagcagcatcgagctcctcggcctgcctggccaggcgagccacgagggccaggttggcgggccccggcgcatccacccacacccgcccgtttgcccccacggccagctcgaacttcagagagcgcccaagcgccgcgaggaaaggcggaccagacgccagggtgcgtgcgtgggaggtggaaacctggaacagggttccacccttcagtgggccgaagccggccgcctggcgggggaagttggtgttgtgggtggagagtcaggtggcagtatcttttggcaggtgttgaggcccgctgtggcgccttcagcaacccagcatgccctcacaacagattttatgtactgctgctagcgcgtccaaacctcgaccaatggccttcctgagaccctcgcacctcccatcctttgaacaaacttttgcacgcaccttgccggcagtatccatgcatgtcagcactgggtcgaggtcgcgagccgcctcctccacccggcaaaacacgacgtctccgacctgcggtgctcagggacgcgtgagtgagcagactatgctgcacctcacaagcatagccttgcccattcaagctcaaccccagcagagcatgcgacacatttgagcctccctcgtcggtccaggcatgaacctgcaacacacatgcataaaatacctggaggtttggtcgatttcgtcgtgccacaccctcaaacgccagcactgggaggaaggccggtcctgggcccccaatgtccaccgtgtagttttctgaatgacgatgtgtgatgatacccaccactgcatcattcaggttcgggatgtacctgcaaatttagggaatgacagagggagaactctgagtcgtgctacttcgctgcagcatggcggtacctatgagggtcatgggcgcaccgtcgtccgcacctcttctgacgattgcagacccacaggctgtctccaggcccctgctgcaccaccccagccttgacagcgatgaggctccgaccagcctgctgcaccccacccccaactcgcacagtccccgtctcaggaaggctggctatgggctcgcctgggacgacacactgcagaaacagcgaagggttggattaaaaagctatcgattcaaggatctggtgctctcgcccagcgcactgtcactcctgacgcccagcgcaccttgccgaggcatgcaggttgttccaccgctgcgacacccatgacagggagatagtgcgtatatcactttcccatacctagccgaaggatatcgattccaagcctattgcagtagcctgcaagcccataataattgtgtagaggtcctgtgctatgacccatgtacactcgagagggcgcgctcgacatgcgaagctcgcgaagcatcatggcaaaagtacgccgggcatctcatttcaggtttccacacaggggccgtgatcgttgcaggattactgtttaagtcttccaagctttgtttaggggtggctccagtcctgactggcagcctgctgtcttcctcaaagccttagagacctcctcacccctacctgcctcactgcgcgagggtggcgcccaggctctcgaacttgagttcaggggtaccagtgatctctttacggcacctggcaaccctcacccggacccggaagcattccgagcacggcatgtcggcccttcacatggacgcccgtccgctttctgcggatttggaccttttcatggacaccctgccggtcctgccctacgacagcttcacccagggccacaacatattcttccatgagggactgcaggcggactcgcccctggactccgggagcctagaagcgtcggggagtggcggggcccagtcctccgaatcccccacggccgtgatccaggacgaccacaagtctgggtccagcaagccgcggggcggcaagaagggcggcaccaagggcaaggaccaggagcagctggagcgcatccgtgctaagaacaggaggtgggctgggtgtctgagacggcaggcatgaggaattgaggccagtaagcgccggcaggggctctggctcacggtgccccccccctgcatggtaggccacctggtggcgcgatggaagtgtgcattattgttaccatctccctcccccagcactcacgtcgccgcgggcacatcccttccttcgcctgggtgcagggcacagagcaggtatcgcgccaagctgaaggcacaggcgcaggacaccgtccagagccacgatcaggtgactggcagttgaagggggaggggcagggcctgatcctgggacacatgcagtgtcaaagggctgcagaacggggtggttggcccgggagtgaagcgccctgggtagtggtcggcctgctcctcgccatgcagtacccttgttgtaagagtaacccggcgacgtaatcttcgatttcacctgtaacacccccccccccccccttcccctcnnnnnnnnnnnnnnnnnnnnnnnnnnnnnnnncccccccctcccttctcatccaggtggcggacgagcttgcgcggctgcgactggagaacgcggcgctggcgcactccaacgacctgatggaccgcgtgctgacggtgcgggaggattacatggcgagcctgaagggcggtgccgaggacgccgccctcggcgatgccgtccccggcttcggcactgtcaccgactcgcgacggccgccctcggcgccgtacccggggcactcgcccgaggccgacgcggcggcgcggcaggcggccgccacctgcggcgtcacgggcctgtcggccgcggaggtggccaagatcaagtgctccgacccggcggccgtggtggcggcctggcaggcgctggtgccgcggctggaggacgcgctgacgcagctgcgcggcgcacgcgacgccgactcccgtgcgctggcctggaccggcatccaggaggcgctgcacgacgcgcgcatgtactgcttcgagcacgcggtgtacaagccgcacaacatccagcagctgctgggcgccaacctgggcgtgggccgcgacggagacggcccgggccccgaccactgggccttcgtggccgccgagctggagctggatgaggcccagcgcgccgcgctggccccgctgcgcgacgtcttcctgcgccgcatctcccgtgtcatggcggagcggcgcgccgtgctgggcgcactggccgccgccacgccggccagcagcctggcggcgctgcagcagtccaccgccgactggctgcgcgtgaacgccgccacctcggagttgtccgccaacctgcagcaggagcacatggtgtgcatggagtttgtgtcgcggggcttcggcggagtgctaacccccctgcaggtgcgtcggtgtttgggaggcaagtgtggtgtgttggaagggggggtggcgctgggcagggcgccaggcgggggtggatcaaggcagggaggcatggagtcagcatggtgaaaagcctgaaacttgaatggggtgaaacccaaggttattgttgcaagggtggagtgtgccaggggcagggatgtttgcgctgcaccgagaatcggagtcgctgggtgggaatctgtgtctattttcagagtttcccagatcctacatgcctcacttccacctccacacccaacctcgacctcctccccccccctcttccacctcgtgcagaaagctattgccatagttcgctcgtacccgtacttccccgacatctacaggtggggctgtggcgaaggaatggtgcttttgctgcagtgcatgtgctcatggagttggctacatgatggatgcttgatgatgggcaaagacgagtcaactcttgcattgccggcttccgagttcgcacctgcattccctgcatgtcatcaacaaaacgcttgctgggcactgcctaccacccatgcagcatttcgacggccagcctgggccctggctacaaccccacctccatgctggacgcgccccgagacttcacagagctctcagaatgaaggacatgaagacgttgaccaaacgcatgccctgatttttccaaatgaccgccatccaggcccagcccttggacgggccacacatctgtaacacgcgagtcccggggattagggggtgctggtcgtcacgtcgtcccgcccaaaactcatgtacaatcctgcccgtgtacgtgtcggtgatgcgccgtgtcgttgcatggctctgggtggaaattttgtaatacttgtggagtaggggtcacgcaggcaggagtacccagcctccaccgccactgggggtcgggcccgggtcaccgctcgtgcgcatgccggcacgcccttcgccatgtccgagtacgactggaccgatttattgagctcccagtcctgggagcctgacctcgagccgttgggaccttgcccagcccccgaggctcacctgccacacccaccctccgctcttgcgtcatgtcaagaggatgatgaggacctgtcccccccagcgtccaccattctaaaccccgccacacaacccctgatcgctgggcctcccagcgacctgcctgtcgccctggacgccgagcccgtgcccagcacggggcgaagcaccacgtgcaccgcaaagaccgccgaggagcgggtggcgcgccagcgcgagcgcaacaagctggcgcagaagcggtaccgtgcccgcaagcaggctgcatcccaggcccgggggatgagtctggcccaggcccgggaggcgctggtcgccgcccgcgccgaggcggcggtgctcgcctcccagcatggcatcctggagcgcctgctggcggtgcatgacgccagcctgagcatcctgggcgagcaccggaaccacagcgcctgccccgcctgcaactacgcggagccgggcatcaccccgggccagctggccgtgctgcacgccgtctgcggcgacggcgagcgctggcggggctgggcgctgggccccgacgatgcccggcacttcgccgcgctgagccccgaggtggtgaccgagcgctggctgggcaggcggcgcacgctggtcgacgtctgcgaccagctggtccagcgtgggggccgctgcccagccctggaggcccacctccagagcgttctggacgagggggtgagcggtgcccaggcttcatgtgtctgattgggggggggggaggttgagtcttgacgcgacatatgcctgcctcctggtgacaggcatgtctcgagagcaggaagcagcgggcgctgaggtatcacagcatggcagcaaaggtttgctggccgcaagtgtctacaagggcaaccctagggcaagtacagcttggaagcctccacgcacctctgaagcgccgccggcaaggcctgcccccacctggcatgcagaggttgctgatgtggcgcgtggcgcactacctgcccggccgcctggcggaggtggggcgaatgaggagggacgcgcccagcgaccactgggagaacgtcgtcgtgagtcagcaggggaggcctgatgtttgagaatggcggtagcagtcgaggggggggcaggtgcatgggcaggcgccgaccccggagttcagtgctgtctgcatgcccgacataacatccatgtgcacactctgcgtgcaaccagccataccttcctctcctgtatcacagaggcggctggggctgacccgggaccaagggtgcgcatgcctcgcagtcgcgcaggctgcccggcggcaggtgtccagcgtgcgtggcaggggtcagggccaggaggtcgacagtgagggatgggagatgggtgggctggtgtgaatgtgtttgatcatcatgcctgccacactgattgctgggggacaccccgcatgttttggatggaagagtacagcaggtgcagcgctgaagggtcctggtgtgcagaaatgtttgtgaatgcccgctcgtgcaaattactcatcctatgcaggtgctggagcagaggaagaggatcctcgcaaaggtgggacacaccaagcttgccctgaccggggcgccgctccagcttcaaacggccagtagcctgcaggtggagtgccggatcatgtgtgtgccgtggcctcatccacgagcggcctggaggcaggcggccactgtgggatgtgcaaacactgtgaggttgcccctgtgggtgttgctgtatcatagcatggatgtgccaaccgacccaactctcccatccctcgtctctgcatgttctctgagcttggctcgaccaatcgcctgactcctcttctgccctgttcctcattctcagctgcggggtctcctggagcagttggagaacagcatggctgctgagaggagcatatatgctgaagctcgaagcctggtcaagaacatcttgacacctgctcaagtgaggcccaacctgcacaacagtttggggcctggtgctatggatgtagcactcattcttggtgatgtatgtgcctctatcataatgattgggtcgcactctccaatgcccccatgacatccagcagcatgcagctcaatcctacgaacccccaactgcctgcaggagggcagaattattgccctgtgtctagagtatggttcaccagacatcagcgggtgcgggcatggggtgcaagggctgtccaccaatgatgcaccactctgcatgtacaagccttgaaacggcctcccgcacgcgggtcaccacggcaccttctatggccccaaaccccatgatcctccacgtccgattccgcaggctcctgacagcctgggagaaagtgtgcggcggtgacagcttcgagcccagggctggaactttcggggtcgtggaagagccctcacttcaggaagtaattggaccaagcgtgcaggtccatcttaattgactgtgtgtccagaatacctttcccaaactgaaagaacgttgaaccttggcacgcttcactgccgtcctgctgtaaaccctttcgtaacggaaactttatgagaatatccacgatgacactgcctgagcagcctcatgacagcatcgcccctttttaacatgccagaagggctgagtaggagcccgtgcaggaggcccgtctggcgctgcagttccgggcaatacactctcgcaggatcagcggacactgccagagaacaatctatgcgacgactgtgccaccagtttgtaatgggggggtcttggttttaagagacacttcgcccacgccgactctcctcaccgcacccttatcgggcttgcgccggttgcacagctatgtccgcgaggatcaggctggcgcagttggttgcctcggacggcaaaccggtgtgtgtgttgagggcggggggttgggggccggcgaacaagggggcccgccaaaggccgtgggacgggcctcccgagcgaaaaagcacttggttaacatcagcaggttggccgctccgttcacgtagcggttgacgacgttgcccttgcaggccgggttggtgcaccgctttgtgtcccacagctccatccacgtcttcacgccgttgcagacccgcttgtgccggtaggcatgcagggtggtgtgacaggcgcagcacagctctgatgacctgtgctcgtccaccaccatcaacccgcacacgcgccgcaggcgccgcaagaacttgatccagggccctggcgggggcccccgcatggcgttcccccggtcctgggccgacaagttacccacgcccacgaccgtggtcatacccccgggggcgcgaaactgctccgccagccgggtgatggcccgctccctgccgacgtatgcctgatggcgcagcttgcggaacggcttctcgtccctgtgccaagccaggcaccgtcgcaggttggagaggatccacgcgacacatgacaggagcacctcggtgctggctgtcttgtgggttgggcacctgcgggaagacagagaggggggattgtggagggaggtcggtgtgtttgaagtggcaggggggtcgtgacacaggtccccagagtagcctgtcactgcctacacctcacaaaccagtcatcaaccacttgcgcagctccctgagaaagtctggggccccggcgtgccacttcgcgatggtcttctgccgccgcttggaccccgacacggcgtggaacttctttgaagagcaggatgtcgcgttaccgtgtttgtcgatagccgtgaacatcttggtccgccccgggtcgatgccgatgtacttgtgtatcttggcatcccctgcaggggtgtcccgcctgcagaggtgtgtatagggggggtggggtggggtgagttgtgttgttnnnnnnnnnntcgtgttgtaggagcgaggcaagtgtgggtggttgctgggggaataagtgggtgggacaggtgggtgcacctcgctgctggtaaacagcacatccacagtcactcccaggaacagagcagccaacactccggcaccacttgcaagcgtcccaggcaatcactgcagcatgtcgacaagccaagagaaccatccctagcagcacacaccttaggagtccatggtgcagaccactcaccgg

SEQ ID NO: 28445 - DNA, 182 bp, Chlorella protothecoides
agagtgacctttacaggatgcacacagctggtcggccatgtgaataaaggcgccagaagcactcctccttgatactgagtggcatgtcgctgtcccagacctctgtatcccagattggctgccgaagtgcaaacccacttcgcccaccatctggggtaattgtgcttgcacactgacttgaa

SEQ ID NO: 28446 - DNA, 73 bp, Chlorella protothecoides
cctggtcgggtgagggactgtatgggatggagtggtggtcgcagagtagggaggtggacagctgcagggtttg

SEQ ID NO: 28447 - DNA, 61 bp, Chlorella protothecoides
tagaggaggggctggcttccccgagcggggggccgacctcggtcggccagacgtctagctc

SEQ ID NO: 28448 - DNA, 77 bp, Chlorella protothecoides
gtgcctacattcgcgctcaaagcgtcgagtgtgccggtggctcccgtgcaaacgctcaagatggccacgccagcgcg

SEQ ID NO: 28449 - DNA, 74 bp, Chlorella protothecoides
caaccctggggagaaaatcccgcgccagtgtggagtggattggcccccccttctgggtcacgccgagagtacta

SEQ ID NO: 28450 - DNA, 207 bp, Chlorella protothecoides
attcaaaccctggcagcaccctcgtgcatgtgaggaggcaccctgacccatgcctggttgtttcgcacagtatgcgttgaaaggtttcagtgcgtacatcatgtcctcatcagggcatgcagagctctcacggggccagtgtccaggctttgccgacatgccgtgaggggtgctgactcatctactccgtgacgaggacatccatca

SEQ ID NO: 28451 - DNA, 73 bp, Chlorella protothecoides
caatgcgccctggtgaagggttctagagggccaatggcaatttcgtgcccagtcgtcacgagtcaggggctgg

SEQ ID NO: 28452 - DNA, 240 bp, Chlorella protothecoides
gcgccgccaaaggcggtctgcggcaggcggaaggggtgccccgtggcggccagcgggtatccggccgtggtcacgcccagcgcggcaccggcctcgtagccggccgccgcgctgcgcacgctgagccgcgcctccagcgcctggtcatacatggccctggcggcctccagctcccccgcccgccccgcatggtccaccatgggcagcaggtgcgtggcgtgccagccgctggaggccgct

SEQ ID NO: 28453 - DNA, 61 bp, Chlorella protothecoides
aggaacaagaaggtgtgacaggcggtcaccgcgcagctgcggagcacttcagatcccctcg

SEQ ID NO: 28454 - DNA, 73 bp, Chlorella protothecoides
cgtggagatcgcggcgcacaacatggaccgcatccgcctggtatgggcccgcatctgggccgtgctctccgac

SEQ ID NO: 28455 - DNA, 77 bp, Chlorella protothecoides
gacgacaacatgcccttgcgttgatgcacatacaatcatctttctcgatatttttaaaacctctcaagactccacac

SEQ ID NO: 28456 - DNA, 111 bp, Chlorella protothecoides
tggcgaccccgatacacggtcatacggtaggttgttagagtgactgagtggggatctgcctggttgggggactgatgtcatcctcatgcatcgcgcctgtgctgatgggca

SEQ ID NO: 28457 - DNA, 61 bp, Chlorella protothecoides
atcaatgtttgagtgtctgagtaccctgtgagatgtcatgatgtgattagaacccccacct

SEQ ID NO: 28458 - DNA, 85 bp, Chlorella protothecoides
agctgcatgccttcaagagggtgcgccttggccagcgtgatcttgtccccttgcctggcgcttgcggggcactctgtgcggtgcc

SEQ ID NO: 28459 - DNA, 71 bp, Chlorella protothecoides
gtaatccagcactgctacaggggtgccaggacatgcgatgcacagaaacctcgagatgccgagcagcgcat

SEQ ID NO: 28460 - DNA, 61 bp, Chlorella protothecoides
gccctgcggcaccgccctgaaggtccccccaccccccgaatctcacctcaccagaggacca

SEQ ID NO: 28461 - DNA, 93 bp, Chlorella protothecoides
gggggtgttggcggtggagagggactcacctacggcactttccttgctgcatagaagtcagtattgagccaagatcccacgggagcagccaat

SEQ ID NO: 28462 - DNA, 82 bp, Chlorella protothecoides
ggtgccgctgatgtgcaagctgctggcatcgcaggccgccgcgactgggcctggagcagctgccatgggcgtgcctccgccg

SEQ ID NO: 28463 - DNA, 79 bp, Chlorella protothecoides
ctggatccccagcgggaagcaggcggaggaggtgtttgcgcgatcgcctacctgctccgactcgtcctcggcgtcccac

SEQ ID NO: 28464 - DNA, 79 bp, Chlorella protothecoides
cgacagcgggtgtgccactcgctcatactgcggcgccacatacaggccccaggcctgccacagagactctggatcaaat

SEQ ID NO: 28465 - DNA, 70 bp, Chlorella protothecoides
gaaggtgggaatggcatctgtgcatgttcaatgtcagtcggtgcgttccatcagagagttggaccttgtg

SEQ ID NO: 28466 - DNA, 61 bp, Chlorella protothecoides
tggggccagagccggccttcctgccaggagtgccaagcctggcccctgccatccccactgc

SEQ ID NO: 28467 - DNA, 61 bp, Chlorella protothecoides
cgggcgcaagcaaccctcacaagctgccagagaggcacgggcatgaggtgttcaggagtca

SEQ ID NO: 28468 - DNA, 84 bp, Chlorella protothecoides
cgcatacattcaattccttgcagcctgggagctaatgtgtatctgacaacggtcgacagtgcagatgccatctgcaagcaagta

SEQ ID NO: 28469 - DNA, 83 bp, Chlorella protothecoides
caaatccgatctcaatcactgtatcttacagattggttgcagcagcaccagggaaaccggttgttatttttagatcatgcatg

SEQ ID NO: 28470 - DNA, 138 bp, Chlorella protothecoides
gcggcacctgtgatgggcaggagggggggggggtcaagaatgtggcggcatttttgtgtgtgggtgtgtgttgagagagaacggggtgtgttgtatggggctggcgggactgagatcgaccggtgcaggacgcccccg

SEQ ID NO: 28471 - DNA, 78 bp, Chlorella protothecoides
tacgcagagaatgcacccacctgcggtatcgtgggctgcgccttctccttccgtggctcaggcgctccaatgtatggg

SEQ ID NO: 28472 - DNA, 74 bp, Chlorella protothecoides
aagctgcccaggaagaaaggggggtgggaaggggttgcgtccggagccccggaagccgttacgaacaccggccg

SEQ ID NO: 28473 - DNA, 80 bp, Chlorella protothecoides
gggctcaccctgcatccacactgcacccacgccccctcccatgcccaacaacctcctcccgcccaggtatactatgtcta

SEQ ID NO: 28474 - DNA, 73 bp, Chlorella protothecoides
tgcagaaccatgcagaacgactttgaatagtttccagcatgcattcacaccgaatttcccttggcccctgcag

SEQ ID NO: 28475 - DNA, 61 bp, Chlorella protothecoides
ttcacaccgaatttcccttggcccctgcagtcaaaaggcagagcagaaggagtctgagagg

SEQ ID NO: 28476 - DNA, 137 bp, Chlorella protothecoides
ggcacaggctccctgtggggtcattaggtccggggggaggcttgcatgtcccacagtctccaggactgtgggttgcctcctcgtcggtctccggctcagagaccaagcgtccccctccctcccccccaaacagagcg

SEQ ID NO: 28477 - DNA, 523 bp, Chlorella protothecoides
acggcgcgcggactggcgctgcgccagctcggcgcgccgcccctgccgggcgcgctgtggctgggcgacgcgggggcgggcaggggtcccctcgacgggtgcgtgccggcggagccggcaaacggtgcggcgcccacccgcaagcgcggccgcgggtggcccgagggggcggtggagccgactggcgcgccaggtgcggaagcacctgtgatggccaaagccctgtcccccgggcccccgcagcggcggctgacgctggtccaggccctccgctgggcccggcgcgaggggctttggcgccagctcgggcaccagctggatgcgctgggcctggccgcgagcgaggagtggcggtgggtgggcgcgccggagtcgggtggtccgtcgcccatgggcggcgcagctcacgcgaagccaggggctgcgggcctcgccgcgcgcgagttcctgggcggctcggcgtcggagcctgcgccgtgcggcgcgtacgtgcgggtcctcgccctgccggcgccgcccggcg

SEQ ID NO: 28478 - DNA, 169 bp, Chlorella protothecoides
cggggcgagggcaggcacctcgggctcagctttcccctccgtccgacgcgcagtgctcagcgatgtaaaggcctctgcgatccacgccgcgtggtttgcgaccaaggagtcaatgttggccagcttcgcatcggcatacgtgcccagatcgctcagggcgagggcgagg

SEQ ID NO: 28479 - DNA, 61 bp, Chlorella protothecoides
gtctggacagccatggcttgtgactcggagtgggagggaacagagtttggccagcatggac

SEQ ID NO: 28480 - DNA, 145 bp, Chlorella protothecoides
gcgcggcactggggcggcgacgctggcgcttcccccttccatggggatgaaccccaccgtcaacgtcagctacctcaagccctaccacggcgacagcgaccatcgcccgccccctgtcttcatcaatgacagcggcgcgcccgcc

SEQ ID NO: 28481 - DNA, 181 bp, Chlorella protothecoides
ccgtgtccaattgtgcgacgcacgcatctgttgcgaaataggaaggagggggttggagagaagtgatttgtgtggatgacatcgaccaaacaaggcaggcatccagagttacacacagtcagcagggacaagcacatccaaagaccgtcctgaggacgggccatgaatgcattcggctggt

SEQ ID NO: 28482 - DNA, 1368 bp, Chlorella protothecoides
  modified_base (1049)..(1058): a, c, t, g, unknown or other
tgttgtcagtgtgcagagcgcagggcgccatcagcggacaagagccttgcgtactgtacctacatcgcttgagggtgacgtagacactccctgatttctcatgccgctcaaacatcctgttcagctcggtgaggaacttgtcggggtccaccttcatcgtgaggagcgctgtggactctcgactccttggagggcactttcaaacacacaccaggatagtgcttgattgttccactctcgattgacttgaaggtgtgcgggatcccggaccgtggacgtgttggccgggtgttctccagcaagccccagcacccgcagcaccaacatccgagccgggcggatctactcccggatgttctgcgcgtaaccccaagcccccgttctttccagtaacataggaggggctatccctggagaatcagggttatagtgcctcgggacgctcatctgtcccagcacacttcgccccccctgagtgtgatcgccttagcccgcgccacagaggctcgccctggcgtactcagagcacccagcccccgtcgacccgagcgaggcggctctgcagggactgggcgagtcagggtctgacgacggatcgaactacagctgggaggaggacgacatggggaacgccttctcctccgatggcctcgagacggggcaggacgttgggcggcagcaggccgtgactgaggcccggcgcaaggtgccgagcgcccggccagcctcggaactggccaagaaggaggattggcccttcattcgggtgcgcggtggagccgcgggcctcgggtgtcgcacgggtttcgggcaggtcggatgacagcctgatggcgtcatcctgtgcgttctgctctgggtgcatgggatgcgctcaggacggtggccacgcgcatcctggcgccagcccccaatgacccaggcattgggctcctgagcaatgccccgcaaagaccctttcgaaagcaatgagcagcggggcaagcaggggcccaaagagtgtgtcgagccccctcctccccctgcccctccccaggaatgcctgggcnnnnnnnnnngaatgagcaacggtgcacgcagggccccaaagagtgtgtcgaaccccctccaccccctgcccctccccaggaatgcctgggcaagatgctgctgttcaaccacctggacgacgacatgcagaaccagatcgtgggggacatgtacgagcgccgcatcggggcgggcgagatcctcatccgggagggggacacaggtgtggcgccgtgcctttgggtgtgtcttgcatcctgctggctgactgggtaggacccctggcacccagcgacggcctaggccccaccagcctctcaggcgctcactacagcctcc

SEQ ID NO: 28483 - DNA, 72 bp, Chlorella protothecoides
ccgccgaggagcgcgctgcagccgccgaggcgttggaaaaagaggccgaggcgcgcggcagcgctgccgagg

SEQ ID NO: 28484 - DNA, 72 bp, Chlorella protothecoides
ccacacacgcatcctgatctggttcctggtggatggaagataactgctttcaaacagacaaccaggatgggg

SEQ ID NO: 28485 - DNA, 152 bp, Chlorella protothecoides
tctccatcgccacgcctgcctgccgctgggcagggccgagtgccacgcaaatacttgttggggttacggacccgagtttccatgtcctcatttcccctgggcagccacatgcaattgctctcccccccccttccttccatcccctgctggca

SEQ ID NO: 28486 - DNA, 79 bp, Chlorella protothecoides
gcgtggaggaccccgacgatggcagggcgcaacgatagttcctttcaagacgtgaatcgctcccgaggccaaaactgtc

SEQ ID NO: 28487 - DNA, 72 bp, Chlorella protothecoides
ccccccccccccccccccccccccccatatatccctctaatctaggactgtagccaagtccatctgtgcggc

SEQ ID NO: 28488 - DNA, 130 bp, Chlorella protothecoides
gaccggctggaaggccgagctggcgcgtcttcgggacgatctgtcgcgccaggaggctgagcaaaatgcggcagacggtgtgtgggaatggctggccagggggcgggggatgttgcgagctacgacatgg

SEQ ID NO: 28489 - DNA, 137 bp, Chlorella protothecoides
cccccgcccgattcgcaggcacgccctcggcctgcgctgccctgtaggctttgtaggcgtcgaggtgcgccaggttggcgcggggctcccaggtggcctcgtcgtcagggtagccctgccacttcaccaggtactgg

SEQ ID NO: 28490 - DNA, 61 bp, Chlorella protothecoides
gcattcccagggccgtccaagatgtcatgcgggctccttgacttgactagcaagtagactg

SEQ ID NO: 28491 - DNA, 118 bp, Chlorella protothecoides
gacatcatgctcgtccagtttaccaacattctggtctccgcatggcccttgaccgatcctgtaccaagtgatgctattgaggcttgcaatcaattgctggccgcagcttccttacagc

SEQ ID NO: 28492 - DNA, 68 bp, Chlorella protothecoides
acctcctcgctcatgggcaggtcggcgggggggggggggccccgcccccccccccccccccccccccc

SEQ ID NO: 28493 - DNA, 201 bp, Chlorella protothecoides
gggggggggggggggggggggggagaggggtgctggcagaccaaggcatggccatgccgtgatgccgagtggctgtgcttgctgcaatgggcaagggggccttggtttggaaagtaggtgtagagggggttcgctggtggcaggtgcaggttgctaccaggaccatcgacgtcatctttaccccgtcctggccttgaacct

SEQ ID NO: 28494 - DNA, 538 bp, Chlorella protothecoides
gcgcgcgccggggggcggcgcgtcggcgcgccgcgcgacgcaaaagtacatggtctcgcgccgcgggccctccagcgagcccagcgccgcgtgcgcggtggccgccgcgacggccgccgggtccagctccgagtaggaggccagcgtgtcgctcgcagagtcaagagaatcttcgcgcaccacggggatgcccaggtcgggcgtggccccggagcgcaagtgcgaggtgtgcgccggcttcaggtccagcaggatcggggccgaggcggggccgcccggcgcggaggagccggaggacacgccgctgctggcggtgtggggggtggaggcgctggcgcccgcagcggcggggcccgagcttctgggatcgtctgggactggcccggggccgccaccgtcgccgtccctctgggcgccagagccgccgacagagtcgctcggcgccatggagccgctgccgccccgcgtcgcggcgccgcgccgcggcaccacgcgcagcgagaagggctccagcgttgcggcggccgcctgcgcggca

SEQ ID NO: 28495 - DNA, 79 bp, Chlorella protothecoides
cgccggggggctgagtgtgctgtcgtctgtggcacaagcagggaggggcgtgaggtgtgggaggatgctgctacccggt

SEQ ID NO: 28496 - DNA, 80 bp, Chlorella protothecoides
catgaatggtgggcccttgagcgcatacccgagacctcgccagcttcacttttcatttgcagcagagaagcggcaagttg

SEQ ID NO: 28497 - DNA, 95 bp, Chlorella protothecoides
atcgctcccattgtgcatgtgaagcaccacgatgcgcgtaccaccactcctggattactcgtttaaaaaagggcttgccatgtattgcgggacaa

SEQ ID NO: 28498 - DNA, 279 bp, Chlorella protothecoides
ggccgtgcccgccgcgcccgagccctcggacgctgacccggagcccatcacaggcaggcgccctggtggggcatctggggcggggttcgaggaggtgcccgccaaggactcggactcggactccgactccgactccgaggacgagttggagctgctagacgatgatgccaaggtggggcgagcatcgtttgtggaatgcggcagtcttgtgggtttggtgtacaagctcctgtgggggtaagggtctcagcaccgttctgcatccccaggggagggagt

SEQ ID NO: 28499 - DNA, 72 bp, Chlorella protothecoides
cgcaccgcttggtgtcccacagttccgtccacgtctccatgccatcgctccaactgtaccaaaccccctcct

SEQ ID NO: 28500 - DNA, 479 bp, Chlorella protothecoides
  modified_base (111)..(317): a, c, t, g, unknown or other
cgggagcggcgtgccatggctgggaggggtttgcaaacccgccgcaccctgcatcacaagcgggtgccggcagctgtccgccaggattcacacccctccctcgggctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgcaacggggcgagacggaacgcacgttctcagacaaagaactccgcaaattttcagcaacagccatctgaattgccccattcagcacgatcttgaaattgcaagtggtcgcggtgagcactggcgtccagtcgtcgtgcagcacgtggagcatttgtgc

SEQ ID NO: 28501 - DNA, 63 bp, Chlorella protothecoides
ttccacgcactgcagaccgcatcctcctgtttcgtgcgatgaacagcgaccttacacccaaga

SEQ ID NO: 28502 - DNA, 8155 bp, Chlorella protothecoides
  modified_base (169)..(178): a, c, t, g, unknown or other
  modified_base (781)..(790): a, c, t, g, unknown or other
  modified_base (915)..(924): a, c, t, g, unknown or other
  modified_base (1160)..(1169): a, c, t, g, unknown or other
  modified_base (2015)..(2024): a, c, t, g, unknown or other
  modified_base (2210)..(2219): a, c, t, g, unknown or other
  modified_base (2292)..(2301): a, c, t, g, unknown or other
  modified_base (2616)..(2625): a, c, t, g, unknown or other
  modified_base (2897)..(2906): a, c, t, g, unknown or other
  modified_base (3241)..(3250): a, c, t, g, unknown or other
  modified_base (3505)..(3514): a, c, t, g, unknown or other
  modified_base (3917)..(3926): a, c, t, g, unknown or other
  modified_base (4793)..(4802): a, c, t, g, unknown or other
  modified_base (5528)..(5606): a, c, t, g, unknown or other
  modified_base (5857)..(5866): a, c, t, g, unknown or other
  modified_base (6147)..(6156): a, c, t, g, unknown or other
  modified_base (6278)..(6287): a, c, t, g, unknown or other
  modified_base (6448)..(6457): a, c, t, g, unknown or other
  modified_base (6903)..(6912): a, c, t, g, unknown or other
  modified_base (7439)..(7448): a, c, t, g, unknown or other
ctgagcaggagcacagtggggtgggtacaatccgcacccagcgagcgtacctctcgcgacaggaaatttgtccacatcatccaccagtgcaccaattgcctcgctcaccatttggaattccttcgactcctacgcggacccccatcattctcgtggtgttacagcgacnnnnnnnnnncgggggagataaaacctcaacgtcatcggcatgcaatattcaaaacgaggggaggatgttcgaggtgcgcaagataaaagtccaaagcttgcggagaggtatcgaaacttggtctgcctccttgtcttgcttaggataacaagacccttcgtcttacgctctgtaataacaccccaagagcacatctaagtgataccttcacggatcgaaacacgggaggcacatgtcagcccaccgtatgggcagggtttccctctcacaagagcaacccgatcagacaacagacccgtcgcaaggcattcgtcctgcgccgctgtgggactgccccaggacttctcgtttatactgcgctcagcacaacatgggcacgtccagcttcgtatctcagacgtgctttcgaggaaggtcagcagtgcggtgatgtctggaagtaccctgagcaggagcacagtggggtgggtacaacccgcacccagcgagcgtacctctagtgacaggaattttgtccacatcaagcaccagtgcaccaattgcctcgctcaccttttggaattcccacgactcctacgcggcccccatcattctcgtggtgttacagcgacnnnnnnnnnngctccctctcacatgaccaacccgatcagaccacaaacccgtcgcaaggcattcctcctgcgcggctttgggactgccccaggacttctcgctcatactgcgctcagcacaacatgggcacgtcnnnnnnnnnnctcgggcgtcaggcgggcacccaaaccctttcactgctgcccgagatggatgtgcaacatgcgctacgaatgcttcggcctgcacccaggtgacggacgatttgagtcctcggagcactctgtggaggacagggtgcagggatgacggccccaaagaagtcagaagaatgtccctgcagcacatgctctcccatataccgttctctggctgcttggtaagcattacctgcaggtgnnnnnnnnnnttcgggcgtcaggcgggcacccaaagcctttcactgctgccagagatggatgtgcaacatgtgctacgaatgcttcggcctgcacccaggtggcggacgatttgagtcctcggagcactctgtggaggacagagtgcagcgatgactgctccaaagaggtcagaaaaatgtccctgcagcacatgctccaccatgcatcgttctttggctgcttggtaagcattacctgcaggtgtagaccgctcgaggtcatgcctcacagcgtgctaatgcgaagggctgcgatgcgccactgcagtggcaagagcgtgccgccttctggaatcccatgagtggaaccgcaagcctgaatggccatgattttgtgtcagggctgctaggacagtgcgttcttgtgagactcccattacaggcagcttcgacatgagatggcgaatcatccgacattctgcaaggtctcgttgccctccgtaaagtagggccccccacctagcctggtgcctcagcatgagcggggacggcgtttactgaggagggccatcagagagacgcagctccaccgtttcgggtggaagggttttgatagttactaaaggatgaaacccattgaaatgtacacacttgtctcaacctagtcccccgccataagtcatgcaatccttgagaatctgcatataaaagcctccgagtgactctgtaacggcctcatgctaaatgatttgtggaatcgacagagtcaaggccctcgagagtcctggaggcggagtgcccctgcacgccacctcaccggcgcgcccattgcatgcgacaaagcctttcacctatttcagtggtgcacggtattcnnnnnnnnnngatataaaagcctctgagtgactctgtaacggcctcatgctagataatttgtggaacatactcctgctcgacagagttaaggccctcgagagtcctggaggcagggtgcccctgcacgccgcctcacctgcgcgcccattacatgcgacaaagcatttcacctatttcagtggtgcacggtattcnnnnnnnnnnttgttggtcccttcaccgttggtgtacttgcaacatgagatgtgttgccgttggtcttgccagagaagctgannnnnnnnnnctgttggttccttcacccttggtgtacttgcaacatgagatttgttgccgttggtcttgccagagaagctgacatcctcgtgcagcacaaacttaccttaacagtatccatcaccaattcgacaggactctcccatcttctggctattctgcctcacccctgacccccagtacctggatgttgaaaggaacttttcagcctgtgctcgggcagttagctcataattcgaggacaaagaggctgcacaccatctcctccaggatccgcttgccccactcagtccggacatctgcctcgcggtggcaggtggtgctnnnnnnnnnncacaccatctcctccaggatccgcttcccccactcattccagacatctgcctcgcggtggcaggtggtgctgaagtccagctccgcttggagcaacccacaggattactccggaagtgccctgtgaagagtgggtcccaatctcttactcggaaggtagggtgcccgtgcagatggtagacgcggtccaggaagatgtccacgagttcactggcgctaaactccctgataaaaggcgcgttgtgcaccattcacgaccagcgttcgataaannnnnnnnnntatcacttactctgaaggtagggtgcccgtgcagatggtaaacgcagtccaggaaaatgtccacgagttcactggcgctaaacttcctgatagtaggcgcatcgtgcaccattcacgaccagcgttcgataaagaccaccatgggggtgcagccgtttggcgtctgggacaagccaccaatgaggtccagggtcacagcttgtcaaggacaatccgtcgtatgctatggccgcaggagaccagccttacggcctaactggggcttgttgcgctggcagggcatcccaggtgctgacaaagtcacggatatttaaagatccccccgcccccccccnnnnnnnnnnatagggccgcaggagaccagccttacggcccaactggggcttgttgcgctggcaggcaccccaggtgctgacaaagtgacgaacaggtgaagatccccccgccacacccccctccacatccgccaccagggtgctcatcaggatggcatggtagtatctcagtcaacattaatgaggacgaattcccttgggttgattttgaatttttttctgcacatgatcagtagcagtgcaatggcgctgtctggtacgttnnnnnnnnnntaatgaggacgaattccctgggttgattttgagttttgtctgcacatgatcaatagcagtgcaatggcgctgtctggtacgttgggcagggcaaatgagtctggctgaggtctaggattttagccactgcagatccagcgagcgcatagagagaataggccgcagacaaaacaacttacctgtggtaccaacatatttgagtctttattcggatcacatgaacatatgtagcacggacaggttgctcttgaatctatgcaatgctctgcgcgacttcacggttggcctctcatctcatcgggctccttgttgcacggatgaccatgagatgcttcgcaatggggaagggtgtcaattcatttatagtatatatttgttataacattacttggtcgcctccagnnnnnnnnnnactgcgcgacttcacggttggcctctcatcacatctggctccttgttgcacggaagaccatgagatgcttcgcaatggggaaggttgtacattcatttatggtatatttttgttataacattacttggtcgcctccaggagatcgtatgttacggtgtggcatcggcgacactttatacaagtacattagatggaaaggcgggaagaaccacgacgccacaacaactggaaagattgtctgctgtacgaaagtatcaagtcagtatgatgaagacaaggcaccaaacgcttcattacttagcacagtatctttagatcggaattacgcattgagtatgagagtagggagtatgccgctgcccctgttccgcgagccatgacggccggtgagacgcaccatgttttcgctggtggggacgcaggcaccccgcatgatgtgcagatatgtgtaacacaccaagccagatattttgcaaaccttccatctcgtaagaggtcgactccttcatctcatgccgacagcgtcctgcactggaggcaaatggcgtgagtaacatttgaactcacgcgccacgaccatgtattgcaacacacaacgcgaccccttggccaaccactttttgctactgctaacacccctccgtctcacagccgcacaaattggggtcgatgggcattatggcgacattggggcactgcggcctcatctgaccttgtgagtatgtttgtagtgttggtttgtgagcttccgtgctgcatctggtagagggatggcgctgttggcaatagcccatccagtgaacggcgctttggcagctctcctttttgcatgtcatcttggagattgcgagcccggagctcctggtnnnnnnnnnnggtatgttacggtgtgtcatgggcgacactttatacaagtatattagatggaaaggcgggaagaagcacaacgccacaacaactggacagattgtctgctgtacgaaattatcaagtcagtgtaatgaagacaaggcaccaaacacttcattacttagcccagtagctgtagattggaattacgcattgaacatgagagtatggaggatgccgctgcccctgttctgcgagtcatgatggtcggtgagacgcaccatgttttcgctggtggtgacgcaggcaccccgcatgatgtgtgcagatatgtgttacacaccaagccagatgctttgcaaaccttccgtctcgcaagaggtcgacttcttcatctcatgccgacagcgtcatgcgctggaagcaaatggcgtgagtagcatttgaactcacgcgccaccaccctatattgcaacgcacagcgcgatcccttggccaaccaattttttgctactgctaacacccctccgtctcgcagccgcacacatcggggtcgatgggcactatggcgacattggggcactgcagcctcatctgaccatgtgagtatgtttgcagtgttggtttgtgagcttccgtgctgcatctggtagagggatggcgctgttggcattgcccatcgagtgaacggcgctttagcagctctccttttggcatgtcaacttggagattgcgagcccggagctcctggtnnnnnnnnnnnnnnnnnnnnnnnnnnnnnnnnnnnnnnnnnnnnnnnnnnnnnnnnnnnnnnnnnnnnnnnnnnnnnnngtaagagctgcaagcccgaactgcacgttgttggtgccaggaggatgtcaagattgtgcgcagccagacacttctccaaaccccatggtgtctccgatgtatgaccaggatctgcagctcgctcgcggttgttgaagtccttgctggacagtatctcgtatctcatgacgcccagttggaagatgtccctcttcagtgtcaccttctcatctccttccacaagttctgggctcgcatacttacaattgacnnnnnnnnnngggggccggaaggttcactgtcgcgagtgacgacttccaactgggcatcatggtttgcaatatactcaccagtaaggtcgtcaacagcctaagagctgcaagcccgaactgcacgttattggtgccaggaggatgtgaagattgtgcgcagccagacacttctccaacccccatggtgtcaccgatgtatgaccaggatctgcagctcgttcgcggttgttggagtccttgctggacagtatctcgtatatcatgacgcccagttggaagatgtccctctnnnnnnnnnngatcttctcatctccttccggaagttctgggctcgcatacttacaattgacacttcacaaggagaccagccaaagtggcatgcattggataagaggctcgccgaacagggctcaaccccgannnnnnnnnngcagccaaagtagcatgcattgggtgagaggctcgccgaacagggctcaaccccgaccagatgcagcacggaactcacattaacaacacagaaaacatacgcaccttgtcaaagaaggtgcaattctcccatgtcgaatcggtgccatcggtcccgacggnnnnnnnnnnttcacataaagaacacagacaatatacgcaccttgtcaaataaggttgtagttccccaatgtcgaatcggtgccatcggtcccgacgggtgcagctgcgaatcggaatactgtcgagccttgtgtgcacggtgaaggtatgattgtatgtttcgcacttgtcattatagttgcgggggcaggtcgcaaggaccccctgtgaagcgggctgctgccccgaagcctgatcttggtgagatgcatcgagagtccagactctcgcgggtgtcggatccagcggattgatgtgccctggtcggcgcagggcgtaataggtagtaaaaagggagggggaaaagtgtgacgggacgggatgaggcgtctgaatatctccttgttcggcggaggggaggaggcaggccacatacatgtcagcggcagactgtcgagtgccaagagctccgagtnnnnnnnnnntgcaaaaggcagtgcaaagggagggggaacagagtgacgggatgggatgaggcatctgaatatctccttgtttggcggaggggaggaggcagccacatacatgtcggccgcagactgtcgagtgccaagagctccgagtcaagcgacccaccctgtgcactgacctctttggatgctgggagtacccttgctgcaggatcttggacctttcatggcagcatctgcctgctgtgatgtggggaaacagttctccgtacagctgggcatgaggtcccgattttgcagccgagcttcattctctcactctgtacagaatccaccaaggtgacacagcactgatgggctaggtggcgctgagcattgggcagtgctgtacttggctggatggcagctaaagtggcgtgatgagcactcggtcttatggggcctgcctactccacacagtgtggacgggtggggttttaaactcagccatgcagagaagtcctggccgtcgtcagtatagtgtactcatgtcaaggctgagnnnnnnnnnnttaggctggatggcacctcgagtggcgtgatgagcactcggtgttaaggggcctgcctactccacgcagtgtggacgggtgggattttgacctcagccatgcagagaagttctggccgtcatcagtatagtgtactcatgtcaaggctgagtatagagatctacctgcaccaaggagaaaagtcagcaaaagccatggacttgtacacagccgctcggcacaatcacgacccatacagggttcttcccacgtatcgattcccagtgccattcatcggacatccaaactcatggtcttcagatcaaccttcgaagctacatgcataccaaccaaccactccggaagccacccgacccgggggtcgggaaggcgcgcgaacacgtcaaatgggatcgggcaggccgacgtcgtccggaaggcatcattcactgatattcagcgtggacatagggtgctgggaccaccgatctgacaagggaaggcctcacttttggaccttcgagcgcacgtcgcctccagcgtctgcccagttacccagcttcccaccctcgtgccgagacctacccgctcacctgctggatcgcatgggcagtggacagtccatagaacagaggatagaaacctttgccaagaagaatgatcactttgggctccaggtgcgacctccgtcggcccgctcatgagtgtgcagggccaccgcccccccc

SEQ ID NO: 28503 - DNA, 406 bp, Chlorella protothecoides
  modified_base (115)..(297): a, c, t, g, unknown or other
cggcctggagttggggattgcatttgaatggtgcacttagtatgcatggtccggatgtaaaacatgatgagcctcacgcaaggcaagatggtggggagggtgagtccagcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttcggatgctccgctcccgggccccgcccttgcaggcaccgctcccagactgccgctcttgttgctgtgcccccaagcgccgggattgagctccgcttcttgata

SEQ ID NO: 28504 - DNA, 3198 bp, Chlorella protothecoides
  modified_base (129)..(355): a, c, t, g, unknown or other
  modified_base (519)..(528): a, c, t, g, unknown or other
  modified_base (922)..(931): a, c, t, g, unknown or other
  modified_base (1322)..(1331): a, c, t, g, unknown or other
  modified_base (1806)..(1815): a, c, t, g, unknown or other
  modified_base (2327)..(2336): a, c, t, g, unknown or other
  modified_base (2508)..(2517): a, c, t, g, unknown or other
  modified_base (2655)..(2664): a, c, t, g, unknown or other
  modified_base (2886)..(2895): a, c, t, g, unknown or other
ggggaggcaatggtggcgggctcggcgagggaggtgggggggatctcaaaggggatgggagaggaggtgggcttggccgagaacttggcggtgggggatacttttgtggcggctggggggcaggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttctttaccgggggaggtgggctcttccttactgccgggggggagctcttcttcgctggaggttgaggacgtctcgtgactgggggggggagccttttcttcgctggtggaggcggtctcttttttgggagaggtgccgcactcgtcttagtgaggggcgnnnnnnnnnnggaggacgtctcttgactggtggggggagccttttcttcgctggttgaggcggtctcttttttgggggaggtgccgcactcgtcttagtgaggggtggcggggtcttcttggcaggggtgacaccggccttctttgcagagggaggtgaccttttggggcctgagggaggcggaatcttcttcgcattaggcgggggaagctttcgtgatgccaaaaccgactgcagtacgctcacgggtgactcttgtcctcgggggcttcttttgtcctcgtttaccgaagcagcttcagccgcgtgaaccgacacaggtgtggtgtactttaaggaagtagtcagcgaattgcttgtcgtttgaacagtagatacacctctcgacctctcttgcaatgtgnnnnnnnnnngttgttctcggggggtagttgtgtactcgttcaccgaagcagcttcagccgcgtgaatcgacacaagtgtggtgtactttaagggaatagtcagcgagctgcttgtcgtttgaacagtggatacacctctcgacctctcttgcaatgtgctgggaaggtcgccgcaggtgacctgcgcgcgaaaaggggaatgcgggctgcttcagcttggctgagcgaaaataaagagacagcaggtcaattaaacttgcaagattcaaacttctcctgtgtatctaccttgacgaagaagagggtcacgagggcgaggaccagcccctgggcgggtcgcggctgtgcgaacatatatcctcttgcgtaccctcactctagcttattcttctcagacatnnnnnnnnnnatcgcggctgtgcgaccatatatcctcttgcttcccctcactctagcttattcttctcagacatgcttatttctctatttcaacctctttgggagagcagggcaaactaaggtacgtacggggcgagccacgccgttgaacccgccggtgctagctccggagaggcctggccggagaggagccggagtgaagtcctgtcgcaagtttcggtcggccgaccggacgtgcctctgtatggacggtgaagcctcaacttcaagtcgaatggatcaagcccacaaagctccgaatctgagttcccctcctcgactgtgaggactggccatgcataaagtcgtatcaagacttccccactgtgattactccttctggatgtgtactgtattggctggcgcaaattgaccagcctgtgccttgaggagacgcagaagggagggaaaccattgctgtgaaggcagaaaaggctacttaaatnnnnnnnnnnctggctggcgcaaagtgatcagcctgtgccttgaggagacgcagaaggggaggggaacatcgctgtaaaggcagaaaaggctacttaaacccctgccataccctcatgtgggccttggggtgagggggctgtgacaaatcgccaggcattccgcttcacccagaagccagctacaacactcgcttggcggacaaggatatattgcagcatgcaggaggacgccaggagagctgacttttgcgttaagcggtcgacgccgatcccgacgtgaggcaaggctgtgccctgcttttggctcccagcagggctcctctccgtaagccagcctccgaggcacagcgctgatcaaacatagcactgcatccagcttattaaacgtgaaagtgatgctgaacacggctgccacctgctgaactgtggatgtcgcacaagcctgtactattcggtttggtgcactgtcgagacgtcctggtacgtgagaggcgccccacagtgagggaagccattattannnnnnnnnnttgctccaacatagcactgtgtctagcttattaaacgtaaaggtaatgctgaaccacggctgccacctgctgatctgtggatgtcgcacaagcctgtactattcggtttggtggactgtcgagacgtgctcgtacgtgaggggcgccccacagtgagggaagccattattannnnnnnnnntcccaaggggtgggtgagacctgccccacttacggaacctgcctcgagaaccccgccgtcgaaagtgcacactcccgcaaacccccatcgggcaatgcaccatcattccagatacatgcgtgcacatgcacggtgggnnnnnnnnnntgatccccttgcgggagtgaggttggatatggtgtacgcaataacttgaagtcagggctggtgggtgagtcagcatacacatcgcgacccgagtctttgttcggctaacccacgcaaaacatttgcaaggtccttttaggcgtttggatcttgggcattaggtgttttgaaaccttttctttgctctcaggctccacccacgtcgcgatgccgaccagtccnnnnnnnnnncaccacaaaggtagtcaaagtcgagcatacgctgcaccgggagttgcttcctgcagagcggcgatgatccgtcagatccgaggagggggtcggtcatcaacccaggcttcagcgcatcccagatgaaactcaccagttgtagaagatggcctgggtctgcttggtgaagagctggccggcctggccgtagcgccccgctgaggggcgaggactggtcggcatcgcgacgtgggtggagtctgagagcaaataaaaggtttttaaacacctaacgcccaagatccaaacgcctaaaaggacctt

SEQ ID NO: 28505 - DNA, 120 bp, Chlorella protothecoides
ggcaacctggtgcaggggctggatcgcgacacgctgagcgcgctgggatcccaccccgcgctgtcagcggagccccagctggccgcggctgtggcgcgggcgctggaccgggacgcgtct

SEQ ID NO: 28506 - DNA, 61 bp, Chlorella protothecoides
atgccttggctgcagccggtggtgggtttgggatgctgaggggtctttctcgaggggcttc

SEQ ID NO: 28507 - DNA, 61 bp, Chlorella protothecoides
cttgctctcttctggaattcaagcccctcccggggccgccctgcaggaacaccgctgccct

SEQ ID NO: 28508 - DNA, 75 bp, Chlorella protothecoides
tcccgttattcacaatttcagcccgaagtactcggttgacgtcagatccccttgccaatgctctgtgagttttca

SEQ ID NO: 28509 - DNA, 132 bp, Chlorella protothecoides
ggcggcatggagggaggttgatgggaggaagggccactgtcgaatgtaaacgtaggtcaaggcacaatcagttccctacatgcattcttgtctccatatcttacggcgctcacccttgtggcaggccagcgc

SEQ ID NO: 28510 - DNA, 62 bp, Chlorella protothecoides
gacttgctcactcacaccctcgctgaggccgcagccgggctggcggcggcgccagaccccca

SEQ ID NO: 28511 - DNA, 79 bp, Chlorella protothecoides
ccaaaccactcacacagccctgtcatgatggtacatcgaagctggtcaccgctgttctttgtatcacgttctgatgttc

SEQ ID NO: 28512 - DNA, 104 bp, Chlorella protothecoides
atgttgaggatcgcgacatgccacccgtcaagaagtggagtccatccactggaattcaccctcctttctcccgctcatgtatctggcttggaaatgattcaaga

SEQ ID NO: 28513 - DNA, 77 bp, Chlorella protothecoides
ctgtatggaggtggagggtgtgaaagttgctagggaaggggctggcggcgccatgacagcgccccagggggggtgca

SEQ ID NO: 28514 - DNA, 95 bp, Chlorella protothecoides
cctggcacacccttccttttatacccaggtacccccccaaacccttccctgcctcccggcaattcgtctgcggactgtttgacagaaacaacccc

SEQ ID NO: 28515 - DNA, 61 bp, Chlorella protothecoides
agcctcgctggacacaccacaacacccgtgcaccttgggtcatgacggtctggaaggctgg

SEQ ID NO: 28516 - DNA, 14670 bp, Chlorella protothecoides
  modified_base (11782)..(11815): a, c, t, g, unknown or other
  modified_base (12572)..(12664): a, c, t, g, unknown or other
  modified_base (13832)..(13920): a, c, t, g, unknown or other
gcggcctccgcggcggcggccgccgcctcggactcggccgccgcactgccggggacggggaagagcgggaccaggagggggcactcccacacgaagccggtgtccagggaggagccggtgcacaactccccgacaaaacgccagtctgcgggtggatggatgggtcggggggtcgatgaggcggactgggtcagagcggccggcagggacatgcgagggtgcctcgcatgcccggcgggaccccctccctggacgaggaccagcgagctcaggcgcccatggacccgcccaggcagtgccatgtctggaggctgcttggcgaggccatcgcgctgcggcgcagccttccccggcaggggagaccggcgtgggagggccgactcgaccccgccagccccacgccccctccgacacctcaccgccgtggatgttgggggaggagtacacgagcgcggtgccgccctggcccttgatcccggacccgatcagcatgcgatgctcctgcacccggaatccggtgcctgcggcggggtaggcggcgagtatggggctgggaaggcatcggcgcccctgcgtggcgccgctccggtgtatgggcacaacgcggtgtgccggcgggctgggctgggctgcatgtagtgtgccccccgtctgcagtgctgaggaagaatatgaagggggggggggcagcgcgcctggggcttcctgggaccccctcccccctattcacaccttcacagcaagacttctcggcatcacctctttcctcagaaagcacccccgacccttccctcagtaaacacccccacccacccacccaggacgccggcggtgttggcggtgtagatgaaggggtcacgccaccctgtcagctgcacgtggtttggcggcaggtccaggaaggggcgctcatgcttcacccactccaccagcaggtcgtcggcggggtcggccggcaccgccacgatctgggactcaatccacaccaggcccaggtcgtgctcggggggtgggggcgggcctgaggcagcattggagcgcaggcgcacgccggtgtagagcagggcggggaggccggaggccgggtccaggacgcagcagccggaaaagcagccgtcggcgtcgaggccgccgggcgtgggcaccagcgcgggcggcagctggcgccagtggatgagatcctcgctcacgctgtggccccacacctgcaggggttgggtggaaaggggggaagggggaaggtggggcaggtgcatgtgcctgctccatgatggcgttgccgccacatgtctcggcgctctgcaccctccgacgcgggaactcacgatgccaaaatcccactcgcacgcctctggcaggtgctggtagaacctgagtgggttggaaaacttgctattggggtgggtggtcacagaggcgcgcccaaggccctatgggcagtatgcaagcaagcccaaagccactcccatgccaccccggcaccatacatgtggtagcggcctttgtaaaagacctacgcgcgagggttgggagatgggtgagtcggcatggattacagcttctgagcaagtttcttatgcccgattgctcggcccgaggtgctgtggcatcccgcagtcaccgcctcaccgggccattgggatcgttcagccaccccgcgtagggctggaggtggtagctgggccgatacgcgtcaaactgtacggggggttcaaggaacagggatgtgtcctcccaccccatctggcccccaagagtcgggggtcaggcgctaagagtctcggggagcggaagctagcgaggcatgagatacaacacggcaatctggcattcccggcctgcactcgtattgatgcagtgaaggagtgcacagggagcacagccattcacttgtggttcgggggacgcacgggtcgggggcccttcactgcatcctcagccgagattgcgggagggcgaggttggggtggcctcttctcatgtcggtgtgacatcacgtaaaaatctctccctccgcatccatgcacacaacactgtccctctgaatgttaaaattcaacctggaagattatacttgtaccatgtagcctattttgccgcatgagtacaaaggtacaggatcgatgagggatgggtcacgccatccccatgcacttcgcctcacccctgcaggcattcgcatccacgacgacgccatgcctggagccagactcgctaaaaattgtgctaagtatacttttggccgtgtttacaggtgggagtggacgcatgtgggtgggaaataaggtcctggggctggtagggtttcctgcaagggttttccgatgcacccttcccgggcccgagccgtgacgcatgggcgatgagcccactcgaccgccatgatcacgatcacccaccggtgcgcatcgcatacagggatcgcgttcgagaagtggcgcgcccgcacccgcggcagggacgctcacggtccctcacacggctggccagacgtccactcaagccccgaaccggagcccctccgcctccaagcagcctcgccacccgatgttctagccaagcatgcgccaggctcccagtccctcatcgacgctgagtttcccagcctgcgggatgtggtgtacgccgactatggcgggtgcccccccctgtccacggtggcgctgcagctctccacccaggtggcagatgggcaactgcagggtgcgatggtatgcattggcgcttgtctagcctgtcgaagacgtcccttgctgtcgcggggtgccaggcgccgcacgggacttactcggagggtgttggtggcaggctggcccatggggcggtcataactcgtcctctgaccctccctacccttcccgcaaaccctgcaggcgctggccgccaagctgacgggcaacccccacagcgccgggtcctggggtcccgggcagcaggactgggcgggcgccctgcgccgccgcaccctggaggcgtgtggcgtcggccctgggcagtacacgtgcatcctgacctcgggggccacggccgcgctgaagctggtcggggagaccttcccctggcaccggggtggctccctcttctgccacctcaccgacaaccacaacagcgtgctgggtgtgcgtgagttggcgcgggaaagcggggcgcgggtcgtgcccgtgcgcctcgaccgctcggcgggcgggcttggcgtgagcctgcccgcctgcccatcggttacggccggcgcggcgcccgggcccgccagcctctttgccttccccatggagtccaacttccatggggtccggtatgggctggagctggtgaatgcggtgcaggcctgcgcgaccgacggcgagcaccgcgcctggagggtcctgctggacgccgccaagggcgctgggacggggccccccgacctcaccgcccatcccgccgactttgtggccctgtcctactacaagctgtttgggtacccgaccggtgaggggtgcaggacagctagtggagggggtgggtgggggcggtggcccggcaaagaggcggaggagcctcgtcatcggccccctccctcgccatacggcactgcaggcctgggcgcgctgctggtgaggaacgacgtcttgcctttccttcgcaagacctactttgggggaggggccgtaggggccagcgctcacgacgcgcccttccacaggtcggttgggaggggaggggttggccggtgggattgcatccacgcggatctgagctgctcatcgatcacgatcgagactcgacagtcccaggacttgcacgcactgcgttgagtctgactcatccccctgcctcaaggtcactccattgcaaccccctttctcccacttttcccccaaaacccaacaaaacacgaccccacagtctgcgccccggcgccgctgggttcgaggacgggacgctccccttcctcgccttccagccggcgctggccggcttcgacgccatcgaacgcatggggggctggcgcagcacggggttgcacgccggcgccctggcgcgcgccctggcaaccaggctggccgccctgcgccacgcctcgggccgcccggcctgcctcctgcacggctgctggcccggtggctcgctgctggcaccggcgggcgaccaggcacccgaggccccggcacgcgacgccgcccaaaccccgacgaacgccgccaccacgctccccgtgcaaaccagccagggccccaccgtgacgttcagcatgctgcggggcgacgggggccatgtggggtaccgcgaggtggagcgcctggcctcgctgcggggcatccgcctgcgtactggatgcatgtgcaatccaggcgcctgcgcccaggccctgggcctcaccagccgaggtggggcggcagggggttggtttgtgtgggggtccatcccaaggtgcgagcgactgcatcacctgcacgagtcactctcacaggaacgatgtggaggtggtgtgtgtgtttgcttggggggtgatgcgcacgctcgcatgcgtcctccaaccaccgcgcctccgcgaggacctgatggtacccggcgcccacccacctcttgccaagccccacctgccgcctcggcggcgctgcgtgcagagatgcgggccaaccacgcggagggccacgtgtgctgggacgaccgcgacctcatgcacggcaagccgacgggggcggtgcgggcgtcgctgggctacgcctcgcgcgcttcggacgtggaccgcatcggtgtgtggctcgcggcgccgctgggagcaggggctgcccagggctgcgccgtgttaacgaactcgagggcctcgtcccgtcctcgtcatccttgcatggcgcatgcgacgctgcaggatgccagccctgatgcaggcgccatccacggcacggcgacgccccccacgcccctccccctgcacgcagtgcacttcctggaggagtttttcgtggaaaaggctgaggcgccagagtccccgcggcccgcgtccacggcgccccgatcctcggccctcgtcgtgacggcgctgacgctgtaccccgtcaagtcctgccggggcatccctgccaccgagtggccgctgggtgaggcggcctgccgagttgtttttcggctgcggggctttgtctggggggcacatcctgaggatgagctggcgcagcacctccacaccccagtgcacagacactcacgtcccctccacgccgcacaccgccaggaccctccggcctgctgcacgatcgggcctgggtcgtcctggatggcgctggcaagcccctgtcccccaagcggtgccccggcctcctctccatccagccgcgcctcgactggaggcggggggcgctggtcctggagtgggtgggaggggtggctcagatgcccggcctggccaggctctcgccggagatgcccctcgggcctggcgctgcaggcgcggggtcctgtcctgaagccgctgggccccaggcgcgcagcgagaccctcgccgcctggctcagcgccaccctgcgacagcctgcgcggctggaggcgagcgtggccaggcggcgacccgcctccaagccgcagagtcgggtccctgaggaggggccgagggccgcagctggagcgaaggcagccggcgcagagaccgagggcgccaccctcgggggttcgggaggcgcacgcagcatcatcactcttggcccgcattccctgcacagcagcgccactcccaacacatcacctgctgacggcaggcagggcatggccgccctgccgactcgcttcgccaccagcggggacctcctcctggtcacgcgggccagcctggagctcctgagcgagcacgctgtgcacgctgtggacctgatcagacccaccgcccgggctggccgcggaggcgtccctgcatgcccaacacccatgggggaatcattcgcagcccgcttccgcccaaacatcgtggtcgacggaccggcggggggggtgcccttcgcagaggacagctggaccgagatcagggcgggggagttgggtctgcgggtcgcaggcgcctgcccacgctgcgaccgcatctgtgtggaccccggggatggcaggtggggcccggggtgagatggaaggctgccacgctggcaagttgagatagtgaatggaagggttgatggtgggacccctctactttcagtctatgcatggcatcgccctggctcatctgctgccacagaccaggcatcgccctgcatggctgtccaatgttttctgtcttttgtgaaacccaccatgcaggtgggtggggccggaacccctgctcagccttgcaaagctgcgtcgccgcaggggcaaggtctgctttggcatccttttggatgtgcagcagcccttgctgccagtcgatgcccccgccaacacccctgctctgccgctgctgcgtgtcggcatggcgctggagtgcctggtgtaagcacacactgaacgatgtgcacttcccatgctccgagatcctggggggggcaagatgccaactgtgtacttacatctcgagggcaagagcgattggaacagagagtgtcctgtgggaatgtgccacaagttggcccactgatgacttggaaaaggggtgggcgcaaatgctactgtatcgcgctgctcaaagggttcagcccctagggtgggcatggaagatgcctggcccgggatacttgggaataacaagtgagtacaagagagtcaccacacaggggcgatggcaagacccagtccggaaacgggtggggcaagctgtatatggcggggcaaagctccagacaggttttaagaagcaggatcggtggctacctacatcgcggctgtggcaggggcagccggaggcggaacaggcacacgtgcagaggggggttgaacgagccggtgggcccgtacatcgaaacaatggaagcgcgctctaaaggccaagcgggcgcgcaaagggtttggaacagagtctcagcaaacaagggtgtggtacgagggggcctggtttatcataggaagtaggtacctgggaagataaataaagaggtgcagcttaggccgcgttggcacgcagggattggccggcctcggcgccctgccctgctgcaaagctgatggggggcaggatggcgtcgacgcggatgggcagcaccggggtgaggcgcagggtgggggtgcagaggtggagctgaagcgtgctgccctcccgctgcgccgcggcgggcggggccaggcggacgtccggcgcagcgttcccgctccctgccagggtgatggtgggctggcccggcggggtggcgtcgcccgtcatggcggggctcggcgcatggggcgagggtatgactgacccagaccccggcgctgcgccagccatcctgacctccaggcggcggctgtgctggccgggctggctgccagaggtcaccgccacgctgtacatgcccatggcgtgggagggggggccgtgtcgggacgccatgtgcttgtggtggagcgaggagcgcgtgtgggggtgcggagggccaggcacctgccatggcgtgccatgtgggggagcaggtgactgcatgcatgccagcaagcgggttcgaggtggggggtatgggtgaggaccgcaaggggctgacaggtgcaaggagagggggtttgatcattgcccattccctgctcgctcagcaagccacctcatcacagccaagcaccagggggggtgcagacactgccagaacaggcatactgaccaggcctgcaaaggcgtcacatcctgaccaaatgctgcctccagggcgggccccatccggtgcacccaccttgttctgtgcctgcttcacccttgggtatcgcttccgcgtcggtgctttccgggctggcccgcgacccgtgggggcgatgggccctggcgcctgggagaccagggccgggcaggtggacactataccctgggccggacggggggatggactgctggcaggccccagggaagccccgctgtccgtggaaatgtgtgaggagttgaggctccaggtcctgctgtcgtcgtcgaggcctagcaccgaggcggagaggaaggcttccagttcgggggggaagctgaaaccgtcatccgcttccgttttcgagcttatcatcggcacggtttcccactctcgatcggcggggcagaaggcaaaggactcgttttccattgcctgcaccttgcggaaattgggatggggtctcattgcgctactggcaggagtacggacaagcaccctgaatgtaaagcaccgtgtaagcacccatgatccattgtagtggtagctaggactcgattgcccgtccggcaactcacgggctcgctatacttgcgattaaacgtaaggctgtgcacaaacgacgcctgccgcaagcacacgtcactagagaatccttgacaccccaaacactgcgcacttaagaaagaaaaaggccttctttcccaacggtggtggactcggtgagatcttggtgacccctggctggggctggggtcccaagcggcttgattgagtagaatctcggaagttcctgcaacgtagcgaagctaggatgaacctgtagcagcttcgaaggtactgcgcccggggcgtgtactgcctttcctttcgaaccatgccctcatctggaattataaggtaaggagtcatacgccgctagcagaatagaattcgagtttttcggagtgtttcggtgatgtgacgtcgtcgggccgcgcacgccttcacgcgcgacagacgcggttgggtcttgcatctcagagagatctgcatgttccccgggtatcctcccaagtggacatcgtctcgcaagatacccatttatcatgcctgatgatcggcggctggagatcacaaagtggctgttgaattcgatcggccagcagtcatgggcaggcacactccgaaaggtgccttgctggcctcagaaagtctcgagtgtcttaatgtgtgcgcccaatgcttgaaacaccatgggtcagtcttgaaaatctgatctgcttcatacgtcttcccgaagagcacgatgagggcctatgaaatcagcaaaagggggcgattgtccacctctgagcactgcatcatgggcagagtctatgcagtcgagatcatcctctcatgctctctggcgcaccagcctatatttttggacttgcaatactcggattgcatatgtaatcatcgccagaaacatgtcctgtcttcacctgcttcatgattgacttgacagggtaaagcatggattacacgaatcactcgcatcatcatcctccaccatatgcttaggaccagggtggtaatgcgtgtactgtgattctggatggtgctggtgcttgtatgcttgttcgcacccgagcccagagctgcatcacgccccgagcactgccttctggagcagattccccactgcatgctctccgcgcgcgctcccaaccccgacgtggtaggtctcgactcccaccatcatcgcgtcgacgccgggagtggatgggatcgtaagaggatcgacttgaggtatggatgttgaccttttctaaaccagagtaagagcgacgatctgccttcgcacccacgcggagctgcagaccttctgcagccatgatatagagccctaatcggatcctcagcaatgttcaggcgtgcagcctgctgagagtctccgaattaatctataaaagcggcatcggcctccgcgtcagttcgccgggggtcgcagtatggacacggcccacgcgaagacagtgaatgaggcacggcagccgagggaacgtgcctgccactcctgccagggcatcctcagacgtaacatctttcatcgggaaggtttcaacattcacatctgcacagtaagctccctgcccgccctcgacatctcaggtgttggaatactttggggtgggcctggaatatggcctgtcctcgcagcaggtcgccagtgcacagcaaatgtacggccgcaacgagctcgccccggacgcaggtgacaaggatggtgggatcgaggggtgtaggtggatcagggagagtgctccaggaacccaggcatgcatgggtgttgtcatccgctatgccgtgaggttggtgtatccaatcatgccaggcttggccgcatgaccacgcaatctcagccatagccccttctgatctccaggcaaacccctgtggaagttggtcctcaagcagtttgacgatcttcttgtaaaggtgtggtgctcagaactggcttggcttcgtgcgaccactgggcgagctgggactcaagtccgggaggggattaagccctgcgcttgtgtcctggcggatctctggatgctccctgcatcactctgggcaacaaggcaacgttgtcgggcaattcttgtgcgtctgaccaattgtgagcagtagtacattgactgcacgcacaccctgaccctgccctcagatcctcattgtggctgccctggtggatttcttcattgcctttgctggtggtgaaggtctgggggcctttgtggagccagctgtgattgtcctcatcctcgtcgccaatggtagggattgaggagggaggaggggacgggcagtgcattgtttttggtgcatggacgaggacggcttgtttgagcagtgcatggaaatcgcgaggccttgcccagtgcctgtgctgaccatgaaatggcgtctgaggcaggagcgcagctggtgctttgctagtacgcgtcggatttgcacttcgtgaaacatgtgaagttccctcccatcccactcggcacagccacggtgggagtgttgacggagaccaatgctgacagggccatagaggagctcaaggcctacgaggccgacgtggcgaccgtgctgcgggaggggcgctggactgtgaccccggcggtcgagatcgtgccgggggacatcgtcgaggtggcagtggggggcaaggtgccggccgatgtgcgcgtggccgccatcctttcctctggcctccgcatcgaccaggtgagggttcctttcacctctgcatgggcacagctgcacgctgtgttgggggatttgggagtgggactctcccataggaatgaacggccagacaccctctgctgcggcacaaggaggcccactgtgtggcgacgccctcccctttagcgttgacgatggcagctggatggcagcgagcactattgcgctcagacccctgttcctgcatccaagtacatgtggatctgcttccccgctcatgccactgcagtccatcttgacgggggagtcgggaagcgttcccaagtctgtcgagcccgtggctgcagggaaggccgtctaccaggacaagaccaacatcctgttttctgtgcgtgggtgcagggacggcttgggcttcgggctggggctggtggatggttgggtggtgtgtgtgtcagggtgggtgcttgtttcgcggttggatggtgggagggtgtatgcaggtgcggcgcatgggtggacatccaaaggcaccttcttgcgtttgggtttgcactaccttgccccctgcactcatcagaccacggacaagcccgcctgctcctttccccctgcagggcaccgtcgtcaccgcaggcaggtgccagggcattgtcacgggaacgggcgcggccaccgccatcggcaagatccgcgacgccatggcgggactggaggatgcagagacgccgctgcgcaagaagctggacgagctgggctccctgctcagcaaggtttgttaagtttgagtttagaatggggaatggagggcggggggggggggggggggcgggggnnnnnnnnnnnnnnnnnnnnnnnnnnnnnnnnnngcgtgcctggcagcatgtagaagggcggtggtggggcctgccatcaattcggggcgccgagcctctgctcgcagcatataccctccgtaaaggctgcgcgccttcttgaacactccacacccctttggcgtccagggcacttcccctcttacacctcttgccttcccaggtgattgccgtcatctgcatcttggtctgggtcgtcaacctgccgcacttcaaggatcccatccacgggagctggtttgcaggtgagggtttctcgagttgagggattttttggagggtgtttgtggagtgttcccgtggcacgggcatacatgatgcttgcatctcctcaattccggtttgtggaccccggcctcaatcctcgcaagtcctggttctcgtcagccccccctctgcccagcccctcaaatgtttaccactcctgcgatcacttcccaggcgctctctactacttcaagatcgccgtggccctggctgtggcagccatcccagagggcctgcctgctggtgagggcggcgtgcctggccatgatgcatcgtgtgggtgaccaataggcgtgcagcctgtgttgctgcatgccctgcaccgacatttccccttccctcagggccccacctccaccaagccctgaccaagcgacccctgtctccccctgtctcgcagtggtgaccacatgccttgccctgggcacccgccagatggccaagcagcacgcgatcgtgcgcaagctgccctcggtggagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggtcgtgcgcgtgacgacgctgggcgccgacgccggacacctggccgactatgaagtgacggggacgtcctttgcgccggaggggacagtgctgacggaggagggcccgctggcctgccccgccgaccagccagccctgtgccagctggccatgtgtgcaggtgagccaagtgcatgggtccagggttcggttgcaggggcagagtgtgtgtctagttggcgcaggtggggtcgctcggaccaagggaggtgccggggggggatggtgagtcgcatctggagagcggtggccagtgatcctgcgtgccggctgcagccgcccagggcaagggtcctggacgcccgatgactggcctcccagcaaggatgtactcctcacccgaggcctttgtcccacccaatccagccctgtgcaacgactcccacctgagctactcgagcgagcgcgggacgtaccagcgcatcggcgaggccacggaggtggccctgcgagtcctggccgaaaaggtgctccgcctgccttgcctctgggttccatgcactcagcctgggagggggaggtccttggagccttgttgcggccatgtgctcctggcctggcgtggggaataagactcggaaccccaccagatcagcactgcaagctaggtttcctggttgtgagagcaaatacatgcctgcccaggacctgaccccttccacacgcacctgagcccactcccctcccatcgcccccgcctgcgcagatcggcatccccgggtacgccgccatgccccatgccctcgcccggttgggccgggaggaaagggcgacgtactgcaacaaccactgggccgaggtctggcgcaagtcctacaccctcgacttctcccggtgcgggaggggagggaccgggggaatgagggggcctccagctccctcgctgtgtttgtaacccaaacttacatgcatggactggacgtcccccacccctcccccttccctcgcccaccttcccccccgcctgccgctgtcgaccccccccgacacctcccccacctctgtacaataccactccctccctgcatcctcagggaccgccgcatgatgagcacgctgtgctcaggccccgacggcccccagctcttcgccaagggcgcgcccgaggccgtcctggcgcgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgctgctgggcgcgcgcgccggcgccgcgaccgtgcccatgaccgaggccctgcgcgtgcgcttgctgcagcgcgtgacggcctacggctccggctccgcgctgcgcacgctggcgctggcctgccggccctggcgcgaggcgcgtggcgaggtgctggccggggacgaggcggggctgaccttcctgggcctggcggggatgcaagacccgccgcgccccgccgtggcgcgcgccgtggcggcctgcgcggccgccggcatccgtgtggtcatggtcacgggcgacaacaaggccaccgccggctccgtggccgcccagatcgggctgctggggccgggggaggcggagggcggaccctcgaccgggaccagcctggcggggctggagttcgacgagctgagcggggaggaacgcgagcgcgccgccgccagcctggtggtgtttgcgcgcgtggaacccaaccacaagaccgcactggtggacctgctcagggcacaggcgagtgagagtgacggggtgtttggggctggagggggagttgaggaccacactatgcagtggggggaggaggctgggggcagaaataaagggggcccccagcagatgccagggcggtgaggggtctggggcgcggtcaggcgcatgacgcatacaaagaggagggcatgtgacctgcgatgtgttctccctggggtctcaatgccagcctggtacatcataccccccaccccccctccccctccacc

SEQ ID NO: 28517 - DNA, 86 bp, Chlorella protothecoides
gccccatggtctgatgttgcagcggagcataccaggggtctgtgttgacacttacccctggctgctgttcgagatttctgggccat

SEQ ID NO: 28518 - DNA, 61 bp, Chlorella protothecoides
cattgatggtgctgtgagacccatacagctaccggtggtggcgactgctggaagactacgt

SEQ ID NO: 28519 - DNA, 84 bp, Chlorella protothecoides
ctgatgacggacacctcctgggggcatcttcgagaaactccattcaaatcaccttatttgtgcaccaaatctgggtgcaccttg

SEQ ID NO: 28520 - DNA, 122 bp, Chlorella protothecoides
ggccccttggtgtaactggacagaactgaactggacgatgaatgagcggatccgcacaagcggcgcagcacaatccctgctctaagaaaattgtggcgtatgcatgtcgaggcggcattgta

SEQ ID NO: 28521 - DNA, 68 bp, Chlorella protothecoides
tggtgcatgggattgtgcagagcatggtattatgaagccacctatgacatcgtggccttggaagaagg

SEQ ID NO: 28522 - DNA, 62 bp, Chlorella protothecoides
agcacttctggtgtcggtgcggtagctctcaccccaaggtcattgatcacccgctccaccct

SEQ ID NO: 28523 - DNA, 118 bp, Chlorella protothecoides
ttcgactccgcataccaggtgaggggtgagagtttttcaggtgatatcatcgccgtgcacggccagtgtgcgccctcgaaaagcgcaggggctggacggcaccatccttctccacctg

SEQ ID NO: 28524 - DNA, 74 bp, Chlorella protothecoides
tctcgccctgggagggcacagggagaggggaggtggggaggtggtattggcttggtgggaaggaaggtatacat

SEQ ID NO: 28525 - DNA, 67 bp, Chlorella protothecoides
tcgctgcaccttgtccttggcggccttctcttcgtacggcttcttgtccgcctctgacagctccttc

SEQ ID NO: 28526 - DNA, 72 bp, Chlorella protothecoides
ggtcgggaagctcacttgcacccatgccccgggatccggggccctgttcccttcgcatccctacctcccacc

SEQ ID NO: 28527 - DNA, 61 bp, Chlorella protothecoides
cgcagggggagaagtcaggggtaaggtacagggaacgggaaaagtacaagcacagtcccat

SEQ ID NO: 28528 - DNA, 127 bp, Chlorella protothecoides
tgagcctccagccagcatgctcccgcagtggatgcaccccacttcaaagcgcagtctcgtgaatcctccacccaccctgctcacgactgactgttaccacgctcgcctccacatacaaccctcctgc

SEQ ID NO: 28529 - DNA, 65 bp, Chlorella protothecoides
tccgcgtgttacaagggggacggccagaagctccgagtctcttctttggcgacatccatccgcaa

SEQ ID NO: 28530 - DNA, 61 bp, Chlorella protothecoides
ggccaccaccaggcccgcggccttgaacagcagctccacctcgaacacgatggagttgcgc

SEQ ID NO: 28531 - DNA, 10928 bp, Chlorella protothecoides
  modified_base (860)..(956): a, c, t, g, unknown or other
  modified_base (2982)..(2991): a, c, t, g, unknown or other
  modified_base (3520)..(3529): a, c, t, g, unknown or other
  modified_base (3691)..(3700): a, c, t, g, unknown or other
  modified_base (4258)..(4267): a, c, t, g, unknown or other
  modified_base (4482)..(4491): a, c, t, g, unknown or other
  modified_base (5085)..(5094): a, c, t, g, unknown or other
  modified_base (5352)..(5361): a, c, t, g, unknown or other
  modified_base (6730)..(6815): a, c, t, g, unknown or other
  modified_base (7072)..(7151): a, c, t, g, unknown or other
  modified_base (7439)..(7448): a, c, t, g, unknown or other
  modified_base (7745)..(7754): a, c, t, g, unknown or other
  modified_base (8457)..(8466): a, c, t, g, unknown or other
  modified_base (9826)..(9835): a, c, t, g, unknown or other
  modified_base (10257)..(10266): a, c, t, g, unknown or other
catcacctccccctcctcctcccccatcacctccccctcctcctgccacttctcctcccccatcgcctccaccctctcctccgcctcctgtgcccacaccgaccctgacaatcgttaagaacgtggacaacacattcaaattcactgtcacctcatctgaaagcttcgaatctgtcgcagtatatagggattcaagtctagagtacacatggaccacggcgcccacgatgagctatgagaaaactccagctgaaaagcgcacatcaggaatatcctatgattggttcgttatggtcacatatgccggcagcattctgtccccagcttcatccgaagtgagtatgcaaggctgaggatctgtgatatgcatgccagagggtgctagccagtcatttgacacctcatcaggtgtacccccgactggacccctttctttccacccgctcctgctgtgtaccgagttgccgccggcttgcagcaccatgaaatgcaactcacacattgcagccggggccttgactgtaatatttccaattcgggtaatgtgccgcagtccaccgctgtggggacttgccagctcctacatcttgcatgggaggccataatgcagcacttactacagagtgatgcaacgcccatcaagattgttgtttggtgtagtggatctccccttcaagccgggaactgcaaattgatgcgcatggacgacacagaaggcctggagaggacagagtcatagggatggtggtgcggggtactcccgtcaccgcctgttccctctttcccctgccgacgtctccgtgcctcgccaatcccaaggcacctcaacctatatcacccgtctcccagaggagatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctgcctccgcaacggttggtttcggaaaccggtttcgatcgtgccggtcccccccctctcaccatacgcacccgtagtggtaccatggatgaggatgagacctttcggaacttcctcaccaggatgacgcagtcgaaggccaaggcgggctgtgacatcgactgcccttttaccccgggcgtaacatcgccgtttgactggcttgcccgcatcgaccgcaaaatgcggctcaagggcgtggtcgacgaggagacgcggctaaacatatatgtcgccaacctggacggcccggtcctctccttcgccactgccctcgtcgacggcgtcaacggcgcgctacccgcggtgaccacacccgcggagttcaaggagaagttcatggcgcatcacagccgcatacaaggccgccgacccgggcgcatcgagctgtaccagctccagcaggcgggcaccgtggcggagtacgcccaggagcatcgggagacggcgtcctggattggggaccttacaccggaggacttccaggcgtccttcttcctcggcctgaagcccgacatcaagctgaaggacagcgtgcggttcgccgccaactacgaggagatgctggagagggctcagtggcaggagcagaaggccgcgctccgcgccgccgagaagagtgtcgccgcgcggaccctgccctcacggggcagcgggggcgcggacgcaactcgtgcgggccataccatgtcggccgcgtcctcgttccgcccgaggaactcccggccgtcccaatcgacgggacaaaggtcggcgactgcgccggtcacttgctacacctgtggcgctcccgggcacatcacccccaactgcccccagcgcgccgcctcctctacgtcatccgcagtgcggggtgcccgaggcggaggtgcgcgggagagcaaggaccacaccgcctctgtccgttttggtgtcgcactaacgggagccgcaccacttcaacaccaggcattgacgacggttgccaggataggcagggctgagctgacctgcctcatcgacagcggcgctgagcgctgcatcatggacgacaaagaggctgcgcgcctcgggctgaagctttcgcccgtgagaagacacctgctcctagcctgcggcgaccagcgcgtccgaggagatcgagaagcccgcgacgtggcggtagacatccgagggcatacctttacgctggacttcctcatcactcccctgactggcacggatgcttatctgggcatgccgtggctctgtaacgcaaacccggtcatccagtggggagcatgccagtggggatatgctcagcaggacgtccctccacgggtgggcactgagccccgcgtggcggacctggaggtccacgcggcagcacctggaggtccacgcggcagcacctgagccccgcgtggaggctacgccatcggaacggtcggccatcaaactggctacagcgcggcgggctgcccgggcctgcaaggacgacaacctctccctggtgttcgtgcgtgccatcacggtggaccaggcatcacggtggaccagacagaggagactagtggagccgaggttccccgcgttgcgcggtttgtcgaggagtatgccgacctcttcccagcagagcttccgacggagctgccgcccaagcgcggcatcgagcacaccatcgagctgaaggaggggactctacccatcgcacgcgcgccctacaggaccgcgccgccggcggcgcacgccgttcgggcgcaagtggaggagatgacgcggcaggggctgatccggccgtccacgtccccctgggcatcgccggtgctgctggtgggcaagaaggatgggtcgcagcgcatgtgcgtggactaccgagcgctcaacaagacgaccatcaagaatcgctacctgctgccgcgggctgacgacctgatggacagggttggcggcgcccgcgtcatctcgaagctggacctgcgcagcggataccaccaggtccgggtggcggagcaggacatccccnnnnnnnnnncaagccggacctgcgcagcggctaccatcaggtccgggtggcggagcaggacatccccaagaccgcgttcaccacacgccacgggctgtttgaatttgcggtgctgccctttggcctctgcagcgcacccgccaccttcatgcgcggcatcaacgacgccatgcgggactacaccgacaagtatgtcgtcgcttacctggacgacatcctggtctactcccccgacatggagacccatctgacgcacctgcgcgcggtgctggacgcgctgcaagacaaccgcctctacgccaaccccaagaagtgtgtcttcgcgcagcccagcgtcagcttcctggggcacgtcatcagcgccgacggcatccgcatggaggatgataagctgcgcgccgtccgggactggcctgcaccctgcaacgtcagggagctgcgcggcttcctgggcctgaccaattactaccgccgcttcatcagacactacgcgcgtttggcgcatctcctgaccgagctgctcaagaccgacgttccnnnnnnnnnntggcacccgcatggaggaggacaagctgcgcgcagtttgggactgacctgaaccctgcaacatcaaggcgctgcgcggcttcctgagacttaccaactgctaccgccgcttcgtcagacactacgcgcgtttggcgcaccccctgaccgagctgctcaaggnnnnnnnnnncgggctgttcgagtttgcggtactgcccttcgggctatgcaacgcgctggcaaccttcatgcgcggcatcaacgacgccatgtggaagtttacagatgactttgtcgtcgcctacctggacgacatcctagtctactcccgggacatggagacccatctgatccacctgcgcgcggtgctggacacgttgcaagacaaccgcctctacgccaaccccaggaagtgcgtcttcgcccagcccagcgtcagcttcctgggccacgtcatcagcgccgacggcatccggatggaggaggataagctgcaggctgtccgcgagtggcccgctccgtccaacgtgagagagctgcgtggcttcttgggcctaacaaattattaccgccgcttcgtcaaacgatacgcgcacctggcgcaccccctgaccgagctgctcaaggacaacgccccttggaactggggcaagctggagcaggaggcctttgcagggctgcgcgactgcttgctgtccgcgcccattgtcgcctgcccagacttctcaagggacttcaccatcatgtnnnnnnnnnnactgcgcgactgtttgctgtccgtgcccattgtcgcctgttcagacttctcaagggacttcaccatcatgtgcgatgcctccgactacgccatcggcgccatgctctgccaacatgacgacgcaggcaacctgagggtcatcgcctacgagtcctggaagctgcggccggcggagtgcaactatcccgcgcacgagaaggaactgctgggcatgnnnnnnnnnncgcctccgactacgccatcggcgccgtgctctgccaacatgacgacgcgggcaacctgagggtcatcgcctacgagtcccggaagctgcgaccggcggagagcaactaccccgcgcacgagaaggaactgctgggcatgatctacgccctagcaaagtggaagcactatgtgcttggcggcaaggtaaacgtgaagaccgacaaccgcgccctgcaattcctgcagagccaccagcagctgtccagccgccaggcccgctggcttgacttcatcgccgagcttgatctacacatcgaccacatccccggcaccagcaacggcgtagcagatgccctgagccgacatccgctgcgcgtggccggcactcgcctcgtcctcacatcagagcccatgcgcgaccggctgcgccgagccgccgccgaagacgcggccgtcgctgagctcaacgcaaccctggacggagggcccgtcgacggctacagcaagcgggacggtctcgtgtacaagcaccaccccaagggtgaccggctcctcatcccggcagattccacactccgacgacagttgctgcaggaggtgcaccacagcgtggnnnnnnnnnntaccaccccaagggttaccggctcctcatcccggcagatctcacactccaacaatagttgctgcaggaggtgcaccacagcgtgggccacggtggacagcgacgcaccctggcggccatgcaacgcacctacatctggcacggcatggacacagacatcaagctcttcgtctgcacctgcgacgcgtgtcagcggaacaagccgcgccagggcccaggcccggactgctgcagcccctgcctacgccagactaccctnnnnnnnnnngcgcacctacatctggcacggcatggacaaggacatcaagctctccgtccgtacctgcgacgcgtgtcagcgaaacaagccgcgccagggcatcaggcccggactactgcagcccctgcctacgccagtctacccttggcagcacatgaccctggacctcgtcactggcctcccgattatgccccgcggacacaacgccgtcgtcgtcttcgtggaccgctattccaaactggtgcactacgtgcccaccaccaagaccgtcaccgccagccagctcgcagaggtattcatcgaccgcgtctacaagcatcacggcctgcccagcgtcatcatcagcgaccgcgacccgcgcttcaatggcaaattttggagacaactgtttggcgccctgaagacagaactgcgcatgagcacggccaaccatcccgagacggacggtcaaactgagcgcgccaaccgcaccctggaagagatcctccgtggcctggtggacccctgtgagaccgactgggacatacaccttccggcggcggagtttgcggccaactccgccatcagcgccgccacgggggccagccccttccagacgttgtatggcttcacgccgccggcccccgcccagctggtctcccactacccagccgttctgggcgccactacggcaccggctcgcgccgcggaattccaagctacgcagacgcgcatgcgggagaccatggccaagtacaaccagcgcatggctgcacaagccaaccgctcgcgccaggaccacgaattcaaggtgggcgaccgcgtccttctcagcagcgcccacctccgcattgcgacccccaatagtcgcaagctggcggctcccttcgtcggacctttcaccatcctggacatgcgcaacaagggcgctgctcgcctggacctccccgccgacatgcgcgtcaacccggtggtcaacgtgagccacctcaaggcctacaactacaactcacacgggcgtcctccacccctgtacattgatggagacgaggagacgtacgaagtcgagagcattctggcccgcaagcctgctggccaagagcatcagtacctcttcaagtggcgcggctacccagaggacgaagctacctgggaaccgctccgcaacctggcccacctgcccatgttgcatgagttccttgcacagcagcacgaggacgtgcctgcttcttagggtgggggagggtgtttgttgtggggtactcctgccttcctctgttccctctctcctatcccaacgcctacgtgcctcggccgtcccaaggcacctcaacctacatcacccgtctcccagaggagatcggggatagttgtaagaactctatctcagaaagtacgnnnnnnnnnnnnnnnnnnnnnnnnnnnnnnnnnnnnnnnnnnnnnnnnnnnnnnnnnnnnnnnnnnnnnnnnnnnnnnnnnnnnnngctcatgctgaccaagattttttttgcgaatgcacttcgcgtcccacagcttttggtgggccacctgcttcccctcttattcccctctttccccaatggtttgccatttaaagcaaccaagtgtgccagcctgatcttgggaagtagctgtttgcaaccggcgcgagtccggcaggggtgtggtgaggagattcggcgtgtcaaaaatgtctcttaaagaaggcacccccctagccgccagttcgaactgtatcatnnnnnnnnnnnnnnnnnnnnnnnnnnnnnnnnnnnnnnnnnnnnnnnnnnnnnnnnnnnnnnnnnnnnnnnnnnnnnnnncaaatcgatgggttggacggcgtcataaattgtacagagacaaggcacttcctgcttggaatacttttgtgtgtgtagtagtggttgggacgagggggaaagggggggggggcaaagtcttgccacctgcacacagccaaatcgaactgtgaccaaatgagtaatgattgtacagccatgttgatgcctgtgaatgaatcttaccgccccgttccacaccaattcggaggctcgagccagtgaacgccgtacagccattgcccttgggatccaaacattttctttcgnnnnnnnnnnctttaccgcccctttcgacaccaatgtggaggctcgagccagtgaacgccgtacaaacgttgcccttgggatccaaacattttctttcgcgttatgctcgccccgaggggcagggtgcactttgatcgatacaccccccctaaccatcctattacgacgcaaatagggttcaacagtatgtcttgatgatatacagaagatttgacggaccaaaagctagtaatcgcgaagcttcagtttggaacgtttgtaaaacgtaggataacctcgggacgccccgggtcgaattggaatctnnnnnnnnnngtttgatcgatacgcccctcctaaccctcctattgcggcacgaatagggttcagtagtacgtctcgataatatacagaagatttgacgggccaaaagctagcattcgcgaagcttcagtttggaacgcttaaaaacgtaggataaccttggcataggaactcgtagacagagtccattcccagggcgcgcggcgagtcctcccccctttcctactcacctatccaagtgcggggaggtcgcagaattaacctgcgctgcttgcagaggtggtcaacaccgcttccttctcctcgggaaccaacagaactcagcttatttggcatgaggtttatcacatccatgcaggccacctgtgtattgaggagctgaggggccaggaaatagagagcagcgggtgggtggtctgcaagcgatccccagcatgcagacagtgcaccctctgcgtgcacctgcgccatttgtgtgtgatgcggggtacatcggaaagacccggaggcccaacctctgtgcgcgagccgagcaaacgggtgagagagggagctcggtgtcggggttttggggggggtcttggccattcccgatctgacgggtctgcagcatcctcggacaggcaggagtcatctccaactgcagtagttcaagattcagatgtatggtactgcggcgggctggcagcaggatcatcattccctcccgcccacnnnnnnnnnnggcatccttggacaggcaggagtcatctccaactgcagcagttcaaggttcagatgtataatactgctgcgggctcgcagcaggatcatcattccctcccgcccaccatcctatgcacacccggctcttctgcaggagggggaccacgccagcgtcgctccgggccctccactcgcgtgcggctgaggggcaacggcaccgatcacctgggatcctccctcaccctccccgggacgggggcgagtttcccgggcccaccaggcactgagggccccccgctgcgtgtgctccccatcggcggcctgggggagattggcatgaactgcatgctcattggcgtgggggaccgctacgtcctcctggatgctggcctcatgtttcccgagtgagcggcttggctcgtcgtgtggagtcgtggtgtttgtaccgggctgtgcgggacttgcccctgtagtcgagggttcactccatcccaaaggcatcgtgatgggagctgccgcccactcgaggccctcagccctgaaccgacgccatcaggtccattagttcatccctcccctccatggaaacgtcttaacactgcccccccccccttacccccagcgtgaccgacctgggcatggccaagcttctccccgacacctccttcctggccaagtggaaggacaagattgaagcggtgttcatcactcatgggcacgaggaccacattggcgccctgccctgggtcatccccgccctggaccccaacacccccatctttgcccccggcttccccatgcgcctcgtggaaagaaggctcaaggtggggctgacttgagtgggggaaggggcttgtttgtgggcgctgtgcacagaagggcagcccgccggctgtgtttcaggtgccatgctgcagatcacgcgatggttgtccctgcagaaaggtccatccacctccccaaacaacctttcgcaggagtacaagctgtggaacccggcgcgcgcacacaccgtggccatccgccgccctttccagtgcggccccttccaggccgaggccttccgcgtcacgcactccatccccgactgttgcggcgtggtgctgcggtgcgaggctggcaccatcgtgcacagcggggactggaagatcgacgagacgcccatcgacggcgagtgctttgaccgcgacttcttcgagcagctgggtgaggagacaggctgagcgtgctgacgagaggaggcgtgtgggtgggggcgagccacgctgcgtgcgggccggaagccttcctcccatcaccctcccggacgtgccccggccgacagcgttacgcctcccctccccaaccaacatccccccagggaaggagggcgtgacgcnnnnnnnnnntgctgcgtgcaggccggaaaccttcctcccattaccctcccggacgtgccccggccgacagcgctacgcctcccctccccaaccgacatccccccagggaaggagggcgtgacgctgttcatgtctgactccaccaacgtgctgtcggcggggagaacccagagcgaggcggtggtggagaaggcgctgatggagcgcatgctggaccatgagaacaagggccgcatcatcaccacccagtttgcctccaacctgcacaggtgtgggcgggcggttgggcacgggcttgggccctcatgccacctgctggcagtcttcgagtgtccttgcacacgagcaaccccccccttcttcccctcctcgcacccatcgccctccctccccgatcgtcccaggctgacgagcgtgaagagggctgcggnnnnnnnnnncccttgcacacgagcacccccccttccttcccctcctcgcacccatcgccccccctccccgatcgttccaggctgacgagcgtgaagagggctgcggacgccgcggggcgccgcatctgcttcgtggggcaggccctgcacacgtacctggaggctgcacatcaggaggggcgcgcccccctggaccccggcctgctggtctcccacacgcaggcggaggagtgggacccctccaagctggtcatcgtgaccacggggagccagggcgagccccgcgcagcgctgtccaaggcggcggcgaaggccagccccctgctgcagctgcgtcccgaggaccttttgctctactcagccaaggtcatcccgggcaatgatcagaaggtgggagcgtgttgcgtgtcttggcgtggggggcttggggttgggtgaagaacgtgggagggtcctgacgggtgcgccatctcggcgatgggccgaggtgtaggccagactgggcgcccagctgcgatcctcatccctcccctgggcacggcttcccctcagcacaccgcaagcagctgtgccgtgccactgcgcctgcttcctgtgtctcggcaggcgtgactcggccgtctcctggcagcccatggctgccttttgcctccctttcaaccccccccccc

SEQ ID NO: 28532 - DNA, 67 bp, Chlorella protothecoides
caggaagctgacgctgggctgggcgaagacgcactttttggggttggcgtagaggcggttgtcttgc

SEQ ID NO: 28533 - DNA, 61 bp, Chlorella protothecoides
gccagctgcagcgcggccgatgaggcgggggagggcggagagcagagggcggcggctgcca

SEQ ID NO: 28534 - DNA, 80 bp, Chlorella protothecoides
ggtgtgaggggtgttgatgcgtggtacctgtggcacccacatggcccttgtctgtgtgcctccacattctgggccctcca

SEQ ID NO: 28535 - DNA, 11611 bp, Chlorella protothecoides
  modified_base (98)..(107): a, c, t, g, unknown or other
  modified_base (297)..(306): a, c, t, g, unknown or other
  modified_base (636)..(645): a, c, t, g, unknown or other
  modified_base (1050)..(1059): a, c, t, g, unknown or other
  modified_base (1304)..(1313): a, c, t, g, unknown or other
  modified_base (1488)..(1497): a, c, t, g, unknown or other
  modified_base (1836)..(1845): a, c, t, g, unknown or other
  modified_base (2080)..(2089): a, c, t, g, unknown or other
  modified_base (4316)..(4325): a, c, t, g, unknown or other
  modified_base (4751)..(4760): a, c, t, g, unknown or other
  modified_base (5422)..(5431): a, c, t, g, unknown or other
  modified_base (8443)..(8452): a, c, t, g, unknown or other
  modified_base (10158)..(10167): a, c, t, g, unknown or other
  modified_base (10819)..(10828): a, c, t, g, unknown or other
  modified_base (11009)..(11215): a, c, t, g, unknown or other
  modified_base (11336)..(11554): a, c, t, g, unknown or other
cgcttcccctcgccgggcagctgcgccgcggaccccccgcgctcccctggccccggggcgggcgagctggagcgcgtggctgccgaggcccggcgggnnnnnnnnnnccggagcgcgtgggtgccgaggcccggcgggagctggtgttcgggccggagggcggggcgggagcgggggaatccgcaggactcgcacgctccacctccctgcgttcaggttcgtggggtcccagcgcgaggggtcgtgccgtggggggtgttgggggggggcacgggccatcgcagcgcccaggtggannnnnnnnnngctccacctccctgcgttcaggttggtgggcccgagcgcgaggggtcctgtcgtggggggtgtggtgggcacgggccatcgcagcgcccaggtggaaacctgcccacccctgcggtgggagcctgagtcttgcggatggcgctggggggaccccgctgagggcggcgtggctgcccgtgcgcgtcctgcacccagggcgcaagcgagcgcgtctcgcatgcctcgcctgcccctcgcacgagacctgccccggaatcagtcccccctcagctcccacaccccggctcgcagatgcgcagcgcgccgcaggtgccgcgccgttcacgccgnnnnnnnnnncgcctcgcctgcccctcgcacgagatctgccccggaatcagtcagttcccacgccccggctcgcagatgcgcaacgcgccgcaggtgccgcgccgttcacgccgcgtacccccggctccggcgccgtggctgctgtggggcggccaggcgggagcgcggcttccccgggaccgctggcggctgccacgccgcggaccgagggcagcccccaggccccggagccgaggctgcagggcagcggggggagtgccaacatggcacgatccctgcaacgtgtgcgggccgcactggagggcatgcctggctcgccgacgggctcagaggaaagggtggcaaggggcgatcccgctggcccggcctgactcgctcccgtgtctgacacgcacccaaccggacctgcactcnnnnnnnnnngcaacatggcacgatccctgcagcgtgtgcgggccgcattggagggcatgcctggctcgccgacgggcacagaggaaagggtggcaaggggcgatcctgctggcccggcctgactcgcacccgtctctgacacgcacccaaccggacctgcactccttcccctgccatgttgctcgggaagccgtgtccaagctcgtgcaaaaaggtgtcagagcaagcgctgccgtgtccctgtatggaccagnnnnnnnnnncccaagctcgtgcaaaaagctgtaagatcaagcgctgccgtgtccctgtatggaccagctgaggtgtagattcccagggcactcacgagagggtcgaggcgcagcgcgcgcgctacgtccccaccggaacacagtcgctcccagagaccttgctgatcaggcgcatcgccagccnnnnnnnnnntgagagggtcgaggcgcagcgcgcgcgcgctacggtcccaccggaacacagtcgctctcaaagaccttgctgatcaggcgcatcgccagcccacaaatatacccaattgtgaagtgttgcatcaagatcacagggctgaattataggcggagtgagtgccgcatgatccccactaccgactcgtcgtcgttcgcaccctaggtggtgccagcaagtctccggcagcctcagccggaatgagcagcgggtacaccgccatcccaagcctgacgtctccaaatggagcatcgaccgcaccacccctcccaaatggcttcgacgacccctcacatccgggannnnnnnnnnctcccaagcctgacgtctccagatggtgcatcgaccgcaccacccctccccaatggcttcgacgacccctcacatccgggagtgagagagaggtgcgaggtagcgggaggccctggggcccggacacagtctgaagcggagctcagccccatattctcgtacctgcatgctgatattcctcatacaactcatgttcaccaatcaattctagggtggcacggtggtggaaggactnnnnnnnnnncatgactcacgtttaccaatcgattctagggtggcacggtggtggaaggactctgtggggtgggggtccccccctcggccccctccccctcccagcaattacctcacgctgatcccactctcggatgcacgattgcaaccgcgggacactcgactcacagtcgttttcctggtgtgtggaccagagagccaagctttgcatgggtcttgatggatggcagcgctgcgcagatgcttcagccctggcggcggtgtcgcactgcaaaggcatatgcaccacggacccacgtccaccgccccatatttacctctctgacctcactccgtaccccttcaaccactacgcagctgggatttgccctggccatcgccggggctgtcttcatcaccgttccgcgtggcgtctccattggggaggtctgtgtccggcccagccgcatgtcctggaacaccacgaagtcgacctaccagctcaagctgctagccatggtccccgtctacaatcccaactacctcaaggtaggagcgcatggtttgttgtttgttttgtcgaggagagcggggcgtgctacaccttgtgcaacagacctcggggtgggaacatgcgggtttgactgtgagcttgagcccaagatcagtcactctcccaaacttctgcctgggcaggcccacattgagggggagctccgggtgctgttctacaacacggaagctggaaagcagagcatgggctccgtcaaactcccagcacgctcctcccctgcggtgggtgctgctctgagggaggtcatcctttcccaaagggggtgctggcgcctgagcgtttaccccagaccgcgcctgcaggaggatctcttacatagagtgggccatcccagcttcgcccggcgcgctcttaagctacgttcctcccctgccattccctgcagatcatcgacgtcacaatcgacgcctcggatgtgccatcggactacatcctggccatcctctcccagtgctccaccttcccagaggtcctcatattcttcctgcagggcaacctcaccgtgagcgagggcaggttgtgcctagcgggttctttgtagacggacattgacccagtggctcacctgcgtccaagtagcctatcctctcagactcctgctccttggtgtcactctcaaggccttggactcgtgggactacacaagtccagcccccaaaacaggcctccactcacctcctcctctcccaatcctgctcccatgcaggctcgatacctattccagcgccagcatttgacggccatcgacacctacttcctcatcgactgtcgcaacggtggcggcatgcagcccgacgatggtccgcccagcgcgacgcccgcgccattggctctggaccgccttcgaggtctggaccccggctggtgctaaaggaaagtttggcatctctacaccccagagatggggaaggtgatcgaggcactgcctgagcatctaacccttttgcttgatcaggcgtgtaggggatcttgtgctcaagttttgtctgtctcatgtgccatgcaaccgcagctggctgagttgcttgaagttgacaaaccccttccttccctgctcgctcgtcgcatagaagtgttgtgttggcatggtgtgctacactcagcgcttgcagcctgcccctgggtaatgtggctcgttgtaggacgcaaaaccaggagagcaacggggccttgctcgcatcaaggcgggcatgcaatcccccccaccatcatcgggtggtcttgtacgacttcactgccttgaggagcgccttggcctcggcgttgctctcaaagtggtcccgaaccggctgcaaggggtggaggggggggtggagatgggtgaaacatgcaaatggacgggccgttttgagcagaggcctggcgcaaggattcaaagagtccaagccccacgctcatgcgctggacagcagcctataacaggcgcagcctccctccccctcggccccctctgccccccccccggaacccgcctggaggatgtcgttgatgctgctcgccaaggccggcttcaggtcagaggggtgcagggctcctgacgcgtaatcggcagcgagctcctcgaagtttgtgtagatgctgaggatgatgggttggtcagcggagacttggtgagaggggaaggaaagtgtgaatgggctgtggggcaatgctggaagaggcagacttgggatgggctcccccnnnnnnnnnnggcgagctcctcaaagtttgtgtagatgctgaggatgaggggttggtcaacggagacttggtgagaggggaaggaaggtgtgactgggctgcggggcaatgccggaagaggcagacttgggatgggctcccccaagcaggagcacacaggagcatgtggggcagaggcacatgcaccgtcagaccccagggatccagctctccaaacagagacggcatgcagccttgcccaaaccaccccgcaaccacaaacatgtcctctcattgtcttgatccccccccccccgccccttcgtgggcctgccctccaacacgcacacactccccatttcccaatctccatcccccccgacacacactcacatattccccccatttttctcagccctggcgacggcgagctgcttggcccagggcagcacgatgnnnnnnnnnncttgtcttgatcaacccccccgccccttcgtgggcttgccctccaacacacccacacactccccatttcccaatctccatccccactgacacacactcacatatttcccccatttttttcagccctggcgacagcgagctgcttggcccagggcagcacgatgtgctggatgtaggagaggcaggggttgccctccacctcccccggcgggcagtacgccttcttgattttggtccgcacctccacctcgctgtcctccatgaagatggcagagttggggtcgctcttgctcatcttctcctggccctggagcagccccggcatcatggggtgggacaggatgacaggcttcatacgcttgggccgcgcgtcgtcagcgtactcccgcgctagcacgttcaccttgcgctgatccatgcccagctggcagatatcggcctgggaggaaaggacggcggggaagggtggatcccagggtgcaatttccgcgcggcccagcacttcagcgccagaaggggccgggtgggcagtaggaaaaggagaggggttgggtgggcagcagcgacttgtatgcttcgacactcgcaggggcagaggtcatagcaacagccctctctggctaagttgcgtagaattcaccccctctgcagtgactgcacacnnnnnnnnnngcttgtgtgcttcgccacccgcaggggcagaggtcatggcaacagccctctctggcaaagttgcgtggaattcaccccctctgcagtgactgcacactccctccatccaccctacatcgcgtctctgccccgctcgccttgaggaagaaaatgtcggcgcactgcatgcaggggtagaagatctgggcggcgctcagatcatcgccctccgcccgccccatgatctggctgcagcgcacgatgcgcttcaggttgttgcggcgggcgatgtccatcaccagggtccagtactcgtcggggcgcttgttgatctcctctggcgttcttgaggggagagtgaggaggatgggcagggcgaagaggatgggtgtggatgatggaaagtgagaatcatgccacccggtacggggccggcacagtgttgctgtccagcacaacatatacacacacgcgggtcttggcacgtgggaccagcttggcacccagtcctcccttcggcacctgcaggtctgcactccaggcctggcctcctcggcctggtcaccccagacatccaaagagaagaaacaaatcagattcccaatgcactgctgacctgaggcgtgcaggaactcgacgcggtccatgtccatccccaccgccttccagatctccaccatgtagttgcccaccgtctggatcttcttcagatccccgcccatcttgttgttcagctgggcaaaccagtcagccaccctgtgtgagggaggggagtgtggcggagtggtgcatgtcctcaccactgcccgccacagcgcatcccaccccaaccaggcatccatccctccctgatggcttcggcccaaggagcgagggaccagcatgccacaccaccctgccagagcggctctgctcaccagaatctgaaggtcacaccgcacttggtgagcttgttgacattcagggctttaagcaccccctgggcaatgtgcatccggcccgagggctcaaatccatcgtaagcaatcggattgggtttcttttccaacaaacgacgcaaatcctcgtcctggatgcactcctcggccacagaacgacacagcgcaaacttctcctccagtgtcagcctgttgggggttgggcagggcgcagccgggcgagagtcgatctctgtgatgctaaagctgagcccgtcgtgatcaaggcatcctaggaacatgcagataaagaaaatcgactcactctgaagcctccttcaggctcaactggctaatgtctacagcgggagcaggttcagtgggttggtccgccatggtacctcgaacagggcgccacgcctttcagtctcaatagtcaatggtgtaatctcagcacacaatggatgaatgacttgctcggccatgcatgcggcactcctgctcgcgggttaggcttggcactccggcgttttcgcatcgcgcgcccccgccttttggacccccccggtcatactaagcacgataagaacagcgtcgatctcgagaggcaggactagaggaaagagtctacaaatataatatacagttttcgcatctccgtatcagtcatctggggatgtgagatctgccgggcatccggtgttcaaagtcgttgtgcccatggctgggcaggacgaggggctgtccggcttcccagcggtccgcaggtgcgcgcttccggttgatatagtcctcatcacaatcaccttagagggtcgatacctgtttcatccagcgctgtctcagtactccacaccgcggtcgtcttctcaccaccaggctgttcaggcgcggaaactttccgggaaccatcaagcccttccgctcccagggcgagtcgggcgtggacttcacgggtgtgcatgggtcacaaccctcgtctcggagccagccggccgagcccggccagcaggtgcgtgcatggagtgggagggccaggacagcctgtattttcacgtctcccggctggacacaagagggaagcgggcgcagggctgttccacccagcgccatccccctgcccctcactgatatcaggccaggaaggggcctgcttcaagtccaggccccaaccagctggccgagatggtgtcagatgtcggtttggcagccctgacccaaccatctggcgtgcctcgaggagcagatggcgcgcccagcgtcagcggcggggaggagggcgtcgcggcactgcgcagcatgagcaactcccgcctgaccaagttcgacaggatcctaggcgacgcagtggtacgctttcttgtggggcaggggtggtcgctgcaggggcaaggcgggccggtggacaggaagcccgtgcccagcggagcagccctgcaggctccaggggtgtgggcaggtgttcagatccttgagccgccgcccttccatcccaaatcccaagctccttccctcgctctcaggtcgacgtggaggcgctgcgagagctggcctggagcggcattcccccgcggctgcgacccgactgctggcggctcctgctgggctacgcccctcccaaccgtgagaggcgggccgccattctggcacgcaaacgccacgaatacaggcgggtgccgtgtgggggggggttgaggctgggaaggggggccttcgtacccgccacggcctggggaggatggcgccgcatgctcttgcccagcagcccagcggcgaggtgtactgggcccccggagtgcaaagaccccatcgccgtgtccaggaatgggaccccacagactcaacaggccccttcaaccccccatcgtgccttgcagagactttgttccagactactacgacggcgctggcctggcgggtgcctctgaggatgaagcaggggccctcagacaggtctggcagtgggagggtggggcgcttgtgcaggcatggcgtccccccttctcgggcacgagtctgtgacatcgacgtcgagttctcccgctaagctgtctgttaacctccatctactctgaccaggtggcggtggatgttccgcgcacggcgccgggcgtcnnnnnnnnnntgacgtcgagttctcccgctaagctgtccgtcaacctccatccactctgaccaggtggcagtggatgttccgcgcacggcgccgggcgtccctttcttctcccagccggatgtgcaaaccagcctggagcggatcctctacatctggggcctgcggtgggtgctgacgacggaggggtcaggggcatcgtgccgcttgccagccgctcccccagctcaaagacgcgcacacacctttccaaacaaaaccatttgcttcggtgcaggcatccggccagcgggtatgtccagggcatcaatgacctggtgactcccttcctggcggtgttcatgtcggagtacttggagggacccatgaacgactgggctgtgggcaccctgccccccgatcaggcgcgacactgtttgttttggttgaaagggaataggagggagggccgggagcccacacccaagctccatttccttggagtgtcgccggctgatagaggtgtcgctggctggtggagtgtcgcctggcctctggcatcaccttcccaattgtcccaccttcctccctccttcaccacctcgcagctgctggcggtggaggccgactgctattggtgcctgtgcaagctgctggacggcatccaggatcactacacccatgcccagcccggcattcagcgcactgtcttccacctccgagagctggtcaggtgggtagcgcgggagggttgggcacatggatcgtggcgaaggtggagcagggctgccccttggccaatgaatttcccaccagacttttcctagaggcccatcatcctcacgccaacccttctgtaggcgcgtggacgctaagaccgcgacacacctcgacgagcagggcctggagtttctccagtttgcattccgctgggtcaactgcctcctgctgcgggagctccccttccagcttggagtcaggctttgggacacgtacctggctgaggggtgaggagcggggatggtccaagggatgggggtgagggatgcgtaatgaatagtctggagacgcatgcctccggggtcagctggacccttgccagtgcggcagtaccccggcccccagccatcagcccccatccctgcgccaggtccagcttgcgggaattcctggtctacgccctggcctccttcctcctgtcctggagctcacaactgcagcagctggagttccaggacctcatcatgttcctgcaggtgggggaggggtgtggaagggcacccgttcctccccaccaagcctgcagcagcatggtcaacgtcccccatgcaggcaccgggcacccagtgcagccacgcaatgtgcatgcatcacaaagcgcgctcacttccctctctgccctctttccccccgagcagcgcccacccacggcagcttggacggagcaggacatggaggtcgtgctttccagagccttcatgtggcgcagctcattcaagggggccacgagccacttctcgtgaaggtgaacaggcgtaatgttgtcttgtgtcccaacctcccttgccgcgatgtatgctcgcgatggcctgcatacatggggcaagcacccaccggtagggtctttgtcaggcttgctagctctgctcgcgccttgatccctttacgagcatgagagtacaatgctatttcatccaatgggaagtgaacagacagatggcgtgaaggtggatattcannnnnnnnnnacgatggcgtgcatacacggggcaagcacctaccggtagggtctttgtcaggcttgctagctctgctcgcgcctcaacccctttacgagcatgagattacaatgctatttcatccaatgggaagtgtacagacagatggcgtgaaggtggatattcaaagcagtttaggcgcgaggggccggcggcgcacagctcagacacgcccctcttccgtttcagtcttgggacagccacagcagcagcggcaagggcagcagaagacgacgaccagggcatcccagcagctccccagcaggttgcagggcagacagaagacgtcggagcagcagcccatattgcctgatgttcctgcggtgaaggcaaggggattgctccggtgaggtctgtgccggatctccgcaggcatgatgccgcgtcccacagtccgatggccacctttatgagtaacgatgtcaaacacacaagtcctgggccgagatgtaacgagcagtaccctgaatcctaggatctgctaagcaaggcgagtcggccgacactttgatactggtctccatgcatacactgctccccaacctccttcgggaacgcaccttgagctcgagtggcgtgcaggaaatgtagatatgattgttgtgattgtttgcttgaggcnnnnnnnnnnttgtaacgagcagtaccctgcatgaatcctagcatctgctaagcaagcggcgaatcgtccgacacttcgatactagtctccatgcatacactgctccccaacctccttctggaacgcaccttgagctcgagtgccgcgcaggaaatgtaaatatgattgttgtgattgtttgcttgaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtggggggaaaggaaggggaagcagagggtccaccaaaagttgtgggatggagtgcatgcgcaaaaaagcacttgatcagcatcagcatgttgaccgccccgttgacgtcgcggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccggaggcgccgcaagaagcggatccagggtcccggcgggggcccccgcatgatg

SEQ ID NO: 28536 - DNA, 63 bp, Chlorella protothecoides
ccctcatcccgttgcagtattcagacgtgtacccagcctgatcagagagcagcagcgacgccg

SEQ ID NO: 28537 - DNA, 119 bp, Chlorella protothecoides
actgagttggaggttccagcaggttccaggagccctttccatgacccagtggtcctccacggtgggaggctcagcctcgcgcacacacacccagcaccagcgacggtcacgcagacgtg

SEQ ID NO: 28538 - DNA, 106 bp, Chlorella protothecoides
cttgggagtgctgcatcccccattcaggtgtgcctgtcagaggggatggggccaggatgcaagctgagatatgctgtgttgtgcatgtactgaaagtcccccttct

SEQ ID NO: 28539 - DNA, 76 bp, Chlorella protothecoides
actcgctgctctctgccaaagcccgtctggaaagctaaatcatatccgcaagaaatctcgaccatccgttaccatg

SEQ ID NO: 28540 - DNA, 71 bp, Chlorella protothecoides
agtgtgcgatccccgcaaccccatcctggccctgcccacaatagagtgagtgggcgcctcgtgtggtgggt

SEQ ID NO: 28541 - DNA, 61 bp, Chlorella protothecoides
aggaggtcgatggcgaggctctgggcgaggtgcgagcctgtggttcttctggggtcgctgc

SEQ ID NO: 28542 - DNA, 74 bp, Chlorella protothecoides
acagatgaccgaatgtacgctttcagtcttgggacggcatgccgtcgtaacgcttacatgccgggttgttctcc

SEQ ID NO: 28543 - DNA, 141 bp, Chlorella protothecoides
ctccacccaggcctagcctgggaaggcgcaaaactgcgccaagtccttgcatcactacatgatcagcaacctgaagctagaataagtataatagtgaacaaattcgcatattgcgtcgatgtagatgtcatgcaggtggtg

SEQ ID NO: 28544 - DNA, 79 bp, Chlorella protothecoides
cctcatgcggggatattcttgagcagattgatcttcgataaaatatctttttgatacgatagcgatgctcgtcaacccc

SEQ ID NO: 28545 - DNA, 120 bp, Chlorella protothecoides
ggccatgagcgtcctgcgggaacaaagagccaggatgaaatacaggaatgtcaacagggtcaagtagaacatggtgatcggtataacaatttaaattgcacagggggaacagcttgttca

SEQ ID NO: 28546 - DNA, 61 bp, Chlorella protothecoides
gctatgtgaatgcgatgcaatgctgaattcgagattgataagacaataccaatttccaagc

SEQ ID NO: 28547 - DNA, 5406 bp, Chlorella protothecoides
  modified_base (919)..(928): a, c, t, g, unknown or other
  modified_base (1050)..(1059): a, c, t, g, unknown or other
  modified_base (1208)..(1217): a, c, t, g, unknown or other
  modified_base (2211)..(2220): a, c, t, g, unknown or other
  modified_base (4418)..(4427): a, c, t, g, unknown or other
  modified_base (4923)..(4932): a, c, t, g, unknown or other
ccctcgccccccccctcgcgggcgtgggcctgggtcgatccctcggccccacctgccctccccgcccaggacttcccggccctctgcgcgccagccagccccgcgcgggtgcctggtcggccggcgcacccgcagcaatgtccgggcgggcgaccgcatgaccgcaccgaggcgccgctggactgtggccgtgacgccctgcctcagacgagggcgcaccccgccggcccacggatccccgccctgccttcgctgcccaaggtgctactgggtattttcagtggagctcgcggcgcctgcagtaccctgtttggttgcgtcatggactggataaccctctccctcccaaccctggagagccaggcctgcaagtgtgcggcgctgttctgacacatctccccttcaactttctccctcaacccatcccgcaggcagacgcgtcggtgcgggaggcggtgctcaaaagcgccgcctgcacctctctccaaccccaccgccagccgccgagcccggcccgcctgcgccgcatgatgcacgccaccgataaagaaagggaggcccacgagtccagcgaggaggagccggagcgggtgagcaagtccagcatccggaagctggtggccgacatgcatgcgcggggctggcaccccgtcaggcagggccacagcgggcactacaagtacgagcgcctgatcccggaactgggggggctgaggcagatgcacatgctggcggggacgccgtcgagccggcgctacatctgggcggtgcgggccgccatggcgcgcgcagaccgcgaggtggcggagctcagggcccgccagcaggggccgagcctggtggcttgactggagtctggcgggggccgtgcctgtccacccgcaggggctgacagcgcaggcagcaggatccagccccnnnnnnnnnnagggcaggggccgtgcctgtccacccgcagggactgacagcgcaggcagcaggatccagcccctgatcccttcaccttcccaatctctgttggaagaaaggggcccggttacattgacatgnnnnnnnnnncaatcccttcaccttccccatctctgtcggaagaaaggggcccggttacattgacatgaagtgctttgaggcatgaggctggaggcacactttttggatcacactggcctcacagccaccctcacagtggtcttccacatgatggaccnnnnnnnnnnattgaggcatgaggctggaggcacactttttagatcacactggccgcgcagccgccctcacagtggtcttccacatgatggaccgactgaaaattgaaagcgtacgtataggtctgaggcaggggcatgtgtggctggaagggtgagggccatgggggcgtacactgtgccccagatcacaggcccaggtggcatgcggtctggggcgcaggccaggggccctgggaggcatggcaaaaacgaagaagtagacttattgtgcgacgtgcgatgaaggaacatattcatggcacggcctgctcgttggggcttctgaccaaagggctcagtctggagatgcccagccgaccctcatgccagtcctcgttgctgctctgcacgcacgacgggagaaaaggctgcatgagcatggaggcgccaagcgcaagcggagccacacaaagttgtgtggattcgtggacgtttgcgcgtgcctcaccccatccttgcaccttcacccataacccttgcctgtgagtttgcgctctcctctgcattgtcggacaggcgacccttcctcatgaagctcagccctgacgatggcatggatccgtacagcagagccgcagctccatgcggggacggcccatccgaccgagggctgttgcttgcgctggtcattccagaggggcgctccagctgcctgcgcctggggctggccatccccccggacattctcccgaggccaaacgtcccatcacggtcagggagcgagcgcggactggaggccatgtcgaaatcaaagcccctgcgaagtatcagggtcagggtgagaggaagatagcgctttgactacccatctgctggacggggctgtttccctgaggcatgcttcagcctctttccattgacgcagggagcacattacaataattgtgcacagaagagctccatctgaacccctcccacatccctggaacctttctcacttggcggtcttcagttgcatgggctnnnnnnnnnnactgtttccctgagcatgcttcagcctctttccattgacacaaggagcacattgcaatcattgtgcacaaattagctccatctgaaccctcccacatccctggaaccttcctcacttggcggtcttcagttgcatgggctctgcctccctccaggagctctgcagttcagccacgaactgtgcctcttcctcatcaaaggactggacgacctgctccgccagctcatgaagcggtccgaagatgccgttctcggaggtattttcggaccgatccgtgccggcgttctcgagcgtggaagggtccggcaaggtcgggcccgccgcgccgccttgcggaatggagtcttggacgaggagggagtccgatggcgtcgggcccagcgcgctcccgtcgcgcacctccggcatcaggtcggcattcaaggaggtgagcctctccagctcatcaacctccctcttgatgtgctgcgcagtggtggagggttcgatgatcgggagcattccggaagccctcgatgtcaagatcggtcccaccgtccctcatgggaacgttcagacacacgcctgcacaccttgatggtggtctcaagaatagagcggctaatgcgatgaagcatagcgcacttggtctgcgctcttcccacgcattcctctatgacgcgagttatctgagctttcgagctggcatttaagaggggcctgagttcgtcttccagctccgccacccgctgacgaatgccctgtgcacgtctctcgaacgatatatttgacatagctgtgacttaggtttctgtttacctgcgatgagacatttgcgccgtccgtaaacctttctgaacgtgctgcgaccagcgcgtgcgatgcacgccgggagcttcggagcaacttcagacctcctctcaaacttctgtaccattcgacatgaatgacagagactgtttctcaacagcagttatctaagtgtgtttggagagtgccatgtgtatgcgagttccaaggtcctcgggatagggaaatccacgctccgccgaaacctcgggatccttcctcacaggtttctaaaaagggagcatgacctcagatggatcctctagccgaccaacgcaaccctcgagtcctgagcaccagtcaaaggatgataaggatcgagggctggtggagtcggtgcatgagcgggcttccgtcgccgccagcaccgccatctcggtagttagccaggccaccaagactgccaaggatgcagtgcgtgatgcgctggagtacggcagagaaagggtctcggaaatcaaaagcagcgtcaaacaggtgtggaaggtggaaactttcccacttgctctttgatggtgtgaggcaggaagagcatccttgtcaaccatggttcctggcaagtttctgtggatgtcatcggactgcctcctccaccctacccctgcaggaggactctacatcaggctctcagacgtcagacagtgcacccatcattgatgcatcgaggggcgaggcacaagaggaccgggcaccaaaggacagggcagccaggaacgatgcgcccagtgaccagggtcccagtaatgaggccatcagtgagacggtgcaacccgctaccgcagcaagggccaggctttgagaccccaagtaaagcgctgccaggaatgaatggtgatgcggataaagaattcctcttgtgtactatgctcctgcagaatcctccctggggaacatgccatgtggatgctctcgcgtatatgtgaaagcttttgtacagtctgagcttttcaaccaccagttccagtgacagtaccaaaggagccatcacggggcagtgtgtgccatggaaaattgctgaatattggtcctgacagtatgcagagagggtctgtgtggagtggctcgacgcctgccgtgcttgcttgcagggggatccgttcctcaagaggcaccgcacttgatgcgcctgcgcagtggatcacatgaatgcctttgatgcggacgccttgcgtcagccaggcatgttcgcattccccgtgcgtcgctgagccaggttgtcatcccgtccatcactgcagccctgataaccctgggacaaaaccttgagttcctacttgagaactttccagctgctacctcctccccccccattgcccgctcccctcgtccctccccgcaccacctgctgggggtgcccatggtcacccacnnnnnnnnnnccccgtccacccccgcagccctcataaccctgggacaaaaccttgagttcctacttgacaactttccagctgctactacctcctccccccttgccctctcccctcgtccctccccgcatcacctgctgggggtgcccatggtcacccactcctcggcggaggaggggtggatgcccacggtggcgtcaaactgggccttagttgcgccgcacttgagtgcgatgcccaggccctgcatgatctcggcggcatcgggtcccaccatatggcacccgaccacctggcgcaggggaggggtgggggatcggggagcagggggtgagggtgccttcctgtgtgttgcagtgcatgtgcatgtaccagtggcggccagcggcaggcactgtcacacccgccggctgcacgccgctggcgctctgtaccacggtaccccacacacaaccccccaaatcaccccccataaaccatacacaccttgtcgctctccacgtgcacnnnnnnnnnnagtacctcacacacatcccccaaaatcatcccccatatatcatacacaccttgtcgctctccacgtgcaccagcatcttcatgaaggtcttctcctccgcccccgacagcgtgttcttcatgggccggaacttggagacgtacacgtccacctccccgttcagcttctcctgtgcctccttctccgacagccccacggtggccagcggcggttgggcaaacacggccgaggcgatgttggcgtagtcaggcgccacatctcgccccccaaacagcgtctccaccagcgcgcggccctccatcagcgccacgggcgtcagcgccacgcggtccgtcacgtcgccaatggcccagatgctgggcacgctggtgcggctgaactcgtccaccacgatggcctggctcttgggcgccagctccacacccgcatcctgcgcgcagggttttgagcgtgtgagtgtgagattgtgttctt

SEQ ID NO: 28548 - DNA, 63 bp, Chlorella protothecoides
gtgacaaacgctgtctccaggaccggggcgtcgggctcagccgcccgtgcctccgggtccgcc

SEQ ID NO: 28549 - DNA, 76 bp, Chlorella protothecoides
agtcatgcatgggttacaagttgtatgtgggtgagggtgatacacaccataacctctgagcctctgacccaagccc

SEQ ID NO: 28550 - DNA, 79 bp, Chlorella protothecoides
atacgtgcctggtcggcgccagggcgctggtgtgcgggggaggcaacctcccgccgcacctcgccgctcgcgcgcaggt

SEQ ID NO: 28551 - DNA, 78 bp, Chlorella protothecoides
aagctctgatgagtcgagggtgaggatgtttagggagatcgaggtgggactcaaaaccatggagatgcatcatggtgg

SEQ ID NO: 28552 - DNA, 61 bp, Chlorella protothecoides
tgctgccagatgtaggccagccgtcgcgaggccaggctggcccgcagctggcaggtcgcat

SEQ ID NO: 28553 - DNA, 74 bp, Chlorella protothecoides
ggcgcggcggcggcgcgggtcggtgaagcgtccgcggccaggatcggtgaagcgtccgcggccagggcggggga

SEQ ID NO: 28554 - DNA, 129 bp, Chlorella protothecoides
gtctcacccccggacaggcgtgagtcaagaccatgccggcttcagttgtgccctctaaccatgacggatcgcagtcgcattccccctaacacactgccgtcccgcacctcgcagggagtttcaggtcgc

SEQ ID NO: 28555 - DNA, 74 bp, Chlorella protothecoides
ccttcgtcttctctgcttggaaaacagagcctagactttcctcacgcaaggtgtcacttcccttcctcgatgtg

SEQ ID NO: 28556 - DNA, 445 bp, Chlorella protothecoides
  modified_base (105)..(340): a, c, t, g, unknown or other
cgcaagagtgggacaatcaagttcatggaacgtcttgtgaagtcaatgtcgttcatggtgtgctggaacttcacgtccgccagccgtgtactcgcccgccctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatcgattgagatcgggagcggccgtcatcagcatggaagcagggggtgccccagggcagcagggcaaggtggagaggacactccatactggggatgtccctg

SEQ ID NO: 28557 - DNA, 80 bp, Chlorella protothecoides
gtgttttgggaggggagtagcctcttttgcaagaatgtggcttgaaggggccaatagaattgggggccatggcgggttgg

SEQ ID NO: 28558 - DNA, 107 bp, Chlorella protothecoides
gggtccaccaacaggatttggaagtcatacccttaagtatccaggtccttcagcgtgttagaattcgggagagctgatgacagagtgtgttgagggctcggccatgg

SEQ ID NO: 28559 - DNA, 72 bp, Chlorella protothecoides
ttagatccttcagtgtaccaggtgcacccaagtcagttcaaaacgaatgattccaggcagtgccctcactcc

SEQ ID NO: 28560 - DNA, 97 bp, Chlorella protothecoides
gcggtcacgggcgcggtggacgccgccaaggagtccactgtgggcgtggtggatgcagccaaggacaccgcgacgggggccgtggacgcggccaagg

SEQ ID NO: 28561 - DNA, 87 bp, Chlorella protothecoides
gagggtataaggggaacacagtgtcggctcgagttgtaaggctaatcgtgcctttggacgccggctctgattgatacagctgctgtg

SEQ ID NO: 28562 - DNA, 89 bp, Chlorella protothecoides
gaaacacaaaattctaatctcaccctgtcctaaagtatccatagtcatcagcggcccgacttcccctcagaccctcgtccttgaggtcc

SEQ ID NO: 28563 - DNA, 97 bp, Chlorella protothecoides
gcccagaccttcagcacgaagttcaccttgtgggggatgagggggggacgcagcagtggggtgacgggcatgtgtcgtcctctgacatgccaagatg

SEQ ID NO: 28564 - DNA, 78 bp, Chlorella protothecoides
tgtccaggtgcgtgggaagtctcgggcctcaagcttcatgtaacatccaaagagccgcctcttcagcaccgctcatcc

SEQ ID NO: 28565 - DNA, 72 bp, Chlorella protothecoides
ttgcgcgccgatgagagctggatgctgaggatgcaagggccacgcgatgtgctcgccaatcttgacccgccg

SEQ ID NO: 28566 - DNA, 61 bp, Chlorella protothecoides
gcccttgaccagctgggtggggcacagggttagggtcctggtgacattctgctcctccagc

SEQ ID NO: 28567 - DNA, 61 bp, Chlorella protothecoides
gggcactggaggcgctgcctcaaacacacaaacacacacacgcacgcacgcacactccctc

SEQ ID NO: 28568 - DNA, 79 bp, Chlorella protothecoides
agtggatatggcttggtgggatcgtgtgtatcccccccaccccacacacaaaaatgctctgcagcttccccatacttac

SEQ ID NO: 28569 - DNA, 82 bp, Chlorella protothecoides
cctgcgcgtcagggcacttgacgtggggccggagtctggggcgctgggctcggggcgggcggcctgccgcgcagccacgccg

SEQ ID NO: 28570 - DNA, 77 bp, Chlorella protothecoides
catgccagccaaacaaggtgtcaccgctcctttaaaacatctcctctcacaccctgcggagccaccacatcactgag

SEQ ID NO: 28571 - DNA, 121 bp, Chlorella protothecoides
actgtgggcaaggagcaaaacggccaagaatttggatgcacgtcaatgcagtcgagatccatggtgcaatcgaagtaacagcaaggtcctcaatccccaatcctgccctcaacgatacctg

SEQ ID NO: 28572 - DNA, 68 bp, Chlorella protothecoides
ccattctttaccccccctttgcaggcccggcaagcctctgacttgcccgccattgtgaaccccttccg

SEQ ID NO: 28573 - DNA, 92 bp, Chlorella protothecoides
gttggggaacactgcgagcattgaagggggccgaaaggggagaggcatgggcgtgagtgaacatcacagagcacgtcacaacacggaggcag

SEQ ID NO: 28574 - DNA, 72 bp, Chlorella protothecoides
actcactgatcatgatcccgtaaggcgtcttgatgaatgccatgacattgaatggctggggcttctgcaagg

SEQ ID NO: 28575 - DNA, 61 bp, Chlorella protothecoides
gctggcgcccgccctggacgtaggcggccgcccagccgtcatcttcagccatgggcttggc

SEQ ID NO: 28576 - DNA, 137 bp, Chlorella protothecoides
caccgacctacaaggggtgttggcgcggggggggaaggggagggagggcgtgaaggtcaggtggatccttgcaggagccgaaggccaaggtgggtggtagtgtgggtcgtgttgggggagatcatttgatatttggg

SEQ ID NO: 28577 - DNA, 204 bp, Chlorella protothecoides
cgcgctcctcagccaccacgacgatgtcggtcccgccgccggcgtgcgcgggagccgttgcacgggagcgccaggccccgggccgctgatttttaatagaaggagacgttgcggcgggtcccgagcgcctgggcgccggggcgcgcgatcccctgggttcccaccacccccacccgtgggcgagagggcgcagagagagagaga

SEQ ID NO: 28578 - DNA, 61 bp, Chlorella protothecoides
aagctcatggagattgccgccagtggtatccggaactgagaaatccacccctgcagctcag

SEQ ID NO: 28579 - DNA, 61 bp, Chlorella protothecoides
cgtggccaggatgcggcgcgccgtctccgtcgtggcgcgcggcaggcccagggggtcggac

SEQ ID NO: 28580 - DNA, 129 bp, Chlorella protothecoides
gcatggaatcagcctctgccctgcctgcgcatagggaagcaaagggaggggagatgtctcctgccgacaggtgacaccacagagagcgaccaaggtaggctggcgcccacagacacctgcactcgaact

SEQ ID NO: 28581 - DNA, 78 bp, Chlorella protothecoides
caagcggtcgctacaggctgagtttattgcgaaaccacttatcgatatatcatgggcgacttcagccagctcgtgaac

SEQ ID NO: 28582 - DNA, 74 bp, Chlorella protothecoides
caggcccaatgccacgggcgtgccagggcgaggcgtgcagcctatcccagcgggctccgacgacagcgctgtgg

SEQ ID NO: 28583 - DNA, 148 bp, Chlorella protothecoides
ctgctgcttaggccgaggatggagaggttgtgtggctcaagcttgacccctggcatcccttcaatccagcgcatgcatgtggtgcagcttcggctgcgcatgctgccttgattaggtgaccggtcgatgtgatgacattgtgtggatg

SEQ ID NO: 28584 - DNA, 19766 bp, Chlorella protothecoides
  modified_base (413)..(422): a, c, t, g, unknown or other
  modified_base (991)..(1000): a, c, t, g, unknown or other
  modified_base (3814)..(3823): a, c, t, g, unknown or other
  modified_base (4441)..(4450): a, c, t, g, unknown or other
  modified_base (5777)..(5786): a, c, t, g, unknown or other
  modified_base (6998)..(7007): a, c, t, g, unknown or other
  modified_base (7225)..(7234): a, c, t, g, unknown or other
  modified_base (7740)..(7749): a, c, t, g, unknown or other
  modified_base (7918)..(7927): a, c, t, g, unknown or other
  modified_base (8340)..(8349): a, c, t, g, unknown or other
  modified_base (9316)..(9325): a, c, t, g, unknown or other
  modified_base (10867)..(10876): a, c, t, g, unknown or other
  modified_base (12536)..(12545): a, c, t, g, unknown or other
  modified_base (13524)..(13533): a, c, t, g, unknown or other
  modified_base (13958)..(13967): a, c, t, g, unknown or other
  modified_base (14519)..(14528): a, c, t, g, unknown or other
  modified_base (14667)..(14676): a, c, t, g, unknown or other
  modified_base (15156)..(15165): a, c, t, g, unknown or other
  modified_base (16528)..(16537): a, c, t, g, unknown or other
  modified_base (16897)..(16906): a, c, t, g, unknown or other
  modified_base (17803)..(17812): a, c, t, g, unknown or other
  modified_base (18308)..(18317): a, c, t, g, unknown or other
  modified_base (18377)..(18386): a, c, t, g, unknown or other
  modified_base (19487)..(19496): a, c, t, g, unknown or other
aggggcgcacgccgcgcgaggggcccgtgggcagcgcccgcgcgcgccggcgcggctgcagcgtgcgcggcacgtgccccagcccgcgctcgcgcaggaagaggcccggggtcaggccgctgctgccccgtccctcgtcgctcagcaccagccggctgcagcgcgtgaggatgaagagcaggcgcgtggccaggccgcgctcgccggggacgaccgcctcggagcgcagcacctgggtggcgtgtggaggacaaggggggaggaggtgagtaaaatactttatgcttctgtggatctgtgcggtccccggaaagctcttaacaaggatcctaatcccacgagcatggcccctcatgcgtgcgaacggtgggggtgtgcgacacagtcatacccacgcaacccgcactctacannnnnnnnnngaaaggggggagggggtgcgtaaaatactccatgcttctctggatctgtgcggtccccggaaagctcttgacaaggatcctcatcccacgagcatggcccctcatgcgtgcaaagggtgggggtgtgcgccgcagtcatacccacgcaacccgcactctacaccccatgagcatgtctccaagcatggaatgctggcagccgtcaacctcttcacacacatccacaaatccaccccggcagcccactggctgtgtcatcccccaaaatcaaggctcctcaccccgacttcatcgacaatgctctggatggagtccctgaagctgtccacgtcatcgttgcggcaccgctcggcgagcgcgatgatggcctccagccggctggagggctggtcggcgggctgggaggcctgcaggtctcgcgcctcctccaagaaccctagcagctcacgccgcacctggagatgatggaggggtcagaatgtgcgctccaagccacccagcatcctgctttgggaaacaggacgacaaacagccgccgtgcagctgctcctggcagccattgtctccannnnnnnnnntctgcatcctactttgggaaacaggacgacaaacagccgccatgcagctgctcctggcagccattgtctccacgaaccacctcctcccccctcctccatcgcctaaatgctgcgcaacacatacctgagctctggcggcgtggaaggtgcggttcaggcgcttcttcccgacggtgaagggcgagggagcacctggactgctctcctgcagcaggggaacaggcgggcaggtgtgtgagagcctcaatgccgaggggtggggagcatcccaaggcaccatgcacatgggcccccactaccggcattcgaatgcccggccgattcaccccgcgcggaacatgcctgttggatcctgctcccgctggacgtcgggtgctcatcggggcggatgaagagggagggcatgcgatgcggcctcacatcggtcgcgaaccccagccgcttgggtacggccggggcaccgtcctgcaccgcactgctcgcgaagggtgtgtacggtgtggcaccctgcgtaatggatgtgggatccgaggatggtgagttggcagactcccggtcacctgcaaggttgcctggctttctcgcggggtgaactcacatctctctgtgggggggcgtcgcggggcgtcgcactggcgtccccttccaaaggtggagtcgcatgctcgtcgctaagcgattccactccccgttccatggccttgccctgtcctcagcgccccataaatgcgacgggcaaccgcagcgatcgtgccccggtactccgtgtcgagcgccacgttatagatgccgacattctgcctatctacataggcatgctgctgaaggaagcaatgcctattcagtagtcagtggtgcgagtgctattggtttggatacatgcgttcccatggtcgcggaccgcccgattgcccgcgccctgttgcacgacactcgagggggtgaagttgtagatcaaaacccactcctgcgaaaacgtgtttgggacgttccagagcagcgcattggaggcctcagacactggagccttattgtgacctgcctatcatactgatcctcccacttgacggagtctgaggcgcttctcgaaagacttctccagccggggatgagtggttcctcctccaccacaggcgcaacggtacggggtgcgagccagtgcatgaggagacgaatacaagttgtatgtatcaactccgtgcggtcagtcaagggcggatgcaattccgtgaagcgcctgcgccattgtcaccacccctgcccctcgtcttcgtcatatgctgcccagggtgctccccctccatcggaagaggcgctgcaggagcagattctacgtgcaaaatatggcggcatgttgccaaagaagaagcagggcccgcgggaccacaagtactttgattccgcggactgggcgttgagtaagcaggggtcaggccagcctcccccctcccagggcctggagcccaagctgggcccctctgctgtccccggccggcgagtctcccagctgggacaacagtgaaacacatgtgttttatcccctttgtacgtctgtttctacatcacaccccaggatactttttccacagttcccgctttcccttgcacacaatgctctgagagtccctgcacctccatgtagacaggcgagcatttgctttggaggcctttttcccctgagaggcccaaccaagcagtaatgggcgttgtgcaggccctcattgcacacccctcccagccgcgagctcctccaggagcagttcgtcgtcgctgctctcctcctcgtcaaagtcgacgtcctcgtcgccggcaccaccctggcgctccagcggcacgtcccagccctcctcatccgacccagaaggctcctcctcgacctgcaggtgcttggactcctgcatctggaagtacttcttgccggacagacgctgggcggcgccggcgtgcaccccctccgtgatggccgtggacgacagcgcccgctctgccgcaaaggcctcctgccaggccaggaacgtctccggggtgaccggcgtcccgtgggcgcgcagcgcagcccgcctcgcctcctccgcctcctgctccttccggagcagcagcgctggatcggtcgaaggcgcagctgcctggagggcctggggacagccagaatggggagggcggggggagagggggaagaggatgggcaggtggcaaaaatgaggcctcgacgcaccagtcccagtagcagccttggtattgaagtaacgaccatgctaaccctgggcacatgcgcatgtcagccgatcctcgccttcgtaatgcatgaccagaagcccaccggaggcagtgcacatgtcacctctgccctccccaagacccagcaaaccaccttttcgttgacccactcctgcgccacgctgaccagcgtgtagatcatggccatgcccaggttggccttgacctccttgtccagggtggtctgcagcatcgccacatcagcgtcgctcagagcactcaccctgcgttgggagtgtgggaagggggtgggacaagagcaccatgctggatttgagtcctactctcgacaatgctggcccccccaactcaccctcgagctctgaggagggggctggtttcgggatatgtcggcgtgtgagcgaagaccagctccgcttgtactgcagccagggcgtggtgggagctggtcagggtgcactgtgttcggatctccttggcccacagctcacacacacgataggccatccgcgtccctgtatccagcggcccaccagggatatcggcttgaacctcgtcgtcctctagtttgggggnnnnnnnnnnaagctggtcagggtgcactgtattcggatctccttgggccacagctcacaaacacgataggccctcctcgtccctgtatccagcggcccaccagggatctcgtcttgaacctcgtcgtcctctagtttgggggagaggaggatgcggtagaccggcccaggggggtcccagccctgggggaccccgtcgtccaactctttggtgcggaggtgggaaagcgcggtgggatcagcactctccaccctgcacgatcacctgtgtactcagctgatgtcaccctgccgcaggggccctaccttgtaagtcatccatgaggatggcttggagagcctccagctccatctcctgctcgccctggtagtccatgctgagagcgccctaacacgacgatggcaatgccacttctaggtattcggatgcatcgttgtatgcaaatgttgtttgctgcggcctgcagcagccttacctttattaagtctcgccttatatgcatggcgcccgggatttcagtctcggtccaattcccccgtgcatgctggggggggtgattctatctgattccaggaggtagctctgaaactacatttgatacttaaatttgagcctgtgtgtcgtgannnnnnnnnnaggggggcgattctatctgattccaggaggtagctcggaaactacattcgatacttaaatttgagcctgtgtgtcgtgactgagaaatcgagggcctgatccctctcggccgcaggggcctgtgggctcttgggagccatggcagggtacaacgtggccctgcgcatgaagttcgagcagcgatgcccggagtgcggggagagtgactttgtcgaggaccactcatcgggggacctcatctgcagggtgagtggtggtgactggaagttaggatgtccctgttctccccactgcttccatgggattccatgctcacgtccgtcggttacacccctcgcagtcctgtgggatggtagtggaggcacacgttatagatgagcggtccgagtggcgcacgtttgcagaaaaggtagcgggtgttgcgggcaggggaatggcctttctgattcagggtgcctcaggcagccccttgacctgctgcgcgggcatcaatttcctttgttcacattcctgacccacatgctcgcctttggtatgccatatcaccatccccagccacgtccccccccccctccccccgcgccgccaggacaaggagtctgccgaccccacacgtgtgggcggccccatcaaccccttgctcaaggacggcggcctgtccaccatgatcacggggggcaagggcgtggacaagggcctgaccagcagcctgcagcgcatgcaggcccgcaccgactccggcgccggcgaccgcagcctggtggcggccttccgcgagatcgggcgtctctgctccgacatgagcctgcaggatgtggtccgccaccaggccaatgagtactacaaggaagccgccgagaagtcgcggtcggtgcgggggcggagccaggcggcggtgtatgcggccgtcgtcttcatggcctgccgccagcagaacattgcgcgcaccttcaaggagctctgcgcctacgcgccccaggccagcaagaaggtggggcgggtgggtgggcatggtggtggggttggggggaagggggggaagaggaaggagggcgtggggcagaggagggctcacgacgcccaccccaggcacatggctgctgggtctttgcgtcagcagagtgcctgcgcattcatgaccacacgcatcgtgcggcgtgaggctcgcgcaagcgtggtgcacatctccctgggccctgcatcgtccacctcgttccctgtatctcgcacgagccccctgatccttacccttcccagccccctttcttccattctcgtctcgcaatccaggagattggcaaaatgtacaagagcatcgtggcggacnnnnnnnnnnaaagggggggaagaggaaggagggcatggggcaggagggctcacgatgcccaccccaggcacacggctgctgggtctttgcgtcggcagagtgcctgcgcattcatggccacacccgtcgggcggcgtgtagctcgcgcaagcgtggtgcacatcaccctgggccctgcatcgtccacctcgttccctgtatctcgctcgagccccctgatccctaccatacctttcccgccccccttccttccattctcgtctcgccatccaggagatcggcaaaatgtacaagagcatcgtggcggacctgcggctgaaggagacggggggctggctgtcggaggcggggtccaaccaccccgccaactacatgcggcgcaacatgtccaagctggccatggacaacgccgacatgcggcggggggtgggcctggccaacgccgcgctgccgcagtcggggcctgagaccgcggagcacgcgccctggcacggcaagagcccgcccagcatcgtgggggccgtgatccatgtcgtggccctgctgcccaccgcctcgcgccggcccagcctggaggacatcagcaaggcctgcggcgtggcggaggccaccatcaaggccgtgtaccgagacatgtacccgcacctggtgggttgggttttgggaggggggtgggttgggaaagagaaccaatgcgaacgggaaagggggcgtagaggaggggacttgaatggggatggcgcgcgttggcaggactctgatctgaggagcatgggcgcctgagcctcgtgaggctgcagcattccctgctcacccacgcgcgcctcctcatggcactcgcgcaacttccatgccgcctgcgcaggcgaggctgttccagaagatggaccgggccctggtgaacgtggaggacgcggccaagctgcctgcgccggcgtgacggccggggccctggtcagtgactgtgatcctcccctcgccatgctccatccaccgccctgcgctcatgctctcgctggctttgcactgggaacctccgtgcaatccaatttcgttcacaacaaacacagcggcaaacagggtggcacagcacatgggcaaacagatctcaaagcctttgcggcatggacggggctggacatggtgctgaggggtcccgtcagctcaagaccacagcccgaatggcaggattgaagggatgtgcgaggcagggtgggaagnnnnnnnnnnggaggggttccgtcagctcaagagcacagcccgagtggcagggttgaagggatgtgcgaggcagggtgggaagcgccagcatctgcgctgtgcacgcttcgcgacgggcaaggtgagcatgtgcttgtgcagggccaatgcaccaaggctccggagagggttgggatgtagcgtagaagaaagtgtatccgtcaggaaagggtggcgcccagtcacannnnnnnnnnactgtgcacgctttgcgacgggcaaggtgagcatgtgctggtgcagggccaatgcaccaagactccggggagggttgggatgtaggctagaagaaagtgtttccgtcaggaaagggtggcgcccagtcacagagggcacaagcttcagtgttgggtgtttcaacgcatgggaggccctgcggtccaagcgccagtgccagccaggaaaaggggcatgttgtgtttgtgcagaggggggggcgggtgcgggcctgctgcgagtccacgggcccgacccagccagccgagggcgtcgccggctcatcgctcacgctgcgtcgtcaaacgccacgatgatgacggtgatgtcgtcgctgcggggctcgttggcaagccacgtgttgtacgcctgctccaccagcttctccgcagcctccagcgggtcggtgtactgtgccacctggcacaatgatgatagaaatttttgttatgttgggggggggcggtacgatgagtaagggtcgggnnnnnnnnnnttgatgacaggggatttttgttgttttttgggggggcggtacgatgagtaagggtcgggccagggttacaggtgaggggaggcatggtccagcgacgccctctccaccaatgacctctcggctctgaacctactttccatgcgggcctgaggtgaagacctcaacagtnnnnnnnnnnaaggtgaggggagggatggtcgagcgacgccctctccaccaatgaactctcggctctgaccctactttctatgcgggcctgaggtgaagacctcaacagttctagcccaacctagcagacccctttccacccttccacgcctcaccaggtccaccgctgcctgtggggagataaattcccagatgccatccgaggccatgatgaggaagggcgtggtggcgggattgatatcgaccgtggtgatctccgggacgcagatcacgcccagccgcttggcaactgagaagatgcgggcagatttggttgggagggagtcatgacgttgactttgggtgcttggacagggtaagcattatcgcttctcccggtcaaagagacgtcccccctctgatgtcctcgccggtcctgatccnnnnnnnnnnggtcatgacgttgactgtgggtgcatggacagggcaagcattgtcaggtctcagcttctcccggtcgaagagacgtcacccctctgatgtcctcgccggtcctgatcccctctatgttcatacccccgccccccctcctccatgtcctcccaccgcctcaaaccgactcacccctgtcccccagggagcgcgtgaaggcggtgcctggccagtcggcgttgggcgcccagacgcggggcggatcgccatcgccgtcgaactccggcccccagcactgcaggctcttgtccttgatgccctccagctggtccacggtgaggatcaccgcccccgcccgcgtcacgcgctcgtgctcctccggcacgcgcggcgtgtggtccacggtgagctggcgcgcggtgggcgccgcgcccggcgcggcgcgcgtcgccagcaccgcgcgcgagtcgcccacgtgcgccacggtcagcgtggcgccgctgaccacgcccatcagcgcggtggtcccgctcagcgtggtccgcgtcttgtgccggtgcagggacgagtcggcctcgatcagcgcctgcgtcagcgccttgcccacgtcgctgtgcgtcttgtgcagctgcacgggcagccgctgggttacctgggcgggaggaggaggggggaaaggactgttgatggtgcgtcacagagggtcatggggccgctgtgcgggggggcttcaggcccgggggtttgggggggtgggggggtgaggggttgcgaggaagtggcagccaggtgcttgagggagtatctggagggtcaggatcgatccatgagatcatcttcctgtttctccaaccgcgctgcgcacagagcagcaagcctgcacctcatcggcgccaatctcgtccacgcctgcaaatcgacgggcgctctcccgacatcgccgcgcatgggccccctcgcagccgcccaccgctcaccttctccagcnnnnnnnnnncgcgcctcatcggcgccaatctcgtgcacgcccgcaaaccgacgggcgcactcccgagatcgccgtgcataggcccccccgcagccgcccaccgctcaccttctccagcgcaaggcgggagcactccgcgccctgcggcccatggccgtcgaagacgccaaacacccagaccccggggtgccccgtcagatccatgcacgccccggagtcctcgttctcgcggtccggcttgttggggtaggtgcctaccttgctgaccagggcgcaccgcaagggcagggagggggccagcacctcgccggactggcgcgagccccagcggtccagcgaggtcgtgccagagctagcgggggacagccagctggacagggaggacatggccggcgccatccacaccgtctcgctcatgcgcggggtcatgccgccggaggcggcggggctcatccccgcgggggagggcgggggcttgccggcgggggagggcgccgccggggcgggtggcttgggcatgctggggccatcgaagggtgagggcctggcgtaggtggggggagtgctggcgcgggtggggggcgtgctggagtaggtgatggtgccggcctgggcggggatggcctgggcgggggagggctggacgggggagggctgcggcttcacgacctccgccggccccagtgggatttcgggtttggaggatgcacaacccatgcgcccaagcttgggtcacgcaagcgaccggattcgaggcagacgcagggattgaggagcctggagggagcgactagggtacaggctggctgccgagttggtgggagctggcacggtgccggtgtcgggggctgctggaactcgggattatgatgggtccgtcgcgtgtgctgtgcccacgagcgcgtggtgcatacgatagatcaaggtatgtacgtcggtgagcgacgtccaggacttgcatgcgggccgggtgggtctgtcgcgttttgcgcaacgtgctcgggcccccaacgaggcgtgagttggatcgggcgattgtgcagtacctccgcccgcgtggcacagggcgtgagtcatcattttctcatggcctcgccctcaccaatcaagggcgtggggtggaaaaacagtgaagtcaaaagcgctaacctcacagcgtgacgcgagttggccagagcattgcgtggatccaggtggtttgtttcacaatgttgcccggcaggcaggctgccaccgtcctggggcgcctgctgggaggaacccgttccttctccgttgggaaaactgcctaccccatcattgatcacacctacgatgccatcgtggtcggagccggcggggcgggcctgcgggcttccgtgggcctgtcggagctcgggttcaacactgcgtgagtggcgccacggaagtgacctgtgcgcagcttcagatcgcaaccgcatgcattcactccaatgtatttttgagcgtggccaatgcgcgttcgggccaagggtcgtggactcaccgggaccctctcacctccccgccccaggtgtatcaccaagctgnnnnnnnnnnacgttcggaccaagggtcgtggactcaccgggacccactcccctccccgccccaggtgtatcaccaagctgtttcccacccgctcccacacggttgcggctcaggggggcatcaatgccgccctcgggaacatgactggtgggtgccagaattggattggggggtgggtggtgggtcggtgtggtggtggggggagtattccccttgccctgaacgtgtggccctgggtgggtcgtgccgcgtcgggtggcgctgcggctcggtcctgcgcggatgcgcccctcccaatgcccatgccacccccgttcacactgctgcgccctcttcttttgcgcctggagatgagatccccacaccccttcacacgcacactcacatggtcctcctgtcctccccaccgccagaggacgactggcggtggcacgcgtacgacaccatcaagggcagcgactggctgggcgaccaggacgcgatcgagtacatgtgtcgcgaggcgcccaaggccgtcatcgagctggagaactacggcctgcccttctcccgcaccgacgagggcaagatctaccagcgcgcgtttggcgggcagagcctggactttggcaacggcgggcaggcgtaccgctgcgcggcggccgccgaccgcacggggcacgccatgctgcacacgctgtacggcgcggccatgcagcacgacgtccgcttcttcgtggagtactttgcgctggacctgatcatggacgccgacggcgtctgccgcggcctgctggcgctgtgcatggaggacggcacgctgcaccgcttccgcgcgcaccagaccatcctggccacgggcggcgcggggcggtcctacttctcctgcacctccgcgcacacctgcacgggcgacggcggcgccatggccgcgcgtgcgggcctgcccatgcaggacatggagttcgtgcagttccaccccaccggcatctacggcgcggggtgcctcatcaccgagggctcgcgcggcgagggcggcgtgctgcgcaacgcgcagggcgagcgcttcatggagcgctacgcgccgacggccaaggacctggcctcgcgcgacgtcgtctcgcgctccatgaccatggagatccgggaggggcgcggcgtggggcccgaggccgaccacatccacctgcacctggaccacctgccccccgagctgctggcggagcgcctgccgggcatctcggagacggcggccatcttcgcgggcgtggacgtcacgcgcgagcccatccccgtcatccccaccgtgcactacaacatgggcggcgtgcccaccaaccaccacggcgaggtggtgcgccccaccgccgccaaccccgacgccgtggtgccggggctcatggccgcgggggaggccgcctccgcctcggtgcacggcgccaaccgcctgggcgccaactccctgctggacatcgtggtgttcggccgcgcctgcgcgctgcgcgtcggcgagacggtgaagcccggccagacccacgccccgctgccggagggcgccggcgatgaggccatcgctcgcctggataggatcaggtgggtggtcctgggtgggtgtggagggtcaccaccccagggtcacacccactgcggtcgacgtcgtccactcctccctcaacctgtccgcgtgggnnnnnnnnnncgaggccatcgctcgcctggacaggatcaggtgggtggtcctggatgggtgtggagggtcaccaccccagggtcccacccactgcgctcgacgtcctccactcctccctcaacctgtccgcgtggggggggcatgcatgcaccatgatgcatcaccccatcaaccccccccccaaaaaaaaacctggtaaccccagacccatcaagcccaaccccaccctcccacaggaacgccaagggttccctgcccgcgtccagcatccggcggaccatgcagcgcgtgatgcagcgcgacgcggcggtgttccgcacccagtccacgctggaggagggctgcgcggccatcgacgcctgcgtcgactcctttgccgacctgggggtgaaggaccggagcatggtgtggaacaccgacatggtggaggcgctggagctggagaactgcctgatcaacgcggcgatcaccatgcactctgcggaggcgcggaaggagtcgcgcggcgcgcactcgcgcgaggacttcaaggagcgcgacgacaaggactggatgaagcacaccgtggcctggttcgactggggcaaggacaaagtgcgcgtggattacaggcccgtgcacgaccagcccctggacgatgagatgccacacatcccgcccaaggcccgcgtctactgagcgcggggcctggggtttctttggagaacgagcacgcggagagtcaggggtccgggggaacgcgcagcgcccctcgccgagacccctgccacccctaccaacaaatttcttggcaccgagggcgcatggctggcccccgatggggcgcccctcccatgcctctccggcgcacagcagtcgttgaatgcacacctgtcgtggaatctacgccctgtagccagggtcagcagacacatgggtgcaggaaggggtggggtacggtgttttcatcatcacacaataacaaaggatcacacgggaataccagtgnnnnnnnnnnccaggggtggggtacggtgtttccatcatcacactataacaaaggatcacacgggaataccagtggagaatgaccggtcggcccacaggctggacaagcagactgcatgcaccaatcatgtgggagccccagaatctaggcccgggcctcgatgctggcagactccttggccttcaagtacttgggcgtgatctccgtcaggtcgacacctgcacgaggggaaggaaggaaacctggcagctcgcagggggagttgtgtcgaacaatcatcaccaactcgatgtgctgagtttcccactgatcaaccacccagaatctcaccctgctctacgagctgggcaagcggacccgtctccagcttcttgacgctcgcttggaagtcctgtgcggtggtcatcaagggatggggcgtctggctgaggatnnnnnnnnnnccgcccatcttcgtgatcacggacccggcgctgctggtgcccgcgcacctgcgctcgccgctgcggccctccatggcctccgccccggacctggcgcgctccgggtcgctgggtgggctgccgcgctccgcggcgccctcgcccccgcccagccagccccagctggccgccggcatcgccgagttgctggtgagtggtgggggagggagaacggagggaggggtggggtcgagttgcgagcagcgtgcaggggttggacccgcggccgtgtgggagtgtggatggcgttccgcggaccgaatgttttcaaaagctcccaagcagcatctcggccggcctgctcacgcccacccaccccccgcgcccacccaggccccgcacatggcgctgccggacatccccgccccgccccccgcggcgggcggcgccgcgccgtacggcgcgggggagggcgcagaggccctccgtgccggctccgcgcccgccggtctgccgggcctggcaggcctggacaagctggcggccgcgggcgacggccccgcccccggcgcnnnnnnnnnngcctgcacgaggggaagggaggaaacctgacaactcgcagggggagttgtgtcgaacaatcattaccaactcaatgtgctgagttcaccactgaccaaccacccagcctctcaccctgctctacgagctgggcaagcgnnnnnnnnnnctataatcatacatgggcaccacatgctgaaacttgtacacacaaacaacaagtaccttgaggaaggccgtcaatgtgctcttaagcgtgtctgccccgtctttgcgctgctccagagcctgggagatataatttggaatgcatcaggaagtggagatctctcttgaccagacgcaaccccaagacaggacgggcacgcctgatcgcatgcatgggtggatcaacaaatagcctttgatcacagcagggccaaccgcatcaccttcttcagatcgctctcgagatcttcctggagcttcttcacgctcttcgtctcatcctcgccgagtttgtcggagaggaaagggatgagtacatccaggcgagcctgagactgcagccgaactccaatggccacagagtccgtctgcggtgagtggcgtgggaatgtggaaggggggcaatgccctctgatcacagcattggtcatgctgtatcacnnnnnnnnnnataggaatgttgaaggggggcaatgcccactgatcacagcattggtcatgctgtatcacatgagacgcattgcgactggaatcatgacagctatgaacaatccaaatgtcctgtgtagctcaccagccgctccaacagctctgaggacgaatctttctccgccgcctgagatcaaggatgtcgatgtttgcataacgtccctaaagaatggcgcgcagcgcaacgagaattttgcaacctcacaagaaagccttgatgcttgcttgcacaccaatccgattaccttctgagcgtggtgcaacaggatgctgagctcgttattctcagcggtgacgacctcgaccacggtcggtgtcgggagctcctcaggacctgaaaccccgggcagtgatcgtgacatcagtgggcgacggaatcacacctgatcgcgaggacaaacgtgtctcgagttccgaaacccaaataggctgcgtcccgtgttccaccttcgagcttctgctttttggcatccttcgtcttcgtcgatctcgtcccagccatggcggccaaggcaggagatccgagaggatagttttcgagcctctgggtaccttttcggagctcaaatcgcgacttcacgaattctgatcaatgtgctattgtcatctctgaatgaggtgtgagactgggcgtgcgtaccagctactcgatctgcagctgccatctagcaggaccgcaggtgccgtcgttgtgagtggtgacggtaacatggtgcagttctaccgcgatccaggtgcgcatggtggcaaggattgtgattccgaaagctgtaggataaatttactgcatttttaagtacatttcctgtcgatccctccgtacacaactgctctgtccccacgatgccggaatccgccaagactttgaggcccccgagcattgtgggtctcacccttgcgagtcacgccaacgcgaagaccgccctcgctgtgctgaacaatattgtcaaggcagagaaggaccatgatattgagaaggtcgtccactacatcaccttccaagcccagctgcaatcggcggtgcgattttggagggtgtcatgagaggactgcaaagagagaacgaatgtctggtctcgcaggtcgggtctgctactcatgaggaaaccgttcacaatgcttcagtgatcatatctacctgcataggccagcaagtcggtgctcatcccagcgatcaaggaagaagaggatggggagtcgctggcaaagagcctggtagatcaggtgggtgtaaattgaaagacatgggcagcttgatatattcaatggaatcgcagtcagagccctcatgtactgctataaattggttacgatgagtggtacgnnnnnnnnnnctaatatattcaacggaatcgcagtcagagccctcatgtaatgctataaattggttacgatgagtggtacggaattgttaccaaaatgtcttcatgcgagggaagaaatgataagggcctggatcccacaacctcttttcccttgcacagtgggagaaggttgacgcacagattaaggctctagacaagaccaagaagcacctttccaatcccgagttcaccaaggttcttgctgcatttcaagaggtaggccttgaaggaccgcatgggtgtggaatgcatcaagctgctgagatgattcagaaatggcatcttggtgatataaaatcaccctcaccacatcctgttatatctgtttannnnnnnnnnaatgattcagaaatggcatctgggttatatatgattaccctcaccacatcctgttatatctgtttaggcgctggaggctgcctattcggacgagcactctgtgctcaagaagctggccgactccaaagaggaggatgtgttggaggagcaggcaaaaagggctgagtctgccaagcaggacgtaaatctggacactgcagctgcgtgagttcaaggagtgtacttctgccctgatcatttgccggatgtaagctgttccctgaggcatcattcagccctcctcatcggtttgcgctcaaatagatgaaatgacttcgctgctttctacgcaagcaagcgatgtcttgtatccattgactgctaaattattgtattctgttactcttattcatgttggtgatcctcgatacctgtcgcgaggcacttgctcaccactccgccccagacaaagtgatcgtcccctgtcgagtatgccaaattgagatgcagtgaactcgtaccatgctcggacagaagagctggaatcccttcaagaaagaggatcctaagcagctggtgcggacatggcagtccaccatccgcaaggagattcgtggcatcgaccggcaaatactgggtgagggaggggtgtgtcagccgcaggtgtgaacagagtcagtatttctagatggagattgaaggcaagcaatcggcaaccatccgcagacatgcagcgggaacagcggggtgcggtgaagctcatcaaggatgctgccaaacgaggggatgtcacctcagccaaggtgacccacaagagcattgcgcatgcatgccctggagggggatcctcctaggatgggcaccaaacccaggctcgcccagcccttcacagatcattgccaaggaggtggtgaccannnnnnnnnnagagcattgcgcatgcatgtcctggagggggatcctcctaggatgtgcaccaaacccaggctcgcccagccctacacagatcattgccaaggaggtggtgaccatccgacggactgtgggaaagctggccgttaacaaggccaccatgatctcgctttccacccagttgtctgagcaactcggtgaggcatgggtccatgtgcccgtgcatgtgcttcatatggagtccacccagtttacacaaggatgcgtgcaacatgctgggctgaatgttgtgcccttgcttctcggctcagcgggcccccgcccagcgccgactcagcacgctcctcacatccttgcccgtccctcacctcttgaagccatggccagcgtagctggcaccctgagcaagagctccgaggtcatgaagctggtgaacagcctgaccaagatcccccagatgcaggccaccatgcgcgaaatgtccaagggtgagtgaggtgggtattctggnnnnnnnnnnacggcgctgactcagcacgctcctcacacccttgcccgtccctcacctcttgaagccatnnnnnnnnnncgatggtgagatacgcaaggggacccaggggtctgagctacagctggtagagctcctgctttggaaggcctgcacgagcatgcgtccctgatctcaacaggcaggtccacaacgattggtgccccttcccacaccccataccctccctacataaactgaacagagatgtataaggctggtgtgctggaggagctggtggcggacaccatggactccgccatggacgaggaggggctggaggaggaaagcgcggaggcggtggacaaggtcctccaagaagtggcaggggagactctggcgcagatggcctcggcgcccagccgccgcgtggcggcgccggagcgcgccgaggcggcgggggcggaggacgaggacgacctggcctcgcgcctggcggccatgcgctcctgagcgggaggactcgccagtcatctgctggcgacgcatggacgaccaagcatcgcgattttcctgcgcatgggattcgtcattcctgcactcgtcgtgcagggaccctgattgtcccaccccacaggggcaggcaagcgtatgaacagttggcaggccaccgaatccagtcctggggtcaggtagatggacctgcatgccgggcccctccgccccactacctcgtccttgtgtgtgccgaaaaggaatgtaaaacagagagtgtcaggcgtctcatggcgacgagggcgaatggatggcaggttgaaccagggtttttggaagggggcacagtggggcattgcgcgagcgtggcctggggacggggcgatcaaaggaaacgcagggcggggccgacacgatgcctccctgcctcggcacggcagccccagctcaagtcggtcgcgggggcgcggcgcgcggcgtggcgtcctccagccaggccagcacgtcgaactccggctgctccggctgctgggccggcgccggtcccgtgccctcggccgcggcgccgggcggcaggccctgcgcggtgctgccctggcccaggtacatgggcacggagagcggcgccacggagagcaggggtgggtgcccgtcggcgggcatgccaaaggcggccgcggaggtcaccaaccccgccaggtcgccggnnnnnnnnnncgatcaaaggctacatgttaatccacccatgcatgcgatcagtcgtgcccgtcttgtcttggggttgcgtctggtcaagagagatccccacttcttgatgcattccaagtcatatctcccaggctctggagcagcgcaaagacggggcagacacgcttaagagcacattgatggcctttctcaaggtacttgttgttttgtgtgaaagtttcagcatgtggtgcccatgtatgatgatgtatcctcagccagacgccccatcccttgatg

SEQ ID NO: 28585 - DNA, 118 bp, Chlorella protothecoides
taggtgggcgacagcagggacgcacgaaacaaagggcagcccaccaggcagtacacggccccctgggtgagcgcgggtgccatccatcccgatcgattcaccttgcgcagctccttga

SEQ ID NO: 28586 - DNA, 74 bp, Chlorella protothecoides
tcgccctgctcaccggcgtgcggccgtcggggggcgtccccccagcccacgcagtggccgccggcgctgcggtg

SEQ ID NO: 28587 - DNA, 72 bp, Chlorella protothecoides
agaggtgggttgactcaatggaccatgcagcgctactatcaaacatctggtggtgtgatgccaggttgggaa

SEQ ID NO: 28588 - DNA, 77 bp, Chlorella protothecoides
ttggcactgcgccgtggattaggcttgccaaagggccgcgccagctacctcaaacgatacaactccccctgatgtcc

SEQ ID NO: 28589 - DNA, 95 bp, Chlorella protothecoides
catccatggcctgtggcccgagtacaagacggggggctggccccagttctgcggggcgcacgcggcccaccaggccgccgggccgcccacccccg

SEQ ID NO: 28590 - DNA, 109 bp, Chlorella protothecoides
tttgcattgtatgtagacatagggtacaagatgaaggtcggattccccatgggtgccagcggtgagaagggagccaagggacaccacgctcggcacgcatttccgagag

SEQ ID NO: 28591 - DNA, 97 bp, Chlorella protothecoides
cctcgggcaagtatggaacacagcaagacgtcgtcccggaaaccgcttcccaagagacacaagaaaccagagggagatgcactggcgtcctatgctt

SEQ ID NO: 28592 - DNA, 61 bp, Chlorella protothecoides
tctcggatacattgtggtgacgtggcgagacatgtcccatgaacttggcagcatgatgggt

SEQ ID NO: 28593 - DNA, 76 bp, Chlorella protothecoides
tacagtccccgggatggccgagtgtaatgcctgggcgatccaaggcaccatctcgagcaaacgcgcgcgaggacac

SEQ ID NO: 28594 - DNA, 71 bp, Chlorella protothecoides
tcccccaaaatgtggcctagtaaccctaagagtgggcaagcgggagcaaaaagggcccgtaaacgaaaacc

SEQ ID NO: 28595 - DNA, 4057 bp, Chlorella protothecoides
  modified_base (566)..(661): a, c, t, g, unknown or other
  modified_base (1050)..(1059): a, c, t, g, unknown or other
  modified_base (2622)..(2631): a, c, t, g, unknown or other
ggggggggggggggggcagaaggggggcgtcagggcgtcacgctgcgagggggccgggtgggcgcgtcagcgcagggaaaaccggagctggcgtgccttgctcgcgtctgcggcgcttcgtgggccctggccgctgccaggaagcctgggcctcgaccctgcggcctgggcggtacgggagagggccaccggctggagccaggtggcaggtggggggcctggcgtgggggtctgggcggtgtctctgagggcctccggggtctctccgggtcgcggccgcttgcgcccgcctccctccaccagcagcgtggctggggagtctggaaaaggggagcaggggatgagggaggggtgacggtgccaagactgggagtgggagcctggccgggccggcaggcggcaaacagtcgtcggctggcctgccatgagcacacctgggccagaagaggtgctgccttccagctccgactgcatctcggccatggccctcgcctccttgcgaagggacacgtagcgcccgcccatctggctggccctgggtggggttgggatgtggctggggtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctgggtccatgcccccgcccccactccctggcgcgggcatgtaccttgagacgaggggcaggttgaaggtagggcccaggcacctgacggccggggagggaaacatcctatccaccatcgatttggaggatgtggacttgcagggggcgtctggctggcggggcgacatgggggcctgatggggcgtggtgacgtcctcctcagacagaaggtctacaggcatgcgggggtgaagaaggggttgggctgagacgttccagggcaggcagcgcattggtccgaatcgcagcagatcatgcaggagaagcttctcatttgatgtccaggtgctggcaccccagtatgtcacccgataaaccaaagtggggagtcctttcgcaaaccannnnnnnnnncggctggcgaggcgaaaggggggcctgatggggcgtggtgacctcctcctcagacagaagatctacaggcacgtggggttgaaggaggggttgggctgagacatgccagggcaggcagcgcatcggtccgacccgcagcagatcatgcagaaggagctcctcattcgatgtcccggtgctggcgccccagtatgtcacccgatgaaccaaagtggggagtcctttcgcaaaccactccaaacaggcagacttctcataaaaagcaaggctgggtgagacttcatcgattcccgaggcttcccggtgacccccgcaccctgagtctttgtcatgtcggactcgtgggctttgatgggtcccggggcgggaagcgaggactctgctcgcaagatcgccacctccgccaggcaccatcgattgcagtggtggtgagggtatcttgggcacacgtacaccttgctgtcgggagggaaggggcggtaggtcagtgaaacgcgtcccggctgcggcactcactgcacatggcacccgcccgctctctggatgtctgacccgcccgaactcacgcagaatttaggtcctttaaaacggtgggctcggcatggtcgcacaggggtccgagcgtggggagatcctgggatctgcccgccaggataccggccggcatggggtccggcgatggcgtcagcgcgggagctatcgagcccttcccgctggttggtgggttgctcgcagtgagatatagagctgaagtgggtgcagagaagtcagttgtcagcacctgtgcagtatccggtacatgctcgcttacccaacagcgcccgaatccggtgcggctctactgcaaatattcaaatggcaggaaatgaaggaacagaatttgaacgacagattcgcccgcggctgcttcactgacccagaccaatgccacctgtaccttgccagtggagtgcgtaatcgacggcggcatttttgtcatctcacaacagaagtcttgtccctagatggcgatccgagctgcatcatagttgatacgcagatttgtacggcatcctgtgctccacgtgcgcaaaaaagggacccaggcttacgttgagctgctcgtctttggtgtacgcagatgaatacatctttccgtcgtgagagtgaatcaagtttgcgtacacgatggagtacttgtcttgcacatctctgaaaggaaaagatgataggtttgtagtcgggagaggtaatccactatgattcctccaccggagtctttaacccaaccagcacagcagttcccagggaactgccggcgatgggaccggctgcatcagtgcttccatggccgttagccatctacggatcactgatatgcacaatccacccaacaggtggagctagggagtggcgcggcattccctgcatcatagagaaagggaaggtgttaagtctgctgccgaaggatagacgcaccacccgtgcgatgggcagcttatgaagaagtcctgcattctcgataaccccactcgcatgacacaccgcccacccccttggccagaatcataccacggaccaccnnnnnnnnnnagtgatcgacggcggcattttggtcatcgcacaacagaagtcttgtccctagatggcgatccgagctgcatcatagttgatacgcagatttgtacggcaacctgtgctccacgtgcgcaaagaagggacccaggcttaggtttgcagtagggagatgtgggttttgtcgagagtctgtcgccaagcatgaaatcggtctcggtgttatgactcttccgagccgggtctcttgggttcacgctgaccttcactgcctttctgtatgtctgtctgcaaagttgcaaaaactacacatgataggcatgcagagaggccctcattatacgagcgtcgttgtggggaagcagtttctgagtgacatggcaatatatcgtcaggacagatttacgttcagccaagtgatgctgatcagcccgttcaacccagcagaagtggcttctgtcacacattttcgcatctacctattgccacgccattctgcatggtttaggttcagtcagtgcgccccctgctgtttccagtgtcagccataagggttgccatagggtggaatggtacgaagatgtgatgagatagtccgccagtatgtcgcatcctgccgcgcgcaatacatcctgagcaccgaggagggagggagctggaggttttcgccagtgcaagtctgattgtcctgcaaagctcaaggggtgacagggccaagggttttcagtcctcaccaggaggcaggctagctcagcctccggaagcgaagatgtagagcgtcgaagcgtgttcgtgcatacctcgtcttcgacacacaaagtctggagcctcctgcagagctcaaaggcttgcttgctctcaacagaccccgctaaaattggcagcaactctgtcatgcagagctcgacttgcagtcgacgagtaggcttccaacaatcagactcagaagctgctgtccaccttggaggctgtggtggctctctcgcagactgatcttcggacttctggaattgcatctttagctttgacacgggcgtcttgtagatggtagcacgtactctcggtgacatgtcgccagacacgtccctcgtacagagcatgtcaccgacattccgaggacatactactgctatttgaaaacaagtttaagacggatttgtcatagcggataagcacgacaccgcgattgagtgtcgcttcgattatgcaccttgagcttggctgggcaaggagtaacattatgagacagagtgtgccccaagcttgcaactgctttcttgagtaatgggcgagctccaccaatgtttcgatctttgcagtgcgttccaagttgccatatcttattgattatcaggaaaggaaggtaggacaccccatgaggagggacggcacgtgctgccttaatcctctctgattccctccaccggagtcttaacccatactg

SEQ ID NO: 28596 - DNA, 92 bp, Chlorella protothecoides
ccgcagccacaattgcaattggaatacctgctttacacgcgctcgacaacaacacattctgcatcatgtctggacgcggcaagggaaagacc

SEQ ID NO: 28597 - DNA, 78 bp, Chlorella protothecoides
cggtcggcccacaggctggacaagcagactccatgcaccactcacgtaggagccccagaatctaggcccgggcctcga

SEQ ID NO: 28598 - DNA, 76 bp, Chlorella protothecoides
cttcaagcgcgccaggtgctgaaaggggtgatgcatcttggggggaggagcaggatgggagggaaggggtgctcgt

SEQ ID NO: 28599 - DNA, 74 bp, Chlorella protothecoides
acatgcccccttgacttggatgcgaaataatgtgcatgccccaagggcggggctgtgcaaggggaagagggcag

SEQ ID NO: 28600 - DNA, 88 bp, Chlorella protothecoides
agattcctgctcatcaaacacaatctcctccaatgctgtgtccttgcactccggtgaatctttcacacaattagaagatggggtggga

SEQ ID NO: 28601 - DNA, 61 bp, Chlorella protothecoides
ttcgtctgttgtccatggtgcacgctgaattccagggcaggagtggcaagtggtggcgtag

SEQ ID NO: 28602 - DNA, 64 bp, Chlorella protothecoides
gcgacacaagggccaggcggagggggagagcgaggaggaggacagcgaggaggaggagagtggg

SEQ ID NO: 28603 - DNA, 97 bp, Chlorella protothecoides
gaggagggacgctgaggcgcatgtgatataggacgaagcgccaccagctctgcgcaaccgtcccatggtacctggttttggagcacctcccgcctcc

SEQ ID NO: 28604 - DNA, 72 bp, Chlorella protothecoides
gccgcctggagtctccttcatcgcccaacctcaaaagacgcgataaacttatcgagcactcacacacagata

SEQ ID NO: 28605 - DNA, 142 bp, Chlorella protothecoides
ggcgtgcccggggggatggggggttggaggaggggcggaggcgggcgccgcagcatggggcggcccctcggcgttcctggcaccgtgggcaccccaccccagcctcccggtgtgatgatggtgcgcgcgctcctcccttgtc

SEQ ID NO: 28606 - DNA, 103 bp, Chlorella protothecoides
gggttggaggatggcgcggggcttgctttgcgtaaattcagctgtatggtacagtttctggcggactggatgagaaggagcgcatgcatgtggcgccctccat

SEQ ID NO: 28607 - DNA, 79 bp, Chlorella protothecoides
gtccttactcagtgtaatagcagtagtcgcccaattacatataagtgttggggggggacccggtcgatgtgaccttctg

SEQ ID NO: 28608 - DNA, 61 bp, Chlorella protothecoides
catctgacaggcagcatggcttgtggctggggccaccaggaccaaaggatgagcctgctgg

SEQ ID NO: 28609 - DNA, 90 bp, Chlorella protothecoides
gaacaaagtgggaccctacaacaacccccaggaaacatgtgagctggaatttggtgcagtggcgctggagagggaggggagatgggatgc

SEQ ID NO: 28610 - DNA, 62 bp, Chlorella protothecoides
cctcggaacccctgcgcatgcatgcctgtgggcccctgcaggatgtcgtgcgagaggtgctg

SEQ ID NO: 28611 - DNA, 66 bp, Chlorella protothecoides
atccttcgatcattttccctcggcacatgaagatattccaatgtcttgaaggcactacgaccgacc

SEQ ID NO: 28612 - DNA, 75 bp, Chlorella protothecoides
cagacaggaccccagccctgcgccacccctgaaaaccccaggggccacactcaccgcaggcccacatgtccacgc

SEQ ID NO: 28613 - DNA, 79 bp, Chlorella protothecoides
agcgcaaacagaagctgggcagaagccggctgcacagcggggcaccggacggggttccagcccgacacctgtgagccag

SEQ ID NO: 28614 - DNA, 71 bp, Chlorella protothecoides
ccctgtgctccgctcttcatcgctggatgcctgccacataccagccactgtcctgcagatctatcgcttta

SEQ ID NO: 28615 - DNA, 67 bp, Chlorella protothecoides
ccctggcctgttctgcagtggggaaagtgatctcagggaaaggcgcgcgcgcggacgtttcatgggt

SEQ ID NO: 28616 - DNA, 61 bp, Chlorella protothecoides
ttccaatgcggtgaaaaactgtgtggcaggtaatgcctcgtctctcacacccacatacccc

SEQ ID NO: 28617 - DNA, 71 bp, Chlorella protothecoides
cgagaagccggcaaacgcacaggctgccaccactcgcccaaatccccctgggctccccacccgctccgagg

SEQ ID NO: 28618 - DNA, 80 bp, Chlorella protothecoides
tgtgtcagtgccccaggcagtcccattctctgtcgttgacctatttcgagtttcatgttgatgagggtcatcatgattgg

SEQ ID NO: 28619 - DNA, 250 bp, Chlorella protothecoides
agcccagcctcaatggcgtgctgggggtggttcagggatgggagtacatgctgatatctaaatgctgaaaggcacagggtcgtggcctggtgtgcaccttcggtcagcagcctgcacactcagcactgcaagccgtgctatgcataatgaaaggcacacaggaagtcactgcccccaaacgaagcacactgccagccccggcactcctaaagcgccccctacctgcagcccgatgacctccgccagcagg

SEQ ID NO: 28620 - DNA, 103 bp, Chlorella protothecoides
ccagatgccacccttcctttttacgccaccccccgaggccaacagagaacaataatccaccctctcaaagcacggcgacaacaacacaacgtgcctcgaggat

SEQ ID NO: 28621 - DNA, 61 bp, Chlorella protothecoides
ctgcctctgcactgtgcataccaaggatgaaaagcagcacatggcagtgacctggactcct

SEQ ID NO: 28622 - DNA, 61 bp, Chlorella protothecoides
aacctcgacagagcggcccaagaccatcccgatagaaacaagaaaagcaaaaggctagatt

SEQ ID NO: 28623 - DNA, 122 bp, Chlorella protothecoides
gtgcctgcaaggctgggcagggcttggtgcagcagccctgggccagccctcaggtgccctcctccttgcacccccttctttacacagctgcgaagcagcagtgcgccgactggctcacagac

SEQ ID NO: 28624 - DNA, 191 bp, Chlorella protothecoides
cgagttcggtccagaatttatggaatgtaaatggcccattcatgcacgcatatcaactcttcctccaacgctcccaatgcgaagcatggcttagaaaggaactgaaccccagcatggcccgcatggtgcaacatgggcacgctcacccgacacgattggcctaccaatgcgcacactctcgctctacagat

SEQ ID NO: 28625 - DNA, 76 bp, Chlorella protothecoides
tgcccagctagcgatcagccaatgcccagcaagcaaccagcgccctcctcaaccctgcctgcagcttgcggagctg

SEQ ID NO: 28626 - DNA, 73 bp, Chlorella protothecoides
ccccctcccgttgcgctggatgtcttttcgatccaggtgggccatggtgtgctagagcctggactgtaatcta

SEQ ID NO: 28627 - DNA, 119 bp, Chlorella protothecoides
ctgcaaccccctgacccggctccatgggctgtagcacacaccaagccctgccccactcagcgcatctgaagcccccccccgcgctcctcaacaccccctcccgccaaccccagggtaat

SEQ ID NO: 28628 - DNA, 87 bp, Chlorella protothecoides
acgaccacgttcggggatcctcctcgcatctgctaatcagactgaattttacaaagcctctgactgcgagcttcatcgcattctggg

SEQ ID NO: 28629 - DNA, 65 bp, Chlorella protothecoides
cctctggccgcgctcagcctgggcggcaacgccctcgccggctccttccccgtcgggctggccgc

SEQ ID NO: 28630 - DNA, 61 bp, Chlorella protothecoides
gtcgatggtcttctgaccctccaactgcccgaagatgtacccgatgaggacatcgtcttcg

SEQ ID NO: 28631 - DNA, 142 bp, Chlorella protothecoides
ttttgctcaacagggcaatacaagtcctgctcccgggggttgagccaaggagcgccgaccaactcacgtcccacccaattgaaactccagaaatggcatcgcaccggtttcggcagaacggcagagggtaacaaataccatt

SEQ ID NO: 28632 - DNA, 75 bp, Chlorella protothecoides
tttgggggtggggaggaagggagcaggggtcgaagaggaaggggatgtggctttttagaatgtcgaggggccggg

SEQ ID NO: 28633 - DNA, 11002 bp, Chlorella protothecoides
  modified_base (104)..(326): a, c, t, g, unknown or other
agcgcgccgcccggcaccgcagcgcccaggccggcgcgcgcgggtttgcccactgcgggaggccgggggccgcgcttggcgggcagcttcccgccggcagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcggcgatggcgcgcgccaggtcggcgtcggcgtccacgccctcccagccgcgcgccttgccgcgcgcggggcgcaggcgggcggccagcggcgcaggcagctccgccgccagcccatgcttggcagcccagtgcggccgcaccacccacaggcaggccaggccggggacggaggccacgggctcgggctcggccagcgccgccacccagcgccgcagcagggccggggtcaggcggtccaggaaggacggctcggggcggcgcaggctggaggaggggacgggcacggcgccgccggcgggcaggccggcggggcccatgggcaggacctcgtactcggcgggcagcccgtccgcgcccaggcgggggccggcacgctgcaccaggcacggcacgagacccgcgcccgcgatcgcggcggccacgggctcgccctgcaatggggtggtcggggggggagggtgacgtcgcgatgcagactcggcagtgcagccaggtgccaggcggggagaatggccgccgtcagtccagccctgttcgtctgcatgcaagacccagccacacaccggcaccaggtgcgactgcatgtggctgatgatggtggcacacagcacgtccaggggctccgtggagtggtgcaccagtcgcagggctggctcctcacacaccgccgggaactggggagggggcaacagggggggctgatcataaccagatagagcgcaaacggaactgcattaagcagcggcaggcagtgagctccctggcagccccacgctcgtgcccacaaacactccaatacacacctggtcgatgagggactgcacgccatactcgctggtcaccgcctcctcatacgtcagccccgagactcgggagtatctgcagctccactcacgctgcctgtgggcggttatctgccgcgtgtagtccctgagggagggtgggtccagtggcaagatcacatcgccggccaggcttccccgcaccgacaaatggtaccccagccccaccccgcatgcagggctggcatgcagccggagtgtcgttggggagcggtgtgagggcatcccgacactccattccggccaccccggcccatcggggacccggtgtgtcccgcagtcgcagcggcagtgccgatcaccccgccctccctggccatgatcaggcacatctgcaatgcccagaaaactcactcatactcccggaaaatctgccccgtgtagcggcagacgaaaacctcctcgttgggccgcaggctgggtggcagctccagccggggctggctgggcgccccctcgctggctggcatggttgcggtggactagccgttgcccggcatcagatgcatcgcgggctttggcatcaggcatctctggagctgcggcgcgggcttcgagcccaggccctgtcaaagctcgggtccgggtcaaatccaaatcaaacaccggcctcgcggggggaggggtcgacatccccgatccggggcatgccgggtgagaaacagcctgacgacacctcgcatgcaccctgaaactatttcgaggtgttaatcggacagactcaagatgtctggtgtcgtgtgcacgcagccatcgcacccctccgcccccgcacccggctctgaatatttcagctggtggtggtgttgcaggccactcggtacaaatgctggtcagtaaccactttgtaatcagtgattcaagtgtcaagatgattcagtctcccacccgtgcccagcgggtctctcactgtgcccagcggcagtcacgactccagcctgagctgctccgccccggcccatggcgacccaggccggtcaattatcatgagcctgaaacccccctcgtagtcccactcccgtcccttcacccccatgtcttggggctggggctgggccgggtgtgaggtgaggcgcatggccctggacgccacctctgcttcaaactccgtgaagatcgcctggcacgcatggggattggtaggggactgtctgcgcgcacgcatggttgtactgcaagggttcctgctcgctgcatggcaccagaggtggccatgcagccgcggggtttgccagggaacacctgtgtgcatcatccagcatgccgcgaggcaaggcactgctcccgtgaacccccatcagcgcccacctgctcccggacggcgcagcagatgagggcgccgccgccctccgccagccgctcctccagcacggccgccacgctggctgccatccagccctcgtacaggatgtctgtccccaggatgacctcgaagcgctcgtcggcggggcccatgggcggtgccacggagggcggggggggttccgaagacgctgccctcactggccctcgcgctgcattccagtccaggaagcgcacggccgcgcaccccgcctcccagccctccgtcgcggcctcagcggccgtcagcgctcgtcgcttctgtggagccccttcccccggaccctcgcccagggtcagatgcatgctggtcaccaggcacagcagcacggcgtccaggtagtcggtcagcaccacacgcgcggcgcccagccgcgccgccgccaggccgcacgcgccgcagccggcgcccagctccagcacgctgcgcccagccaccatgtcggggtgtgccgccagcaacctgtgcatgggattgcgtggggcggaggtcggggggggagggggcagcgtgccggcagaaaatgcagtgcgggggcgaatgggaagggcgcagattccagaccgacccaaaggagggatcggccatggagaagtccataggctcctgcacggcacctgttcaggatgtgtgccgccacccagagcctggcgccaacgccgtccccgagtgccccctccatcagggtgatggacaccccgccggcgtatcgggcctgcacaacctgcagaatttgtgagcggagtacagtcaccgcaaggtccaggcctgccctgattgggtgatgtaggatgtggtcaccatgctcagccaaccaataggaaaggggcatgacttcctcaggcccgccgcgtacccctccactggcagccgcgctgccgctgcaggcagcaatgatgtcggcggccaggtctgccgcctcctcctgatctggacctgcagggtgacccgcatgcacagggcgtcacattgccaagatgatacatcagggcctgaagtctgccagttggaaaacacctctgaacccaaaccctgcagtggcttggcctcaccgatccgcttgagcatggcagtgaggcgcgacgccaccctggagtggcgtgcctgcagaggagtcgagcaacaagggctggaactcaaaagaagttggtacaagcccagcgaatgaggggcccgtcggatgggagctgcgaaactcggcctgcatgcaggctccagcactgccttgagagtacccacctcctcgacatatgcctccttagcgatcacggcctccagcatgtccttgagcgccctgatgagtctcgtatcactcaatgtagcattttgcactacctcgagccactcctccacccgttcagaggcaatgaggagctccagaaagtcggcctcgtcagctggctgggccatgtcgggcgctcaacgaggcacccccgccaggggtgccgctcgcccacacttgcaagtccacaatcacgtaacgtgtcagatatgtggactttgccatttctagtttgggatgtccctgccagactccggcattgctccgagctccggcgcacgctgtcctgggcgcgtggacattccaccgaagatcccacgtctcaagatgacaagcagagcgctctgaggtggcccccacctgcttatcacatcgataaagggcaatgatgcctcacaaggttcatttcaatatgaaagaaggacaccagatctcaagctgcaacttcttgcaaatacttcctcaagctgcggcaagcttatagattgggagcagcaattcgctcagtgcaaggggctcccctgctggccactatgaggctcgtgtttcagcggcagcaggagtgagtggacaccctccaccactttagagggcaggccgtcttcatcctggtcggaagtagccccaagcaggtgctgcccctctgggtcgtggatcgctgcatgcccctcggaggctgcaacattgaggagactgatcttctggcgattcacctccaggatacccaccgcaaggaatacagcaccaagcacctgcagccagctgatggcctcgtcgaagaaggccagtcccaggaggctggcatacaccacctgtgtcgtggagaagggcatgagaggcattcgaccacttgacatgggatgttcaggatgcccagccgccacttctcgcagattttgtgggatgcgatgcatggatgaagtgtctaagaaaagcttcactcccactgccgtttctctttgtaaaccaaactaagaaccacaagcgccaccgagacactgccggtgtcccagcaattccacgccaatgccctgtcccacccccagaaccagcactggcacatacctgcatgaggttgacattggcacactttgctgcaggcatgagctgcaggccccggcccatcagcagctgggccaggaaggaggtcaaggcgatgcccaccagggtcaaagcttggagcggggagggcagcaagagtgggccgggaaacgacagggcaacagccggcaggatggtgaagaagctgacagaaaagaaccaggccgacattgtgagcgggacggtttgtctgcagagggaggggtgggcgggatactctaaagctggttatgcgctgatgtgtgaggctgaggcccctcttctccagtccatccccccacacacggtcccaccttctccctccgactcacttgccgacatggcgaatcacgacataggcccccgccgtcaggaaggcccctgccagcgcggcccccacgcccagcagccgctctcgcgtccagggcacgggccgcccggtcagcatgccgaccaggaagggcggctgcgccacgatgaacacacccagcaggcaggtggtgcagcccaccagggtgtgccggcccgcgggctctcccagcaccagccacgccagcgctgcggtcagggccggggccaggaagaggatgctggtgctgtccgctagtggcagggccagcaccgccaggtacaccgctatttgactggcgattgcagtgttgggtgggaagggaggaggctgagggtcggaaagtggacggtgaactttgtaagggatggtgcatgcaggatgatgcggggctgaagctgagctggctccagcaattggtaggaagcagggccctgaggactcctggaacgctcaggggtccatgcagacatcatggcctcctgtcctggtctcagacctccaaagtattcctcaaaaaccattggtacccgtgacccagcccaatgagcatctgtgccacagcaactctcacctagttgctcccaggatgcctcgtatgagcaggatgccatactgctcccgccgtccaaacaggggcggggctcctgccggccgcgcaaaagacaggaccacagcgcaggtcatggagatcacgctcctggccaggatgatctcagtcacgggcagggcggggccgatgtacttgaggagagcggaagagacgctgaagcacaagcccgagcagaccacacatgacatgccagtgtcccacagcaatctgccagtagagaatgcatgggagcacaattgagggtcttgaagaggcaatgcaaggacctattgagcccagagcatcatcaaagtttccacgcctcatccggctgtcaagaatggaggagcattgaccctctcgtctcagggccacaagtcggtctgtgagcgatagacttgtctcacatacggctgggatgccctggcaccacacaaactgtatttaatcacctaggaaacgccatgcatcgccgggcgacctcccacccggcccctcggggtgggagggtttgagagagcgtcacgttttcgaaggggtcgggaacggtcacggtggacgaggtaggggtaagctgaacatgcatcatgcacacataataataatatggtaacaattatatatgtatgctcttaaatagctctgtgttggccccgcagcaagtgatcttctccgtgctggctgacgtaatcgggttggctatttgtaacacaaccaggtttctttctgatgtcagtggcagcttccctcccgagcaagtcagctgcgagggggcccatgacgcttccccagctcgaccccaaatcccttctctgcgatagacggacgatccagggcgtccgcgagcaaggggtcagtctcaggctggccaggtgcttcccccttctcccgattgacctccaggatgcccagcccaatcagcacgccaccactcagcttgagagcagtggtgggctcgccgaagagcaccgctccagccacattggcgtacaccacctggagtgggcgccattgggtagtttgtgaggaacgagagcgtgcctgctgatactctggaaattgtagggacaatgggacaggtctagccacttgcatggcacagaggcaccgttcccaatcacagcacaccatatggtcaccatagacaatctatactctccaccaacaacgacctggaggaggctgagggaagccgctttgcccacatgcatcagctggatgcccctgcccatcaggatctggccgaggaaggaggtggccgccacccccgccatcgcggccgcctccaggaggctgggcaggacgggtcccgcggggaaggcgaccgctagcggcgccacggccgacgccaggctggtggcgtggaaccacatggagacggtgaggggccgctcgcgcagtccgatgcgccggatggtgacctgggacgccgaccccatcgccgcgccggccagcgcaaaggccacgcctaggccccgcgcgcgcgtccagggcacgccctcccccgcccagccgccgaggagcatgggcggttgggcgacgacagccacgcccagcaggctcagcacgcagcccgccagcgtgtgcaggcctgcgggctcgctcagcaccagtatggccaggatggcagtgatggttggggagatgaacacgatgctcacgctgtcggccatggggagcagggtcagcgccgcgtaccgacacaacatgctgcggggtagcgtggggaggagggggggtcggcaggctgccgggtatgacatgaccaaggctcaatcttggtcagaaatacacacatccgtacatttcaagtacaaggggtccttgatcagacatgtctgcaccgctttagtatcaccttccggatcccagggcccccctcaggctcaggagcgcccagctcctcctctcgccaaacaggggtttgacattacgcagcctcccggccgtgaagccagcggccattgagaggctggaccgcacgaatatgatttgcatgacgggcacatgccggccgatggccttcaccagaacgctcgatgcgctgaagagtatgccgctgagcagcacacacaacagaccggaggtccacaatgccctgatgtgggagtcgtatgtggatgccaactagtaaatatttgtactcatgattactataaccatccaatacggtccaggccccgatacagcgactacgcaccctgtaaggggtcccgagcaccgggcacatgtaccccatgacgcagcttcctctggcagttggctggatgatctcaagagacgtgaggtttgcgtcgtgacattgctgtgctgctcctcatcatttcccactgccagcatgtggagtagactgcggtgagcagagctgggccggtctcctgatagggtgtttgacgggcgaagcttacgtgatgcaacatcacctgctgccctgctgtggagcctccgcacgcccagcagggacgtgaaaacagcagaccgcagcgcagctcactgttcatcccatcactattaccgctgcaagaagtgtatatacgcatcatattgtacacattgtgcaaagcgagggaggcgacgtcgggatcccagcatcagcgagcttttgaatgatcacatcgccttaggccgacctcgctcactcaggagacgttcgcttgtaggctgcctgcccagagactgctctaaaggctaccatgcagctctcgcgcggcgctattgcgggcatcctatcagatgggcccccgcaggtctacacggtccagtgcgccggtgagcggggggaaaccatggggcatcggaaaggccacgacagtgttgcgctgcgtagcactgcttcccgacatgccaaattccatgtcatgcaggtgtcaagaaagtcatgaatcccaatgggcagccccggtaccgactcatgctctccgatggcgagttccagtatgtctgcatgctggccagccagctgtccgacctcgtcgtcaaccagctgcaggaagggtgtatcctccagatcacagagtacatctgtcagtttgtgcagaccaagaagtacgttcagcagattgtagtagtgtgagggtggggtggtgatggaaggacactacaaactgaggggggtggggcagtgcatctacaatgtcatcctataccttcaagccgcatctgctttcaacagcattaaagtcactctttgaattccaatcatcactcctccgcatggcagggtggtcatcgtgctcaactgcaaggtggtgcaggcagagtgccccaagatcggcaaccctgtgatgtacaccgacccgtccgtagtggctgcgcccggcaccgcgcagccgtcggcagccgcgccagcaccctttgctgcgccccagcatgctgcacatccagcctcagcatacggagctccacccgccactggcccggctcccgcgtacggagccccccctcctaccgggagtgcttctgcctatggggcccccccatcggctggtgccgcccccgcctacggggctccacccgccagcgctgccccagcctacggggctccccccgccagcgctgccccagcctacggggcgcctccgcagcatgcgggcaccccgtacggcgtgccagcccctgtgccgagcgcctacggagcgccgcctcagggcacagggcccgcagctgcagcctcatatgcagtcccgccctctgcagggcagcaaggcccctacggggcgccccagagcgccggcgcctatggtgttccgcccgcagccacagggccgtatggcggccactccggcgctgcacagtatggagctgccgttggaggtggtccaaaggcagcatatggggcgtcagcctaccagcagcagggacccaaggcggaacctgctaacccgtatggcggcggcgggggagggatacctgctgcttacccccccaccaccaaggcatacggcaatccttcaggtgtgcacggcagggctgtgcggcgcaggattccgggaaggatacatgcagtgagagagtgcggattgttggggatattgggctccaggcacttccagaatgggtcatgggttgcaagttggtttgccttgcattattcagttcaattacttttcagacatgccaaccatgctgtgcctcctctctacacagggccccctcagtaccggggtcagggggctgtggcacgtgatgctggccccgccagcatcatgcccatcaactccctaaactcctaccagaaccgctggaccatcaaggcccgcgtaacccacaagagcgacatccggaggtgggggagggggacacactgtgatgttcctggatcactggctcctgacagggcctcaaccccctttctcccatggtcacgcacgcaggtacaccaatgccaggggggagggccggttcttctcctttgacctcttggatgcgcagggcggggagatcagggccgtcggctggaatgatcaggtgcgaggcagggctggtgtgggagtgccgcgtgttaggaaggaggccgttgggtgccagatatgcactttgtcaccagctaatgccttgatgcattcctcaatgcttcagcaacagctgtaacccggcacatgctttccttgctgcagtgtgacaagtggtacgaggccgtggagacgggcaaggtctacctcgtctccaaggccagcctgcgcaacaagcgtggggtgcgttgcaaagcatgggaggagggtttcgtaggctcggagcctttaggaggaggtgacggacatgctctcattggatcgcgttctcattgtgtgttccttttgagcagcgtggtttgagcgtaagccctgccttcaaccccttccgatccgcgatcctggtgcagaacttcaaccagacccgccaccagtttgagatccatctggagaatgggagccaggtagagcctgttcaggacgaagccgagatcccccagctccactttaatgtgagtgctgggcggggagatcgatgtggatttcagtgggccatgcttggtgctgaagggctgctaggattgcacgaaaggctcgccattctgagcacctgatcgatcgtctgaccccttctggaggcctctttctgtgaacacatccccatttcatacacggtcagccttggtcaccctcatccattatccaccccccctcccccctttcacccccccgc

SEQ ID NO: 28634 - DNA, 448 bp, Chlorella protothecoides
  modified_base (98)..(198): a, c, t, g, unknown or other
ctggggctgctgcagccgatgcggcggctgacgctgcagtgtcatcgacctgtgcatgtaggaagggtctggggctggtgaatacatgtgtagctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacagtcctgcattcccggtcatccctcaccactcacatctgggtggtttgcgtcgtgctgcgtcgcctcctcgcccgcctgcccttgtggcgcatccccggaagtctgcgcgggagctggctcggccggctgtcgcctctcgcgctccgcgaggagtcgcctggccagcggcaggcagaggtgtgggtaactttcccacatgccctttgccggcctcgtcggcatgcaccggcgaagttcgacgatcc

SEQ ID NO: 28635 - DNA, 64 bp, Chlorella protothecoides
cgacagccggccgagccagctcccgcgcagacttccggggatgcgccacaagggcaggcgggcg

SEQ ID NO: 28636 - DNA, 75 bp, Chlorella protothecoides
aggaaggagaacatgccatgcaagaccgacaatggggcaaacttgtcaagcagcccctgtcaaatgatgtgctca

SEQ ID NO: 28637 - DNA, 77 bp, Chlorella protothecoides
acccttggagacatggaccccatgcctgccaacattcgccctacgctcaacgttcgcctccccacaggcgtgtacat

SEQ ID NO: 28638 - DNA, 123 bp, Chlorella protothecoides
ttggagtcgaacccatcagcgccgtgggccgagacagtgcatgtgtctgggtaagccaaaccctgaatccacaccgtacccgagagatggtgctgggcaccgtcgcggacgtgtgccgggcat

SEQ ID NO: 28639 - DNA, 61 bp, Chlorella protothecoides
caagtggctgacgtacaaggagacccaggggaggaattcttgtggctttgtgtggggtggc

SEQ ID NO: 28640 - DNA, 72 bp, Chlorella protothecoides
tcgcgctcgatggggcgcagcaggatgggcgtgggccacttccaccctgacaaaacctgtcgttggtgagga

SEQ ID NO: 28641 - DNA, 100 bp, Chlorella protothecoides
tgctccagcagcgcatggggtcgtgaggggcgcgccccggcgctgcggggcgcacgggtgtgtgatgcctggcgtggcctgctgacgctggtcctgggtg

SEQ ID NO: 28642 - DNA, 11035 bp, Chlorella protothecoides
  modified_base (3834)..(3843): a, c, t, g, unknown or other
  modified_base (4033)..(4042): a, c, t, g, unknown or other
  modified_base (6853)..(6862): a, c, t, g, unknown or other
  modified_base (7667)..(7676): a, c, t, g, unknown or other
cacccccttgcccacccccccgagcgcctcctggacctcccacatgacagcacggcggctggccgcctccgatgcggtgctcgaccccggactcggcttctggctctcccgccagcgctggctgtgggcgcgcgggcgcctggaccgcgcccgcgcggagctgctgcacgtctccggcgtggatctggacgttggcggggccatgtcctcacgcgactggcagcaggccgccgtcgacgcggccgccttcttgggcaccgctgacatcgctctccccgggggcgcagagcggtgggcctccgtcgcaagccctggcctgaggcaggaggggaaggagggcccgctggcgggcccctcccaggcctggacggggtccacgcgcgctgcgcccggcgccgggcgcagcgcccagggcggcagccgcagaatggcggtggtgcgctgggcgcgctcggtgctggccgcgcaccgcgagggcgtgctgtcccccgcgcagcggcgcttcctcgccttcctggacctgtcctgggtgctggaggcaggcgaggcgcgggcggagggcgaagccaaggatgccgcgctgcaggcctggcgggggaggctggcggcggcggcgcggggtctcaccccgtcgcgcgaggcccggctctggctccggcggcagcgggcgctgggcacgctgggcctgctgccacctgcgcaggccgccctgctcaggggtttgggcgtcggggagggggagggcaggagcgctgaggacctggagtgggatgccatgctcagcaggtggcttgtcctatcctcctggaccacgccgctccgggtgggtggaaggatggggtaaaggggcgggttttgtgcgtcgagaggtggtgctgcgatgcagttgggggcgcaggtggtcgggagctttcaccctgcacgagctgacacactctgtggcgatttgcattgccccctgatgcattggaaggatcacacccacctgctccccccacacccaataacccaccaggcatccgagctgccctctgtggacccccagctggcggcctgggtggatctccaggtccaccccgacacgcagctacccaaggagaagctggctcagctggaggccatcggcctggggcggggctgcaggccggccgcggcgcggcgacccctcaagcagctggcatgaactggggctagtggatgtccatggagacagccaccccatttccgaacccaggggtgcatgctctggatgttgcgcagaagaacggagaatagcttgccgaatttatgctgaatgccggtggcggagccccacccatgtagaaccatgacatcttcccccaggtgccggtacacccgcaactgtactgcagggttcccaccttgttccctccgtcggacactcctgtcaagcaggccatgcctggacacatgaggaacgggaccgcaccagatcgagctctcgggaccattaaaacagtaaaggaatttcgaggagatcctggggggcgctgtgagtctcagatcacttgtagccaggaggtcgtgcgcccaggcactggacaccacacctgagcctgccattcctgtcccatcgcttccacacgtctgaggtggggctccagggtatccgcagcttgacgtagagctgctctagacgcgacggcctgcctccccctcccccggccacacggttcaaagggcgcctcgccactccccgtctcggaccatgccatccctgcacctgccctccgcgctggccctggccttcctcgtcaccgccctcctggccccccgcggcgccctggctgccagtttccgtgtcgagacgaacgccctgcgcatcaaggagccggccagctacgccggaagctacgactccgccattggcgacttcggggtgcccctctacggtggcaccctccagggccggatcgggcacctggccgccaaccccaagggctgctccaacttcacggggtccctgcctgagggcgtggagatcctactggccatccgcggcgactgcttcttcgtggagaaggcctaccatgcccagctggctggcgccaaggccgtcatcgtggccgacaacatccaggagcacctgctgaccatggccatcccggaggatcgcccggacatcgcagccctggtgccaaagatcgccatcccggtggccctggtgcagaaggtgggcgggccaggccggtggatgggggatgtgcaaaatgagggagtgcatgcgagtcctgtggtcctaatgcagaagaggcggctttccagggagctcgccacttgtggtccagccttgccgtgcccctgcgtgcccttatcaatcatgcacagggaggtcccaatgccgttgcataccaggggccggacacctcattaccacctgtgtgccctgaacgacatcattccctccccacccctcaaatcctcccatcccctcgccaggacgccggggaccggatccagagcgccctggccgccgaccagggcgcggtgatcgtggagtttgactggaaagagtccattgtgcaccccgacaaccgcgtggagtgggagctgtggttcagcaccaacaccgcctgcgggcaggcctgctccgccacctcctccttcctggcccagttcaaggacagcgcggtgagcctggagcaggagggcttcaccgcctttaccccccacgtcatgctggggtcctgcagcgtctggacctcggaggagctgtgccaccgcaactgcatccgcggcggcaagtactgctccaccaccgcctcgtccacgggcgcggcgggggagctcaccgggcgtgccgtgagtggagccttcattgtctgttccttgtttctttgatgaggttgaccgccgtggtgcgcgctgcctgggctggggcgccctgcagtctgtccccgcccctcaacagggggtgggagtgtgcgctcttcccatctggcagcactggtcctagaattcaatcaccaataccccccctcccccccccacaaaaagaacacccacccactcacccacccacagatcgtggagcaggacctgcggcacctctgcgtgcacaaggtgctgaatgagacgaagaaggcgtggcagtggtgggagtacgccgcgcgcttcgcggcgcactgccgccccgaggccggccagttcaccaccgcctgctccgagcagcagctgcgcgacctgggcgtggacaccaacgccgtgggcggatgtgtggggtcgctggactcgggcgaggcgcacccgctgctggacgcgcaggtgcgcgcgcagaacgagcgcggtcccatgggccgtgtcatcatgctgcccacgctggtggtgaacaccaaccagtaccgcgggcggctgaacaacgccggcgtgctgcgcgcgctgtgcgctgggttcgccgagggcactgagccgcccgcatgcctgaacccgggggtcaacgtggacgagtgcacgcagggcgtggacacctgctggaaggagaatggcttcagcgcctgcgtcgacaccttccggggctacgtctgccactgcccggaaggtgccgcaccccttttcctcttttttttgggggggggggatgggggtggaacgagggtgggctggaaagaatcgggagctggtgtgtgtgagctgtgatggagggcactggatgagggggatgactactttcccttgctctaggcatgtgggagtcggtgcatccctcgatctggaggcatgcgatcccacccaatgacacttgcaagagtctcacattgtctccgtccccaaaacacactcgtccaggctggattggggacgggtaccactgcnnnnnnnnnngtctgtgtaagggaggcgagtggggggaaggcatgttgacaggccgtggtctgggggtgaaggcagcgtcagagctgtgctgctcaccaacctggcactaccttgttgatataagctgatgaatggtcgagttccaggcggcgggactgcctgtactgtggcatcgtcccccccaaccttcccacccttnnnnnnnnnnacatctccgtcccaaaaacacacttgcccaggctggattggggacgggtaccactgcaccgacatagacgagtgcgcgacagagctgcacaactgcgagcaggtctgcatcaacacgcctgggagcttccgctgcgagtgtaacaagggctacaagctggtgagaggggtgggtctacagttctgtgtaagggaggcgagtgggggggcggcatgttgacaggccgtggtctggggtgaaggcagcgtcagagctgtactgctcaccaacctggcactaccttgtcgatataagctgatgaatggtcgagttcctggcggcgggactgcctgtactgcggcatcgtcccccccaaccttcccaccctttcccccacacactgcagctgggaggcagtcccggggtgcctggcgtctgcatccccatccctggcgcgacagggttgccggtgtggctgatcctggtgctcactgcaggtggcattgggtggaatttgtgtttgggggaccacatcctgacattgccgatagattcaaattcctcctgcctcacggaaatggaattgttgaatcacctgccctccccccacccatggcagctgcggttgtgtcgacttctgtggcgggcatcactgtgtatcgctggagaacacagcacgccatgcaggatgagatccgcgcgatcatgtgaggaacaggtgttggggtggggctcaggatgcagcgtacagcgagggcagagtgcatcaatagtccaagccgctcccctgcttggaggactgcttgactgtactctttgagggctgaaagttatcaacactgcctggttccacctgatcctcactctgaccgcatcgacaggcgggattacatgccgctggaggaccgagctgacccggaagccggcaggaagctgctgagcccgcgtcgcaacggcaagggcccgccccctgtgcagcatgccgtggatgacgaggaagacgactattcaggcggataccaggctcctgacaccaggcaagggagcctgacgctcgggtgtaagaaggatgggatggcggatcaaggcccggggcccagtgggtgggctttgcggccagctgatgccatattcttgcatgctcgttgaggaaccaggtcccaatgccgtcaaccctttcctttgcagggagagcgtacgtctgaacccgactggaggaccattgtgagggtgggcactgtcatccagagctgcagcattgagcccgctccctcagttgtgtgcaacaacatcactcacctatgcagggtgtccatcaagcaagcttgcaatgtccagaccttgttgtgtgtgcctgccgtgtctgatgctgttgtttgtgttacttgtaccatggatgcatgggacataaggcttcagcttggtcctggaaaattgcactgaagcgcaaaggagacgactccagatcagtggcaatgatagtgggtaaggtccacaacaatcgttagagccctgggctgacattgaacaactgagtgcagacgcaaatcatgtgccgatgcccagcgggctggctccggtcgctactgcttgacaagagtctgtcctgacacgctcgaccagctgaacaggcgctcctccggcttcaacaccatcttacggtttgcaacagatgatccgcccagaaatccttcataacctgcaatcgcggcaagtggcgacgatgtcggtgtgcgcagtgcggcacaatccgccaccatctgcaccactcaactgctgttctggccggaatccacgccccacgtacccctgacagcattgccaaacgggctggaggtctccaagtacttggtctccaggtcgtaaatctgcgcttggtcagaaggaggcagaggcatgagctttggggtttcatgaagcaaatctcaaaagtgatgctaaccaccagcggaagaagtatgctgcaaacaagcacctgttgctcacaagcacctgttgctctacatgccgtagctcctcggccacagcgaggcgccgcttctccaggtctacgacctctgcagctgccttgtctttggcagggctaccggcatcggcccctctcttcctactgccgggcatgggactggtgggagggctctgtccgggtgtggtcttggtcttgggagctttcggacgtgtcataccctggtcatatttggtgtgctggcaactgtattctcggtgttcggcagtgcctgcaggagctccagaagctgagctgagtagcaaggcgtttcgtagtctctgctccgctactgctacggagctcaaagcaaaaagaggctcggcaccgggacgttgcgcttacatgcaattgcggaaacagatacaacgagtcttccctcgttgcaagggcgtgcagggactctggggaacgtaggaaagtcgagatccaagaccttcttttgcgcgcgagaatcaggtcctgcgctactttgcaacccccctccccatgccatcataggcgatactccccatcctgatggaacgggcataacatacatgctctcgagacatcagttaatggttcagactgtggagcatcactgtccaaatttgatgctgtaagagccggtggctgggtccttctctgccttgaagttgtcgagactcatcccgaacttgccgagtactgtatttcccagctccttgagcttgcctgcgcaggtcatgcagggccaacgtgaaaggtggcaatgatcagtccatggcttcgagactgaatcagcaagtcaggccaggtcgacgtcttttagagacatctggtccaagcaccccaagcgacgaagnnnnnnnnnngagtcaggccaggttgacgtctttcagagtcatctggtccaagcaccccaagcgacgaagtaggctcacccagcatctcgtctttgagcttctccctcctctcctccacgacaggtcggaggcgcgccgccgcagcaccagcggcgctgttccctgcatctagctctactgcctacgcgctggcatggagtgggcaccagtggtcatgcagggggccgtacttgaggcctcgaggggggtccggaccatgccgggctccggcttgccaggggcatgcccgaggcatgtgctggggtaccctggccatcctggcccacacttgtaaccgctggcatgcagcccaccttgtcaaaatccagcagggcatgttccaggtcgtccagggcttcataagcagcggccctgcgcatcagcgccttgccataggttggatctagctccagcgcgtggctgcagtccgtgacgacctcggcgtgccgcgccattcggagggagcatgccgcgcggttgcagtggtacacggctcgttgcgtcgcctccgcaggcgccacctccaaggctgccgtgtacagctcctgcagcgctggggcaatacaatgttcagcgagcaggcaggcagcagagggggagggggggtgttgaagaatggacatgactttttaaaggaaggacgttccgctgacacactggcagacagagctgagtgatcagcaggctgggtcgctcctgaaatgccacaccccacaacaacaacaccccacaacaacaccagggaccctgcaccgcacgcacgtaggccttctcnnnnnnnnnnctgatcagcaggctgagtcgctcctgaaatgccacaccccacaataataacaccccacaacaacaccaggcaccctgcaccgcacgcacgtaggccttctcgtcatctccagtcttgaagtaagtgttgccctctaccttcagggcttctgcctgctctatgggatcctgtggatcgacgccgtgagtcaaaatcagctgctgcgtcgtgcgagcgccccccgaaaggcagagactgccctgagcacgatccaggcactccccaccaacctgctcggagctggaggcggcgttcgcctcgcactcctcagggacatctcctgaaggatcagggatcacaatcggcgcatccgagtatgtgatggagtctgtctttgggggctcagactctgtagacgtgggcgtcgcctctggctgatcagtcacgtcctcgaagaccaccgccatgcccaccgagcaccgagtgcaaccttgagtctaagatagatacctgtagatgttgagacgcaaaatttagagccagcattcatgtcgaagcccacccaggattcccttccgccggacctgattccacacatgcgcgctgcttgattcaggagatcgcctctcccccctcctcccctgcagacatcgagggggtccccgacatcggtggcccccctttaccttgtctacccactctcgccgccttgaatccatccatttccgctggtgtaccggaggctctccgagccagtaacctttcgtactatcccgcgaccctgtctccccctggtggtccctgctcaactcggccatggcccagggggccgaaagttgggaagatgtggacgctagactgcaagatctatctattcggggtacggagggggctacacctccctctcaatccggcagtgtgacgccggacgatgcttcggggtgagtggccctgccgcgaaggggtagcttcatacatgtccatgaatgcgaggtccgatgccccgtccccaccatccgtcgtcgtcttacatttctttcctccctgcgcatgatccgtttcccgcagagcggaggcgccccttcctgcccctccccccgcggaacaatctcttgagaaggcggtgcaatccgtcgaccatgcgctgcgggacgccctctgccacccaaagaaccgtgctgtgggtgcgtttgggcatgcaggggttactccaaccgccgcgctgcctctcccgaaacggatcgcgtctgcttgtagtactgcgggcagcatggaggggggccgtcattctgggaggcagtgtcctccagaccccatgaccaccttccacacccctcgccaccccgcagtgctacaactcgaagccgatgtctcttggttcgtgtccaacagccgcgaaccgcagtttgtgttcacgggggacatgtcgtcgtatgaggtgcgtgcatcgctgggcatggggcagggattaggctcgggaggaggacggtctgcgctccgacagccgccacccatgcctggggcaccatgacggctcccccgcctgaatctatcatgctcatgtcccctgcccgcccccccaccagaggctgctggcacaccgtgtggctcagcactggggcctggaaaccacgatcatcagccaaggccccgaccagggacgcatcctcgcatcccgctccttccacaccggcagtccctcggtgagagggtggcccatgccctgcaggccgggccgtgcatgcataccctccctcgctccgctaccggcccaggccgcggaccagctgcctcagcaggctcctgaagctgggcccaaccccccacacctccttcctttcagatcaagttgatggacgtccctgtcgccctggccgagagcccgctgtacgccgccacctcggtggggccccttccccagatgcctagcggccccggcgggggtgctcccggcgccacgccgcgcgttctggtcaggcgccggcccgagcgccagaccgggcggcactccgtggagggcagcagcggctcccacccaggcgccaactaccttcagttcaactccaacgaggacagggaggcggtgtatgcccaggcgcgcgcccgcatcttcgcagacagccagggtggcggcggcagcggcggcggcgtgcagcaaccccccccgccgacgcagctgggcggcggcggcggccaccccggcgcccagtcctcgccccggggcttcagcgggcacggtcatggcggcggcgcgtttgtgccgctgcgcggcgggtccctggatggatacctgagccccaggggcagcgtgccatcgcccctggccctggcgcccccccaccagccgccacccccgccccccagccaggggcagcctggggcgggggcgtacgggcgcaaggcccagctgcgcaacaagcaggaggacatggcggacccagacttccggcgcgggaggttctccccacgcttcgaccagggctcctacgcgcccgaagaccccaacagcctgtacctccggcccacctactccaccgaggttggcaggggaggagagcgggcgccgtgcaggccggctgctgcggggttcgtgcgcgccgggcgactcgtgtgtcgcgcttccctcctgcatgcaccgttggggaagggactgcactgtggacatggcaagctgcactgccgctcacatcccggcatgccggctcgacactgccccatggccccctcctgtcttgcagttccctgagctcggcccgaagccggatggcactccgcatgtgtccccatcccactaccagcccgtgtacccgcaaggctaccccggtcctggggtgagtcacaggcaaatgcttgcttgcatgcagcggggctgcaggaggttgcgtaggttgcccttcctgatggaaacctgagatctggcctcggaacactttgcctgccccacatggccccaagttcatcagactgagtttgtgggaccctttgtccaccgaaaggcctgattctccttttgcttcctcctttcctctcaacacagatggtggcgatgagcccctaccacatgtaccctgggcagggcatggtcccccccggcatgatggccgcccacatcccgggcggcatggcgctctacccggcgggcggctccatgccctacgccccgcctggcggcgcggcctacatgcctatcccccagtacggctatgtgcccatccgccccgggtcggaccccatgctggccttccacgcccagggcatgcccatgtacggcggcggctatggcgggccgcccatgtcccccgcgggctcccgggggatgggcggcgggccccagggcctgcaccccgtctcccgccgtgccagctccgacgcgcggcccg

SEQ ID NO: 28643 - DNA, 162 bp, Chlorella protothecoides
ttccggacgcggtaccagtagggttatcaaggcaaatgctgtcgcgagctcgaccccaatcgtttcgataacaatatcagtggaggaagggcctgtcagctggctggttcctgggccactttcccacggtcgcctttcgcactcctgccgaccgaaacccca

SEQ ID NO: 28644 - DNA, 66 bp, Chlorella protothecoides
tctgaaacccatgcaggaaaggctggggggtcccgtccgcccaggagctcgtagaaggcccgttcc

SEQ ID NO: 28645 - DNA, 99 bp, Chlorella protothecoides
cctcccacgccctgctctagctgtttcttcatcaaccacttgccctgttgcaactgcattccacgcacttgcactcgctctacgcgccctttcttttgc

SEQ ID NO: 28646 - DNA, 64 bp, Chlorella protothecoides
gtgccatccacatgcaaccaagatcagaccgatcgtgggatcagcgtccatcctgcggccctga

SEQ ID NO: 28647 - DNA, 79 bp, Chlorella protothecoides
ctgcacgctcgtgctcctcagcgagaccgcttgggcacaaagaggtccttgtagaggtcctgcagcgaggcattgtgaa

SEQ ID NO: 28648 - DNA, 61 bp, Chlorella protothecoides
gcaccgcctggccgagatccgccgcttctttgaggactacaagaagaacgagaacaagatc

SEQ ID NO: 28649 - DNA, 72 bp, Chlorella protothecoides
gataaaacctctctcagacgtggcccagagggtacccaccggtggcctgagccgggatgagcctgctggtga

SEQ ID NO: 28650 - DNA, 76 bp, Chlorella protothecoides
agcatggcatgtgcgacgattgcagaggcaagtcagagggggctggaccctgtttggcggtgcaggccaggtcagc

SEQ ID NO: 28651 - DNA, 448 bp, Chlorella protothecoides
  modified_base (126)..(281): a, c, t, g, unknown or other
cacagagaatgggagatgcttcctcctccctccacgccgtcctgctccgataacgcatgctccaccctatccggacgccaggtacggtggagctttccctcaccctcgtggacgatgaggtcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggggatgcagtggggacgaggtgctcagactgttgggctctgcattgtcagtgccttgtacatacctcgtcataaagtccctgccccaggcattgctctgtcgacccctcccgccgagtgctcagcagctgccccagtgccagcaccacatgattctgccaccc

SEQ ID NO: 28652 - DNA, 76 bp, Chlorella protothecoides
agcccccacaacggtggaccgctgtatatgtcctgaaataggaatggtacaggtggaccccgaatgcagtgtgatg

SEQ ID NO: 28653 - DNA, 70 bp, Chlorella protothecoides
tagagaacccttgaaaaacacgctgacatccccatcggtagcaacttggtggcggtcagaggccaaatac

SEQ ID NO: 28654 - DNA, 61 bp, Chlorella protothecoides
cctgcccaggcgccagaggggctacgtccaggagcacatgttcggcgggggtggcaacggc

SEQ ID NO: 28655 - DNA, 397 bp, Chlorella protothecoides
  modified_base (91)..(302): a, c, t, g, unknown or other
tgggagcgccagagctccccgctcaagatcaccgcggacgcgcgtcgggcgttccaggacttcctgccctacttccaggccgaggccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgaaaaatgttccattcgtactggagcacgtcaagcatcgtgtgtcttgctcctcaagatcatgctcctccatccagcctgcaaattttgtct

SEQ ID NO: 28656 - DNA, 61 bp, Chlorella protothecoides
catgtttacggaaggggcacgcgaccgtaaaccccattcgcattctctcgatcacaacaca

SEQ ID NO: 28657 - DNA, 3531 bp, Chlorella protothecoides
  modified_base (657)..(666): a, c, t, g, unknown or other
  modified_base (2732)..(2741): a, c, t, g, unknown or other
tgggcggcggcggcggcggcgggggagaagtgcccgtcggcgtcggtggtcaccccgacgccgccgcgaccgccgcaccggcccccgcctcccctgcactcccccccgcccagcgcgacctggacttcgacctggagaagtgggcggcggcgggcgcggcgctgcccctgctggcggcctgcgcggcgtgccgcgcaggggtcaagcgcgcgcacctggtggacgcggcgggggatggcggcctgctgctggagctctactcccgcgacggcgtcggctccatggtctccaccgacctgtacgagggcatgcgccccgcggagccgcgcgacctgggccccatcgccgagctgctgcgcccgctggaggagggcgggttcctggtgcgccgctccgcggcgcgcctcgccgccgacctgccgcacttcacggtctgggagcgggagggccgcgtgctgggctgcgtggcagcgccccccctgggcgatggcgtggcggagctgggcgcctttgccgtgcaccccgcctaccgccgcctgggcaagggcgacgggctgctggagtgtgtggaggccgccgccgccgcggcgggcgcgcacacgctggtgctgctgaccacgcgtacggccgactggttcgcgcagcgcggcttccgcnnnnnnnnnncgtggaggcggccgccgccgcggcgggcgcgcacacgctcgtgctgctgaccacgcgtacagccgactggttcgcgcagcgcggcttccgccacgtggggcccgccgcgggaaacgcgctgctgccggaggccaggcgggcccaggtggacccgggcaggaactcccagctgtacgccaagagcctcgcctgaggggcacgcatggtgcgatgctcaggcggggggacccagcctgccggtgcttggcagggttgggaaggtagaggaccgcaccagatgttccatcaaaattcttgtaagcattgcgatccgtttcccgagcggcggcgcgctgggtgccggggaggtgctccgcaaggggaagagagggggggccaccttccggggtcggacgggcagaacctctctgcagcaacctcccgtttcgcacttggcccgctggcgggacccggtcgacccttcactgccttccgctccccatcaaacccgaacacccgctcacacggacttgcaaacgggttgagagcgcagtcgagcagcactgcgaccatacaacacccctgcctgcgcctggcttgacgaaggtcgtggccgtgagcacgcagcactgaccgcggcgatctgtgagggcccccccaagcgcaaatcaagggcgcgtggtgtggatgccgcttacgggtgccgctctggcttcccaacggtgcagttcctcggcgccaacggcggttcaagcaccgactgccgagccaagggagtccgtcgcctcatctggctacccgcacggcctgggttcggcgatcagacaagctacccttccattctgcagcgtgtcgcaggtgagggaggggcgaggggtggtttgggacccggcgcctgcccgcgcccttgagcgcccttgtttgaaaacaggcccgccttcggggccgacgggctcctctttcctgctcatgccatcgtgctgtggagattttgtgcacttgtcgaggcgccagcagggccctggcgaacgcactcccctggccccggagcctgtgatccaacgcgctcgaaccctcatccgctcctccccagggcgttgtgagcgcggcgaccggcgccgcgctgaccctcgtccttcgtagagcgttgatcggcagcccaagcctgtctgtggacgaccacccgatgcaggtgggcaggttgccatgggttgtgagtgcatgggggccaagtccttgttgactggcccatctctgctgtgtagggaggcatggctgcagtctcctgggcaccttctgctacccacagtctgccgtgctagagcctgatcccatctggcatacaaaaagcaggccagtatgtgctcagggcactgcaacccgccgcccctgtgcacgctcacaggtccaggagaactcggccgtggcggcagcggcggccacggcgaccgtggtggcctcctcctcggccaagctggcccccccgccccccaagcccgaccagaagccagtgcacgacgtggtggcgggggccatggcgcgcgccgcctcgcagtccaccatccacccgctggacacgatgaaggtgcggatgcagacgggcccgcgggcgggcgcgccgcgcggcgccggcccccgctccggcccgcgcctgccttcctcgcgccccgcccggggcggcggcctggcccgcaacctgaacgagttcaagggcctgtacaagggcgtggtgggcgcggccaccggcgcgggcctcatcatcggcacctactttgccttctactccaccaccaagcgcttcctgcgcgagcactccaccctctccgacggctccgtcgcctttgtgtcgggggccaccgccgcgctcggctcatccgtggtcaaggtcccgctcgcggtctgcatccgctcggtgcaggcgggggtgtacaccaacgccctcgctgcggcgcaggacatcgtcaaggcggcgggagtgcgcggcctcttcacggtgagaagggcagagtggggtttcatgtgctgggactgaatgagcgggggggtggaggaggtcggagggggttgcagcgagggtatgggttgtnnnnnnnnnntaacgccctcgccgcggcgcaggacatcgtcaaggcggccggtgtgcgcggcctcttcacggtgagaagggcggagtggggtttcatgtgctgagactgaatgagcgggggggtggagggggttggagggggttgcagcgagggtatgggttgttgttcgagatggccaagcatgtcatgtcctccctccctccaaccccctcccccggcctctccctgcacctcggttgttaccctctgatgtttgaacctgattccctcatcgttcacccagcccagcgtgaaaataacatccctccaacaccaccctccacaaacagggcttcctgccgaccatcctggaggacgtgcccgacatggcagtcaagtttgcggtgtacgagacggtgcgcaacctgcacctgcgcctgcgcggccggcacgcctcggtgctggaggacctgtgcatcggcgggtttgcgggcgcggccgccgcggccgccaccacccccctggacgtggtcaagacggtgatgatgaccaccgccagcgcgcggccgacggtggtgtcggcgtcgcgcgccatcctgcgcgagggcggcggcgcgcgcgctttcttccgcggcatgggcccccgcgcgctgtccaacggcctcaactccgccatcttcttctgcttcttcgaggccatccgccaggtgctgaccaagcagcaggcggcccgcgtcgcgcaggccgccacgggggtcaaggccgcgccgccggcctggcgcgcgcgcgtgcggctgccgggcaggcagcggaccgcggc

SEQ ID NO: 28658 - DNA, 61 bp, Chlorella protothecoides
gtgttacagagatggtcatcggcgaggggtactgtcgcaaggggcgtgtactgcgccctgc

SEQ ID NO: 28659 - DNA, 61 bp, Chlorella protothecoides
ttgggccttttcatgctgcatgctacctgccctggcaacgttagagcctggataatggtac

SEQ ID NO: 28660 - DNA, 75 bp, Chlorella protothecoides
ctcaacatggcgatccctggggagatcgactagccatgcttactatggaaaattctccctcaagcagtagcttca

SEQ ID NO: 28661 - DNA, 123 bp, Chlorella protothecoides
atgtacccctggcgtctagcaggggccggtgagagggccagctcccggggctctctacaacaagtccccttgacaaagacaccgtcgtcccctccctccccaacctgcgcgctggagtgccgc

SEQ ID NO: 28662 - DNA, 72 bp, Chlorella protothecoides
gctcttccccgttgtcacgcctctccccagcccctttcaatccgcctgtcccctgcctctccgcaggtcaag

SEQ ID NO: 28663 - DNA, 61 bp, Chlorella protothecoides
tcacgattgcctgtttatgccaggtgacaggtatactggaagacgttgcaatactttcata

SEQ ID NO: 28664 - DNA, 127 bp, Chlorella protothecoides
caacatcctgctgtccagcgcgggggcggtgaaggtcagcgactttggcgtcagcgcccagctgtcgagcacggtgggctacaagcggcgcacctttgtgggcagcccgctgtggatggcgccggag

SEQ ID NO: 28665 - DNA, 77 bp, Chlorella protothecoides
ctccggggtcgaatggataccccatgtaaaatggtaggttctcttcagcgctcgacatcgcgcttgcacactgttcc

SEQ ID NO: 28666 - DNA, 74 bp, Chlorella protothecoides
ctgctggggcggggttcgtcattttgcaaggacatgctctgacaccggggtgcagctacctggggtgaagggcg

SEQ ID NO: 28667 - DNA, 75 bp, Chlorella protothecoides
tttcttctacgacctctttgcggggcaggcagacgacaggcctccgggggatgcgccggggacgcagacggggag

SEQ ID NO: 28668 - DNA, 62 bp, Chlorella protothecoides
ggcggcaagcgcgatcgcagcggggcgcccaggggcgccccgcagggcaggggatcgccgac

SEQ ID NO: 28669 - DNA, 61 bp, Chlorella protothecoides
tgcccccgcgaatgtcgcctcccaaccggaaccctcccctgcctcgattgccggcagcctg

SEQ ID NO: 28670 - DNA, 79 bp, Chlorella protothecoides
aaacccgcccaggaagatgttgattccctcgcgcacggaaaaggggagtgtgaccacgccgtaggcgccgggcttgcca

SEQ ID NO: 28671 - DNA, 137 bp, Chlorella protothecoides
cagcacttgacagtcgatcagcacctcatggtagcagcccgctcacagcagcatcgatgccagcgcagattcgagtccattcagaggggtgagaaccgagaccaccccttcccacccatcacaacccacccaacgcc

SEQ ID NO: 28672 - DNA, 61 bp, Chlorella protothecoides
tcgaccatcgcatccctctccaccggctgggactgacaatcacacggcaaccccttgctgc

SEQ ID NO: 28673 - DNA, 93 bp, Chlorella protothecoides
tcatttggaaggcatggttccatgcaggaattctgttgatcaatgggtatgggagattggataacagggaaaggagaggtgtgatgcagcagg

SEQ ID NO: 28674 - DNA, 73 bp, Chlorella protothecoides
ggttggcgccgatggcagacatgctcggtactcttacagttcatcctggctattttgagccctgtagtcctgc

SEQ ID NO: 28675 - DNA, 96 bp, Chlorella protothecoides
gggatcctcggacaggtatgcgccaacctggagaagatggcaaaactggagtcttagcatcgactaccgagtatattctggcagcagaccgccaaa

SEQ ID NO: 28676 - DNA, 9499 bp, Chlorella protothecoides
  modified_base (307)..(316): a, c, t, g, unknown or other
  modified_base (1488)..(1497): a, c, t, g, unknown or other
  modified_base (3237)..(3246): a, c, t, g, unknown or other
  modified_base (3699)..(3708): a, c, t, g, unknown or other
  modified_base (4398)..(4407): a, c, t, g, unknown or other
  modified_base (5187)..(5196): a, c, t, g, unknown or other
  modified_base (5756)..(5765): a, c, t, g, unknown or other
  modified_base (6092)..(6101): a, c, t, g, unknown or other
  modified_base (6354)..(6363): a, c, t, g, unknown or other
  modified_base (6719)..(6818): a, c, t, g, unknown or other
  modified_base (7346)..(7355): a, c, t, g, unknown or other
  modified_base (9104)..(9113): a, c, t, g, unknown or other
gccgggggatcctccattggggggtgatggggggaccccgcccctacaccgacaagatacgaagctgatggactcggtgcctcaacccaagcacaggcccccagcccgatctgacaagaatagactagcaattggtgggctcgtaggggctcggcggggggacatcggcgcgcaaagcgatccaaatgttgagagttgcagggacagtacctaagatgcaagctctgctgtgccgatggtactaccatcccttgcggggaggggccccagcatattttatttcctctgatgtccctcccgggcatcnnnnnnnnnngttgcggggaggggccccagcatgtcttatttcctctgatgtccctcccgggcatcacagatccagtcactcgcgcggatccctcccaaaaccttttgcaggatgtccagagacgcaccccccggtaccaaggtgtacgtcggcaaccttgagccggacacgcaggagtcggtgctgtcggatgaggtgtgtgcgccaagagatttcgcccgtccagcccctgctccgacccctgtgtgacggccatcatcccatcttcatgactcctcgcgtctcctggtcctcatcgagcgacaccctgccccctgtcggtctccacgccctcctgccgccttctgacgctgtgcctctcctcctcagttctccaagtacggacgcatctccagctgctggttggcccgcaacccttctggtgagcgttgcatggagggttgcggctgtggccttgcgatcgccgctgcgctgcgtccctgcacctcgatcactggccagtcatccccccgagacaacgatgcccatccctgcaggcttcgccttcgtccagttcgaggaccctcgtgatgcggaggacgcagtcaccggactggccggcaagaacgggtggcgcgttgaggtagcgcgcccaccccgtgcccgtgatgaccgcttcggtggtggtccccccggtggtggcgaccgcaggtgggccgggattctattaacatggctgagaagggtgcgggaacgatgggtgtccaattccacggctctctgctgctcagttaacaagcccctggcgcgatatccaccctcacaggctctccaccccttctccatcacaggtgctaccagtgcaatgagccagggcactttgcgcgtgagtgccctcgtgggcccggcggcggcggcggcggtggcggcggttacggcgaccgcgaccgtggttacggcgaccgcgaacgcagctacggcgaccgcgaccgtggctatggcggcgacagatcccgtgacgacaggcgcgacgacaggcgctccgaccgctacagcgatcgcgacaggtgcgcgagcggctggcatttaattgtttggatagtgtacagggtgaacgcgtcgcttcgcttaggactacctggtgcaggcccgttcgtcaatgctgggtgccgtgcctctgcgatcctggcctgctgtagctnnnnnnnnnncaggacttcctggtgcaggcccgctcgtcaatgctgtgtgctgtgcctctgcgatcctggcctgctgtagctccagggacaagggcgccacacgggctgtgctgattgcgctccgagtgccccctgctgaccccctggacatccttgcggagcgttggtacaccacccgtacctcactatgctctcctgcgggcccccacccatgcatagggactacgagcgccgcgacgaccgggatcgcagggaacggagccccgtccccgagcgcaggcgcgagcgcagcccggccggcgagcgggaccgcagggacaggagcccccctgcggcggtggaccgcgaccgccgtggctcccccgagtactgagcccgacgatgggagggcgtgggctgggctttgccctggtgcctcgcgcaagtatggcaggattgttctttcccgccaaacgccatgccctggccctgcctgacgctctgtgacggaaggactcacagcaaagaggtggtcagcaataattgtgcaaggcgtggaaattgtcagggagagaggggggttggcttcccgcctgcactggcaggtgcatgtcgatcagagagtgcaccgcgctcttgatcttgacagggtgagcaggccttggcctcggcccttggcgccagattgccttgctcgactgtccgccgtggcgtaccagcatgcacagcgtcgctgcatgcgaggggtgttcagtcctgggggcttggcaacaaggtccagcagcgtggaccctccacccgccgccccggccggcagcgggtctgtgaatgcgggccgtctatgagctgtagtccctatgctcactgccacgctgtccctcacaccgccttccacgtgctgagcagccccgcatccgaccaggtggccagcaggttgcggtgggggtggtgcgccacgccgatgggccccttgtcggtgacgcgctgggtgccctccagcctcccccccgcccccgtggcgaagctgtacagcacgccgtcctcgccgaggcagtgcgcccactcgccgcgcggcgacagcgcggcggcaacgaagtcgccgccctccgccctgcccgactggaagctgcgcagcacctgccccgtcagcgtcatgaggtacagcgtgctgcaccgccccgccacgtagacctggcccgggttggcggggtcggggagcaggcggtccagcgccacgtcgcccacgcgcgcgccgggcggcggcggccggaagctggccaggcactcgcaggagcgcgcatcccacagccggacgctgccgtcggcggaggcggagagcacgcgcgagccctgcaccacgtacaccgcgcagttgacgaaggaggtgtggccccggaactccttgagcatgcgcccgctcttgatgccatgcaccctgaacgggggtggggagacgggtgagtgaacagggggaggaggtggtgggtgaggagtaggtgggtgaggaggtgtcagctgaccaccaggacccaaagccagccactcagctgcacaaacacttgacagcgatcacaaccggccccgcgtccaggggcctggcggcaccctgagatcctgcacccccctcccttacacgaacagccacccaccggatgaggccgtcgtagctggtgctgagcacatggctggagtctgcgctgagggccaggctcgtcacgccttgggtgtgggccgagtcgaacctgcggacgcactggccggttgccaccnnnnnnnnnnacacccccccccttaaacgaacagccacccaccggatgaggccgtcatagctggtgctgagcacatggctggagtcggcgctgagggccaggcttgtcacgccttgggtgtgggccgagtcaaacctgcggacgcactggccggttgccacccgccagaccttgatcttgccgtcctgggggggcaggggatttaacgagggatgggaggggttggtagattgttggggctgtggaggtgacggttgcaagaagggggctacccgctgggcctcgaccgcacatcacgcaagcatttcgctgccttgcttgccgcccggacttcctcccttctccatttcaattccccatcagcatgtctgccaccaacattggccaatgcagcgcaggagcctcgatgtcgacatgaatccctgcctgcctgttctctaggaccttcccacccttccctccnnnnnnnnnncgcgcagcagcctcgatgtcggcatgaatccctgcctgcccgttctctaggaccttcccacccttccctccccatccaaccccaatgccacaagcctgatacttccccccagaatgaacactccacaaatgcgcccaccatggagcctgatgccaggagctcggagtcggaggaccaggccagcgccagcaccgcctggtcatgcatcatgaaccgctcctcggcctggtaggcaagatccttcttcagcttgccgctgacgtggtcccacacctcgatgaagccgtcgacactgccggtgaccaggagcaggccgtcgggcgagaaggcggcggtctccgggtgtgacttggtcccaaacttgatggtgcggtccagagctgtggggcaacgctccacctcatcgcgggcccctgccgccgacccgcggaacaggtcgaatgtggcgcccggcgccagcaggccctggtgctgctgcctgtgtttgggtatcgtagggtgctctgtattcttttcagaggggcgggcaggatatctggaaggttggtcgtggcgtaaagtcctcaaaggagtcataggagggacaacacacgtgcagctggaatcaagcacagctgtatttgtcgcccgctcaacccccccccgttttcaacaacagtcgctcaccacttgagggcctggccgatgacnnnnnnnnnngagtcctcaaaggagtcatatggagggacaacacacgggcagctggaatccagcacagctgtatttgtcgcccgctcaacaccccaccgtcttcaacaacaagcgctcaccacttgagggcctggccgatgacggccatcaggcgggagggcggcaccgaggtcacctccaccgccagcctggcggccagggcgccgcggcgcgcgtcgcgcggtgtcgcaccgtagaggtcccgcgcgtctggcgacggcgcggcggccaggcgctcgaggcgggcgtagcgcccagcgtcggcgtcgcgcatgcgcgcaaacaccgcggcctggcgcaggaggggcttggcggtgtcggtctcacgcagctccagcagctccagcagcacctgctcgtacaggtcctccagcaggtccaccggcagcttcagggtggccagctggggcaggatcaggtcccaccgtcccgcccgcacgtccgcggtgaaggcctccagactctccaccgcattcagcgacaccccgcactcctcctggatggctgcgaaggaggacgtcagtgagttctccttgcagaactgcaggatgaccttgatcacactggggtggtgggaggaggggggttggaggggggccataagggatatgagggtcatggaacaggtggctcctcatggtccagtctgaaatatcagcgcagtcccagcacggcaccgatgcagggcctcgagaacagagtagccaagctcagagtgcactcactctgtggcagcgatctccagggacnnnnnnnnnntcagtctgaaatatcagcgcagtcccagcaccgcactggtgcagggtctcgagaaaagagtagccaagctcagagtgtactcactctgtggcagcgatctccagggacatggctccactgccttcctcaggcaggaccacgcacagccttgaagcagcacaggctgactggagtggcaattatgccacaggtggcgccatcgcacactccttgtaaagtgttcccaacctgggcggcacgacgcggatcgtgttatctaaacgattgctcaaatgacgaactgtttaggtaagcctttactcggaagcctcctcatgaggactgcaggtgcagaggcattgtcggttttgtgcgcgcggaattgagaagactcccctctgagaatctcctgtgaaaagtaatcctccaggcggtgagcacactggagaatcatctgaaaaacaaactctagcttgtggtactgaccctgaatgagtcatggcatggctttacaaattgcatgctggacattggacatggtcctattgcgcacatcacgggtgacacacgtccctacaatnnnnnnnnnntgtctagcttgtgttactgaccctcaatgagccatggcatggctttacaagttgcatgctggacattggacgcattacttttgctcacatcacgggtgacacacgtccctacaatcacacattcaaagcgtcaatcaaaaaagaatgggggagagcgacatgagatggaaagggatcaccctgctcggtcctggagcctgttcccggttttggtgcaggaatggagcacaccaagaggtggcacaggcagagagggtcagagactcctgtaacagtgcggtgagcatcgtggatgattgtgcggtcaacgtatcttcagctccttcnnnnnnnnnnttcaaagactcctgtaacagtgcgatgagcatcgtggatggttgtgcggtcaacgtatcttcagctccttcaccttcgatttatacacaaatggtactagctagtcctgttgcaccctacttctttggtggagggctcctcttctttggaggcggtggatagtgcttcttgctgggcggcggaggcctccttttggtgggcggtggggacttcttctttgtgggtggaggaggcttcttcttggatggcggcnnnnnnnnnncatttatacacaaatggtactagctagacctgttgcacccctacttctttggtggagggctcctcttttttggaggcgggggatagtgcttcttgctgggcggtggaggcctccttttggtgggcggtggggccttcttctttgtgggtggaggaggcttcctttttgcaggtggaggaggcttcttttttgcaggtggaggaggcttcttcttggatggcggcggagacttcttcttagggggcggtggatgcctccttgctggaggcggcggggttttcttcttgggcggcggtgggtgtcttttagagggaggtggatgcttcttctgtggaggcggcggagacttcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcttctgaggaggaggtgggtgctttttggggggggggggggtgcttcttgactggcggcgggggtgactttttcttgggtggggggggacgcttgggcgggggtggtgagctgatcaccagcgtctcagaggtcaagagtgaggacttctcgcactgcacagcagaggtcttcatgttgttgcagaagatgaagttgcccgtgttgttgctcccaacgttgttgcccccacgattgttgttacctgcatgaagtgggaaaggaggtggggtctcaggctccatttcttccacacagctcctgactggtgcgctgttgccatgtccacgacccaacagcgtcgcagcaaactcccccaccccttgatcccccttttccaaatccatatcctccttcatgagccaactcttccaccagcacttgccaaggttgtgggtgccggtgttgccggtcccaatgttcaacgaccctgtgtttttcgcccccacgttgaaattcacgtcggccaagcatggctctcggccgnnnnnnnnnnaaaccggtgttttgcgcccccacgttgaagttcacgtcggccaagcatggctctcggccgtgcggcacgcattccaggatggtcagccactcgcaggtcgtgcatggcacctctgcatccaatcgcagcacatttatgctgaatggaaagtaccacaggcgctggatgttggggtaactctctgtcgtgccaaccccgccatggtagccactggccctgtgtgtagtattgattgggcgggagattcagctcagcggggtgattctgggagtgcatcatgctagcatgaggtgttggacaacagcaaatgagtgcaagtggtggtcacatgcatggccacccctgctctgccaggcatcacgctcgcacctgcagaacaagtcagcgctctccaagcttacaagatagagattgccatatttcctgcagcacaagaggcatggcgggaaactgagatggtaaaaaaattgactggcagatcgcaggcttgtgagacaggtatggtgacactggccaaagagaagctggcgactgcaactcgtcaacccccatgatggcaaaagggactgaaaaatcaaggcagcccactttcgcgaacgcactgaatggtagggagcgcaaagaacttggaggagcaggcgacctattgggagggaatgggatggaggtaccgttggtaaggccctgggccaggaggggcgccaccaactgggcactacgcagattcttccaggtgccctgtgaactcaccgtggcgctctcagctactgttgacaagagtattaagctcaatatcaggagtggccctcctgtcgttgaacccagacctccccgggcgctcggttgggtgtgcatctctcccggacctcgacggggagccggacttcaacgacggcccggcccgaagaacagtggcccgagatttactgactagacatcttgagttgcgggaggtacactcatcgatatgtttgggaccgtgaagggccattttagcgcacccgcatcgggagcagctccggctgggcccggaccccaggtctccgggcgcgccgctcggatccgcgcaccacgggcagggaggatcacccaggctccggcaatgtcgtgcttcagatgtgtcaaagtgttacatcgtcagaggtacaacaccaacagcagcagcattgagcaggatagatggtcagtgatgccgcaaggggctccctgcgcctcgtgccaggggcacctgcctcggaccggcagcagcaccccccctcgcccctcagcccatgtacatgcccgcgcccgtatcatgctcggccttctgctgcgcgcgctgcgaggcctgctgctgctgcagcaggcgcaccaccgcccctgcctgcgcggcgcgcggcagctcggcgatgcgggcctgcaccgagggcggcagtgaggccatgaaggcacgcagctgcgcggcgcgctcggcgtctccggggcgcgcctgctgttgctgctgctgctgccactgcgcctgctgcatctgctgcgcgtgctgtgcgtgcatctgctgcatgtgctgggcctgctgcatctgctgtgcgtgctgggcctgctgcatgtgctgctgcgcctgggcctgttgcatgtgcgcctgcgcctgcgcctgctgcaggtgtgcctgggcctgcgcctgctgcgcctgctgcatgtgcgcctgcgcctgcgcatgctgcaggtgtgcctgggcctgcgcctgcgcctgctgcgcctgctgcatgtgcnnnnnnnnnnggcctgctgcatctgctgcgcctgctgcatctgctgctgcgcctgcgcctgctgcatgtgcgcctgcgcctgcgcctgctgcatgttggcctgcgcctgctgcgcacgctgcgcggccgccacgtgccgcgcgtacagcgcctcgaacgtcgcgctctgctgcgccagcgacagctccagcacctggtgccgctcctggggcgtcatgcgcgacagcagcgcctgcaccgcgctctgctgcgcctcgggcggcagcgcacccagcgtcggtgccacggggccctgggcggcgggcggccgcccggggccgtactggtgggcctggcgcgcgcccgggtcgccctgcaggtagcccccgccggggcgccggtcgtaggcgccgcccg

SEQ ID NO: 28677 - DNA, 137 bp, Chlorella protothecoides
ccgatctgtggggagcttcacgggggagagacccagccagctggaacgatgcatcccgcctgcttgttcagcgctgaacccgcgcgcctgtcgtgcgctgaatgagatttccagggtggatgcctgctctgtgctgc

SEQ ID NO: 28678 - DNA, 70 bp, Chlorella protothecoides
tcctcgccttgcagcctggctactggcacgccatcgtggattgtgcagccctgagcctcccttcattcga

SEQ ID NO: 28679 - DNA, 91 bp, Chlorella protothecoides
cacactgagcgccaccccagtcgtcactctatctgtaccagcagacagcgtgcctgtcgctggccggaggggtccatcctgcaagcttctc

SEQ ID NO: 28680 - DNA, 210 bp, Chlorella protothecoides
caggctccttcactccccccactggggctgcgccgatgtgctgccctcctcatgctgcaatcaacatggcacacaggtgggcaacggcctcctcgcccaccgcgcaacccctacactcaagcagctggcctgcatgccccgagtccagcgccctcccggaaccctcccgtgtcgaatgaggcaagcaccagccatgagcactccacctcc

SEQ ID NO: 28681 - DNA, 76 bp, Chlorella protothecoides
caacgtgacatcctgctcatccaaggagttccacgccatgtcgggatccaagcggcgggagaagaccattgcgaag

SEQ ID NO: 28682 - DNA, 157 bp, Chlorella protothecoides
cttcctgcagatgtacatctgggcctgcccacccctgcaggttggctgatctttttattaggggggggggaggggggttggtgtcttgctgagtcaatccggtggggggaagacagtgcctctagaggacaagaagatgcggtcagtgcataacctg

SEQ ID NO: 28683 - DNA, 257 bp, Chlorella protothecoides
ccggggagtgggaggaccctgctgcttcagggcgcctgtacatcagatgtctaagcgccgcggggggtaggtggctcgcgctgatgccctgcacaccccctcttccccgattagcccgggacaatgcagtcgtgccccctattccccgaaacaccccccccaaatgcacaaacctgggcgtcctcgggtagggctgcgaggacagggttggcagacggtggcggggtcctggacccgccacgacgcgcccgcttcgc

SEQ ID NO: 28684 - DNA, 61 bp, Chlorella protothecoides
gcggcatgggatttggctggcggtgcgggggcttcctgattctctgggcaaggttgtggtt

SEQ ID NO: 28685 - DNA, 79 bp, Chlorella protothecoides
gggaaaggtgcggcgctcgaaatgtgctaccacagggctgcagcttaaagttggcatcgctcgcggacttgccagtcca

SEQ ID NO: 28686 - DNA, 96 bp, Chlorella protothecoides
ttggggggtggagagtgcggagtggtggggggtctgagcagcgaggctgcagtctccagaggcagccggaggcagcgagccctcgccgcgccgcgt

SEQ ID NO: 28687 - DNA, 61 bp, Chlorella protothecoides
gtgtgtgtggtgtggtgtgtggggggggggagggggaagaggggcgatggtgtcccaagga

SEQ ID NO: 28688 - DNA, 148 bp, Chlorella protothecoides
gggggaagaggggcgatggtgtcccaaggacggcacgcaagcaaccacatgactgggtgtgcgctgcgctgagctgttgcaagggtgcattcaggccagtcgactttgattacagccgtgggcccggctgcgactgccgctgcaactc

SEQ ID NO: 28689 - DNA, 61 bp, Chlorella protothecoides
acatcacgctgcagcactgcgtgccatggctgaggcaacgctggaagggccttccctgagc

SEQ ID NO: 28690 - DNA, 152 bp, Chlorella protothecoides
gccaggatgctcgaccccgtgcgtccctttttgttttttggaaagcggaaacggctgggtgtacgaggcggcagggggcatgggggtggaccccctgtcttgcgcggggtgtttgtgcatggggccatgcgtcccggctgggcccctgctgt

SEQ ID NO: 28691 - DNA, 162 bp, Chlorella protothecoides
ccctacgccctcatgcaaggcatgacgcgggggagttggggcaggggctggcttgcagctcccaggccagccggcacggagccgcttctgtatgacccggggccaaccttcaaatccagtcctccaccccgcaatttataaacccctgccctctttccacct

SEQ ID NO: 28692 - DNA, 3069 bp, Chlorella protothecoides
  modified_base (458)..(467): a, c, t, g, unknown or other
  modified_base (1009)..(1018): a, c, t, g, unknown or other
  modified_base (1530)..(1539): a, c, t, g, unknown or other
  modified_base (2652)..(2661): a, c, t, g, unknown or other
atcggtggccggcgccgcggcctggccggagcgtcggcccaggccggagtagcccatggcgccctcgaactcgtccagggtcagcgcccgcccgctgaacaggtcccgcacctggccggccgtggcgtctagcggggacggggagcctggggacgccccattgggcccctgcccggcctccccgccccgctccgccccgctttccagcacgtacaccgccccggtatcgcggtccttgatccagaagcgctgtgcgttttagggggggggcagtcatgtgtgagggtggtgacgttctgttgtctggagcactgccacccaggatgaagattcatgcgtgtcgaggccgggacagggccagagggcttcagccacgtgcaaggagtggccatgcgcaggaggaggaaggtaccgcgagggcaacacagtgtccccgggcatgtacccagcccgcccannnnnnnnnntgttctgttgtctggagcgctgcgtcccaggatgaagattcatgtgtgtcgaggccgggacaggaccagagggcttcagccacgtgcaaggcgtggccatgcgcaggaggaggaaggtgccgcaagggcaacacggtgtccccgggcatgtacccagcccgcccatgcccgcggaccttgtcgagagcgtactccgcgccggagtctaggtcccggattttgaaggccgcctcggggagggcgtagatgccggtgctgggggcttcccgcggcgggacggagaagaggctggcgcccagggcctccgcccccgcccccgatggacccgcgccgtcggaggagactggggaggaggcgggcttggaggtggatctgcgtggcacaggaccggcggcttccggagccagtggctgtcgaggcgggggcgtcgggcgcttctttcctgttcaaaccgaggaagatccaggtggaagggtcgagcgcggtcacatgccaaggacgagtcaagttggaaggtgggcgcctgggtgtgtgccccacannnnnnnnnntgggggcgtcgggcgcttctttcctgttcagaccgaggaagagccgggtggaagggtcgagcgcggttacatgccaaggacgagtcaagtttgaaggtgggcgcctgggtgtgtgccccacaccgcacattctggcgccttgcagagctgcatacccccagccccacccccgccctccctcctcgcgcacccgtggagtcgggactgaccagggcggacccggtggagccatactcggtggtgccatcgctgcaggacccgggactggtcccgacctgcagacgactgagcatcgacatgctgctcccaatcagagttccttatcgtgcatggtctggcaagcacggcatcagctcggcctggagctgcacgtgaaggggagccaggggccgagacggtttgcctcttcttactcgatcgcagactttgagcgttgaacaatcaccaagaagaagaattgttcggatgtagacacgtaaactttgacaatgtcgaggtgtggagcgggaggnnnnnnnnnntaattgttcggatgtagacacgtaaagtttgacaatgtcgaggtgtggagcgggaggggtgcaccgcgtcggagcgatctcacggacaatgtgctgggcgtgctaaggcgacagacatggcaaccgatgagctcagccagtcaaacttcaccttggcatgagcataacgtgcgtttattacatccgaattattcgacagagacggaagaggtcctgcaagtgttcatactggatactcaatgcggtcagaggccgccaaggcctcttatgatgggcaagggggtcaagtggacgccacagtgagctaggctgtacctgacttcagcacacctggacgcacacacgcgagcaggagtacatcgggtacgggggattgcagtgaagaagggcgatgtgcccgaatggtcagtcaggggcaaaagggttggcctgggacggttgtgtaatcagcctgtgcaaatgtgggaagaccacatgtcagagcttactctcgtcgtcaagatctttcttgggtgttgtcaggcggtgctggacagtttattgagggggctgccgctcgtgtcggcctcagcttcctccagagggccccccggggtccgcgccggggggctgctgaggctgcgccagggtccggggccggcggggaacatggccagagaacggcggcggcgggggaatgtgcctgcgctggctcaggctggagcgcaggccctctgatggagaaggtgctgtcggaggtgccgcgcgaggtcgcaaggacgccgggccggtctgggtctggtggctgctgagcgctcaccagtgaagggggatgggagggttgagggccaccgccgtgccagttgccaagggtgacaggggacgcgctggctccacggcgatcaatgcaggtaaaattttgccatagtgaatgcaggtgctgcgcatgtgcacctccgccaccacccacctggtgccagcaccgccttcaccgccaggcgcgccgcccatctgcggcagcgccgcgacctgcgagggcgggaatggggcaacgctcggtcggtctgggcgctgtcttggcatggaggtacatgagaggctacgtagggcgcaggcaggcgggctgcgggcagnnnnnnnnnntgctcggtcagtctgggcgctgtcttggcatagaggcacatgagaggctatgtagggcgcaggcaggcgggctgcgggcagcctggcaccacctcccgccggcaggcccggccctgccccctgcagccgaaagcacacggccgaccctgctcttcgaccccgctgcacccccaacccccacccagctctcaggccattcccccctgcttcccccccgctcaccacggcagctagggcgtcggtcagctcgcgcgactgccgcgtcgaggcgtggccgccctgctgcagcagcgctgtgaggagcccagtcagcacagcatgcacgtcgggctgcacctccacgcccgagcccaggtgccgccccagctcctgcagcgcgcgctgcagcagggcgggccccgccccggg

SEQ ID NO: 28693 - DNA, 61 bp, Chlorella protothecoides
tgctacggaagatgcccttctcctcccttcggagtgaccagcgcgcatttcacggtcactc

SEQ ID NO: 28694 - DNA, 99 bp, Chlorella protothecoides
aaggagggcagcatatcgccccgctgatgggcatgcacctgaagccctgccatgcaaccccccgcgcactgggatgccggccaggactccccagcaacc

SEQ ID NO: 28695 - DNA, 61 bp, Chlorella protothecoides
gtacgacgacctccgtgcatgcgtttcctcgcaacatacttgacatagcagggacaggtga

SEQ ID NO: 28696 - DNA, 123 bp, Chlorella protothecoides
tagagggtgcctaggtacctattgcattagggttgtggagttgccatggactgctcaatcaagggatgggttccccccagaacgtcaatcactcctgacaactgcatgctgtgcactgcaccc

SEQ ID NO: 28697 - DNA, 76 bp, Chlorella protothecoides
gccatccagcttagtttgtccccatcccatttaccatagttacactatcgcactcctcccgcacacagctcatcaa

SEQ ID NO: 28698 - DNA, 409 bp, Chlorella protothecoides
  modified_base (87)..(348): a, c, t, g, unknown or other
cctgtgcaggggatgtctcggtcgggcgttcacccccctccacatgtgccctcctttccattcccacgacgcagcatgttcccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcacatgctccaggagcgttgggggagaaaaagatgcaaggtgcatgtcctgctgcca

SEQ ID NO: 28699 - DNA, 95 bp, Chlorella protothecoides
ccaccctgcgtggtcaccctcgcgccggctgtcgtcgaagcctaacccccgtcgggccccccaccgcagcggcgatcctgtcggcctacgccacc

SEQ ID NO: 28700 - DNA, 144 bp, Chlorella protothecoides
ggcggaggtgctgagctggacactcgagctgggggggcccctgtgctgtgctccgggccagcgctctacctccctgcccgtcaccgagatcctggcggtggagatgcaggcggcccgcatgcgcagggtctggcggtcctggcc

SEQ ID NO: 28701 - DNA, 61 bp, Chlorella protothecoides
ttgataaccctactggtaccgcgtccggaagcccattcactcagcggagcagagccttgtc

SEQ ID NO: 28702 - DNA, 77 bp, Chlorella protothecoides
tgcggctgcggtgtggctcatggatgtcacttggtttgcacccgggaaccagcggaaccccactggccagcttcagg

SEQ ID NO: 28703 - DNA, 89 bp, Chlorella protothecoides
caggcacctgcaggtcttgaacccacccccacccccccaccccttcataaacaacccacaaacatcatgaaatgccatactcacagtag

SEQ ID NO: 28704 - DNA, 61 bp, Chlorella protothecoides
gccatgcactttggataccatgcccgcatgtcgactactggggacagctgagcgtcgccac

SEQ ID NO: 28705 - DNA, 65 bp, Chlorella protothecoides
agctcccagcacagcaaagttgcagactgggagggtgttggggcggaaaagtggatgcaggaggg

SEQ ID NO: 28706 - DNA, 76 bp, Chlorella protothecoides
cttccccaccgccgtgacggcgctggtggcgcgcgtcgaggggccagggggtcggaccccggcctgggcgcagacg

SEQ ID NO: 28707 - DNA, 66 bp, Chlorella protothecoides
tggcgaggggggggcggcgggggatgatggcgacgcggcctccgaaagccagctggacggctcctt

SEQ ID NO: 28708 - DNA, 61 bp, Chlorella protothecoides
gggggagcgaggtgatgggactttggatgagcccgccgagacagtagacgtgtctgccacg

SEQ ID NO: 28709 - DNA, 80 bp, Chlorella protothecoides
gattgttgaggtatggagcttgcaggcgaatgtttgacagaaaggcacaaatcctctggaggtggggctgcttcttcctt

SEQ ID NO: 28710 - DNA, 108 bp, Chlorella protothecoides
gagcccccctgctcttgctcaggaccagtgacctgcctagtaccgttctgcctgtgggataacaatgtggcggggagttaaccatgctgatggatgtgatggtgcgga

SEQ ID NO: 28711 - DNA, 68 bp, Chlorella protothecoides
cgagcgacggcaggtctgggagaggaggggttggggcacgcgggaggggcatgaaagtgctggcccgc

SEQ ID NO: 28712 - DNA, 64 bp, Chlorella protothecoides
gatccaagggagcagagatgcaggtgaggttgcgagctgtgttcagtgtactggcatctgggtc

SEQ ID NO: 28713 - DNA, 61 bp, Chlorella protothecoides
ctggagccaggtggactcagcggatggcggagaggatgcgcagttggcgacgtgggtgaaa

SEQ ID NO: 28714 - DNA, 61 bp, Chlorella protothecoides
ctattgctctgtgcctatacttcccgctagaccttccatacttgacaacgctgcttgcccg

SEQ ID NO: 28715 - DNA, 61 bp, Chlorella protothecoides
cccatccatattttctctgaatgttacatattggaaagtcccgatttggcatgactgtatt

SEQ ID NO: 28716 - DNA, 61 bp, Chlorella protothecoides
gcgccgctgggtggccaagctgtccgactttgggctggcggagctggtggcgaggggccag

SEQ ID NO: 28717 - DNA, 61 bp, Chlorella protothecoides
attctaggcacaccctgggcacggcgggcgggtgcttagagcaaggatcctgcggcaccca

SEQ ID NO: 28718 - DNA, 61 bp, Chlorella protothecoides
cctcactcgagcgagcaggtgtggctgggggtcattgtagccctgcagggccagctccacg

SEQ ID NO: 28719 - DNA, 12419 bp, Chlorella protothecoides
  modified_base (533)..(542): a, c, t, g, unknown or other
  modified_base (724)..(733): a, c, t, g, unknown or other
  modified_base (930)..(939): a, c, t, g, unknown or other
  modified_base (1996)..(2005): a, c, t, g, unknown or other
  modified_base (2635)..(2644): a, c, t, g, unknown or other
  modified_base (3461)..(3470): a, c, t, g, unknown or other
  modified_base (4909)..(4918): a, c, t, g, unknown or other
  modified_base (5106)..(5115): a, c, t, g, unknown or other
  modified_base (5935)..(5944): a, c, t, g, unknown or other
  modified_base (6212)..(6221): a, c, t, g, unknown or other
  modified_base (6966)..(6975): a, c, t, g, unknown or other
  modified_base (7736)..(7745): a, c, t, g, unknown or other
  modified_base (8313)..(8322): a, c, t, g, unknown or other
  modified_base (8441)..(8450): a, c, t, g, unknown or other
  modified_base (8534)..(8543): a, c, t, g, unknown or other
  modified_base (8845)..(8854): a, c, t, g, unknown or other
  modified_base (9288)..(9297): a, c, t, g, unknown or other
  modified_base (9712)..(9904): a, c, t, g, unknown or other
  modified_base (10661)..(10670): a, c, t, g, unknown or other
  modified_base (11212)..(11221): a, c, t, g, unknown or other
  modified_base (11345)..(11354): a, c, t, g, unknown or other
  modified_base (11546)..(11555): a, c, t, g, unknown or other
  modified_base (12079)..(12088): a, c, t, g, unknown or other
  modified_base (12256)..(12286): a, c, t, g, unknown or other
ccccgccccccttttgtgcagccaatgagaagcccaaaacaaaggccgactggagccaggtaccttttagatgtctggttagggccacagatggcaagaggaagataagcacgctcctgtcagagaaggagctggcacgatttcgagactcatacagcaccattctcagggtaggctggtgttttatctgggtatgcagaagcatgcagggcctgatgctcgtcattcgaactatgataccagacgcgatcttccttacgaatctccaaacaggcacatacacatgctctgaagcgaagagagcggactcggggaccaaaggcatgatgtttgttttcactcctttgatcggtgcttaatccactggcttgactgcaaggccaagcacctgcttgacacagaacaaagctctgctgcttttgttgtggaggtgcactggcatgcggacctcgtcgtcctctccaggccgtcgacccagatctcaatccttggatctcaatttgagctccctcatgcttcaatctggctccccnnnnnnnnnnatgcttaatccactggcttgactgcaaggtcaagcacctgcttgatacagaacaaagctgtgctgcttttgttgtggaggtccactggcatgcggacctcgttgtcctctccaggccctcggcccagatctcaatccttggatctcagttcgagctccctcatgcttcaatctggctccccnnnnnnnnnnaatgctgttaagcccacacactaccatgaagcggggggcaccactacggccccctggcgagactgctttccatattacgcggtaactatctcggagaagggatgttgagttaccagtgctacaaatagccttcagctttctctcagaaacggtgtgtgacacttgcttcagaatccttcccagctcgtcgagctgtnnnnnnnnnnctggatcctgtagatgtgccttgttccccagggatagagtcgaagaacttggctcacctgtgcatcgttctgcccgactatgctgttaagcccgacacactaccatgaagcgggggggcatcactacgcccccctggcgagactgctttccatatcacttgggaactatctcggagaagggatgttgagttatcagtgctacaaatagccttcatctttctctcaaaaacggtgtatgacacttggttcagaatccttcccagctcgtcgagctgtgcccatcgagtgcgcgtgcgcgcagagtgcatttcaatcgcgaatgcatcctgtgtcagctaacacacgcataccaccctttgcccgctggctaccacagacccaagccatcattcagctgctgccatgccgaatcgctcaaagtcggcgccgttcagtacacacgcccgaggggtgcctctgttcgacaaaaacaggtttgtggacctgccccgacacctggccagggtgatcttggacttccgggacctctcctcctccatcttctggttcatctcctgccaaacctggtacacgctgcactgcaccctggtcaccatcttcagcagtgagggggaggggactttgtccatggaggagagaaagggtgtacactggggtttgatgtcaggcccgcaagcagctatttcctggcaggttgccatcgtgcaggaagtctgcacttcacattctgaattcctactccccagccccatcccaaacccctccattgcagctgcattctttgcgttcttccagcctagtacacccctctttgcctacctggactggacactcatctgctttgtgatcgtgctgcccctggtgggattcaccttctttgcctatgcgcgcaaggaacgctgcctggatgagctctccaaaggtgcgctgtgctggggtgagggtctgtcaggatttgagactgatttgctgcagcgggggtcgccagaacatcgaaccagatgacttcatcaaggattgcacagtatatctttgctgcagcactgctgaggcaggnnnnnnnnnnactggggtgagggtctgtcagggtttgaaactgatttgctgcagcggtggttgccagagcatcgaacctgatgacttcctcgaggattgcacataatatctttgctgcagcactgctgaggcaggacctctgaacatctcctaacccttccccaccaactctccacgcagtgaagctgctgctcataggaatattcacgacgcatgaggccgagaatgcagtcagcgacaccgcagacggagtgcgggaggccatcttcaccctcatggaggccatgcagcgatatttcctgcccgcccgcttctacagccggtattacccatacatgggcttccggaacgccatggtgggtatggggcttgtcttgtatatgggaagatgagggtgctgggctgcgagggtctccactggggcggggccatccatggtttggggggttgccgctggcctgctgcgctcattcagcctcgacagctttgtggctccctgggatgaatcccccgatgacatgctacacaaacactgagcgagcagtagacctctagcgagcgcctgcctggccgcgaacctctgtccacacccaccatgcgccttgattctccaaaccggctggctacactgcccccaatnnnnnnnnnnccattcagcctcggcagctttgtggctccctggcatgaaccccccgatgacatgctacacaaacactgggcgagcagtagacctctagcgagcgcctgcctggccgcgaccctctgtccaagcccaccatgcaccttgattttccaaaccggctggctacactgccccccatccaacccctcatccctttgcccaccgcagatccagatcgcaatggaccgtgcccagtacgtacgagagagccggggctgcatgcgccagctggaggcggcgacgagggggctgggcaccagtggtgcccagcacccggttctggtggcgcagcagcacgagcgcgtggccgcgctggcctactccctcgagcgcctggccaacgtcaaggagttccggacgccccagggcgcacgcagcgtggcccggctctacgtgggcctcatcatccccatctttttcgggccctactggggctgggtgtccaatcagaccaattttggctttgcctttttcttcagcattgtggtgagggtgcaggcaggggggtgaagggagttgggacaggagagggggagggcatgtgctggcacgcctggcagagtgtggcctgcttgacgacgagctccttcacgccagctgaggctaggcaggatggtgctggatggcactttgcgagtcagctccgcaccaccccacccacccttctccatctcgccagcattgctgccatgtcattcttcatgtataggaacgtattctcaatgtatggactgtcacaggccctgtcgtccccaccctcctctccacccacccacccctcccnnnnnnnnnnctgtattggaacgtattctcaatgtatgggctgtcacaggccctgtcgtcctcaccctcctctccacccacccacccctcccagttggagatggcgcttgtatcagtcttgaacctgagtctggccctggaagacccgttcgacaacctggggatggacggcgtcttcatagatgaagccttgttcgaggtgcagcaggtgctcaacggcgaggatggggcagcgagcgaggccgtgaccgtcgcaggagctgccagccaagtgccaggtgcttcgcacaaagaccctgagacgggggactttgggaatgctcagggcgaggagggcatgctgtaaatggtgtccccagggagcagccgcggggggatgaagagagaactgatggcgggaccagcgcagcgaaggacgacttgtacgaaagaactgacagaggtgcccgtcggagagtatactgctatttcatcatcgatatatccccacctgttttgtgttttgtgtacacccctgtctgtagccatgtctcgggagggaaggagggacagggacgatggaggcggcaagaccaaaatctccctcctggtccgcaacctgcccctggatgccaggttggtttaagcaaaccgatgatcgatacgaatcatgcatgatgttcccgtgcggtgtggagggcgtccggtctccctccccatgaccccatgctcttgccccctcccaggcccgacgaaatccgtgtgaagttcgagaaatacggacgcgtgcgcgatgtctacctcccacgtgagtctctagcatgccttgctcgtaatgtcgccccaccggcgctgctgcggcgtggagcgacggtccgtgttgcccacgagctcactgtgccccctccccatccaccttgcaggcgactactgtgagtagggaacagaggactcatgcccgtgtccaagcacccgccgttgcctcactgtccttaccgtgacgacaccctgcacttgctcagcagtgaccaagtccatgttcagtccaagagatcacgagctgacttgaagtgcccctccatgagcctgtccaagtcgagacgatgctgggtgcatgccccgtccaaccccaagcacgagcccctggagcagaccctcccagcccctgcttggcgcacgcctgatggaagttcccctccctgcaaagcacagactctggtcgccccaaaggctttgggttcgtggagttcctggacgtgagggaggcggacgacgccatctaccacctggaccgcaccgacttcatgggccgcgagatcaccgtcatccacagccgggagtcgcgcaagacgcccaacgacatgcttgcgcgcgagagtgagtcctggaccgtggcggggcctggtgtgggtgactgcgtggagatggctgtcgggacgcggaggaggtgggcgggcgggtcccactccnnnnnnnnnncgcgtggagacggctgtggggacacggaggaggtgggcgggcgggtcccactccccgcacctctggctccctcttcatcctgctgccatcgacctccctgcaccccccgccgtccacccacgccaccccactcgtcccaggggatgcccctcctcgcggcggtagcgactatggccgccggggcggcnnnnnnnnnnagctccctcttcatcctgctgcgattgacctctctacaccccacgccgttcacccacgccaccccacccgtcccaggggatgcccctcctcgtggcggtagcgactatggccgccggggcggccgctcccggagccgcagcccctcccgcgacaggaggcggcgccgatccccaagccgctcccgctccggcgaccggcgccacggccgctcccgctcccggtctcctggcagggatgggcgcaggcggtccagccgccgcagccccagccgaagcccggtgaggacgcggtcgccgccgaggcctcgatcccgctcacccgctcaccggtcgagccggagatccctgtccaggtgaagcaggggagtgaaccgtgagcgcgctccttccccgcccctcccatgaactgatgctgggtgctggtgccactccttggctgcggttggccctcacagcaccacaatgcaccttcctgacacaggggaaggagcccgaggtcacgctcacccccgccccgcatggcatcccgctcgcccaaggcctccccaccagcccggtcagcatcccggtcgccggcacctgggtcgccccgggccacaaggtcggcctcccccgcccgctcggcatcaccctcgccgaagcccatgtctgacgatgcctgacctgacaagaatgcttgcaagaaactgtaaaacggctgtgggacgtggataggacattttgtagtgcaggtactggtggggtccaaggagggggggaaatgtagtatcctgagccataaaaatatatttgtttaactctgtcgcaatgacttcagtannnnnnnnnnactgacaagaatgcttgcaagaaactgtaatacggctgggggacgtggataggacattttggaagggacatactggtggggtccaaggagagggggaaatgtatcatcctgagccccgcgcgcgaaaaccgggcatgatgccggcatgtaaaacacaatgcaccggtgccatgactatcagtacatgcatttgcaatttccaaaatacacacagggacaggattggctgggatggagaaggcggttcgcttgatgcaacctatcaccnnnnnnnnnnaaggggatgggcggagtgtcatgtaggcggggttttcaggtttgcaggactccattagaggctgcccattgcacggatgcgtctatccctcggcagcaaactcaacaccttccctttctctatgatgcagggaatgccgcgccactccctagctccacctgttgggtggattgtgcatatcagtgatccgtagatggctaacggccatggaagcattgatgcagccggtcccatcgcccgcagttccctaggaactgctgtgcagtttgggttaaagactccggtggaggaatcatagtggattatggcagcacgtgccacccctccctgagcctggggcgaaaccggcatgatgccggaaagtaaacacacaccccggtgccatggcttgactattaatacatgcattgcaattccaatacacagagacaagatttgctgggatggaaaaggcggttcgcttgatgcaacctatcacccgaagcccggcggtacacctctgcttccgagccgcccgccccgccatgggccgagccttggcatctttgggcaccagacgtaccttcaaggtgttttcaatggctcaggaggatgaaggcgcctggatggtcgtgggcctgggcaacccgggccaaaaatatcatggcacacgacacaatgtgggttcggtggctgactcttcagagaaaatgcactgtattttgaggagcagactcgttcagaagatgttgccgtccattcatannnnnnnnnnagactctccagggacaatgcactgtattttgaggagcagaatcgttcagaagatgttgccgtccattcataccaattcgctttgatgtggactgggatgtgagcagcatctgcagtgcctctgtgaccaggacttgcaccgcgattcagcttgttgggactcaagggcccccatcaccttgcacacctgtgcacgcagatcgggtttgcgctggtagacagcctggccatgtccgagggcatctccatggacaagcagcaggagaaggcggctgtgggccggggcaccctggccggccgcagcgtcatgctcgtgaagccccagaccttcatgaaccgcagcggacagagcgtgggcgccctcgcgaggtactacaaggtgccgctggagcgcgtcctggtcgtcgccgacgacctggacacgccgctgggcgcgctgcgcctgagagccaagggcagcaacgcggggcacaacggcatgcgcagcgtgcagagcgcgatgggggggtccaccgccttcccgcgcctgcgcctgggcataggccgccccgccggcggccgcgatgtcgccgactttgtgctgcaggtaggcgcggcaggagcggcggggggggcggggcctgggggttggacccgcattcctgtgcggatgttgttgacactgtggtggggccgttgtttttcaaccaccccggcccggtaccagcctccgtgctcccatagacgctgaagagggaatcgagcctcgacctgcgtacctcnnnnnnnnnntcggggcgggggtttggacacacattcctgtgcggatgttgttgacactgtggtggggccgctgtttttcaaccaccccggcccggttccagctccgtgctcccatagacgctgaggagggaatcgagcctcgacctgcgtacctcttccccacccacccctcctctgcagcccttctcgcggcaagaaagggaggtggccgaggtgggcctggcagaggcggtggacgtggtacgggcggtgctgaccctgggcttacaaaaggccatctcgggggtccgggtcgacgcccaggggaagcagtatgccgtgcaggccccgcccaaagcgaccggcaccaagaggaaggcaggcacgggcgaggcggaggcagcatcgagcacgccgccggaagccgtcgcgcaagtctgaccgcagtcttccctgccacgcctggcctcagttttcccttcagcaatacatcgtgcatatgccggcttgtacaacatgtgcagggcaaggatgacaatcagtcaagcggtttggggggaatggtgtgcagtggggatggcaggggccaggcttggcnnnnnnnnnntgtcgcgcaagtctgaccgcagtcctccctgtcacgcctggcctcagttttctcttcagcaatacatcgtgcatatcccggcttgtaaaacatgtgcagggcaaggatgacaatcagtnnnnnnnnnncaggcgtcgtgtgtcagggctcagcctcctcgccccacccctcgtctcgatcctgctccagcactcccgcgatgcgctgtttcnnnnnnnnnngaggcgtcgtgtgtcagggctcagcgtcctcgccccacccctcgtctcgatcttgctccagcactcccgcgatgcgctgtttcaggttgatcttcagctcccgcggcctgacccagggccccggcaggagggccgccagcccgctaggctcctccggctctgcaaatagaaaggaggagggcaggggtggcggccagggaggaggatgcggagcaatggtgcacagatgggtgtggctgccctgcgctccccgcttcctgtagcaaagacaccctcccagtccctccccaccttcccagggnnnnnnnnnntaatagaaaaggaggagggcaggggtggccgccagggaggagggtgtggagcgctggtgcaaagatgggtgtggctgccctgcgcgccccgcttcctgtagcaaagagcccctcccagtccctccccaccttcccagggctgcagctcgtccacctcccagaccacgaccttgcggggcggggctgcttgggcacgctgctgctgccgccaccgcgccgcctgggcatgggaaatagggtgggggtgcagcagtggtgggcctcgatttgtcaggcgctggcgccgggagaaggcacccatggtgcgcagtgtgcatcagcggagacgcaacgagctgcgcgggccactccgacccgcaaaacaccatggacaggcgccatcgaccaccatgccatccaccacccctggctcaccgcgggggggaggtcgaggnnnnnnnnnntggcgctggcgattggagaaggcatccatggcgcgcagtgtacatcagcggagacgcaacaagctgcgcgggtcactccgccccgcaaaacaccatggacaagcgccatcgaccaccatcctatccaccatccctggctcaccgcgggggggaggtcgagggaggccgccatgagggcatccgacaggtcatcgcccacggtgatgcgctgcgcgggctgcgagtctgccggcgcaggggacggcggcgcggggggctgcgccggcacggccggtccgtcgttccctcgtgccacctggactcggggcgcaggtcggtccgccgtcggagcggccctcgcgggcgcggcgggccgctgccgcggggccggagtgggccgctcggcacggtgcgcgctcggcgccgccctcccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgcgcctcgcccccagcctcctgcttgccgccccgacgtgcctgcggggtgccccccgccagcgccgacagcatgttccagctcccggcgtccagccgcttggcccccgccgccgcggcgcgggcgccggcgggggagggcggggccgcgcctcgccggtcgggggtcagcacgggggaggaggagatgctgggctggtagccgtcgtcgccagcatccaggtcctgcaccccccccgccgcctcggcgtcgtgcagggcgagcaaggtggcctccagcctcaccacgcctggcgagggttttgtgtgtggcacagtggcctgccctggtgtcgcagccaggagcagacccactcacaggcatcgtcctgcctcccccaaacctcctgcgccgggtactgcaggcattccatacaccccgcacctccagcagcctcgccgggtgagtgggcagcggcctcgacctccacacacaggaccaggtcgcggcagccgggacccgccagctgcgacagggcgcccgccgccgcctgcgcggccatgcgctccgctgcctgcgcaggcgtcgagcatcgaggtggtgtgccgtgcacggcgccggcatcgcgtgacatgccggtaccaatgccgaccgatcctcgcagccagcgtcccccgggacctcgatcagagcatgcccggcccagagtccgaggccaagcctcctccccctcaagaaaccggcaccttgtgctgctgcagcgcacgctcgctgnnnnnnnnnngcacagtggcctggctggtgtcgcagccaggagcagactcactcacaagcatcgtcctgcctccccaaacctcgagcgccgggtattgcaggcatgccatgcaccccgcacctcgagcagcatcgccaggtgagtgggcagcggcctcgacctccacacacaggaccaggtcgcggcagccgggacccgccagctgcgacagggcgcccgccgccgcctgcgcggccatgcgctccgctgcctgcgcaggcgtcgagcatcgaggtggtgtgccgtgcacggcgccggcatcgcgtgacatgccggtaccactgccgaccgatcctcgcatccagcgtcccttgggacctcgatcagtgcatgtctggcccagagttcgaggccaagcctccttcccctcagaagccggtaccttgtgctgctgcagcgcacgctcgctgccgacgtcgacgcccagggccaggggaccgggcagcgtgaggcagcacagcacgccccgagtgtcacccaacaccccgtccaggaagggggagtcggccgcnnnnnnnnnngcggcgcgcctggcccagcaatgcaccaagaggtcacctccccacaccaggaagacgacaccccccccgcacaccttggccggggagaggcgcgaggtctcgctggggggcatgcaggcctggnnnnnnnnnntaggcagcgtgaggcagcacagcacgccccgcgtgtcacccagcaccccgtccaggaagggggagtcggccgcggcgcgcactgcatctgtggccaggtgcatcagcgcctgcgcgtgccatgggatggagctgggcgagcacctggaagggagtttactcgcagcacagcccttttgcctgcctcggggcnnnnnnnnnnagtgccatgggatggagctgggcgagcacccggagggcagtttacttgcagcacagcccttttgcctgcctcggggcgagcaaaccccgagtcctctacccggctgtggctggccccaccattccactcgacccaggcactgcgcgctcggcccagcaatgcaccgagaggtcaccacctcctcacaccaggaagacgacaccccccccacacacacaccttggccggggagaggcgtgaggtctcgctggggggcatgcaggcctggccccgccccgtcagggcaaagcccggccgcgtcagcagctgctgcaggggtggcgagaggaggcgcttgaagtggcgcagctcgcggccgtgccacatcagcgccccgcgctgcgacttcaggatctcccggctctgggaacgggcgaggcgtgggtggggcgcgcttgactcggtgtgttcggctgatcggtggtgttcggctgatcggtggtctccgtcgggagcgccacacactgcacaggtgaacaaagccnnnnnnnnnngctcggtgtgttcggctgatcggtggtctccgtcaggcgcgccacacactgcacaggtgaacaaagccgcgccgatcgcgtcagcgccccgcactcctttgccgcgcccaggccggggttcgacatcgctgtgcgcccggggaccctccccccctccccccccacccnnnnnnnnnnnnnnnnnnnnnnnnnnnnnnntgcagcacgccgcgcacggcgtgctccagcgccaggtcggcgatctccgtggcctgcgccacggtcaccgcggcgccgccgccccaggcctgcatcagcacctcctggtccaccagcgcgaccaggtgcgccg

SEQ ID NO: 28720 - DNA, 74 bp, Chlorella protothecoides
cctgcaccgcggcgtggcgggcgcgcgccacgtcttccaggcgttggagccggggacggacaagatggcggcgc

SEQ ID NO: 28721 - DNA, 123 bp, Chlorella protothecoides
tgctgtgacaatgacttcaagttgtgtaaagcctgcagtgccttgatgttcccgcaacatacttcagcacccccccccccaaactcaataaacgcccaggtatgtcggcgtcatgcacatgga

SEQ ID NO: 28722 - DNA, 75 bp, Chlorella protothecoides
acttggacttgcaaagggaggatcacatctctcgaaatccctcggttgaaccccttttcgccccctcccactcat

SEQ ID NO: 28723 - DNA, 111 bp, Chlorella protothecoides
cgcgtgtttgagcccgcaagcttgccggagtcagggggcacgcaacccatcgcatctccctccctccccctgtcgtagtcgaatgtcgagacctggagccctgcagtggga

SEQ ID NO: 28724 - DNA, 77 bp, Chlorella protothecoides
acatcctcattctcgcatcaagaaggagtcacaaccagccgtgtacgcgccagttctacaccccagcgtctaccttg

SEQ ID NO: 28725 - DNA, 61 bp, Chlorella protothecoides
cctcaaaactcctcatatgtgtcctgccccttccccatcacaggcaccactcccgtgcacg

SEQ ID NO: 28726 - DNA, 66 bp, Chlorella protothecoides
tgagcgcgtgtgaacgagcggggtgtaggtcttggtcgggaacgacttcatgcacctgccccaccc

SEQ ID NO: 28727 - DNA, 61 bp, Chlorella protothecoides
atgggtggagccacctctgtgtggcatggggcctggagcgttcagccccatggggcttccc

SEQ ID NO: 28728 - DNA, 6376 bp, Chlorella protothecoides
  modified_base (96)..(105): a, c, t, g, unknown or other
  modified_base (1063)..(1072): a, c, t, g, unknown or other
  modified_base (1410)..(1419): a, c, t, g, unknown or other
  modified_base (3084)..(3093): a, c, t, g, unknown or other
  modified_base (3667)..(3676): a, c, t, g, unknown or other
  modified_base (3930)..(3939): a, c, t, g, unknown or other
  modified_base (4149)..(4158): a, c, t, g, unknown or other
  modified_base (4257)..(4266): a, c, t, g, unknown or other
  modified_base (4667)..(4676): a, c, t, g, unknown or other
  modified_base (4903)..(4912): a, c, t, g, unknown or other
gactcctccccccgccctttcccgtcctgcaaccatcagctcctttgccaagatactaattgtgacaacccactgctccttttcccccattcccannnnnnnnnntaccatcagctcctttgccaagctactatgtgtggcaacccactgctccttttcccccattcccagtccggtaccggtactcctgcctgatggacgctgccaacatctgggcgccagagggcctgccgtctggcttcgactatgtcctctccacagccaagggcccctctgtgatgctgatcgagacgtggtgagtggccaaagaaagggcgccctgccgtgacggtggggatgcatcatcgttcggtggaccaagtccccccattgcccccccccttcccatcaccacctctgcaggtggggccagaatcggtacagctcggagaaggatgacttcatcaaccaggctctgcaccagcgggtccagctggccctggcgcagaacatcaccatcataatccccgccggcatcggcctgtgccccatctgcgagaacatccttgccgcccaccccaacatcatcacggtccagggtgtggacgtgcgtgatcagctgagcagctttgccgagtcaaactcctcctgcctcagcctgctggcgccggggggcggcatgggcaacggggtgctgggcgccatggcccagggcaacctcaccaccatcctgcctcagtgagttaagaagggtgaagaggggctcgaacagggtcagggtttggtgttggcagggagttgcaggttgtcggtggccatggatgagtgggggggcatgtgagggcgggaaaaggaatgtgagtggttttggagcaagaggacgtggcgaggtcggcagctgggggtcgggacttgcagcgagctcgaatgcataggggggctccagagcatttgatctgacactgcccatgcactccccatgcagtgctcctgggcactgaatcaagattatgttccacctcccccctccccctcccacaccatagggccttcggagcggcgtccctggtggccggcctggcgnnnnnnnnnngaagaatggtggaggggggctcggactgggtcagggttcggtattggcagggaggtgcaggttgtcggtggccatggatgacagggggcccatgtgagggcgggaagaggaaggtgactggtgttggagcaaaagaacgtggcgaggtcggcagctgggtcgggacttgcagcgagctcgagtgcctatggggggcccagagcattcgatctgacgctgcccatgcgctccccatgcagtgctcctgggcactgaatcaagattgtattccacctcccccctccacctcccacaccatagggcctttggagcggcgtccctggtggccggcctggcgnnnnnnnnnngccgctacgccggcccaggtcaagcgtgcgctgctggcggccgccacgcgggaccgggtgctgctggcggggtcggaggcgcacaaccgcctggcgtacaccgacctgaccttcaacgccaccgtacccgactccggcgcggggccgggcggggagggcgggggcgggggcggcctttccacgcccgccatcctgggcctggcgctgccgttgggcgcgctcctgctcctggccgtgggcgggggcctgtgttacggctgggcgcggctggcgtctcggcgcggcgcggcactggtggcccaccgcctggacggcgagtgggagatcgcggagaagcgcatcaagctggtgcgccgcgccgacggcgagccctggcagctgggccacggctcccacggcccgctgtacaaggcggtgaaggacggggtgcaggtggtggcggtgcggccgctacggtgcgggggggagggcgcggagcacgagcgctgcgtgcgcgagatcgcgatgatgcgcttcctgtcgcgcgacgccaacatcacccagttttacggcgcggtggtgggcgcgcagagcctgaccctggtggccgagttcatggcgggcggcgacctgcgcgccgccatcgacgccgacgcgcgcgggcggctggcctggtgggcggggggcaagggcgtggcactggacgtcacgcgcggcctgcacttcctgcacaccctgcgcgttgcgcaccgcgacgtcaagtccggcagcgtcctgctcacgcgcgacggccgcgctaagctgagcgatgtgggcatggcgcgggtggtgggggagcaggcccccgatgatggcttcgtggggacccaggcctgggccgccccggagctgctggcggggcaggcctatgacgaacgcgtggacatctggtccctgggcacgctgctgtgggagatcgtcacgcgggaggtgcccatgcgcggcatgctgcgcccgccgctggtccccgaggagtgcccgcaggaggtggccgacgtcatcgccgcatgcatgcagcgcgaccccgctcgccgccccgacgcccacaccgtctacaccctgctcctggaggcggagccggcgacgggggccgaggcggcgggcgcggcgccggacgcctaccccggcagcggctccgtcaccgactgctcttcggtgggcacgccgcggggcggcacggcgccctccccgctcagcgtgatcagcaacagcttgtccctggccgagcccctgcgctggtcggccacaccgaccggctccagggcgcagagcaaggggtcggcggtgcaccccgtcagcccccagctccgctgcatggtggaccagatccagcgacgcttccgacatcacgaggccatggcggcggcgcgcgccgaggccgtcagcccgcgcttccccagcccctttgaggagcaggcgggccccacgcccgtgaggaacgtgttcggtcggccctctgcggggaccggcttcgtgtgacggtgaggaccatgagacgtgctgacttgttggcggtgaggggatgggaagggcatggggagacggatgctcacgatggtggtgtcctctgactcgcaccgagttccaggaggatgtgcaagaaacttgatcccccctgatctggctgcagcgcgggggcgagatctnnnnnnnnnnatgtcctctgactcgcaccgagttctaagaggatgtgcaagaaacttgatcccccttgatctggctgcagcgcgggggcgagatctgatgcagcagagcaggctggaaggaaagcagacaagggagtagacacacctcgctcccgcaatctggcttggacacatggccagctctccgtgtggaaagtctggctgaggagtccatggcacccaggtggtgaggtggcgggcgcgattattgacagaggggcccgctggctctcgttgcctgctcagagggcatgctcgatgtcagtcagcaccacccttgctccccgcccaacaggcggcccccaccatgccgtcttccctggagtggccacgccaagtgatggtcgtccctgggctccaagcaccttgacaatgagatctgtgctccagagttaagctgcacggcccgcaccgggcggcacaaaacccctgcctctcatccgcattgggtgcccagcatagtgagcaggagtccagcaaccatgtatcggtcagaaattgggatttcccacgaaatcccagagtgcctctgacgcacaggtgannnnnnnnnnggtccagcaaccatggatcggtcagggattgggatttccgacggaatcccagagtgcctctgacgcacaggtgattgtgcttctgttgcaaacaaatgtactttggattgctgatgtcctcacccctgttttcgcatgttccagctgcagcaacacaataagcagttgaacatctcaaattcgttgctttccctgcagccgtatgcatccttcaaataacccctctcaatctcaacatcttctgtggagtagtnnnnnnnnnntagctgcagcagcacaataagcagttgaacatctcatattcgttgctttccatgcagccgtgtgcattccttcaaataacccttctcaatctcaacatcttctgtggagtagttttccttgatgcctccttcccgccctgggcacatgcccttgtaagttcattgtttgtgagacaggagaggggtgcatctgaagccgtgttggcctcnnnnnnnnnnatgatatttgctgctgtgcttttccatcttctgctcctgtgtgtagtttgtgagatttctgttcggagagcctctcgcaccacaccaatatagggtttnnnnnnnnnngcctgggcacatgcccttgtaagttcatcgtttttgagacaagggaggggtgcatctgaagccgtgttggcctcatgccaacgagccaccaaagtggttcctggggcggtggtacccaaaagtgactatcatcctatcctggtgatatctgctgccgtgattttccatcttctgctcctgtgtatagtttgtgagatttctgttcggaaagcctctcgcaccacaccaatatagggtttggatgtgcgcattgttagctcgctgctttctaacgccgggaccccctggtgtgatcggcggtgcaaagcactcgctatggttcctataagagtggtcaactggaaccaccattatttctgcgcggttcagtcagcttgtttgctgtggtttcattcatgtgnnnnnnnnnnggtggtcaactgaacccatcattatttctgcgcgggtcagccagcttgtttgctgtggtttcattcatgtgccgcctcgcgttccgcgctcgctgatgctccgcgcagcagctgcgctcccactgaagcacacgcgtatagcggcgctacgtacaccatacgagtcgcaacacctccctactcattcctgtgaaaggggagggtgcgcaggcaagacattctcggtnnnnnnnnnncgatgctccgcgcagcagctgcgctcccaatgaagcacacgcgtatagcggcgctatgtacaccatacgagtcgcagcacctcccttctcaatcctgtgaaaagggagggtgcgcaggcaagacattctcggtgcatggcccagtaggaaagaacgaacatcgtacagtcagtcggggggggaaccctcagcagccacctcctggctctcacacataaacctggaccaattgctgagagctaagatgttgaaagaggaaacggttcacaccaagcattagatatcacagggactccggtcatacttgttctgtcgaagcgctagtagattctttagacacacgtggcacgtatagcgcgaggggggcaacctcgttcctcgagaggaaggtagcgatgaaggcagcttggcgggcaccggtcaaggcgcggcccgcgaatcctggtgcataatcgatgtaatgttttcaccttcctaattctcgctctcgagagtacggtgaggtgaaagttaccgagcaggcaggagccagcggctggaggtcgcccaaaacactgccctcatgcgggcgggggtctggctcctcgtggtctgctttcttgggccctcaatcctctctgaggctcagacgggtgccaacggatttcggaacaacccctcagagacgacatggagctccgagcctgttgccgcgcaacagcggtgggaagccattatcaagtgagccttgcctctcgcagtggataaatgggcctcgaatgcatggatcattatgtatgctgacagcctccgtcctgaatccgcttgtgcagtgagacggggggggtactggccctgcatgaggctctcatcgtccggctctcgggcccgggagtggtgcccttcacgctggacacccaagccatcctggccaaggccttccagcaggtcgtcattcccaacctgggtaagtggcattactcggtatctgttgccgaggcgcgccccacgcatgacggcgtcgcggtagaggttactgccggacgggttggtctgggtcggcgcgatgcatgttctgggcagcttatatcgggggcataatgttcacaggctgagtcaccgccagcaattgacgcttttcgactctctccctccttgccccaggtcccgtggagattgtcagctacaggtatgtgcaggattgggagaagggggtgtggggtgtgggggggatggggagggagcgggagcgggagcgggagcagcatgcctgccaggaacaagggaggagctgatgacccaagctggcccctgtctgtcagacagcttcccttgcgctggtgtatctggtcacaacagtggctattgcccgtggcctcgagatgctgcctcaagtagggtggcacgcatctcatgcagccaaccccccctcactcccctgttcctcccaatcgcgccagggagaactaccccaagcccggctac

SEQ ID NO: 28729 - DNA, 253 bp, Chlorella protothecoides
ggaggacacaagatctttggcttgtggataatagttctgggaatgtatgatgccccatggtatgcgactttgtgtgacaatcacctgaacatggcgttgtccggaggttttgcttggctgtggcagtttcacagcagggattgtccctgacaacccccgactacatgcatcctctaccaggaaaactcagtaagctcatgaggtggggagcttccatgcaggcccaagaatcgagctttcgtgatagctagtc

SEQ ID NO: 28730 - DNA, 97 bp, Chlorella protothecoides
gggcggggccgcggccccatccacgggcgtgtccccgggcgccagcagcgtgtcccccgccgggtcccccggcgccagcgccacgccggggacgagc

SEQ ID NO: 28731 - DNA, 61 bp, Chlorella protothecoides
gcgtccaaagttccctcttctgtttacctcacccgcctttaccgttgcacagaggccagcc

SEQ ID NO: 28732 - DNA, 77 bp, Chlorella protothecoides
gaccttcagacctgggtgaaccagacccctattctgatcccccccccctctacacacacacgcacacacacacacaa

SEQ ID NO: 28733 - DNA, 80 bp, Chlorella protothecoides
tgtgttcaacaaacttgcacataccatccacagaattcattgctctgtatccaaagaaaactacctgagccgtccaaccg

SEQ ID NO: 28734 - DNA, 61 bp, Chlorella protothecoides
ggtgcaagatgttcctgggctgtgaccgtcgggaggtgtgtacagacccttgacctacggc

SEQ ID NO: 28735 - DNA, 61 bp, Chlorella protothecoides
tgtgctggctgtcttgtgggttgggcccctctgggaaagggggcttgaggagggggggggg

SEQ ID NO: 28736 - DNA, 78 bp, Chlorella protothecoides
accagtgctcctgtgagccatgacaggtcggtttaagttgaatctgaagaaacaacaatacatgcacgtccgcttata

SEQ ID NO: 28737 - DNA, 6592 bp, Chlorella protothecoides
  modified_base (561)..(570): a, c, t, g, unknown or other
  modified_base (801)..(865): a, c, t, g, unknown or other
  modified_base (1492)..(1501): a, c, t, g, unknown or other
  modified_base (1820)..(1829): a, c, t, g, unknown or other
  modified_base (2265)..(2274): a, c, t, g, unknown or other
  modified_base (3176)..(3185): a, c, t, g, unknown or other
  modified_base (5014)..(5023): a, c, t, g, unknown or other
  modified_base (5504)..(5513): a, c, t, g, unknown or other
  modified_base (5949)..(5958): a, c, t, g, unknown or other
cggcgcgcgccgcggcgcccgcgtcggcgcccgccgcgcgcgcggccaggaccaggagcggcatgagcgcaaagagcaggccgaccatgcagtcctggatgaccagggtgcccaccacgatctgcccgctggcgctgtgctggcagcgccggtccgataggcacttgaccacgatgctggtgctgctcatgcccgccagcgcgccgacaaaggcgcccagggagggggaggtgccgatggcggcagccacgccggccgacaggccggagaggagggccacctgcagcgcgccgcccagcagcgccacgtcgcgcacagcgcgcagcttggccagcgagaactccaggcccaggctgaagagcaggagctggacccccagctgggccagggactggacctggatacagaggatttggaggggggaagcgatcatgggtgtgaaggagagggggggggcttgggcgactgcgagcagtagcagggggcggggggaagggcccacaacttggggctgaaggaaggaggaacgtcgcacaggaggcagcgctgggacgccgaccnnnnnnnnnnctgggcggctgcaggcagtagcagggggcggggctgggtgactttgggcagtagcagggggcggggggaagagcccacaatttggggctgaaggaaggatgaacgccgcacaggaggcagcgctgggacgccgacctctccgccagctcacagggtcatgcatatcccatgcagcacgagctcctgcctcttcacccgagcagcgcccccgacctccaccctccaaaccannnnnnnnnnnnnnnnnnnnnnnnnnnnnnnnnnnnnnnnnnnnnnnnnnnnnnnnnnnnnnnnnttgagggcccccggccccaccaccgaccctgcgatgaagtagccgttgatggtgggctgccccaccgcctccatggccatgcccatcatcgcgcaagcggcgatgagcacggtcaggtccttgaccagacgcgggtcgagggtgatgcccatgccgccctcctccccggccttggagaggacatactcgttgtctttgctgtcgatgatgcggtcgacgtcgccctcgcccccggtggccgcggcggcggccgcctcccgggccttggccgccgcggccaaccgcgccgcctcgtcggcgctgacgccggcgccggccttgctggcgtcagcggcggtggcattgccctgggcgcctgtctcctctgcggtcgcgttggcgtgcgactggtggtccttcttggaggagatgattatcaccgtctgttcggtggcctgcaggggggaggtggtgcggtggtgcctgggtgcagggcggcaggaccagtgaatggcacatcgtatggcgtgatcgagtgtgagggacggagaatttacaagtgggaaggctcctcgttcatccagtgcgtccatcgccttccctcaacccatcccgcaacaccagcccaatccatcctcacgtcgccgnnnnnnnnnnacgtcgccttccctcgatccaccccgcgacaccagcccaatccatcctcacgtcgccggcctgcgcggttttgttgtattcgctgccctgctctgcgctcttctcctcctcgtgcttgaactcctcccgcagagcctcatccaggatctgcagggaggggctcggaaaagatggccgtgggcatctccatccctagattgaggaggaaccccaatgacagtcccaacccacgagctccagccgaatatcagcgcctatcggcccgtcctcacatgtgcaatggtgtccttgtgcttctccgtcccgttgccagccgtgnnnnnnnnnncatcagccgtcctcacatgtgcaatggtgtctttgtgcttctccgtcccgttgccagccgtggtgttgagtatcagggctttcgtgtccgggattcccgggaccgtggcaccggcctggaggagtgtacgactcaccagaggccctcccgcggcgcacgagtctacgcagagatacagcagaaccaggatggggatgtggtgccaccgggtggtggctctccgagccatgaaagccacgagtcctacgacgacacactcccagggctgctccaaaagatggtcgggcccgctcgcatcccggctgcgtgcctcacaccgctaggcacatacatcgttgtgtgatttgcaatacgcgagaattgtagttgcagtctgggctgggatcccacaccatgcacgaatgcagtgtggttattcgaaggtgcggtacagtgnnnnnnnnnngatgcacatacatcgttgtgtgatttgcaaacgcgagaattgtagtcgcagtctgggctgaggttccacacccatgcacgaatgtagtgtggttattcgaaggtgcggtacagtggaaaggacgcattgcctgggaccgagtggagtccttctctgcccatccttgcatcctgggcctgtgggtctgttgcagtcaaagagtcggtcatcagacaggaatgcatcatgggtgggtaccgaggtcactcgggcgctggctcgccggtcagggcggtaaagcgcttccgcgaagatttcttgctgtgaccaaagtgctcggcgatgcgggaccacttcaggtgcttcttgcccagcacctgtggaaatcgacaggtggaggtgggtcgcgggtggctgctggcatctgtctgacttgagtgtgggcagcgtatcagagtttgcacttgccatggccctggctttggggcgggaacctcaccaccctgccaggcctcaccaggcctcacctccttgcggtacccctcctcgcgcacgaggcgctgcagctccaggtcctgggcggctgtccaggcaccccctggggtcgttgggggcgccgagtctggagcaggggtgtcggcgggagcagctggacctggggtctgagcctctgcagtgtccgcttggaccttggccttctttgcccgaggaccagacgcaggacctgcgaagaggtagaatgaaggcacaaggaggggcttagagacactctctgcatgtgagagggtctcacacaggctgcagaagaataatggacacgcacctacgctccagttgatacacctcgcaccagggtcattcaccaccattccacacataataaatcatgttgtcccggtatcagggtggtacctggtgtggtnnnnnnnnnngtaatggacacgcacctacgctgcagctgatgcaactcgcaccagggtcattcaccaccgttccacacataataaatcatgttctcccggtatcagggtggtacctggtgtggttgagacgggtccagaagcacctggggctttgtctccagagagggctgcgtagtgtgccttgacttgtgacccaccagacgcatcaaagaggcgggcaatagctgcatagtttgggttgagcccatggttggcatacttctcgcctgcgtggcgggaggaacagtggtgccataggtgacgtcggtcgatgctgatgctggttgatggcaagaggacccggcaggatcatatgcaagcagcagactgtgggaagctttcacctccatggcatgtgcttgcaaccaccccttcccctcctgttcttattcaacagcccacgcaccaagcttctcgatgcggtactccttgtcctcaatcagcttgacgagttcagcactctgctcctcggtccagaccatctttggtcgccgtaccttgcggggcaggtcgctcgcctcggcctcggccttggccttcgcggtcatcctgggttttgtacccggagtccccttgatgaccttgtgccaggcttctggttcaggggctggcagcgtcttcatcagggaccaaatctcggagaccgcctcgggcacggtcgtattcctcccccgtgcggaggccaccaggtgcatgctcagatagtagaaaaggttgctcccatactctgccaactccgcctccgaggtgggaagcgtgtcggatgccatcaaggcgtgtgatgagtccctgttcccaagctggaagtgcgaaaggcggggtactgggtgactatgggccaggcacgcacgggcttgtccctcacagctaagggttggtgcaggaaggtccggtaggactctgatatcttggtacagaattattggatggcaagatccagcaatgtgcgaagtagaagcatgagcaatcctcctcgtctgttggccccctcccacgatggctcgggcgctcgaacggattgggggccacgaattcacaggtagcaaggatgtgctcataatccgtgttcaccaccatcggtggcgctggttggaaacctaaaaattcatacacaactacatcctacggtttgataaattactttgggaaatacagggctaatcctccaccatactcaattcgcgaccatcgtctcgccagctgtcctcaactacagttgtcacccttcggttatactccttcctgtgcaggtgagtgccgtggcatcccttagtatcttgttcttggcaggtgcaatatcagaaggggggaaaggactcatgccatacatactgacaatagaattctcacctatcctccacataaagtttggcagcttcagagttggcgggcgagtttggattggggtctgacagcagtgactgcagggcgggttagcgggggccggaagattcaatttgctgctgatctctaaggagcgaaaagtttgtaaagtaatgctgcgaccagcatcaatacaagaaagtacaagtcaatcgggtccactcacctgaatggaggtcaagatggccgagacatcgtaaatgggactccactggttctgtaagatgtccaaacagatgctcccatcagcatatactgcatgagcaaaacaggagaagggatttgtgatatgatgctgctagcgcgtccgcaggacgatggcatacactgcttgcctcgatgccactcactgttcgggtgatacattggcgtcttgaacttcacgatgggggccttgttgggatagtcctctgagnnnnnnnnnntgggtgatacattggcgtcttgaacttcacaatgggggccttgttgggatagtcctctgagaacgctaatgtcaggaggaagacacctgggatgacacggtggaggctaaaattgaggccccacccgggaggggtctggaagcagcacccactctccaggtttggccctcacctccatcccagaccgttccctccggtccaaagatgactgctcgccagttcatgatgttgtctgacctaggcgaggcgttcactccctccggcgggtcctgctgaagacctgcatggagaacgggtgcactcggtattgagaggcgcagaggtcccgtgtcaaagaaggagaaggctataacatccctgtaagtaaacctcacgtttaaaatcgcgcatcaaccgcttcctcgccggtgtggtcatagtagctttaccggggtgcagtgacacagactgctcgaagtaaagagggcaagtctctgaatgnnnnnnnnnngaggagaaggctataacatccatataagtacatctcacgcttaaaatcgcgcatcaatcgtttcctcgccggtgtggtcatagtagctgtgccggggtgcagtgacacaggctactcgaagtaaagagggcaagtctctgaatgaatcaccgccaccaccacgactatgaaggtcaggaaataccagcatccgttcaacaataaaacattctatccagcgagagtgctcagatcattggttgttgcggtgggaccatcatcgtcgaacttctacatcctccggaaccgtgtttggacctcgatcacttatctatacactctgccagcccctgaaagccaatcggcgttcaccgctgccgccggcatttcttttatatgtttgaatgaaatgaattgagtatctgtgtcccactgtttctgcacagggagccatgcnnnnnnnnnnctcggcgttcaccactgccgccggcatttcttttatacgtttgaatgaaatgaattgagtatctgcgtcccactgtttctgcacagggagccatgcgcccagcaatcccgggtggttcccgtgtccattcggggaccaccgttgcccgtccctcacccctgctccgccagcagtccatagcgagacccttcactgccgcatcaaaaagccatgcctaccgtcggaggtcttctaggtgcgccctgtggacgcgggacgtctctggaggagggggcaaggcctgcctgctgcattggcctgctgcatgaagggggccctgcctgaggccttccacaccctccatgcccgcaggcgcctccaaccccggtcccaggccgactggacagagcagaacgccccctggctgaagcgcctggtgtccatcgtgcgcccggagaccgcagaccccaccgcccggtcccggggccgccccggcgcccccggcctggaggccgagcgcgcgccctccgcccgcgcgcaccgcctggaggtgcttgtggcggtgcgcaagctgtaccgcaacctcctgcgcgccgacgtgctgctggccgacacgcggcccgtgtacgagccggcggcggcgcggcccgccgac

SEQ ID NO: 28738 - DNA, 78 bp, Chlorella protothecoides
ccccccagccgttcttggcgttcacgcggtctggggacgtgcagtcaagagtgaggcggagcgtgagcagccgttgaa

SEQ ID NO: 28739 - DNA, 76 bp, Chlorella protothecoides
ctttgcaaaaggccgggatgccgtccaaggcggaaggaggactacttcctgaccagaggcggcagaagtatctgcc

SEQ ID NO: 28740 - DNA, 102 bp, Chlorella protothecoides
gggttctatggcagagagagtgtgcagcccccagctttcagccaggtctccggccacagaggcagtacagaaatcgggccccaccagaaaagaaaaccatcg

SEQ ID NO: 28741 - DNA, 61 bp, Chlorella protothecoides
ttccttcccaaccaccgacacctgatacctaacagtgaccctctcccctccttccccactg

SEQ ID NO: 28742 - DNA, 80 bp, Chlorella protothecoides
cgcggtgggggggacccactggccccgctcaacatcctcctgcgggggtgcgagtctcggggcagggtgactcgtggggc

SEQ ID NO: 28743 - DNA, 121 bp, Chlorella protothecoides
tgccagcgagaccctcaccttcgagcacacgtacacctactggggtgggttgcagcgttgagcgtcgggcggggctggggcctggccgggcctgcgcagtggtctgactgcagcggcagcg

SEQ ID NO: 28744 - DNA, 117 bp, Chlorella protothecoides
acgcatgacaacctccaacctcggcatgatcgcccgagtcacctcccccgtccaccctacctggtcacatttgccgtccagtgcaccgtggctgagcctctgaacgaccaaaagggc

SEQ ID NO: 28745 - DNA, 75 bp, Chlorella protothecoides
gctgcatttgtcgtcagggtctaaatacatatcatacctattctcgaagatagactcgcaactcctgagctgtgc

SEQ ID NO: 28746 - DNA, 107 bp, Chlorella protothecoides
cagcttcttgcagtgtccacacctgcagagaggcaaccacacgagaagcctcgggagcaagtctcattttgggcagtagtataccccagcagttgccacgagcgaca

SEQ ID NO: 28747 - DNA, 66 bp, Chlorella protothecoides
atgcatgcattgcagctaccaaacaagcctaaaacagcatgcatgcatgcatgtgtgcactggaca

SEQ ID NO: 28748 - DNA, 226 bp, Chlorella protothecoides
cagtgagcgcggcgagatctgctttacagctgtgtggcaaggacacagagggtttgggatgtactggtggtgaggagaagtggggttgtgatcccaggaatgggcgccttgacgcaagactggaagccgcatgagtctgcagtccccttgcccatcaccgcccccatagatccttcccccccgaagatgtccccttgctgccgacgccacgcgcagacgttctaca

SEQ ID NO: 28749 - DNA, 61 bp, Chlorella protothecoides
ctgggttcattggagtacctgctgcaaggcgggggatggccaccggcccaaactccgaaga

SEQ ID NO: 28750 - DNA, 138 bp, Chlorella protothecoides
gtgaggagggcaagtatggcacaatggcccttcctcgtcaggcaggcatgcaacacttcaaatgcacgggaagcaattcccgtgagtttgcaatagtcatctcgatcctctggggcggcagtctgtgccaggtgctgc

SEQ ID NO: 28751 - DNA, 151 bp, Chlorella protothecoides
cacatgaggggcagcttggtcacccttttccatggccgctgcgcgtcccaagctgtcagtcctcatcatccactgagagagcactcatccctgggagacttggtcctgtctgattacacaacaacgagcaggtggcagggctgtacaggcg

SEQ ID NO: 28752 - DNA, 85 bp, Chlorella protothecoides
tcttgtcgcctcctgtattcgtaatggtcctgcagaaggcgacagactcccaagtcttgtcctggtggtccctcgggatcaagaa

SEQ ID NO: 28753 - DNA, 65 bp, Chlorella protothecoides
cgcaggatctcctgctcttgcaccaggaactcgcggtgcgcggccacgatgccgcgtagctgctc

SEQ ID NO: 28754 - DNA, 61 bp, Chlorella protothecoides
acccaaattgccaccatacgacaatatgttgtccatcgcatgctcgatccgggtgcaaccc

SEQ ID NO: 28755 - DNA, 61 bp, Chlorella protothecoides
ccccatccggtcaaacaccgtatggcgggggttgttcaaacctcccgggatggcccctggg

SEQ ID NO: 28756 - DNA, 103 bp, Chlorella protothecoides
gcatgccaggcgtccaccccacaccttcgtcccagctccaaaacactgcccctgccaaaccccggccccctttgccagcctcaccgggtgctcctcatcgtac

SEQ ID NO: 28757 - DNA, 78 bp, Chlorella protothecoides
catgtagtgatgcctgggcacggagccagcagtgcctccatatcaccacagctcctgagccaggtctgtcaggcactc

SEQ ID NO: 28758 - DNA, 449 bp, Chlorella protothecoides
  modified_base (167)..(176): a, c, t, g, unknown or other
cccgcccaaccagtcgcctcccccgcccagggagtcgcctcccccgcctagcgactcgcctcccccgccccagcaattcccgcctccacccttgcccacgccacctccctcaaccccacctccaccactgaaatatgcggcacagggtaccatcatgttcagttcannnnnnnnnntcgccccagcaactcccgcctccacccttgccttcgccacctcccccacctccacctccaccactgaaatacgcggcacagggtaccatcatgttcagttcatcaagtgtcgtgccagtgatcatcactttgactctgaccacaaacttccgcccggcaacgatctcctttttagtatttgaccgttactacataccctacatctcttcctctctttcccccggtgacagctcattttcttatacacaatccataccaggctcagaccagatt

SEQ ID NO: 28759 - DNA, 64 bp, Chlorella protothecoides
gcccctgctccaggcctgcccctgcgccagcctgtcattccatagatccgtggatggagagagc

SEQ ID NO: 28760 - DNA, 139 bp, Chlorella protothecoides
ctgcactcagtctgtgctcaggtttccctttatgaataggtcgccaagcatcttccatggcaatacccaccgcagcaacttccatggcatcacccactgcagtggcaaggctaagggcacatcatccctcaaactgatc

SEQ ID NO: 28761 - DNA, 61 bp, Chlorella protothecoides
agacatctcctcctggagcggagggggggttagacactggagacgcgacggcctcgccact

SEQ ID NO: 28762 - DNA, 83 bp, Chlorella protothecoides
ggtccggcccagggcgcgcgcctgggccgccgacgcgctgcgggccgccgacacgctgcgggccgccgacgcgccgagggaac

SEQ ID NO: 28763 - DNA, 67 bp, Chlorella protothecoides
gcccgggaggagcgagcgcggcgggtgagtcgatggttgcgttgtgggtggggcctgcggcgcatcc

SEQ ID NO: 28764 - DNA, 447 bp, Chlorella protothecoides
  modified_base (173)..(395): a, c, t, g, unknown or other
aggaggtgtgctttgatgcctcttgatctcgtgtgcagcttgcaggggatgcgttgctatattctgtgtgaacgcggattggtgcgccagcatttccaagatgggcccatgcttcccatttgggcccctgtacccatcacctctctccacaaccaaacatctctgcagttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcatggttggccggagctcaggctgccactgtcacatgcagtctgtcctg

SEQ ID NO: 28765 - DNA, 76 bp, Chlorella protothecoides
tgggccgtgtgtgacccttccacgcattccttgaaaaaacattgtccctacctgggcattgtcgagtgtctgccag

SEQ ID NO: 28766 - DNA, 76 bp, Chlorella protothecoides
tttcaagaagcgccctccccctgtgagatttagttttggaaacaaaatcggttaaatcaaacatgcgctgacttgg

SEQ ID NO: 28767 - DNA, 75 bp, Chlorella protothecoides
agcagagaatgcaggccgccagggtcgtgctggcacactgcgtgtgtgaggagctgcagcacttccacctccctc

SEQ ID NO: 28768 - DNA, 118 bp, Chlorella protothecoides
agaagaagcctggccagccgcagagccaggcgtcacacggcaaggcacttccaaagtcccccgcaccggcccagaagatctcttcacgacttccaaaggccatgaaatctgtgggagt

SEQ ID NO: 28769 - DNA, 74 bp, Chlorella protothecoides
atcaggctcctcacggaggcgactcgggtgagtattgcattgagaacccgcaatatcatccccactatgcctcc

SEQ ID NO: 28770 - DNA, 139 bp, Chlorella protothecoides
cgagagcgctggcccggggcagggaaacactgcgaccgacatccctagtgccaggtgcgggcaggagctgccctttgcgcgagtcagccactggagatctgctcagattatgttttgtagcccaaggactgcatcggaa

SEQ ID NO: 28771 - DNA, 70 bp, Chlorella protothecoides
gattgggatggtgtgggcatgcctggaaaatattctcagtagctcctcgccctcggcccagtcctccccg

SEQ ID NO: 28772 - DNA, 61 bp, Chlorella protothecoides
tcccgtcagctgacggagctgacgacaaattatggatcccgcagtgcggactacaaccatc

SEQ ID NO: 28773 - DNA, 112 bp, Chlorella protothecoides
gggtggggggaggggggggggttacgcttggggtggtgacaaacacctgcacctgctcgaacagaaacagccagtacaagctcaaaatgcatacactgtccagggcactgca

SEQ ID NO: 28774 - DNA, 78 bp, Chlorella protothecoides
ggccttggcgagtgtattcaggttctgggttacccccacacctcagcaagtgtgggccatcgccccaaccaaatgtct

SEQ ID NO: 28775 - DNA, 87 bp, Chlorella protothecoides
ggcagcagctagattgtgaggcagcgcgccagaggatcctcctgtcaccccagagctgaccgccgccagccacccaactttgcagaa

SEQ ID NO: 28776 - DNA, 68 bp, Chlorella protothecoides
ccttccactccgccgcagagcgccgagccggcccccaaattcagggcatcgctgcgcaagcttgcgtc

SEQ ID NO: 28777 - DNA, 63 bp, Chlorella protothecoides
accgttctttcaccacattatcgcccccctagaacaagtcacaactcgcacttctaatgacat

SEQ ID NO: 28778 - DNA, 116 bp, Chlorella protothecoides
gaccaagatatgtgtgattggctcatcagtatacacagctcgctaatgtgctcaggaagggtccacgggaggaccagctgtgatgaatgcgggaggttgcgcgttggaaacaggct

SEQ ID NO: 28779 - DNA, 65 bp, Chlorella protothecoides
cgaggacattcggaaggcaccccagatcacagcgaggccagcgcacgctcaccagtcggagttgg

SEQ ID NO: 28780 - DNA, 78 bp, Chlorella protothecoides
cagccttcacacccccaacctggcccccccccaatatgtgcccacacccacaggagctgaccgagtaccgtcggagga

SEQ ID NO: 28781 - DNA, 64 bp, Chlorella protothecoides
gcctgcgtcgcgggcgatcggggcccctcctcttcctccccttcctttgtgtcgctaccggctg

SEQ ID NO: 28782 - DNA, 61 bp, Chlorella protothecoides
aagcgatacacccatcgtgaacccacctttcccacatgcagggccgtgtatcaggacacag

SEQ ID NO: 28783 - DNA, 237 bp, Chlorella protothecoides
ccctctgccaccccgcatgtttcaactgtggtgcgggggcagggtgccggcgaagcagggccgggcaaggacgcctctgttcaagacatggaggtgaggtgtcgtgcccgcttgaggtcccgggttattgcaaatgggtggggctcgtgtgcgccctatcatgtctttgttgctaacagagattgggtcttccttttcatcgtgccatgcgtgggcgccttcacttgcttgctcggc

SEQ ID NO: 28784 - DNA, 72 bp, Chlorella protothecoides
tacgtgtgccatgtatcgctcttgatcttcggtcaaaaagacctctagtgccaagcctccggctgcagcttg

SEQ ID NO: 28785 - DNA, 61 bp, Chlorella protothecoides
ggaatgtccacagtcaagctggcctccatcaagcagctcctgcgcgcaggcgttgcgcttc

SEQ ID NO: 28786 - DNA, 142 bp, Chlorella protothecoides
gcatgaccagggcgacagcggcgcgctgccagcagggatgtgggcccggcacccactcagccacctctacatggcgcagcggagcgcctccagcagcgttggcgccaaggccccgggcagcgcctcaatgtcggccttgcgc

SEQ ID NO: 28787 - DNA, 69 bp, Chlorella protothecoides
caatgatcgggcacatggagttgcccccccgcccttgttagcatgcagggggtcccacctcagagtcag

SEQ ID NO: 28788 - DNA, 86 bp, Chlorella protothecoides
gcatcgcctctctcgcagacctcgaattttaagtcccgcatcgcggaccaggaatcgtgtgcatgaggctgcactgttcttgcgtt

SEQ ID NO: 28789 - DNA, 78 bp, Chlorella protothecoides
cctcgccgtcgtcgccatccatacccttcacggccggcagctccagcgccgctgggtccaccgactccacgatgcggt

SEQ ID NO: 28790 - DNA, 64 bp, Chlorella protothecoides
tggtataccatgcgcttcaaaacttcgtaccgcgctcgtgcctgcggcgtgtgcatagggccat

SEQ ID NO: 28791 - DNA, 199 bp, Chlorella protothecoides
caaacctggtaggtggcagtgggggtgggggacgtgatgttgaggagggaaggcggaggattgtagggaggcatcctgcagagagttgcacgatgggggggatcccgctgcgcccactcagcctaggcctgatgcggtcagcatggctggcaccaaatccggctggagtggctaccccactggcggaggtcagtccccc

SEQ ID NO: 28792 - DNA, 123 bp, Chlorella protothecoides
ctgaacagccctgcaaatgcatcagagtaggggcttgctgggaatgccccatcaactcatgctcacgatcctggatccagactgttcatgccctgcactcacccaggtacagggtcttgttgc

SEQ ID NO: 28793 - DNA, 61 bp, Chlorella protothecoides
tgtcgaggcgcaccccccgccgattattgcaccagcagccattccggcggctttccgtgcc

SEQ ID NO: 28794 - DNA, 61 bp, Chlorella protothecoides
gccagaaaacaaggtgaggcgcccgtcgttgggcacttccgggctcacacggtgaaggact

SEQ ID NO: 28795 - DNA, 81 bp, Chlorella protothecoides
ccgggcagtcaaagcacacctgcgggcgaggaagcatcgtggcgcagcatagcaagtactctcatcagatgaaaatgccac

SEQ ID NO: 28796 - DNA, 66 bp, Chlorella protothecoides
gtccagaagacggcagtggaggcacgcagcgcggacagcgcacggactgtggcatggtctctgtcg

SEQ ID NO: 28797 - DNA, 61 bp, Chlorella protothecoides
tggaccagtgcacacctgcttgaccccgcacctatggtgatctggtcaaaggtgtcgttct

SEQ ID NO: 28798 - DNA, 64 bp, Chlorella protothecoides
cgaggccagccccgggccctgcacgcttcgttcccagcgccgcagacctggtcgcactcaaggc

SEQ ID NO: 28799 - DNA, 122 bp, Chlorella protothecoides
cgggcactctgcctctctgccattaactacatgcccctcctttgatcgcccagcccctcggcatcgttgaatggctgaccctctggctctgggaggcatcaggaattctcctttacagcaga

SEQ ID NO: 28800 - DNA, 134 bp, Chlorella protothecoides
gggtccagactgggccatggtttgagtatggtcctgtaagggcacagggggagaccatgcaccggacctgcctgtgccacccagcacggttgaccctccctgcttctcgatccacagatgacactgagatgagg

SEQ ID NO: 28801 - DNA, 61 bp, Chlorella protothecoides
aacaccgcgggggtcctgcgccgccacccccccccccccccgatttaaaattcattcgccg

SEQ ID NO: 28802 - DNA, 137 bp, Chlorella protothecoides
cagagcgaagaaagggagaatggtgtggggttgccttgcatgcagttcaggattcaggtgatggctggatgcacagcgcttgagcgcgctcgtcgatcatgcgaaccatcgctccacagagggtgaggaagtcaccc

SEQ ID NO: 28803 - DNA, 61 bp, Chlorella protothecoides
gccggtgccacccaccaccagcagggtgttctttccgactgtcgagccactggacgcagca

SEQ ID NO: 28804 - DNA, 61 bp, Chlorella protothecoides
gtacgagccgcctggatatcgcagcacaatgatgctgattctcggtttccatccttagggt

SEQ ID NO: 28805 - DNA, 87 bp, Chlorella protothecoides
gcagcgtggcctgcatgcaggccgcctgtgctgctgacagcggcacccttgcttgggaaatggtggctgccaatctgtgggacaaag

SEQ ID NO: 28806 - DNA, 432 bp, Chlorella protothecoides
  modified_base (131)..(336): a, c, t, g, unknown or other
atgacatgttcatgggagtcaagggcctacatcattactccaagtcccgagttctcttccctccctttgcagcccacactgtggaaatatcctcgggaactgtacaagctcttggacgctgaaacgctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcggcctccatagcgggtgactgagcgtcctgacggaatactgagtagtgcatttccacccttgcggcaccgcagcgttatgcagagcccacagc

SEQ ID NO: 28807 - DNA, 97 bp, Chlorella protothecoides
ccaccatccaacagcagattcaacaatttcaaagaacatgatgagcagtcagttggcaaaaccgagtttcctgactcgccagaatcaacctggctta

SEQ ID NO: 28808 - DNA, 61 bp, Chlorella protothecoides
tccattttcgcgagatcgaggtggcggaggtgggtatgggtggggtcctaagtacgtgctg

SEQ ID NO: 28809 - DNA, 142 bp, Chlorella protothecoides
gagatcatgtggtctgcggtggtggccgcatggtctgcgctggtcggctgatcgatgttggccgggggctctcccggggtcggggtgcttgccgacacaggggcgccctcgccggccgcatgcagcaggagggcctcccagg

SEQ ID NO: 28810 - DNA, 61 bp, Chlorella protothecoides
ccgccgccccgcccacctttccgcttgcgcacggggccagccacggggccgacgcccgcgc

SEQ ID NO: 28811 - DNA, 61 bp, Chlorella protothecoides
gtcccccgcactcgccgcaggcctacccgcgaatgcaccccctccccttcctcctcccttt

SEQ ID NO: 28812 - DNA, 111 bp, Chlorella protothecoides
cccccccgcacgttgggcacgctactggagcagcgtgagatcatcctgcgctacgcagccacctctcccggcatcgtggcagtgtgcttctgcatggcctatgtggtcatg

SEQ ID NO: 28813 - DNA, 100 bp, Chlorella protothecoides
ggggggggtgatggggagagggggcgacggtctacaaggccctgtgcagccacatccgatggactgcaatggccgcatctcgtcatacagcagtccagcc

SEQ ID NO: 28814 - DNA, 542 bp, Chlorella protothecoides
gtgtgcattgaattgttgacagctggctgtgtcccttgatagcagcatgctgttgagtccctgcacacagccgtgtgctaagcatctctcccatcaccaccctccacaatacacaggacgcccactccttcttcaaggacattctgggtggaaactggagcgaccacgtccccgcggcctggaaggaccatggtgagttctcagtgatgtactctgggtgacgagccatgactcaaattgttggcgctcatctgtcagcggctactcgtccagagccagagtgatcaacctctcatcctgcagacttcagcctggacaagctgatcccctttgacctgaagcacagcctggatgacttcctggagaacagtcagctggacgagttccgccggccccataccatccctgagctccatgacctcttcgagtctaccctcgccaagttctgcaagaatttcacgtaggtttgggaggaggggtgtcctggcacatggttgctccctgaatggtaatctcgactcccacacaccgggcgactccga

SEQ ID NO: 28815 - DNA, 61 bp, Chlorella protothecoides
ttgcgcgttcagaaatctggggcgggtcctaccagccaatccttctaacctacgataagat

SEQ ID NO: 28816 - DNA, 61 bp, Chlorella protothecoides
ccttcaccggatcgcacgcgatctccaaacaccttggcagcctcttccaactccctgcgtg

SEQ ID NO: 28817 - DNA, 61 bp, Chlorella protothecoides
cttgagcctccaatgggatcggatcgagaagtggtgactctgcagtttggcagtctcgcca

SEQ ID NO: 28818 - DNA, 507 bp, Chlorella protothecoides
  modified_base (137)..(382): a, c, t, g, unknown or other
tcctccctgggaagtaaacgaggatcctcccgatggcgtcgccgagtggctcccgtgttcgaaggtccatccatatgtccatgctagtattactcaagaactgcaacctgcacaccaatagagcgtttgcgataccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgatgagagttggcctcgatcgcgcccaaggagacgtgatacagcataggggagtcggcctgccccatccatgtgacagacctgtcctgtcccatcccgtcgcctcacctcctcccaccgagct

SEQ ID NO: 28819 - DNA, 78 bp, Chlorella protothecoides
cacttggtgacagggcgacatcaagaacgcacgcagctacctcctgtgccccccgcagatcgttgctgcgacaaccgt

SEQ ID NO: 28820 - DNA, 75 bp, Chlorella protothecoides
cccgtcgtgtcccctccccctcctccccaccacggtgagatactggtgtcgttgctccatctgcatcaggcaaag

SEQ ID NO: 28821 - DNA, 188 bp, Chlorella protothecoides
catggaccgtgctgaggctgcaccgctcccactatctaggcacatgtcaacgtaatttctggtatactccacctcgatcaacagatggcaaaccctgacccaggatgccctgttgggccgccgcgcctgatgctgtctcactccccttgccttcttcaaagcctttacccctcagcacgagacccacg

SEQ ID NO: 28822 - DNA, 28295 bp, Chlorella protothecoides
  modified_base (849)..(906): a, c, t, g, unknown or other
  modified_base (6758)..(6815): a, c, t, g, unknown or other
  modified_base (27626)..(27735): a, c, t, g, unknown or other
ccccccccccccccacacacatacacacatacacacctgctgtgcagccactcccaggtggcgttggtcatctccgcgcccagggtctgcaccaccgcgccccccgccatgcacccgatctccgcgcagcgggggagcgccgcgccgcgcagcgtgccgtacaggaacccggcggcaaagaggtcgcccgcgcccgtggcgtccacgaccctgaccccggtgcaggcgggctgggcatgcacgacgtccgagccgcgcgaccgcacgacgcagccccgctcgcccagcgtgaccaccgcggtgtcgcagtgcgccgcgaggtatgccaggccgcgcagcggcccgccctcgtcggcgccgcggcgctcgcccaccacctcgcacgcctcgtcctcgttggcgaagcagagcgccaccgcgcccgactccagcagcgcgcgcagcgtggggcggaaggcgcgcaccacctcgaaggaggccaggtccagcgccaggcgcgcgccggcggcctgcgccgcgcgcaccgccgcgtccagcatgcccgggatgtaggccgcgtatgctgaggcgaagagccagcccgcgccggcacaggaccctgcgtccagctcgccggggtccagcgccgctgaccccgcgatggcggtgcgcatcgtgcgctggccgggggcggagaggatgcagcagcgcgcggtgggcacgggcttggccagcacgcgcgagacgtccacgcccgcgcgcctcatgctgcggctgaacagcacgccccactcgtcctggccccgtgcgcccacctgggatgaagagggcggggaacttgggtttgtgtgtgtgtgggggggggggggnnnnnnnnnnnnnnnnnnnnnnnnnnnnnnnnnnnnnnnnnnnnnnnnnnnnnnnnnntgagagtggtggagacaagaaggggccggatctgtgacctgtaaggaacttcaatatgtatactactgtgcggacattctacggatctcgtggcagacagacctcagcacacccactcacacccacccaccaggcgggcgtgcacgccgaagccggccaggcctcgcgtggtgttggcagcgctgcccccggctctgctgtagtactcgccggcctcggccaggatgcggcggacttcctccagggtcacgcggtgggagccccctagctcgtcgtccactcccagggagcgcagcgagccctcatcggagacctggcggggcaggggtgtggatgtgtgcacggtcaggtctgaggatgctcaggcgagtggatgctccaagggagcgtcgattctggttccagggtttttgagatgccagccatgcactccagcactgtaggagaaccctccgccccctcgcacacccattccggcgcaccgtgagcaggtgatcgacgatcgcaatcggctgcaaggccacaatctcaaccccggagctggcagctccatcgggggtgctggatgccagatccagggccagccccagccggtctcccattggagcaggctccacaggaacccaccacgggaagtgcaacgtcaatcttcacgagcgtggtgttagatggcttccatgcactggtcggtcaacgttataagactgctcggcaaagtacgtctctgatcgcctgtgccggtgtcttgcaaatttctccgacatggcgcgcgcctcatgagacagagtcgcgggctctcatcttggccatggagcccagcacccccccagacgtgctgctcatttgcccaaggctatgcatggagtctcgaccgcgtgtttctgtcgaaggagcgcccccagtgctcgtgcatggccggtgccaggtcaaaccccggtcggcagggttcggtgtcctgaagaccgcatcggcatgatctgcagcatcaaccccatcaatacgccgcatcggcgtgtactattcccgaggatctctgtagaccggggttcccagcgaagaggagcgggtgggtggggacccgatcgtgtttggcagggtcccaccacagtccatgctgcagagcagtcggctggccctgggaagtgcaagccaggcaacattgtggtcgccgtcgacacaacgcaagtaagcacgagctgcatagaatggaaaggatagtcagaacttgaatctggccactcaccgagcagccagaaggagtggcagcactgccaatcctggaagcatcaacatacagcattcaacagaccagggcctggtgtgtcattcctgctcggcaaaaatcctgggaggaccaggcaagaacagggaacgccactcccttgaccccagccaccccctgtgtccacgcaggactccctgtcggccctccactgggccatctcccacctctaccgcgagggcgagtcctcgctggtcatcctgcacgtggtgcccgacgtgtacgactcacctgcccccgggtccatttactacgaggagacggccgacccggagctggaagccgctctggaggccgaagcacgggccttcctggaggagcagtttgtgtcccgggccgcggcggcgggcatcccggcgcgcgtggtgctcgtgcgggagggcaacacgcgccacgtcggctgggccgtcgccaaagctgccgaggagctgcaggtcgggaggaggtgttgtgcaggttggcgggtgcgcatgttgagcttgccgatgctcgaggggttcgacctgggaaggcccattggttgctggcatatgtcctcgcaaacaaacacccggatagccatctgcgcacctggcactccctctcacaaactcctctttctgaaactcccaggcctgcccgctggtgctggccaagcacaaccagagcgcgtgggaggcgatgttccttggctcggtggccactttctgtgccgcacactgcaagcagccggtgctcctcatcccacccatcacccagaagtgatgccctgcgtggtgctgggcattcacagcccccaagcgccaaagtatagcctcgggcctgcagcaccatgcttcatcctggaatttgattgtccacgccccaacagatcgaggtgctgcctcctagttcatggtggaccccgccgcccctgcccaggcccctgtacacctgcctgctcaagcaggattcctgtgccttgccttcatttcccacagagtttcgtactttcttgtgttatgctcgtcagttgcagctcgcagagggtacagaggtgactcgtgtggccaagtgcctgcacctctcggggtcgcaccacgaacaccgcactccaccaggccccatggcacccaggtcaggccgtcccggccgccgccgcctcgccgcccttgaaccaggtgacgtcgggcacggcggccccgcccgcgtcgctcaggatcagtgtccgggcctccgcgttctcgtaccagcgctgcaggttctcgcgcacggggcgtgcatactcgttgccgaagcaggtgagcgtgaaccagaggaaggcggagtgagtgaccaccgcgatgttggtctccggccgcgtcatcagccactgtgtgcgaggaagaggggggacacgggcgctgactccgaggctccggggatggtggtgcgacagggagagggggcaagtgcatggctgggcgacacgacggagaaggaatccgtccatttacccgtgtccctgcagatcgccaaggggccacgatggcacgagctcgctgccgaagccacgctctcgtccttgctgggacactgcagtggccccggccccgtcaccccccaccatcacgaccagcagccagacacccgcgcggcgcgccgccggcccacctgcaggaacttcatgccgcgcttgaccacctggccctcgccctccaccaggcccggcgaccagagctcgtcggcgtcgctctcgatcagcgaaaagtcgacgcccgggaaggcggcgccggcctcgctcaccgcccgccgctggtcgcagtggctggggcccaggcgctcgcggcagagctcgtgcgccacgaaggcgacgccgggggggaggtaaagcgcggcgtgctcggcgcgcacgttgggctcccccgtctgggcgcgcatgagcagctggtcgggcagcggggcgcctaagtccatgccgtcctcctcgtcgggcggcggggcaatggtctgggggaggtgcggcaagccaaacacgcccgccgccgtctccagggctcgcatcatgggcgacaccaccaccagctgggggggtgggtgggtgggtggttggggcgcgcaaaatgtagagaaagctggtcaggggcaggtagggtcagagacggggttcagagtatcaggacaccatgcgaccatgccccagctgcgtcactgttgatttgcgcagggctctcgtcaaagctgtgggcgcatgcgagatctgtcggcccccgcatgcgtgcgggcagagaagcactcaggcagagaagccacgcatgcccaagtcccccccccccccctaaaacacacatgaacctccagcgcccatttttgcatgcgcacctggacactgttgcatggagggttggaggccatgtgcaccgccagggtgtgggcctgcttccaccccaccggcgtgaggtgggagtcaggggtgttgatgccaatgttgtggaagccctcgccgtgccgaatgaagtggatggtcttggtgtggcagatgggcatgaggctgagctggggttcgtacttggccggtcgggcgtccatgaggttggtgggggacgacccgatgggagttccgttggcatctgggggggaatgggtgcgagatggagcaagccctgtgagtgctgcggcggcctccaggggggcgctgtccagcggctcgccatgcgccatgcaccgcaccccgccctacccgtgtggtcggtgaggatgtcctggaactcccgacggatcttggcggtgtggcgcaggtagtcatgcatgccactgctccaaaacagattgggcttgcgctcccattgccccgtgcaccagttgacaaactgctggttcagggcagtcacgtactcccggaagtgctccgccctgtccttgcccttcttctgcccgctcatcctggggccggctctgacgcgggtcgtaagaagtggaggacactatcgtgtgaccatggagctcggggcggctctgcaaggaccgtgcgctctgagttgggggtccaaggatgttgtggtcgccacaacggaccggggcagaggcagtggctggaggcgcagcagtgcgagacagggacaagtctagaacaaggatgtcgattcaagggcatgcgccatcatgcatgccccgttgttatgtgcacgtctcctgcaccgcgaccgctgcgcccccaggggcgctgccctgcggggcagggtttgatccgacggcgacagatatgaggggggggggtctgatccacttctgggagtcgacctcctattacccactcccaccctcttgatgcctgatgccagtgccatggtctacctggatgccacactgctctctggcaggctgtgccagcccccctccctcggcacctgctgtacacccttgttactcaaattcccagccccttgtcccagaagtgcttgttctgctcctgttacacgcacgcctcaccaacatgtcaccccctggccgcggtcttggcggcctggtggttggaggtgagctccgccagcacgtcctgggtcacgggctggtgcccctggtactccatggtgaactcgcccttgccctgcgtcatggagcgcagcgcggtagagtagccgaacatctggttgaggggcacggaggcctccagcacggtgtcgtccccctcctgctccgacccattgatcacgcccttgcgccggttgatgtcgcccatgaccccgccctggaactcggtgggcgcctgcacctccacgcgcatgatgggctccagcaccgtggcccccgcacgctcgaaggcggcgcggaaggcgtgcacgcaggccagcttgaaggctagctcggaggagtccaccgcgtgcgcggcgccatcggtgagcaccacgcgcactccctccacgggatgcccgatgagggagccggagttgacggcctcggcaaaccccttttcgcaggcggggaggtaggcgggggggatgacgttgccgatgatgccgttctcgaactcaaacttggtggggtggccgggggggaggggctcgatacgccccgcgacgcgcgcgtactggccctgcccccccgactgcttcttgtgcaggtagtcgaaggtggcggcgcgggtgatggtctcgcggtagttcacgcgcgggcgccccacctcgcagtccacgcggtactcgcggcgcatgcgctctatgtagatctccaggtgcagctcgcccatgccgctgatgaccgtctgcccgctttccccgtcctgggccatgcggaaggtggggtcctccttctggaagcggttgagcgccttggagaagttggcgctctggtcgcgcgcgcgcggagccaccgccaggctcataaccggctcgggcacgcggatggaggtcatggccacgcgcgtgccgtcggtgaaggtgtcgcccgacgcgcactccacgccgaacagcgccacgatgtcgcccgcccctgcctcggcgatgtcctccaactcgttggagtgcatgcgcacgaggcgcgggaccttgagccgcttgcccgtgctctggttcacgatgttgtcacccttgcgcagcacacctgacttattatgaagggggaagggggggggggnnnnnnnnnnnnnnnnnnnnnnnnnnnnnnnnnnnnnnnnnnnnnnnnnnnnnnnnnngggggccggctgtgcatgagaagtgtgggttccagtatcacacccccgcgctgacaagggagcactacccacagcccagcaggaagatttggagatggaatcgccaatcaccatccgccaacagcgcaggggctgttcagtctggtgacccaatccccccaacacaccgctgtagatgcggacgtaggtgagctggccgaagcgcccctcctccagcttgaaggccagggccaccagcggcccagacctggcgggaggagggcaggaatgaggggttgacagtgatgcatgcaagcaaggtatgggacgcagcaggaccagcaccccattacgcttcccgccaggctggcaggcacagacaggacgctcgttggaggcctgagaaatgtaccacctcaggctgacccaccgcctctcccaccactccgctcaacaatcacttgcctggtgcagtgtacgggcactggcgcctcggagtccgcgaggtcaaccccggtgttggtgatgtcgatggggcagggcaggtagtcggttaccctgcagggaagggcaaggggtcccggaatgcgaatggtgcatcaattccaaggccccacagttgtgcccagcagcaagccctgtgcactgtgcaatgttgcgcatgagccccgttcacagcctcctcacccatccagcagcagctgcacccccttgttcttgaaggcagaccccatgaagaccgggacgaagccgagggagagcgtggcgcggcggatgccgtgccgcagggaggcggcgtccaccggttcctccatgaggaagagctcgccaacgccctcatccacctctgccactcgctccaccagctccgtgcgcttggcctccatctctgccatgaattccacgggcacggggatctctgggagaggggaagggggttgaggggtgtgacagtaagtggtgctctgcatcgtaagcggggtgtggcagatggcaataggtgggagctgggatttccaggccagggttgttcgccgagaagtgtgggatcagcccaaagtttggcttgccttcagtgacggagcattacaccacgtcctcgcacacacagctgagagtccacagacccgccaggcacctcagactcccctccttcagcgcacctacgacgctgtctccactggggccctcgaacacgaaagccttgcgctccactaggtcgatgagccccttcatggagtcctccacacccatggggatctgcaggtagaccgcggaccggccctgggttacggcatgtgcaggaaggcggggcacagcaatggcgtgtcccgaccgcctttccagggatggaaggaaatctccgacgctgtgctcgaatgcacagcactggaccgagcattccccttgaaccccctctgatttgtcaaccttacacacactgctcgcacctgcacggctgcggcgttcaagcgcagcttctccctcagctgccgcaggaccttcatggggtcagccccggccctggagtgggagtgatcggagtggagagcgtcagggcggcatccggacccaacaggagacgagcatgccgggttctacaagaagtatgagacatcacacaatacagcactgtgactaggagtgcacctcaactgagagggttccttccaatggcgcctggtaacaacccaaccccacctgtccagcttgttgatgaaggccaggcgaggcacatcatatcgccgcatctgcctgtccacagtgattgactgcgactggacgcctcccacgctgcgaggggaaggttgcgctggctcctgagcacatgcaggggccagtagaggagccaccggggcaagtgcgtggcctgatccaaccccctcccctgctgcccacctgcacaacacgagaatagctccatccagcactcgcagggcacgctccacctgaaggttacaaggtgagggcaggggtacagaggatcacagcaaggtgtggtgaggagactcagtggctttcctgggcccccatcactgctggcatcgattaatgtcatgagcgtgcatgtgcatcttgaagacatcccacgttaccccacccatgcccagcacctcgattgtgaagtccacatggcctggggtgtcgatcaggttgatgtgagtgtccttccactggcagaaggtggctgcagactggatggtgatgcctttctccctttccaagtccatggagtccatcttggctcccacgccgtccttgcctcgcacctgggaggtggggcgaggcggggttagcagggtgcggcggggtgacacctaggatgcatgggcaccagcttggtgcacagcctctcaagcacgccttggctccggccagcacccatcccttcgtgccactcacctcatggatggcgttgatgcgaccagtgtagtacaagatgcgctcggacagggtggtcttcccactgtcaatgtgtgcagagattccgatgttcctcacgtccgacaggagggcccgatcctcgtcctggacgcccgatggcagtgccgcatatcctcttgtcgctgctacgtccaggctaccgaggcagggaagcaggccagcagctccggggccctggggtccaggcgcatgcaggcatggtgcgcgccctgtcgcggcgagcagcctgcgggccacgcccagcataatttaactacactcagtacgtgtgagattgacctctgacttttgcgcagtggatcacactgggccacgcctgccccctgtttgggacaccaacgagctgcacggagcaatgctcgccagctcccgtgacccacgagtgattcaaagctaaacccaaggactcttgaaataactctaaaaattgaatgacctgattgtgagaggccgtttcgcggggttcgggcgccacaagccaggcattctcacattgatgagtcaccgccggcgcgattatctgtagcacttgacgtagcagaagttggagatcccactctacgccaaaaatgccctctgcaatacacccttgtggattccatgcaggcatctgttacacagatgccaggccgaacacttcctggacgcgatgcaggtagtccaccttttccaagcactccggacatgtcacccctttgctggccagcagtttcttcagctgcgccaccttgaacttgttcaagtctgtctctggcgtcagttggatggcttcgatgcaccgactaccgtccctgaagctcagcacaaactttgcgagggcttcggacttcatgtcccctgcggaggataggggtggaggggctgagcctgccagccattttttccgagtttcatggctgatgcatcaagcaggcatcaccttgtctccctccttgcttggtcaagtgcattgtttggtcatagatcaccaccaccctgactgcactctgatacgtacccgtgtgcctgatcgtggtgccggcgtccccgccgcacacagcaaccaccgcagggaagctgcttatgttgaagcgctccaccatgccctggaaaaggtggtgggtagggcactggtcggtgctgagccatgcgaggaaactgctgtgctcccatgggcacgtcggcactgagtgtttgcgccgtgcacaccaatcatccaccatgccacagccgtcgtcgtggtaccttagccgtgctgggcacctccgcgatcgccaccttgcccttgaagcgtagggacaggctgcgcgccagggcccccggctgctgcttggtcgtgaagaggaggacggacaccccccaggccgggctgggcttcaagaacgcctcgagctgggcctgcagggacgggaaggggccgtcgcatgggggattgactcctgcatgccgtcagggtaaggactgccgaaaatacatgtatggcataggtgtgccatcttgtcagcagggagtcatatctcccatctgtgtctcctcatgcatgctcggcaccgtgtttgattatctgtgcagcacccaagctgcaaccccgggcatccaccccatggagtgcgccaccctttacactcacagggctggagacgctgggcacgtcggaggggagcagccccagcgcaaagtccttgagcgcagctgcgctcctctcgcctgagtagtccacgctccgcccctccacaaaggccttgatggtggggtagccctgcacgccgtgctcctggcacagcgcggcctcctcctcgcagttcaccgcccccaccctcaccacgcccgccagcgcctccgccagcctgccccacttgggcgccagctggcggcagtggccgcaccagggggcgtagaactccaccagccacacccagccatccctggtcccggaggggaaggagtccacgcccagtttcctgacggcaggcatgccgtcatacaggcccccgcccggccgctgctgctgctgctgctgatggtggcccccaaaccctccggggaaacctggaaggatgcaacgagaggccggccaggatgaagaagggagcactcgagcctgaccaggccacaccagagcgctgccgccaccaggccgtgcagcattgcgcccatcacgacccacagatgacagggagcgcactcacctccgcccccgccgccaaattggaactggattcgctgaccacccattccccctccattgccaaaaacggtgcggaaggtggcgaaaggatcaccctgtgcagggaggtgcggggtgttgtttccttgtagaactcaggagagaagttgccactctgcctcccagcatgaggacggccatgttccccttcccgtcccaccaactcacctggaaatggaaacctgcccctccacccccaggaccggcctggcctcccggtctcaagccatcttctccaagctggtcgtacatgcgccgcttttccggatcgctgagcacctcatacgctgccgcaacttccctgaatttcttctcggcgccctccttgtcatcggggttcctgtccggatgatgcttcctgcacgtcgccagtgcatggacggcgagttgggcatgcagaacctcccttcctaattataacttttagttgaacaagtgtccagagggctccttacatggcttgtcgcctgtacgccttctggatcgttcgctcgtcggcgtccgtggcaacgcccagcaggtcataatacttgctgtcacgcacagcaagtactgagggtgcgaggatgagaagtaagcaggctcctgccagacacgcgtgtgagtccggctgcatgaatgcagcggcaatctgcaaacgtcctccagctacgtctccctatccgactatcggggtcacgagtggtgaataagtatgtcggcttatttattggggtatgaatgtggctttggcagggttgatagcaagctgcggacgtgggcaccgaaaggaacagccagcccggaattcgtcatcttggaaagattgaattagggcacctgcacggcatgctgctgtcgattggcgtttggacagccctcccattacctggatactgtgcatttcaaggggccttgtggacactcgcgcagatgcactagctgtcaagtcgtctcttgaggtccagtgtgtggattgaggaacaaatgtgcacctaaagttgatttggatgcagaatctggaggttgtgcaagcaatcagatatgccagaaatgagctcttcctcaaagttgcaacgactgcccctcaagctgcggacaaaccctcctttggaatcagtcagctgcttcttgtgcacgagttcagcaatctatctgcaggacactgacagatgcactgagatacccacactttaggcccacactactcactgcaccgtaagcatgcttagacgttttgtctgtctgtgcacacggaaatgacagaacggcagggtgggccagacttgtatttcaggggtacggcgatgagttcttcgcgcccttacggagatcgtctgtcgaggaggaagcacctttctgcggcattatctaggcaacgattctacatacgttgcggggcctgcaacaggcgcttagcgatgcatttatacctcttcgcaattcggccttgattaacatagcaccaccgatcccactacagctgcctccagctcctcaagggagcgcataccaaggtcggtgtcggttcccaatgaagctcgactcgtgtgcacaatgcggagcatgcttgtaatgctccaatgctgcctcatctaaaatccaggccagtgcatcctctgacagcactgcccttccccaggcgccatgaccaagcgcgtcctcgccctctttgacgtcgacgggaccctgacggtggcacgcaaggtgggaggttgctcagcgggaccgcgatggcacgatcatctggtgcatgctctgtgaattggtcataaatgtcactgctcctcctcgactaggacatcgagccggacatggttgagcacctcaaaaagcttcggaaggtagggcaaccgccatgacctcacgctggagtggacgatctctgtgcgagaggtgggcagtgcaatgcgcaggaagacttttcacaagtatcttgtgtcgttctttggcaggctgtgaaggtgggtactgtcggcggctccgacctcgcaaagcagctagagcagctgggcaagacaggtgatcaggggtcgaaacagggctgcttggattggactcgaggcaatgcatgcagtcgctcacagatgttcagcccttgcgctctgtgcaaccctacaattggtggggcgctcgggcctttgcagggacaggaggacctgctctggtcagaacagacgtgacactgcattgtccgatcctcccaaagcgtgccgtcaccaatcgcgtgtctgttcactgaaccccgcccacagtcctggaggactttgactttgtgtttgctgagaatggtctggtggcgtatgaggcgggtaagctgctggcggtgcagtcgattgccaagcacctgggagaggagtcgctgcagcgactcctcaacttcatgctgcagtatctttcaggtgggggaatgaacgaccagtaggccaaaactggtgtgctgtcgtacacatcttgacatctggaacagaggtcaccctgtcagcagcacatgctgcggccagtccacccagcctcctccgctcctcccaggcatcgagttgccagtaaagcgtggcaccttcatcgaattccgtaaaggcatgctgaatgtatcgcccattggacgcaactgctgccaggaggagcgagacgccttcgaggtgtacgacctcaagcatggcatccggtgagtgcctgaggacgtgcctcgcaagcgcatggtgcactctctgcccagctgtgcattctttgtgccaggacccttcccttgtccacatgctcccatgactcacctgtacagggcaaagttcctcgaggtattgaaggagaagtttgcagacctggacctcacctattccatcgggggtcaaatttcctttgatgtgtttccaaaggtaagaatggacatagacctggcctgttgagttggtggcgcccagatttagtgggtgtgcgttgatcaagatgggtgtgcgttgattaagatatagaaagcctgcacagattaccaatggcgccagttgggactggatgtcccatgggaaagcagagccgccttcttctctgatcttcctcaaggtatcatcaataaagcccagttaattaaccatgcgaccaccccaaccccacattcccacagggctgggacaagacgtattgccttcggtatgtgcgagagcagtttgatgagatccacttctttggcgacaaaaccttcgaggtgggttagggacggagaagggtctgtgttgcttggtgcgtgctgggccctcgctccaatgtgccacccggtcactcctgcacgaggaaatcgccttgactttgatgtattccgtacagggtggcaacgactacgagattttcgagtctccagagaccatcggccacacagtgaatggccctgccgacaccattgcccaaaccactaagcttttcttgtgaactcctgtggcaaggcccagggtgactttgaacatgacaatgcagttgcttgtttcacttcatgccgccgacatttggatgctgaatggccccccctgtagtgcttgaatagattttatccaggtctcggtgtcaggcatgggttgggtcagggcgcgaagggcgttcgaatatgggttaccgacggtattgaagtcataccactcaaagctccccccgaatgatcaccagaaagagtaggagaattgtggtgtataggctccttgttctgggccttggcgaagcataggcgccacgcgcgatgtccctgtcagtcgcccggagccggctgacggaggagcgcaagcagtggcgcaagaacaagccctttggattccatgctcgccccgagacgacatccaccgggtacgtgaggtttagaagggctccactgcgtacagactccccgctctgtcatgcccgactgtgagacctgcactgctgcaccatcggccagggagacgaacctactgaagtggaattgccacatccccggcaaggagaacactctctgggagggtggtttctacccactcaccatggagttcagcgaggagtaccccgccaggcccccaaaggtgtgcgtgggcaaatgtatcttgggggaattcatgatctccaagcgccgctcaaattgcaaacccctcaaacaccaatttgccctcttctcaatgccacgcgcagtgcaaattccccgccgggttctttcaccccaatatttatcctagcgggactgtctgcctgtccatcctgaacgaggatgaaggctggcggccgtcaataacggtgaagcagatcctcgtgggcattcaggtaagccgccttctgcacaaggctggtgcgatgtggaacggctggtcaagacagcgctgttgaacctggccttggagagtgctcaccttccctgccctgcccccaccgagctcaggagctattggacacgccaaacccccattcaccagcccagtcagacgcctacctgatgttcacccagcggttgacagagtacaagaggaagatcaaggatgtggcgtccaagtacccgcctccacattgagagctgcagggtgagcgccgcatacatgtcaagcagcagcagcctctgtgtgacgctggatgtagaggtgaaatcctgctgagggcgcacatcggcagccaggacaccctccgacacgtgccactgagcgttttacacccggccgagtgtggagccttggaggctcagactcagaaggaatgagggtccttcctgcttagacttccacccctggcccagccctgcagtcattggtgcccgtgcccagttggaaaggcgtactgagtctgccttcactgttttgcctgttacctctgcctctctccaccccaaggctggtattgagggggagcccagcagcccacaatctggatggctagcgatgctctcaagggaaggctcatcttctacccccggcgcagtctgggattcgcatgcctgcccttggcaggtcgatgacgttccgtgccatcgctcccaaaccagcattagggtttgacaagaaaacgtcgaaatctgactgaaggcagtaccacttcacgcgacttcatgaacatctggatactgtaaatttggcgcatggcatgattatttggcgtagaacggtggatattgaggacaatttaacgctcgtgcacccggatgttagtcggagccgagtcggtgtccggacgatgcccggcacaggagccgcaccccaaaccgtccgtttctccgcagagaaataggactatgtagaatcaaagtatcaatttcaaggcattgatctgactctctgacctcatgccggagctgtgcatgttttggcgcagatggcacgttgccacaggtacgatgggtttcggaaaggtgaaggattcagggcgctgctctacttcattgcatatgtgtttggggtattgtccggcattggtgtggagaagttatgcctccattatgaactgtcatgtgagatgaggggcatttcctcgcccggtgcgaggttctcatcaaaactccggcttccctcccttgcaccccactcccctcccagacacatcccctatcgtcgccagcatactggccgctatccacatggtgtacatcattcccatcctgacaggcagggcggtgcacgagtctgtttcgggggatggcatcgtaggtaacatcctacgccttccggcttctacggttggggaagcaatgattgaatgggtagacacgcgcccctcatgctcccccacaggaacatacagtattgagagcaccggtatcaggttcaattgtaacgtcagtactgctgtgaggttggctgtgtatggcatgtttgccgtcctcctcgtctcggccatcgtggagatctgcatcgtatccatcggtctcaaaggtggggcgtgcgaggggtgggacatggcctgccctgagcgcgcgctgacagctgggcgccattgaaatccatacaggtgggccactcgaggagtacaagcgtgcgcccatcgtcccccttctgtatgcggaggtgttcctttgggtgctggccctggcgtggacaggtgggatggctagatgcactcggatcaccgtcgcccacagggcactgggggatgagcaggacggggggggtgagagggcagccctttgatatgtaggcagaatatggaggtatcgagtcctgtgtggcaaggcatgattggccctgattggctgtatgtcattctccaatgccctgcgcagtgtacggcacgtacatggtcgtcagccccgtcgtggcagctcagtgctgggacaacaatccctgtgcgtacagcaacaggtttccagcagcatgtacgggagttccagattcaggaggtatggatatcgttctggaacaagatgttgggaaagccgtgcttgtgagcggcgtgagggtgtcgagcaagcatcaggagcaagctgccgtcgccaagggagcatggccggttgagaggggatgtgacatgcgcattggagggcacggcctgcatacagtagcctcctcaaggacccattccattgcaggcgccaacaccctgagccctccttgccaaaccctcttggacaactcgcggcaatgggggtgcgaagggacttggtccaggccgcttgcttccttgtctaatcatccttgcagctaagactgagggttcccctggttagctcctgacatcaatgcaccatcctcccaggggctgctttgaggaatggttcttgcttggcacaagctatattctgcacgatgagttcagagatgactctgtttccgctggggattggaactgctctgccaccaccccggcagctgacaacatcgatggctgggtcgccaacgccttctttgatggtgtgtgagagaatgggggggaagggggggaggcgccactgtgatgctgagcatggagggctgactctggcccgggcaggacactgccccatcagcggcagaagaaaaatgcctcgtcccctccgccacgctcctaggtaacttgagctggtaccttgaccgtgctgaccagctgctggatgggagcgtggacgacgccggattcaacctggatctgctgattgagggagggacgctggccgccgtccgggcctacaaccagcagctccggagcctggggtacctgacacgcaacatcgagctggcgttcctcaacctctccggcctgccctatgacctggagcgagtggcccagggcgcaccctgggccgggtgccagaacgaatcctgcgcgtggctcatcaggtgcgctgcgcatgctgccttagggatccgtgggaaggagggacacgtgctaccgcgcagcgctgggggactgcccccgtgccagcctgagcatgcacacgggctggagcagccgccactccctcccaaatcctgcgacctcgctcgcagtgcctctgatgcatgcgagcagtgggacctgctcctggcactgcctgtgccccgcgataacaagcgatattttatgatcctggtgtggacgggctggggcctgctggcgttcaaagtgtaggtgccgaggtgttgtggggtggtgggctgtgtgaccggcgggaggttctccgccattttccacgcccactaccagctaaacccgggaagtgggtttgctggaagtggtgtgaccacagggcgctgtgttgtgccacgtggggggatcaatttcaccgtccccttctcacccggctgggccgtgtagtttcctggtggcacttgccttcaactccttccccgactacgaggatgtggagagctgggagggagggctgagggtgttcagccgcctgtgctgctttggcaacgtccttcatgaagaggtcatggaagaaaggtgaacacccgctggagtgagtctcaccccgagagccgtggattgtggggctcagtggcttgaagcctcaggaccttttctgagggagaggacctgaaggtctgcactctgcctcttgtcattggtttgggggagcatgacgctggaccgaggtcctgcgatactccactgccctgctgcaggcacgtgccttcccgcgtcatcgcccagagcctgagcatgctcttcggcagcatcgacctggaccccaccgaccgcctcttcgctgctctgctgctggcggagcagcagcgggaccagcgtcagatcaacatgcgcctcatgctggacagagccggtgatggaggggactttgggaggagggcggccggtcactgtacgacctctggacgcctgagctgcggaattgctctcatgccatcatgccgcccgtcagccatcccagagactcctcccgtgcaggcttcaagatgcgccaggcaaagggcggggccttcttcaagggtcgtcgtgcctggaatagcggagagcttgatccggaagagtcacatggtgttcggggacagggcatgcacgccttccagccctggctcggagctgtggaggagggccactaccccgtgtactgcaggacggggctgcattacgacgacgcaggcttgggcgaggagaacgggggctgggcagcctcgccaggaggtctcaacgcatcacgcccgccgtggaccccctgcctgcgcgtgacgcataggtacatgcccatgctcacccctgccgaggtacctgctgaatacctgtctcacatcaacccagtggaggtggccgctgtctgctcgggtgagtgcatgctgcaggcctgtgagtcatccctggaggccacatgcagctgggcagggggcggccgggtggcgtcttgaggaatcaacatggccctgccataatcttactgcaaccaatcccggtgttcagaccctctcccccgtgttccgcatgcctgcagggccgcagagacccgtgatggcatcagctttgcaagacatgcaccgcatggcaacctttgcggttgcagcctatggcgtgcagaaccaggcatggaacggcggaaggtgaggccgatgcaccttttgcagtttgcaagggtcgctttcacagtgcattccggtgtcccatggactccaccaagcgctcagctgatgttcagatgccagccacctcccttatgccagcagacgtcctgtgaggtgcagcgggtgcattgatacactgaagagcctatacagccggatcgtgggagggaggcatgggccccgtcagcgcaactgcgatgctatccttgaccttacaggtttgttgtctggtggaagccgctttgctcaaatctcaatctcgtgtatctcaatggcctgcactgcgctaggagtgtgatacctgtcctttactctggtttccactcctgagagaggagggtgttagtcgggcgttttcctcagcacaggtgtccgttatcacccagccaaacctccccatggctcacaggatgcagaccgacggacctgctctatgtctcatgtgagttttgttatgggtagaacctacgagcctgtgttttgttgaacacccatctggcatctcagcttgatcaacccttctccccacaatgttcatcccagatgcaaacatgccagcaggcgcactcccgtatttggtgatgtgggaccgcagccatgatactctcgtcatttcactgagagggacaggtgtgacgttgagtctttgccggactgtcacccacgagaagctcgttcagtttcaggcgtttgcagcggcgtgtctgggtgccatgcctgggcacagcatcatctgactttccccattgcaccaaacctccttgcagtgagcctggcagatcttgtcacagacctgctcagtcagccagtcgacgtctcggactggctgcctgcttgggtccgggtgggtgcaaggggccgtcactggatgtgggatgcagtcagcagagcggctgaacaaagattgccacctgcctctccatggtgctcgtattttatcagtacggaaatccatccgcccgatcgtctgtgttccttgctggctgccacagaggtacccacccgagccacaccttgcatgctgcagaaggagattgctgaagaccagcccgtctatgcccatgctgggatagtctcggctgcaacagccgtccttgtcgacatggaggagaagggtttgctcaaggtggggactcaaagtgtgccaggctttcgtgcaaagcttgccgagccgagtgtgtgttcccggtctcctttctgcctggaatggcagccatgacgggtcccgcccaccaatcacccctcaggaacttcttgccgagcaccagcgctgtgctcttctgaggaggctctccacgcagttgggtgaacagagcctgggattccaatccatgcgccgtagattctccgctgccagccttgtgaatggtgccgcacttgatcctcagcatcagcactggcagcgcggtgaggcagggggcaagcgcatgcttctcattagatcccatgcatctgtgtgatggtgaccctgggttgccacatgagccagctgagagcggggttcctcgagccagcataagttggggagcactgcctgcaaaggtcctgtggcttacccatgcatgtcggcctccctcccagttggtgacctggaagccttcttcactctggaccggctgcgaggcatcttgaggaggagggagggggcatctctgaagctcgccctcaccggccactcccttggagcagctgtggcctgcatgctcggtctccaactgcgccaagagtgcccaggtttgctcgacagcggcctggtggaccgtgctcccgcactgcagtcatgcttgaggtctctcagcctcccccctcacaccttctacagacattcggtgctgggcattctgcccgccgggcggcctgatgagctggaacctggctcagctgactcgcaggttctgtacctcgatcgtggtgggcaaggatgtgatcagccgcatgtcgttcaatgctctcaagcggacggtggacgaaatggtcatctgccttgccaggtgcaggatcatagaacatcgaggggctgtgttgggtaacccggtttgtgtttgcttgggaaggccaccctggatcggcaaaactccggcttccaggagctgtgcaggcctgggcatccagggacgaggcactgcgtcgcttcacctctgcccagcagaaacttcccctaacaacctgttccccctgtgtccctggtcaacagatgccgtcgccctaaactcattgtactagctgactttctgctgggcaggagagggaagtccagggtcccaccctccaccctctgtgatatggacaacatccccgacttcacgctgaagatccttgagaggtgctgggggtggtgggacttggattgcatgtgcaaaacatgcgtcatacccttcgtgtccgtggcgtggggcgcgtgttcagcgaccttgctcttgcctgctggagcaggggaggggtcaccacgagaacatcaggctctccctcacttcttccaggtggaaatattgtgtgcaaacgatgcgcacccgacatctccctcccatccaccccccctcctgccaggtactgcaagacatcctactttcatgatctagagcagcctgagctctaccccccgggcgatttggccttcctcaggcccttcaagcagaggcataggaaagagtccttctgggatgctgtttggatcagtgccaacggtgcgcctttggttcatggtggtggagtcggggggttcgcgcatgctgagattgccgtcttgagggttttggtacgtagtctctcaagtgcacccttttgtctccatgcagacttggtaggggagggtatacaggtctctgcggccatgctcttgcaccatagggtttatagcctgatggacgccttggaatccagtttgcagcatgcacaaaacctcgctgccacacctgttcactgtgaggcgaggccctcctgaacattcaaccttccttcgtcctcctgctattccgtgtacctggcaagctcaccgacaagtataatttgtatccaccacactcaacccatggccatacttttgtcgagatgatctcgggaggatacactggtagctactgacgacccctacaacaatttaccgcaccacaccctcgagttttgtgggggcgtgctagtctccgcgacctggactggcgcaaacaggttgactttgagaatttacagagcaagtccctgtacgccccctgatcctggggtttgaacgacgtgggcgcggtcacggcatgggccaccggttgacgaggaaaccacggaaccgtaaggtgcagtggcgtacatcggcaacggatccttgcatcaaataccgtctgtcggggcgtgagatacctccaaaatgatcgttcaatggctattccatacaattgcggaccctgtgctgccaacggcaatgctggctatttcgtgagaaaagccctcggacggcccgcagagagtatggcccactgttatctggttgcataacattcgcacccgcatgatggtatacgtttccgaagattttgtttaaacgttatattacaacatgccggagctccgattgtttagaagacggtggcacatcgcgtcaggtaccacgttctgtgtgcgaggcttgggctgcattctggtcgtacagggaaccctgcagcctgcatggcattgtggtcgcggtaacgcttgagcctctcgtgagagtggtgaggtggcagtgaatgttttgtcaaggggctgatctcaatacatcctgtgggccaatcttccggtgcagataccttcccaatcgtagcttgtgtgctggcgtgtgtgcatgtaggcttcctcataccctacatctccggtacgttcgagtccttctcttagttttaatccctgcattggatctggtttatgatgttgaggcatccggtcgtcatgctagctcgccctgtgtaatctgaaacattgagtgaagcactgggaggatcagtaacaccaagcccctcctgctccacctgaaggggcctattccatcgaaagcaccggcatacagaacaattgcagcgtcggcacggccgtcagagtggctgtgtatggcatgtttgccgtgatggtggtggcagcatgcctggagtttgccatcgtctccataggattaaatggtgagtcatggatcgatgtggcacgcacagaatcgcgtggagactggcccgcatctttatctggttactctgtcccagggaggggatctttagacgctcaaggggatgcccccatccttgatccggtctgcacgattcctccccctcctccctgcaggtggaccccttgaggagtctaagcgggctcccattaaaccactgctctacattgagtttttcctctggatagtcctcctctcctggacaggtatggcgatgtgcaggcctcaggtccatgccactctgcattcacccagcacgaatgtgtgcgaaagggcaaccactgttcttctgctccacgttcaaggattgagtctgtcatctgtccaccatgccgcatcaaccctgttgcagtgtatgggacgtacatcgtcaggagtccgaatgtgggtgccgagtgctgggacaacaatccctgtgcctacagcgatgaccttcccgcctcgtgcacagggcccaaagttgcaggtgcgtcagcaggaggggcgagtgaaccctcgatcactgatcatggtgtcgtgggaatggctctacgttctcaagcccgtgggacagtcctttccagtgtggcccctcacaatcttcgtttgtgaattgcactttaatccttggcaccccttgctcacaggtgtcagtaccttgagccctccatgcaagttcgtcagtgagaactcgcagcaatggcagtacgtgtcggcgcgcagggtgtgggctgcttgtcgctccatcctgactggttacgcccatgcatgcgcctcacttctcatagccagccagcaccctttgtttcttggcaatcctgtgcaggctttgctttactgagtgggttgtctacggcgtgagctatgtgtggtttgctgccctcgacacagcggatgattgggactgccaagtcccgccacctgggactgaggacgttgaccagtgggtcagcgatacctatctggatggtgaggctgtgatggtgcatagaaagtatggtctgctgcacccagcggcgggacttgcatgtgtccaggactgacaggtcgcttctgcaaaggctcgaatgcctgtgagcggcctcgtgtggtctgctgctcatgtgggaagttttgtcctggatcacttccatgacgcaaacccgcaagcaggtgattgacgagtctctgagggctgaaaatctctacccctatccccttgcagggaacctgaccctgctccaggagatcgaggcagagggcgacggcgacgattcaacccaagttgtcacagatattgatttcactgcgacggggggtagcagggctgcggtcgctctgtacaacgagcaggtcaagggcgtgggcgccctcacacgtaactttgaggctgccttcctgaacgccacaggggtgcccttcaacccagatgccgcgggggagagcgccccctggtttccgtgccaaaactccacttgccagaagctcatccagtgagaagggacccgactgatgtgtgtgtgtgtgtgtggagtgccctcataaaaatgcaagattgccagaaacaatggttccttgcgtggctcttacggattgcagtggttacaatgcttgagtctgacttccttttaatccctccccattgtccatcagggctgcggatgagtgcacagagtgggacatcctgctcaggctccctgacccatccaaccgcaaagctttctttgagggcctggtgtggacaagttggggcatcctggcttttcaagtgtatgtaggagcaacgaagggggggaggaaggcggcacacaaattgctgcggtcgacttgcacagaccggacaatgcattcatcccttcaccctcctgctcccccaatgcagcatcctcgtggtggtggccttcaattccttcccggactacaccgaggttgacagctgggagggcagcctgcgacacatgagccgcttttgttgctgtggctccatcatgcaggaggctgtgctggacacttcgtgagatgggctgtggggtcccttcagcacagttgcaagggactgtgaactacactgggcttgatgccagaatagtggccgcaagctcattcttctgtatacacagatctgctggcagtttcaaccatgttcagccgcaccctcctcatctattatcccagggagccggcttcccgtgagattgccaagagtcttaacatgttgtttggaggcatcgaccttgaccccaccgaccggctctttgcagccctccttgtggcggagcaccagagcgaccagcggcagcgcaatatgcggcacatgctgagcagagccggtgcggggtttgaggtgctttgcgccccactgggtgttgcatgttgcccactgcatacttttacttcaatcctggcggcgaactgggccattctggcgctcccataacttcccccatcgcgtgcagggtacgtcacaaacatgcaaaggcagggcgccttcatcaaggggtctcagcgtcgagatggcgggcagttgagccagactccagaacccagggcccaccggtctgtgagctggcacctgcccccttcacccttcagttccaggacatctcgtgtcatgcccatgtatcggcgcacgatgatgaagctggatgaggtggcgctggaggagggcgggcgctttgatgatgccatgtcagggacagactcccctagcttgaagtgggtgcgggagcagctggggaccaggataaccctggcctaccagtacgcgcccatcatcaccccagtctgccttccggccgtgtactgcgaccacctcacgccacaggaagcggctgacatctactcgggtgtgtggtggtgtgcgatgggctagagggagctggtcatgctaggtaccaggatcacttgttccatgtacaacatccatctctgtcaccggcaattcgttgctagaaatcttctttgctgggctgttgtgtgggtgttcgagcctcattgcttgccaatgcatctgcatggcctgcaccacatccctcgcatgacagggctcagggagaatgttcctgtgcagcagctgaggcaggcccagagtatgtccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttgatactttgctgtcagtagagaggggtgtattgctgtgtcccctgcaagccagtggatgagcaccgtggccccacgagctcgacgactgcttcatggccacctctgatgcgcacctgggctttccccatctgcaggcgtccacccacctgtgctgccaacataaccctgttccggaagtgcatgagcaaggtgttccgactccaggactcgtacagacagcggaactgcgaagccatcctggaagtcacaggtgagaagctggcgggtctcgtgaagtgagcgtccacattgtctgcacggccgcagaaggtcttggacgaatgaggggcataggatacgtatgagcagtctggaatagctcagtggatcctgttgcacgttttccacacaggatcggacgcctcagacctgttgtttgtatcatgtgagcagctacgcggggaagcctctgacgcatgatgcagctgtgcctgagcatggtcccatccaccacccccacaaatcgtctcggccttcataccttcgcagacgccaacacttctgggggcgccctg

SEQ ID NO: 28823 - DNA, 61 bp, Chlorella protothecoides
cgatcgtcataaagggtggcatccctatccacccgtcaacctcgggtggtgggctgtgcct

SEQ ID NO: 28824 - DNA, 61 bp, Chlorella protothecoides
caaagtacctgcgtgggttcatatggcgggggagagggcctgggaggttgccaccctcgtc

SEQ ID NO: 28825 - DNA, 61 bp, Chlorella protothecoides
taccaacccccatggaattccccatactttgcaggagcttgccaaggaccagggggtcgtc

SEQ ID NO: 28826 - DNA, 93 bp, Chlorella protothecoides
gccggggctgcgcctaggggatgtgaaagggggggagaaggggcacaggatatctacaacatgcacaggatacctcaacctccgtcccacaac

SEQ ID NO: 28827 - DNA, 72 bp, Chlorella protothecoides
cccagagcgtctgagcatgcaacccatatcgctgccgatggaccgccccaccaagggcctgggtgtcgggaa

SEQ ID NO: 28828 - DNA, 88 bp, Chlorella protothecoides
ccccacctggacagtaggcatcctggggtcgtcccagccatccacaatgccgttctcgacaaaccaggtgagcttgcgcttggagagg

SEQ ID NO: 28829 - DNA, 11136 bp, Chlorella protothecoides
  modified_base (9984)..(10058): a, c, t, g, unknown or other
  modified_base (10397)..(10483): a, c, t, g, unknown or other
  modified_base (10712)..(10780): a, c, t, g, unknown or other
gcggcgcgcagaggccgcggcgccggcgcggccgggcgcggggttggcgccgccccgccctcacccgcgaccccgggcgactacgtcgtccccgcgggcttcacctggaggcagctgccggccgtgaatgtgagctccggcgtcctggcggcgcgccgctccatcatcgtggccgccgtgcggcgcttcctggccctgcgtgaagaggtttgtggtggtcttgggtgtgggaggccaaggagggtgaaggggcctgaatggccaggatgggcaaagatgcatgtgtggcgacgctcagcgcaggaggatccggctgcgaacatcccgccacccactcacctgcaacgcgacttgctcggagaggcaggcgggccgaccgcatacgtactcttcctgcgcccacaagccatgcacctcccttcacctgctcccctcactcacatgcagctgcccgcatcgcagcgaccctcctacgcctcgaggcgagagcacctgaggggcgccgacgtgcggctcgccggccgagtcaccgccgagtttgcgaccgccttcccgcgcctgctgcagcagctgggctacgacgccgggctcttcgcctccgtgtggctcaaccgcctgcgccgggggtgggacagagtggatgggacgctggaggcggggctgggagtgctggaggggcccgtgcccggcggcggcgccaagagccctgccagcgagggcgcctgggcgggggaggggcccgcgctggcagtgcgcgacgccggctgggagtctggcaggagggagcgggaggggacgccggggagcggcgccgacgagggcgcgagcgccggcagccgccgcgcgcggcggctggaccgggaagcgcgggacgacgacctgtccgatgtgggctggaggtggcaatgtggagaggggtggtgagggggtttcatgcaaccggccttcgagcaggtgcctggtgtaaggaagcaagaggtccatcgatgcctctcagcggccctccccctcgcacccttccctccccttgcagcctgggatcggtgcctcgggggggcatgccggcgcgaccccggggcgcaaggcggccaggggcgtgtggtgcgggccgggggtgtcggcggaggcgtggcgggcgggcgccgacgcgcgctcctgcctgtgcacggccttctcccccgggccggctgggaacgccgccgctggcgccttcccggacaccccccgcttccacagctggctggccgtgggcgcgcgcggcggccgggtgtggctctggaaagcgcggccgccggagcgcgggccgagcctggacgccaccgcagccgctcgcccaggcgaggccggcgcctcgctgcgcctcgtccgcggcctggccctcggcgcctcctgggtcacggcactggccttcctgccgcacggcggggagggggcccatggcgcggcgggacccaggtcatcgcagaccctggcggcgggcatgtcgtgcgggcgcgtgaggctgctgaccctggacggcgacggcggcctgcttgcgcagcgctgcgtcctgccccccgacctgagccccgtcacctgcctggccgcggcggccggctgcgtcgcggccggcaaggccgatgggaggctgcacgtgtgggcagcgccgctcagggaagcggtcgtgtgtgggagccaggtcgccgtgcaggggcctggggacgatgctgtcgaggacctgcgagcgagcacagagcgcgacaccgtaggctgccccgcagccgcgcacgggcaccgcccggcgacgggggttgcttggggccaccgagggatggaccccggcgccctgcccctcctggtctccgccgggctgggtggggagctgtgcgcctggagggtggagcgaggagtccacgaggtgaccctggccccagcccccgccctctcgcccgccggcagggccaaggatgcggggtggggctgcctgggggtggccgcttcgggcagcggactgctaattgccacgctgcgtcacgcccgtcaccccgccacagagctcgtcaagtgagtgtgtgcgtgtgcgtgtgtgtgtgtgggggggggacattgcacctagttcccaggaaaagaaagggggtgagacacctactaagaagggtgctgccacatgtccaggctcctgtgctcgtggattgttgggggtgagaccctggcaagacaccttggaggcgatgaaaggggtcgcactctaggggcccctcttgacgcggccgtgcagcctccatcatcctgctcacaaaatcccgtcctcctctttatcacaaccgcaggcagctccaggtgcaccagagggtggtccagtcggtggtgcggctgtattgcctccccgaccccgaccagcgggacctgcagcaggcagcgcgggcctgggtggctcggggcgcgggcgccggaggcgccatgcccttgccctccgccctctgggacgtgctatgcgcgctgcgtcagcccaccgagaccgatggcgaggaccccccggcgcgcctgctgagctggctgtccgccggcgcgggggaggcgcacggccagggcgccgcgctgcgctgcgccgtggccgcgctgcgcgtgctgagcggcagggagcctggcgccggggcggctgccatggagctggacctcctgctcaggcgcgcgcgtggggcgctgacggccgcgctggcgggcgatgggaggggcgcgacagccaactgccctgtcgaagatgaggccactgaggcggtgctgggccgggtggcggcgtgggtgctggccagcgctggcgagagcggagtcgacgaggagctgctgggcctggccgctgcggtcccacagcgtaacgagctcgacgcatccgcgcccctggcggggggcatggagggggccaccaccgccctcaagacgctcaaggtcagattttggggaggacggcgcatggtccatgtgtggggatgcccgtcgcttgagatcccaggttccaccctttagaaacgcctgcctcgccccaacctcaaattcattcctccataaaaacaggacgggagcacagtcgtcgtcgcgcgctgccccctcacgctgctgccgctggaaacgtccaggacgtggcagtgctgcgtgtgcgaacgacgctacgcgcgctgggaggcctctgggtgcgtgctctgcgcgggggcgctggggccgctccgggggagcctctgcctgaacgtcccctgcctctgacgtcgggcagcgctgcaggggctgtcggttcagtcctacagctcatcccatgtacttccattttccggatcatatgtggtggtgttgagtaacaccagtaatgtgaggtcagggagtcagggttgggcgcccgctcaggcggatgtgaacttggtcacggccttggtgccctcagacacggcgtgcttggccagctcgccaggtagcaccagccgcacggcggtctggatctcgcggctggtcagggtgggcttcttgttcacgcgggacaactgggcggcctgggtagcgatcttgtcgaactggtccacgatgaacgagttcaggatggtgatggccttggaggagatgccggtgtcggggtggacctgcttgagcaccttgaagatgtagagcttgtagctctccacgctcttcttgctggtcttcttcttgtcgcccgcgggcttcttcgccgcgacgggcttcttggccgacacgggcttcttgctggcgacgggagccattttggagtagttgatggaaacagtggttatggatagtaatttgatcggatgtctctccttccaatcttgtgtttccgagtgcggagttgtgcctatccccggggtttcttaattcttggcctcccggaccggtctgcacatgttccagaagaggtttattacaagatcaagttcgcccaactcgagcataccacgctccaatatcccgcacagattattagattagtaaccatgtctggacgcggcaagggaaagacctccggcagcaaggccgtgagcaagtcctccaaggcgggcctgcagttccccgtcgggcgtatcgcccgctacctgaagaacggccgctacgctggtgagtgcatggctgttcgggagtctttattcagagtaaatctgcaaaaattccggtcgaccatcctctcgtgactctatgcaactcacagagcgcatcggtgccggcgcccccgtgtacctggcagctgtcctggagtacctggcggccgaggtgctcgagctggccggcaacgccgctcgcgacaacaagaagacccgcatcgtgccccgccacatccagctggcggtccgcaacgacgaggagctgtccaagctgctcgccggcgtgaccatcgccgagggcggtgtgctccccaacatccagtcggtgctcctgcccaagaagaccggcaagaaggacgagtaggcaaccttctattcaagaaaaataactggtgttattcgacaccaccaccttggataggaaaataagtaccaagtatacagcaagatcaatacgtcatcgtgaagggttgtcacaaggaagcagcaagattgcacagcagtgtggtcctcatgtgggaggcacagcacctaggtcactgctcgcagcttcttgtttcaacggtgcagcgccgccgtccagcgcgtgttcggagatcgcgggagtgcgggggtcaaactggtagttgggtgccaggaggcaatcgccctcagggggcaggcgcaggccatagtgtggtttgatctctggaagtgcttgggcattgatctctgcggcaagctgttgcaagacctgtgcaatgcatgaggatttcctcaacaatagtagtgtgccagacactcaaactgctcacgtcataaacagcatgcctttcccacataccttcagcgacggcggggtggtgaaggtgtgggcagatgccagctctgttgccaagactacatgtggcatggtcacctctggtcgtggtcccagcgacctctcagcaatggcctgtggaatcgagagcgcacaagggacctcgagtaacgaacaggactcaccatcaaggttgaaaaggggcgcactacgcctcccatacattcaactgctccgtacctcggcgtcctgcaggcactccgcagtgtaccggtactggaagtcgagcagctgctggatcacacgaggctcgtatgccgtgacactctgagggggggaggggaggagcttttgtccgtcggtactggtttggccttcggagtcagggaccgaacagaacgcgaccctcgcttcacctcaccatgctccgaaggagagatataatcttgacgccatcaggaggcagctcctccggtgtgctcatttcacgctggcacttgaggtgttcctctttgcccacaggaactacggcacaaaagaatcgactaaaaaggattataacacgaaattatcacccatcatgtgcaacaaagcattatcggagacgaggatcgtgccttcctttagctattgttgctttccgagccagtcatcgcgcgcgccctgccatgctggcagaacaaccgcgaaggggaacaaacaatcttagtgatgcatccaccatggacacagaaagacagtcacagagcacttcattaatcccaatcagccatcatggcaatcgggtagcagtttgacatccgtggctgcgctcgtcgtgtgcgctgtgcccccgatcactccattccatctgcctgcacaagactcattttgcgggtgaattattgatcgcacaggctgaatatagtaatttgcatatccatcggatgccatcaaagagcgtctacaacgaatggctcccgcagcacctggcggagcgtgtcgccacaggtgcgtgagggttttggggtatgttgccagagcacagagattccagcctgcccctgcagagccccacgccatactgctccacctgtaccaccgtgacacagaggaaccagcgcggtatgctgccctggtggcggcgctgaaggcgcagtgggagcgcgacagccgcaccctgtctgctgccgaggccctccgggccacccagccctacatcgccctctgtaggacgtgagtgtctatgacttggaggagatcgcgctgtgatggtgccgactgtgggcggcgcatggctggggtgaagtccctgagatgatctcagggcagtcaggcttgataatcacagcgacacctgctccgccgcccctctttcacgccctccctcctccctccctgacctggcagcctctaccatgcacgcgctgacctcgacagcacctccctgcatgacctggtacactgccagctggaaatggtggcgcagggtgagggcgacctcatggtgcagacgcggtgggcactgcagctgcagcagctgctgcgcacgcaccgcagcaagctgagcatcgaggtgccctggcgcccctggtacctcatgctgcgccgcacggtactgcgcgacgacctggagtacgagggtgggtcatggcgacggggcggagctggaaccaggggatgggtcaaggagggggtttgaggcgggcacgacgcgagagactgaagcggtgctgggcgggctacttatgtgttacggcatggaggcgatacctgtacttgtcgacagaggtgttgagtccaccagcctcgcccggcgagcgacgcgcttctgcgccactcatggtcaaggctgggtccggtttggcatccatgttgcccattggcgccccggcatccctgcacccccccaaaacgcatgttcacccccccctccctccatttcgcagggggcgcgctgtcagaggcgcggcgccagaccctggcccgcctcatccaccgcctgcggcgccacttcccccggggctcggccgccgagatctgggatgagttcaagacggcgctgcgggacgtgcagcgtgtcgacggctttgaggtgaatgttttgggggagagggagggaggtggttgggaaggtgaacgagcacgcctgcgttgagcagccgacacaggaagcactgtcatggccgagaagccttggactcgcatgctgggcgtgcgccgaggcctcacacccatctcccagaccatctgccccgcctcgctcaccattgcttaccccccccacacacccatgcccccccaggccctgggctggctgaccatgctgctgccgaccacggcgctcaaggccggcgacggcgactggggcgcctgggcagaggagtgggtcgctctctggcgcgccgtgccccactgctcctactgggacgcgctgtggggcgcgctcttcgcgcgcctggcctcccacgacgccttcggtgggtgccgggcggggggctgacgcgcgggtgtgctcacatggcggggtgcctcccaagtctgggggtggaggaggtccggcaccaggcacctagtggcctggaccgtttggtgtggtccgccccgagggcttttcctgtgctgccggctcgtcctttgcgtgagggccctgcctgggtcgcggcgtcgtcccctcattgccccaggctccgacgagtcctgtcacccaggcacaccaccaccgcccccctccaggcctgatcgactggcaccaccacctgcccgagctgtacacccattttctgtgggccttccgcgtccccgtgggcacctccttcgccgacccccccttctccttcgactgccccaagcactgtcaggtgctgttcgccaacgagctggcctcccgcagcgagtgcgccgcccacgccgccatctacatgctggggcacggtggcggcccccccggcgccgactccgcgctggcccacctggagggcctggtgggcctgctggagcagtactaccacccctccaacggcgggcgctggaactcgggcctggcccacctgttcaagacgctggcctccgccttcggcgcgcggctgctggccgagagcaacgccgcgcggcgcaccgcggagcgcgcacgcggcccgcgcggcgcctccgccccgcccgacgcgccagcgggggacgcggaggcggaggtggacccgggcggcgcaggcgcggaggaggacgccagcgtggacggcgacgacgccagcgaggccagtgaggccagcgacgacgacgtgcaggcctcgggttcggacagttcgggcgaggacgacctgctgccagtgccgccgggcgggcggcgccgcgcgccgctcaccgacgtggtagtcgaacgggtcgtgggggctttgctgaggctggcctccaaggcccagttcagcaaggtaggctttacatttggtttggggggtgggagggggaagggatgggggaatggaccatgtgagggagaagaggatcaggaagggggtagtgacagacggaaggcctccctccgggtgaccaatgcccgccttacgggagcttggctgaccgtcccgagcatgattctccatgcgatgctgtggctctcgcacatggggcgagtccttgcccgaaatccaaggcacgtcctgcccagcctgcatgaacaccccccccctctacacacacacacctcaaaacccaacaggacaaggagcttcggcgcagcgccacgcgcatcctaggcctgctggcagaggtgtcgccgcgcgcggtgctgcccggcgtgcacgcgcactttgtggcggcgctggagacggtgaccagcaccagcgtgctggccagcgccatccagacgctgagcctctgcgtgcgcccgctgctcgtcgccgggctggtcctgcctcccgaggacggcggcggcggggttgaggtcgctgtgggcatgaacggggatggtgaggtaccagggggcgccgatgccgcgcgggccaccgccggcgcctcactggccgccgcgctgatggccaccgtgccgggcatcgacgccaacgacccgcccaagagcctggccgtcttcaggttctatgccatcgtgctttcctccctggcccagcttccggtagggcgaggaggtgtctgtgtgaggagaacaaaccccagtcttgacgacagtgtctgcttcaggaccgagctgccgcactcctcgaccgccactgccggctacattcgatgccggtctcaaggtaccccctcaatgcaccctttccaggaggtggccaccccaggcttcccgctggagaccgagatctgggtggaggagctgctgtcccacgtctttgccgtcatctccaacctggacgcgcctgagcacaggggtgcgtcggagggtgacaggagggagggccgcaggggctgggtgagagcgctgctgctgcgaggggccggggcggctgtgtgtgagtgcctgactggccgtgcgcggacgattgattgcgacatggaacgcgtggtagggtagtgcatgccgcagtgcgtgatccatggtggtgcaccgggtgaccacagcaactcccttttcccatccatccacaaccctcccaaccacaacccacccctcatcctaacccagacgagcaccaagctgaggggctggggtctggggagggagaggagaccttcctgcttgacggcaactccatgttccgcccgctcatggagctgctcttctcccgcctgccccccggcctgcgccggcacgccatccagcgtgtggggcgcttcctgctggagaccacgctgagctcggtgatggcggaggccgcggtgctgtgcaacgccgtggcctgggccgacccgcggctggcgggggagctggtgctggcgcccacgctgcgtctgctgcgcgccgacgccgaggcggcggccgccgcgccgcgccgcgccggcgcgccgcgcctctcgaaggcccaggaggcggtgctggcctggcgcatcaaccttgcctccagcctggtcatgtacgcgggctgtgcggcggtggcccagaaggtggaggtgctgggcgcactgcgcgcgctggccgcgctgcccgcgctgcctgtggccgaggcgctgcannnnnnnnnnnnnnnnnnnnnnnnnnnnnnnnnnnnnnnnnnnnnnnnnnnnnnnnnnnnnnnnnnnnnnnnnnnctcctccctgctcctgggcctggtgcaggcctacccgctgggcgggttcgaccccgcgcccgccccccgccgcctggccctgcccggcagcggcgtggagctggaggccttcgtggagctgcgcggcggcggcggcgagcgcccgcgctggcacgcgccggacgccgcggagctggcgctggcgcgggaggtgctggacgcgcacctggccgcgccgctggcgcgcctgggcgccatgctggacgcgggagactttgcggcggcctgcaccgccgaggccggcgcgcgcggagggcgcgaggccctgcgcgccctgctctggcagctccagggctgccnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtcggtgtgcctggccccgctggccgcggcgcaggcggcgggggagcccacctcccccccggtcagcctggtgggggagctgggcgccgcggtcggctcggcgcgcgagcgcgaggagggcgcggctgtcgtgctgcgcgcgctgcgcgccgccgacgccgccgatccggacaccctctacctcctgctcaccgtcgccgacagcttcatggcgggtacggccgggnnnnnnnnnnnnnnnnnnnnnnnnnnnnnnnnnnnnnnnnnnnnnnnnnnnnnnnnnnnnnnnnnnnnnaggctgggatgggaccgatgcgtcgccgggtgggcgatggcgtacaggcaggccgcggcgtccccggggacatcccgcgccacccatcccccccccccaaaccccgcagccgggagcgcggagtactcggactcgctggaccacgcctcctcctgggcggcggacgagaagtgggtgtcggagaagccgctggcggggcggctgtatgtcggcgcagggctgtgggacccgcgccggcgctggtgccggcgccgcccgcgctggctggtggccgagaagacgttcctgagcctgcgctggcgcgcgtcgcaggcggcctaccgcggcgccgccaccgccgccgcccccgcgccggc

SEQ ID NO: 28830 - DNA, 81 bp, Chlorella protothecoides
ctgtagtgaagcaccggcaggcaagttgcatgactccacgacgcatgaaacatccagtgttcttcgcatcacctcgaactc

SEQ ID NO: 28831 - DNA, 862 bp, Chlorella protothecoides
aaacatggtgccatttcagtgacgattgccggtgttgcatgcacatactgccagaactgatcgcggggcatatcattgcagggcccagactccagcgtgcccagtgcgcctaccagtgcttggcccaataggcagccgaacggggatcggaccagcttgcgacgtaggggtcgctccaatagcaccagggccgtgcctgtggattgaaaatggagtgaagaagtgcatcagggttgacgcttgcaggtactggggtggacagggactggagggcagagggagtcgatggtgcgagctcaaggtcaaccacacacagcacatcatgagcaagggatgcaaagaaagactcagcatcaggcctgtgaacgcaaaggcccaggtgatctccatggcctgtgctggccaatgtactgtgcgacactgtggagtccttctcactcttggccccttgtcactcagtgaactctagtccttgagactacgttccagatggggttcagctgcagcggccgctgctgtagtgcacgtcccaccctttggccgcaaggcctgcccaagaacgctgcattgctgcggaccagcatggcagatgaagccgccggtgttatgctgggtgccacggcccagcacccagagcataagggaggcaagaccatccttggagaggtcagccagccttcccagccccgacagtaactgcgtggcgtccagcgtgtgagagggcaaggtggcagggctctgagtaggcgagctggcaccaagctctgacagataggtggatgtttttgcatgcgccacagcctctgcatcctccacgagcttgcggaacacactctcgccagtccaccgactaatcaagcac

SEQ ID NO: 28832 - DNA, 487 bp, Chlorella protothecoides
atcggatgtggatttccctagctgctcagaaggaggcgcacaatgaggctgccagtaacatagcccacatcaaagatgctggtacatgtccgcacagtgtagaaaattactgtgagcggaatgagaaccttccgtcgaggcgtatttgctgtttattgggtttatatagctcatcgagggtctagttcagaatgaactcaagtttgcggctgcctgagtgtcctgtactgttggatactgttcatctgttcataatactctacacacgtcttgggttcaactactggcacctaccgaggtcctagctgggttcccaatccttcggagaatccttatctttggattgcaagaagcagtcagaatcgaggtggccagattacacgtgtaccccataccagagcaccacaggatcagtaatgaggccatctacgtcgtcaaccaaggacccgtggatttgatcaaacgaacgtcgtcggtgtccagtgtg

SEQ ID NO: 28833 - DNA, 61 bp, Chlorella protothecoides
tgtagagttgaagactcttctgcactttcaaccctgcagccgacatgaaagcccctgggct

SEQ ID NO: 28834 - DNA, 111 bp, Chlorella protothecoides
tcccgtattctccagctgtgcagcgattggatttcagggtttggtttgacaacaacttgtcaatgtggagcaaaccaccatgagtttggggagccccccgaggcccctcag

SEQ ID NO: 28835 - DNA, 65 bp, Chlorella protothecoides
gctccctatactctcaacatggccaacattcgatagcttggcctcgttctgccggcgctgaggag

SEQ ID NO: 28836 - DNA, 61 bp, Chlorella protothecoides
gggtgtgagagaggggctggtacgggggggggggcgcaaagtggagcgggccatctgcctc

SEQ ID NO: 28837 - DNA, 61 bp, Chlorella protothecoides
tgtggatggtcagctgttcttgatctcggacaaaagcggcccagcattctgccggtgagac

SEQ ID NO: 28838 - DNA, 3382 bp, Chlorella protothecoides
  modified_base (1124)..(1133): a, c, t, g, unknown or other
  modified_base (1671)..(1737): a, c, t, g, unknown or other
  modified_base (2258)..(2267): a, c, t, g, unknown or other
  modified_base (2439)..(2448): a, c, t, g, unknown or other
  modified_base (2967)..(2976): a, c, t, g, unknown or other
tgcgcgccgaggggtgcgccgctgtggctgccgcccccgggggccgcacctggtcccccgcccccgccgggcccttcggcaccgggcgtgcggcgcgcaaggttggcgccgtccagcaggcgccgcagggcggccaccacctgctgccagtcctcgcagaccttatcaaagggcggggcctccttcacgtacccgcgctcgtccaggtgctcgcggtagcccacgggcgcatagcgcagcagcatctcctgcgtgtagatgcccggcacggtgcggctgcgcaggatgtccatgatgtcggcggggatgatgatgcccgggggcgggtccaggcgcttgtgcagctccagcgcctccacctgctcgtccttgtactccagcagccgctccagcagcgcctgcttgcgccccgccgcctcggtgctcagctgcgtggcacgcagctccgccgccagctccgccaccgtgccctctgtctccgccatgcgcgacttctgcttgtcgcggaagcgcttctgcgcctcgcgcgcgcgcagctgcttcgtcgtcagctgcgcggtgtcggcggggcggcgaccgcgccgcttggcgccgccctcgggcgcgccgacgtcgggcggggtccggcccccgctgccgctggcgagggaggcgctggtggatgcagacgtggcccccgctccaggcgcgccaggggcgtgcaccggcaccatgggcggcggcgcgcccaccagcggcagcggctgccctgtgctggccgcttgcagcgcgtacccctcgctgacggtgtacaggtggcggatgtcgtcctcggtcaggcccgtcatgcccgcctggcgcagcagcgcggcaaactccagctgctgcggattcagggacgtggagccggggccaggcggggcggtggcggcgggggcgacgctggggtcccaggccatcgccccggaatccgcctgcatgcgcagcgtctgctggagcaggttgtgggccgcggggagggccggcggaacgggggaggggacgggctgcgtggggggtaagggagggggccagggaggggctgggaatgcacctccgggagccattcttaacaccgacaggcagacgtaccctccgttcaaacnnnnnnnnnntgggaggggacgggctgcgtggagggacggggagggggccagggtggggctgggaatgcacctccgggagccagtctcaacgccgacaggcagacgtaccctccgttcaaacgcgtgcgcgagggtcgggcgacaacgagccctctctcacctccatctttacccagacagagtcgtcgtccgcctccatgggtcccggcggggggaacgggggcagcggccctcccacggcgatgccggaaaattctggaacctgcgtgctaccccatcgctcagggcccaggcctgctaagaggttctccaagctagcagatggtgtcatatgcatcaagatggacgcgcggtgtgcccggtgaagcctggtcgctcctgccttgggcacccacagtacatgggaaaccccaggagaccaacgaactgggataatcaggtcccagcggtagcctagagtatcaagcaatatttaagagatcgaggccaagggtcaaagaggcaggtcccgaatttggaggaggtgagcgactcgcggactctcatnnnnnnnnnnnnnnnnnnnnnnnnnnnnnnnnnnnnnnnnnnnnnnnnnnnnnnnnnnnnnnnnnnnagaggtgtaccctccaacaaaagaaactcaatctcgcacacactctgtgcattcggcgtacatctaatgctcagacttgcgtcagacaatgaggagggtcaggaatatggttgcatgaagcatggacagggcacacacatagctgcccactgagactctgaccagcgctgtatggcaccgcaggtacactctgaacagcgcgatcaggggactttatcaacataattcttctctagtaggcttttgagacgatttgcatgacgagctgcacccatcaaccttgcgttgtcattgatggacgggtgggtgaacacctgcaagtggtgtgaccttgagtaagcaaagcaaagcaaagcatatggagcagataattatattccggaaagctacgaggttgaatgcatgttcagtcttctggagggcaaggatccatctggaatggagcgccttcctgctgcatggcccgtttgtgaagacctggccgtggtacccccatcgatccttttcagaaaatcgctgtnnnnnnnnnnttatggaatggagcgcctgcctgctgcatggcccgtttgtgaagaccttggccgtggtaccccatcgatccttttcagaaaatcgctgtgccgtatcccttgcacggtatcttgcttgcttttattcgttgacattagaaatataaatgggaagcgtaggagaggcgccacnnnnnnnnnngtcttgcttggcttttattctttgacgttagaagtataaatgggaagcgtaggagaggcgccaccttcttccctgtatctctgagggcaatcaaggatgtcgagggactccaggtccccgacgaggaggaggagcagccgcgggcgcagttcatcttcggggtgcgttcaagcagaatggacgggtctcacgcgcttgactgtctagtcaccccccgcactgcaggtcgggccctcctacttcagcccatcctcctaccccacccaccctcgcaggagttataccagcagcgacgacagccgatccccgaggagaaggtcccgttctgattcccggagccccgccaggcgacggtgcgtgtgttcaggatggcagggaggccctgagggggtgcactgcagccctgcataacacaatagtggctgggaacaccaagggcaatgggtggggcctgactcctggcttcccaagctcaaagaatgattgctattcgtgccctgtcagcagatcccccagcannnnnnnnnngaatgggtagggcctgactcctggcttcccgagctcaaacaatgattgcaattcgtgccctgtcagcagatcccccagcagcagtcgttcccggagtccgagccgtggccggaggcccagtccaaggagacgccgctcgccgagtcgcagtcccgaggatcgcaggcggcgtcagagccctgcggaggcgaggaggcgtcacagcccaataatttttcggagggatcccagccccgatgaccgcaggcgaggcaggagtcctgtggagccgaggcggcgctccagccctggcgctggcccccgccgggactggggcccgcgcgaccggcgccagggcagcgggagccccggccgccggccccgcgacgacaggcgcaagggcggcgccaacgcggcgccggcgcgc

SEQ ID NO: 28839 - DNA, 79 bp, Chlorella protothecoides
agacctgcatggcgtgggcgagggggctggacaggcctacagaaaagttgctgggctgaggctgccaggttccaatttc

SEQ ID NO: 28840 - DNA, 61 bp, Chlorella protothecoides
agaaacaaagcccacaccaatttttgcaccatccccagaagccacgcatgccgatgcatcc

SEQ ID NO: 28841 - DNA, 166 bp, Chlorella protothecoides
gcggtgcaagggtcccagactctcacagtctgtaccaatctattcttgttctggtgggttgcaccttgcctttgcacctgcaactgatggtgcatgcttaaagtcgcaagggcaggtgccaacaccccttctcccaacgtatatgctcaatcaccaggcccattga

SEQ ID NO: 28842 - DNA, 79 bp, Chlorella protothecoides
acgtttttgtccaaggatgcaagacaaagattcttaaacagtctgcgggtgcaagtacatagcagcaagaagactgaag

SEQ ID NO: 28843 - DNA, 71 bp, Chlorella protothecoides
ccacacacgcatcctgatctggttcctggtttatggacgatactgctttcaaacagacaaccaggatgggg

SEQ ID NO: 28844 - DNA, 61 bp, Chlorella protothecoides
cacgacgacagacacccaaccatgcatcgcccgcgagagcatgctctggagccaatgagtg

SEQ ID NO: 28845 - DNA, 96 bp, Chlorella protothecoides
atgccggcgacaaggcagacatgcatgtcagacagagatgcaacaagcgatatcgtcaaccataatcctacctggaggatccgccagaccatcttc

SEQ ID NO: 28846 - DNA, 62 bp, Chlorella protothecoides
gagtggcactgatctgttgcagcgagaggttaagcttgcagaggtcaggttgtttcagccag

SEQ ID NO: 28847 - DNA, 61 bp, Chlorella protothecoides
tcctggccaggaagggtctggcttggagggtgcctccaggtaaacacgggacactcccctc

SEQ ID NO: 28848 - DNA, 208 bp, Chlorella protothecoides
aggatgtgcggaaagatggagattaagagcggatgtagacgtctgacataaatacaggacaaaattacttttacatatgcctgacggagggagcaagggttgcggatgccacagcttctgtgggcatccgcaagccaacgtcatgtgcgggagcgagttagacggaccggcgacatcttccgagttgcacgcattcaccccaactccc

SEQ ID NO: 28849 - DNA, 62 bp, Chlorella protothecoides
cgagccgattgaagtgcacaccacaatgatacattctgctagatacagaggcgtgcacggac

SEQ ID NO: 28850 - DNA, 63 bp, Chlorella protothecoides
aaactgggacgtcttctcattggtagggaatgcgcatgcggtgcagcagcccatacgacgctg

SEQ ID NO: 28851 - DNA, 61 bp, Chlorella protothecoides
gcgaattaccccagcctgacaaagaggttgtgcaggtgtgagctgtccagcgcacacggca

SEQ ID NO: 28852 - DNA, 192 bp, Chlorella protothecoides
gcagtgacccttcccaaagcctccttcagactcacctgacatgcttccggctgccatcgacgctcatgttataggacgcatccaaaactaacccaaacttggtagcaatgatgaccttctgccttggaatgcctgcaatggccctgcctgagtggggtagggtggagggaaattggttggtcgaaggggggg

SEQ ID NO: 28853 - DNA, 105 bp, Chlorella protothecoides
cgtttctgagccgcaacatattactacagcccttcttagcggcaagtgttcccattgctcccttcccagatcgatgatggcgagctcgaggtgccaagtgcatag

SEQ ID NO: 28854 - DNA, 61 bp, Chlorella protothecoides
gtgcggcgtggcggctgtgctgctcgcgaacgagcctcccctctccctgcagcgtgctgcg

SEQ ID NO: 28855 - DNA, 61 bp, Chlorella protothecoides
gcggcatgggatttggctggcggtgcggtgtcttcctgattctctgggcgaggtagtggtt

SEQ ID NO: 28856 - DNA, 61 bp, Chlorella protothecoides
gtgtgtgtgtgggaaggcctgcaatctgtcacaaggtcgcaccgactggatggcgcgcgcg

SEQ ID NO: 28857 - DNA, 163 bp, Chlorella protothecoides
gaacacacgagtgaccccctcctccaaggaccgcgctggacctgcagggggatagatggagttgcagtcatctcagctgtggacggcggacgtcgagcctagatgttcgggtctgcgagagtctggccctcgcccagccactgcgcccctcccatgacgccat

SEQ ID NO: 28858 - DNA, 182 bp, Chlorella protothecoides
ggggcagtcctacacggtctcactctatgcacgggctggcgaggtgggatgggccaaattgtttggggtgtgattgcccgtgcagagagtgcggagtgagacgcgggcaccatgtctgccgtgggtgctttagtactgaccctgggtctgggtcagggctgcagcatgtccatgtctggtgt

SEQ ID NO: 28859 - DNA, 96 bp, Chlorella protothecoides
ccagggggggggggggggatcctataaccaccaactggacacggtcccctctgatcccctaccctcacctggtcatggatgccgtagatcgcccac

SEQ ID NO: 28860 - DNA, 92 bp, Chlorella protothecoides
tcaccaggtgatgcgcgttccactgcgataagacttaattactttgggaacgagactacctctcttgcagtcaattgaatgaaactttcaag

SEQ ID NO: 28861 - DNA, 61 bp, Chlorella protothecoides
ctttggtggacccagcagccagagggcgcctccccctaccaaagcaagcactcggcagcct

SEQ ID NO: 28862 - DNA, 82 bp, Chlorella protothecoides
ctccacgccgcgcgcctcccattcggcgcacacgcgctggtcgccgcaggccagcagcagctgccgccgtaccggcgtcagg

SEQ ID NO: 28863 - DNA, 79 bp, Chlorella protothecoides
gaacatcagaacgtgatacaaagaacagcgatggccagcttcgatgtagcatcatgacagggctgtgtgagtggtttgg

SEQ ID NO: 28864 - DNA, 61 bp, Chlorella protothecoides
aggcaggtgcaaaagtgttgtgggggccccatctccggagtcttcccccctttccacctgc

SEQ ID NO: 28865 - DNA, 79 bp, Chlorella protothecoides
ccagaggcaggctttcgctctgcggcgaattgagattgtgtggaggagatccatggttcagcaccgagtggtggccgcc

SEQ ID NO: 28866 - DNA, 132 bp, Chlorella protothecoides
attactttgcccccgtctggctcctccccagcgactccagggggcaacgcacacctctgactcctccagctcggcacggagctccatgacctgagctgcgtggtcggccgcagacttgacctcaagccggtg

SEQ ID NO: 28867 - DNA, 132 bp, Chlorella protothecoides
gcgggcctggctggtggaggttgcagcgggtggctgtttccgctgagtccaaaagaggaggcccttcccgcctgggtcttcgtcgcggtacatcaccagggctggcgccacttccagatatccactcccccc

SEQ ID NO: 28868 - DNA, 78 bp, Chlorella protothecoides
cagcttcaggaattctgcatccggaccctcgatgccatcggtctgacggcatccagggggcgctctgaccgcctgacg

SEQ ID NO: 28869 - DNA, 71 bp, Chlorella protothecoides
cacggctatcgtgctgactcatgagcggaaaagcagcagcgcgtgcttcctcatgcaccgcacctggacca

SEQ ID NO: 28870 - DNA, 237 bp, Chlorella protothecoides
tgtgagtgcgaactcccgctatcttatgtacattttacatccatctgagcgataccagcagagacgtaccggcgcaatgcagcaacgcaacaagacttcatcatcaagcatgagagctgttgacaataaaccgtaatcatgattggtatgcgacataaatatgagactgcctggttcacagtcagcagatgtgcacgatactgcagtaagttcaggctgatgcagtttgaagcgtca

SEQ ID NO: 28871 - DNA, 75 bp, Chlorella protothecoides
tttgaatagaggagtggggtggtgtgggatcaaaagagccggctgatttgggtggtgctgagctcctcgagcaat

SEQ ID NO: 28872 - DNA, 215 bp, Chlorella protothecoides
agagtctaccgggtggcagcatgagcagcgagcttcagtactaagaagtagccgagtttgttttgcatttcaagacagaattgaaggcgctgggagaacatcacgctcatctcgacttgccagccagtagcatgctgctgcatgcggtaaagcatgttttatgcgcccaaccgctaacgcacacatgctcgccaccaggctgtggtcaggcaggg

SEQ ID NO: 28873 - DNA, 61 bp, Chlorella protothecoides
cagggacaggtgcttggctgctatggcggggcctgtgtactcatccgccttgccctgcagc

SEQ ID NO: 28874 - DNA, 107 bp, Chlorella protothecoides
ccgcacgtcccccagccgcatgtgctcctgcgatgcaagggtttcaggaaaggggggagtcattggggtgtgggctgtgccgcatcagagtgacacgcgcccagcca

SEQ ID NO: 28875 - DNA, 151 bp, Chlorella protothecoides
ggcatgcaggcgccagtcaaaggagcgcacgatccgatccacctgctccagagggagcgcccacgcccgccacccactctgcccgtcggcgcccgccgcagcagggtcggcgggcgcatggacggtgctgcagcggccactctcccccttg

SEQ ID NO: 28876 - DNA, 121 bp, Chlorella protothecoides
aatttctgggaggtgcgctgacgcgggaggtgaagctcctctcagaccgagcatgtctgggctgagaagatcgcttgaggtgctactggcctgtcgttcatcctggtgcagcaccggcgga

SEQ ID NO: 28877 - DNA, 65 bp, Chlorella protothecoides
cccccccccccccccccccccccccgcccaccccccccacccctggcaggaccagtgtggaggac

SEQ ID NO: 28878 - DNA, 63 bp, Chlorella protothecoides
cccacccctggcaggaccagtgtggaggactggggacctcgtcgaagaagacgagtatggctg

SEQ ID NO: 28879 - DNA, 86 bp, Chlorella protothecoides
ctccggggcaggttgcaggcgagggtcggaggcgggaatgtcgggagttcccctcacgatgccgctgggcgaggtgtcagaccagt

SEQ ID NO: 28880 - DNA, 148 bp, Chlorella protothecoides
gttgcaaagtgcaccgttcacctcagaggacgggacaaatggggattgccctcgggaacttggtcgcgcaacccgcactatctcgaaattcaaagatgcttacaccagctcaaatgccgtgccggtctcgtgcacacagcttcgacac

SEQ ID NO: 28881 - DNA, 70 bp, Chlorella protothecoides
agtgatggctcctcatgctactgcttgatctccttgcatcacccatcacaggtcgcaagggtacagcaag

SEQ ID NO: 28882 - DNA, 351 bp, Chlorella protothecoides
ccccccaccccccaccccctccccttacgtccccggcagctcctggggctgggaaaccgggagctgtgcagcgagtcccacatccagcgcgcccacgacgccctggccgaggaggagctggaggccggctactccccactcgcccgtctgggccgcgacaagctgctgtacgcggcgcgggagggcctgcggagcgcgcgcggccgcgtgcgtaccctcgcgcccgacatcgccatagagccgctgctcctgcccggggccctggccctgctccagcaggtgggcgcctacgacctcgtggtcgaggccgcggcggcggcgcccgccagcctggcgcgcggcctgcgcggc

SEQ ID NO: 28883 - DNA, 107 bp, Chlorella protothecoides
tgccgctcatgacgcgcttgcccatgccccctctcaaacacacggcgaatagcttccaggccaccaacgcaggcatgcccctcagatgccaatcacccacctatagt

SEQ ID NO: 28884 - DNA, 64 bp, Chlorella protothecoides
tcgatccatatgttcagctctaccgcttggcgtttcagaggcagttgctgcccgcacgccacga

SEQ ID NO: 28885 - DNA, 78 bp, Chlorella protothecoides
aaccaccggcatgtacttggtgtcgtatacgaggttctgggttcaacacacgagtgtcggcgcggcacaggcaggctg

SEQ ID NO: 28886 - DNA, 76 bp, Chlorella protothecoides
agtaccattgcggtacaccaccaggcacttcccaggcagagccagcacatttcggcccatctggaagaacttgacc

SEQ ID NO: 28887 - DNA, 283 bp, Chlorella protothecoides
ggaccaggcgatgccctccgccgcgtactccgcctgctcgccctgtggtcacggggcgtttggttggggaggttgaggcagggctggggggggcgcactcaggatggcgtggtgtggcgcgtatgagggcgtggcggcgggcgggccaaggcctccgctcgcgctgctccgtcccacctgactcacacagcagccattgtgccgtcagtgcggcccctgaacaccagcccgacaaaccttgaagacgtgggcgttgaagtgctgctggaggcgctcgttggcc

SEQ ID NO: 28888 - DNA, 69 bp, Chlorella protothecoides
gggagaggggtctggactccggctcgtcagaaggatcgaccttgccggcgacagcaggccatcgggcgg

SEQ ID NO: 28889 - DNA, 156 bp, Chlorella protothecoides
ctccaggcaggcacgcaggtcgtgcagggttggcaggctgggccggcggggacagcagtgtggaagattggggtcaagggcagtactggcagcggcatgggtatggttcgcgacatgcacagcgctccatccatctttctatgcacgcagctcccc

SEQ ID NO: 28890 - DNA, 230 bp, Chlorella protothecoides
aggctaccaccaggtgcgggccaaccgcaaaaggggggcggacggggtggctggtgctcatggttgcattccccccccctggtgccctgtgcgcatgcgtcggcatgcggcaccccacgctgacggggcaactgccgctggcctcggctgcccggcgagcgtggacccccccccctctccatgctcttcccatgacccctttccctctgcgccgcgcgtccgagcagatt

SEQ ID NO: 28891 - DNA, 147 bp, Chlorella protothecoides
tacatacctacagagcaggctgaaaggtgtaggcacctcgctccatcaccagcgtgcccctgcggatgctgaaatgcggccccctggctctcgcccccctgacacgcatccccccttatcacaaagcaggctcgtcgctgatcatgt

SEQ ID NO: 28892 - DNA, 128 bp, Chlorella protothecoides
tgccggctcgaagccgaggccgccccggcccgaggcttcgtgggaggtgctaatcaggatcaccaccgtctgcctgaacgacacctggcgcccactgccatccgccagcctttgagttatgggggggg

SEQ ID NO: 28893 - DNA, 116 bp, Chlorella protothecoides
atcctacctacatgcacaggtcggtgacaccgcagcgtcagccgccgccgccgcagcagccgcagccgcagccgcagccgccgccaccacagagctcaagcgcaaggttgaggagc

SEQ ID NO: 28894 - DNA, 159 bp, Chlorella protothecoides
cagcacgatttccgacaccgtcagcgacccgcgcgcgtcggccagccgcgtggggggctgcacgggaacgccgccattggcggtagagatgcggaaggcctccgccgcgtcctccaccacgatgcctgggaagaggggggggggggggggggggggggg

SEQ ID NO: 28895 - DNA, 61 bp, Chlorella protothecoides
gcatgattcgatcgtctcgtccagccagggggcgtgaagccggtcggcaggacctacttat

SEQ ID NO: 28896 - DNA, 248 bp, Chlorella protothecoides
ggcaataggaggccatggatgcattgtccatttggcagctgaatacgacgctgacatggacagtcttgaccgcctgactgcgccacgtttttaccagccaggcagtgcccaccctgcaatgtatttctgactggcaagttgacctgaccctttgcaagacccgaatcctggctcgagagccacttgttctcgccacattcgcaggcaagtcagagaggtccccaatcagggaggacagcagtggcgat

SEQ ID NO: 28897 - DNA, 607 bp, Chlorella protothecoides
cacacagattgctttccctgtctcatggagatcaatgcatacgccagaacttgctccacaggcatgcagggaggtgcctcgtccgtgcaacttgccttgagcagacccttctcctccatgtcaaggaggatggccgtggcggcagacacgacgccggcatgggcatacatgcactcgtccttgtgtgattgcgcctgcagcaagtggtttgccagcagttgccacgtcaaaacggtccttcaacatgccaccggcagctggtgagtccatcacactgcacgataaggcagaacaacagcctgggccctgctcatcagaagccagtgagtcgtacctcctggacccatggggggagccagtcagacacgtccacgggctgactcagcagatccgtgatgaggtcctccatgctcactgtggtggcaagggcgtcggttactcctttggggctgcggtcttgccggtcatagcaagcaggtagctggcccagccgtcgacctccaccactcagctcaccggtgcccctgatggagatgaccaaagagttgctgggcctgtggcgcatcacaaggtagggcagggcgcccccagaagtgttggcgtctgc

SEQ ID NO: 28898 - DNA, 61 bp, Chlorella protothecoides
gcggcaacagattgctgtggggggttggcatgtacgacaaaccttctcatctcacccttct

SEQ ID NO: 28899 - DNA, 112 bp, Chlorella protothecoides
acatgtgcttgtgtgcagctgcagctccagggcaaggcaccttgctcgacatggcttccaggtctggccagctgagcagctctgctccttcaaagtcatgccatcaccatca

SEQ ID NO: 28900 - DNA, 68 bp, Chlorella protothecoides
cccacagctgcacacaaccagccactctacccgtccccacagaccctgcggctctatgccgcggacca

SEQ ID NO: 28901 - DNA, 141 bp, Chlorella protothecoides
caagcatacctgcggcaggcagcattttatttcacgggttacctattggctgtacctatatctggtgcccttgccatttccaaggttaaaaggtgtgtgccacctcgcgctggtggcaccctggcgtgcgtatgtgccctt

SEQ ID NO: 28902 - DNA, 93 bp, Chlorella protothecoides
tggggagattgaagactttgggatcgggagaactttgtgttctggttggtcaatgtccctcgcctttatactccgagcgcgttgttaactttg

SEQ ID NO: 28903 - DNA, 61 bp, Chlorella protothecoides
tgatccccaccacacatcatcaccgtgcccccccttgcgccaccacaggccgccatcgtat

SEQ ID NO: 28904 - DNA, 238 bp, Chlorella protothecoides
ggggaggggtgttcggggtgtgagaaggatcccgatgtgtcaagtgtgctgtgctgtggggtgccacgccattgctgctcaaaggtgggacgagggatctccgcccaggacactacaacactgccgctgtgcgccggggcaaaccacctccccacacctagcccatccccgaacatccgcgccaaaacttcccaaggcgcatgacaaccccccggcgcccctccacacacctcgctgg

SEQ ID NO: 28905 - DNA, 63 bp, Chlorella protothecoides
gggccgacgcgggcgaggagggcggcggcgtccccgccgccttcccgggcgtggaggcggggc

SEQ ID NO: 28906 - DNA, 80 bp, Chlorella protothecoides
tgtcgcccctggggcaaggaagacaccggaacagagcacagaccccccacgccacccagccttctcaccgtggagaagcc

SEQ ID NO: 28907 - DNA, 61 bp, Chlorella protothecoides
tcggccggggtcgatgccaacatacttgtgtatcctagcctcctctggaggagggtcccgc

SEQ ID NO: 28908 - DNA, 71 bp, Chlorella protothecoides
gcttttgcggcccgtcaacgagtgcatctaacctcactgcgcccccccccgcccgatcgcagtttcctgga

SEQ ID NO: 28909 - DNA, 1398 bp, Chlorella protothecoides
  modified_base (311)..(388): a, c, t, g, unknown or other
  modified_base (1228)..(1237): a, c, t, g, unknown or other
cgccggctgcgcaccgcaggcgctgagtttgcggcctgggtcttccgccacgcagccctggccgacctggcccccgccgcggaccctgccctggccgcctgcctggcgctggtcctggacggggctggggagacggccggcgccgccgacgcgggcacgcgcggcgcggccctgcgcgcggtgggcacgcttgcgcagcgtgtgccggcctgcctggcggggcgcgtggacgtcgcagctgcgctgttcgaggcgctggcccgcgagcctgcgggcacgcgcgcgctgctgcaggagacgctggcgggggnnnnnnnnnnnnnnnnnnnnnnnnnnnnnnnnnnnnnnnnnnnnnnnnnnnnnnnnnnnnnnnnnnnnnnnnnnnnnngcgcaagcggacgccggggcgcgggcgcaggtgttggccgtgctggcggcgcacatccgctcgccgcaggaggcggcgcgcgccaccgcgctgcagtgggcggccaaggtgttcccgggggaggacgtggaggcgcgctacctggccgtcgtcgcagcgggggatgtgcggggcaccgtggcggcggccgcggtggactcgctgacccccgtgccggggacgcgggaggagcgcgggctgccgcgcttcctggacatgctgggctgcctgctgcgccaccaccccgccctggggcgggtcggcgctgtcggcgccgactcgggcctctccctcaaggtgtgtctcggtggggatgggggcctgggggtcctagaaggatgccgcaatgggccgccacagaatgatcggggtggcaagcgctgggagggggtccggtatcgagtgcagagggtgggggtcagcgattatgaagcttgcggggacagtgggcctgcaccaggctgcccacacgcccggcgcctggcatctggtgcagggcggcgtgcatcggcattcccaccctcacagtaatccatccacctcccacccgcctccccacccctcctgcaaagtccctggcggcggccgtgcgtttcctggagcggttgcggagatcggagatcgagcgcatggaggccgccctcccgcccgccgcccttgcctcctacgccgccctgctggcccccggcctgggccccaacgcccccactgccctgcaggccggcgccctccgcgccctgctgggcgcgctaggcgcaggggccgtgggacggcggccggcggtggacgaggccaccgccnnnnnnnnnngcgccctgcaggccgacgccctccgcgccctgctgggcgtgctaggtgcaggggccggcggccggcggccggcggtggacgaggccaccgccaccgccctgggcctccgcgtcgccgcgctgaccgtgcacgccaacgcgcccgtgcgcggcctggcggcg

SEQ ID NO: 28910 - DNA, 113 bp, Chlorella protothecoides
taggaagggtgaatacagagtgggaactcgagcagatcaggctcctcctggcaaaacccaggccatacatgaatcctcagacgtcattcactcaccgggaacgtagagctgat

SEQ ID NO: 28911 - DNA, 61 bp, Chlorella protothecoides
cgttgcgcctgcagtgcagggaggagagtgcagagtcagaacgtctgcgctgggctgtctg

SEQ ID NO: 28912 - DNA, 152 bp, Chlorella protothecoides
gatttaaagctatcaaggccatgggtcaatacactgagtgatgcggctgtcgcggcgaccagatcaaattgcccggttgcgcgccagtctaagtgcacagctcgcaggccgttaacagattctcgcgcactggtgaaattcgacaaaccatt

SEQ ID NO: 28913 - DNA, 70 bp, Chlorella protothecoides
gcacgctaggccgattcgggaaggtgtgtggggacttggcgtgtgccactttggaggggggctccagggg

SEQ ID NO: 28914 - DNA, 96 bp, Chlorella protothecoides
gtggtaaagactgttgagaacacgaaattcgcttctcgagatccatgacatccaatgattgttctgaccatcaccctcaatgctgcagggcaagca

SEQ ID NO: 28915 - DNA, 111 bp, Chlorella protothecoides
ggatgtccgggcctgtgcaccgcacggctgccgaaaaatggccttttcagccccttaaagtgggtactccatcacagaacgggtggcgcaaggagcatctggctgctctcg

SEQ ID NO: 28916 - DNA, 61 bp, Chlorella protothecoides
aaacgtgaggcagatgggcatcggctgaccaccccccatgaaccctgagatatcagacagg

SEQ ID NO: 28917 - DNA, 127 bp, Chlorella protothecoides
gttggctgtgtgggtgggggatggttgtgtgggatgaacaagccgacaaggttggtatgcactgcctggagtcaggaaacgatgaggcgcagggctagcctcggtttatttgttgctcatactgggc

SEQ ID NO: 28918 - DNA, 76 bp, Chlorella protothecoides
cgcacccagttcctctggcgtcacttgcaggtgcaggggcatgaactgcctcccccccgcagcggcgtcgtttgcc

SEQ ID NO: 28919 - DNA, 61 bp, Chlorella protothecoides
caggggcaccgacatcgaccacgacctgtatgctgtgctgctggaaagggtgctcaccagg

SEQ ID NO: 28920 - DNA, 77 bp, Chlorella protothecoides
gacctccctgcatagtttctgtttcattctcgccccatctccttgtacatgtgaatgctgccaccccctttccgggt

SEQ ID NO: 28921 - DNA, 426 bp, Chlorella protothecoides
gccgcgctcgcgcgcgcgtccgcccgccgccgtcacgcgcagcgccgcggcgcgcggctcgttgggcgtcacgcggtagttcagcgcgacgccgttggacaggcggcgctggaccacgcctgaggccgggtgcggggctgggcgcgcagacccggccccggggacctccacccaggcgggttgacgctcctccagcagcgccgccagcacgtcctccggcaccaggtgctccggcacgtccacctccggcagcggcgcgacgtcggcgccccccgcctccgccagcgccgccgcaatctcctcgccgctcagccggaagcgcaccgcgccctccggcggctcctcgtcgtcggcgtcgccgtcggcagcgctcgggtccagcgccgcgtccagcgcggcggcgggcgccgtggcgcgcagcgccgc

SEQ ID NO: 28922 - DNA, 61 bp, Chlorella protothecoides
ggtgcgcttccggctgagcggcgaggagatcgcggcggcgctggcggaggcggggggcgcc

SEQ ID NO: 28923 - DNA, 61 bp, Chlorella protothecoides
cctcccacctacccgccaatacattgtgtgttgggacaggaattgtgtttcaggggctgct

SEQ ID NO: 28924 - DNA, 77 bp, Chlorella protothecoides
ggctccggctgtagcatgttcgacaagaggttcttttttatgttgtagggctaggagcagtccgattcggaaaattt

SEQ ID NO: 28925 - DNA, 7656 bp, Chlorella protothecoides
  modified_base (596)..(696): a, c, t, g, unknown or other
ccgctgctggccgccgggctggtggacggcacgctgcgcgtgctgggcctggacccggccgacccgctgcgcgcgctggccacgcaggccctgggcgccgcgccggagtcgctactgctggccgcctcgcccggcggcgggctcaccctcgccgtcggcctggccacgggcctgctcctgcgcaccgaggtggaccccgtcaccggcgccctcagcgacacgcgctcccgcttcctgggcacgcgcgcgccgcgcctgttccgcgtcgccctgggcggcgcgcccgccatgctggccctctcctcccgcccctggctggggtacgcggaccaggggcgcttcgcactcgtccccgggtcgcacgccgcgctggactgggccgcgcccttcgcctccgagcagtgccccgaggggtttgtggccgtcgcgggggggcagctccgcgtgctggccgtcgagcgcctgggccagcgcttcgaccagagggcggtgcgcctgcgctacacgccacgcgaactcctcatccacccagaccacaaggtgcttggggtgtttttgttatgatcccgggggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccggccatgtggcctgggtgtggagcgctgtgcgcgaggtgtccatactcgggcacacgcgcttccctcacgggacccgggatcgggccctcctcaattgctcctcatccaatcggagctcttcaccccaccgacctgatccatcccctccccaatgatcaccatcccagctgctcatcacggtcgaggctgaccagggggtggtcccgctgagagagcaggaggggctggcggagggggcgctggccgtgcccgaggccgccgcggagctcggcccgcccccgctgccggacggcggggccgcggccgagcccgggccgtccgacgtgcagttccacgccgtcgggctcgaggcgggggaggaaagcgccgcggcgctggaccaggtggggtgcccgacgggcctgccggggcgctggggctcatgcgtgagggtggtagacccgctggccctggccaccaccgactgcgtggagcttggggggaacgaggccgcgctatgcgccgcgctggtcggcttcgagggcgaggacgcgctggtgctggccgtgggcgtggcgcgaggcctgtccttctatcccaagcagtcggaaggtgcggtgtatttaaagttggttgttttttgggggggggctggtagctgggggagaggatgtcagcgggggggacatgagagatcagaaggtggcatacaaggagagacaccagggccggggtggggagcggcggcggcgacgaggacagacgaccagcccagtggcggggcctgccgccttggcagcgtgcatggcactccaatagtcgaacaccgtcgactggccttgcagtgttactttggtcacgcctggatcccgcttgccaggccgctcatccctccaccgcatcaccccgtctccttgcacaactccccacatcccaggcggcgccatccacatctaccgcttcggccctgggggccgggcactggagctggtgcacaccacacccctcgacgacatccctcgggccatggtggccttccgggggcggctgttggcaggggtgggggcctccgtccgcctctacgatctgggtgagtgtgaaaactggggcgtggggggcgtgtcatggagaggtgggctcaaccgtgtgcgggttacgctgccagctgcagtcgatgacaagctcacatcggatcgccaccatgccgtgcccaggcaagaagcgcctgctgcgcaagagcgaataccggaagcttcccacggcggtggcaaagctggcagtcaacggcaaccgcgtgtatgtgggggacgccagccagtcgttcctgtacctcaagtgggtgatgagggagggcctgtggggttttgtctgtgcagccaggggtaggccaatgtcccatgagggttgcggctggatttgagaatggatgtatgcttgggggagggatggctacaagccaggctgcccacgtgagcctcaggcgcatctcctggctgaggcagccccagtgaagacctccacaatgtacccagcctctggctccgatggtgcacttgacaccagcctcatcaatctccccaccccaccccacccacacctcaactctgacaggtacaagaagtccgacaacagcttctacgtctttgccgatgacacggtgccgcgatccatcaccgccgccctgaacctcgactacgacacgatggcgggggcagatcgcttcggcaacctgcacatctcgcgcctgccgccggagctctccgcccaggtgccggcgtggctgcaggcgggggggaccaagcagggaggggaggggacgagccggccgtcgggatgcagactccttttccctgatctcgctcggcatcacacgtggcaatgcggggggtgcgtgggtttacatcttccatcgatccagccccttcaccactcctcaggtggaggaggaccccacgggcggcaagtttgcggggcagagcggggtgctgggcggcgcttccaacaagctggactccatcatcaatttccatgtgaggcagtgggtgtgaagtgactcccggggtggtggggaggtgcagtcaaagcatcacctgtgtggaaggcgcttggggcgcctgtggatgccggcgggcccaagaggtcttggatgcgtggatgcctcagccactgcatgcctggtggggtgtctgtgtgcaggggatgcaccctctggctgcacggggcctcgacccctcctgtgccccattcgatgaatgccacgcctcactcctgcggacactcaccgctctcctacctccttttcaacccccaggtgggggagacggtgacggcgctgcagcgtggaacgctgcagccgggggggcgggaagtgctcatctactccacaatcctgggtggcctgggcaccctgttcccctttgccagccgcgaggacctcgacttcttccagcacctggagctgcacatgcgggcggaggccccgccgctactgggccgcgaccaccttgccttcaggtgcggatgcctgggagcagagttgctgcagagcctggggctgcagcagggtcccaaggctgctccctgccacagcccgggccgctgtgccctgtctcttgtgagagaggtgccccgtcgcgcccagtgcacggggtgtatcatgccagtacaccagctcccgaccgcccgctgtccaggtccgcctacttccctgtcaagtcggtggtggacggggacatctgcgagcaatttgcacagctgcccatcgacaagcagcggcaggtgggcgggatgaggggaaggtgggggcgtcagggtcctgatcagggccgggagtgtgagtggcaagggcgcatggactggcctgtgccgcctgcgacagggaccttgcaggcaccaggtgtcgtgtcagggattgctcaggctcaccacccagccctgccctcagatcgcgagcgagctggatcgcagcccaggggaagtgctcaagaagctggaggatgtgcgaaaccgcataatctgacccatgctcctgtctgttgggcacccaatttgtgatgttacagagatctcacagccactttgttgcaaagctggggtttggtgggagaatgcaaggtctccgaccacgaaaagaatcgccgaccagtgtcatcgccggcacatgggctcgggcgtcagaaggatgtggcaggggagtctgggacatcgagggacaggtaccaacctctccctgggctgcatcggctccaacaaagaggtttaccagcatagtcatcccttaccccagccctacactcgatcgtccactccagacagcttgccctccaccaggtctgtgtagggcagcttgcgcgcatcctccaccacagcctccgccccggcaaagctctgggacgcggtctggtgggtgtaggtgatcacgcaccgcatgccggccctgagggcagcctccaggccgatggcgctgtcttcgatgaccaggcaggcgcttggatccacacccagcttctccgcagcctcctgcggggaccagggaggagagcggttgggttggcaggcattctcatgggaaaccacctgggtgcaggaggtttgcagctgattatgatgaacagcgcacgctcaacgccatacaatgccccctacctaaggccacacacaccttgtagattgcagggttgggtttcttctcagcaacatcgtcgccagcaaggaaggcgtcgagggagaagaacctgtcctcccccaacacattttgcagggcgtactggaccgcaatcttggtgctcgcagagcacacagcgaccttgagaccgtcctttcttgctgcgtcaaacagctcaaccacgcccggcctcgggtcgatgggttgattgcctggcagggggggggagtgtgggcgcatgttgcggatgtagcggcgggctcgtgcagtgtatgaggccgggcttgtgcagttcataggtaaggtagcctcagagcacaacttatgatgagcgacatatcgccgaagccctccctacccttggcccccccagaccctcgcaatgaagaacaaacggctcccgctctcagcggccaggccactcaccgacaatgtccttgtaggcctccgtcttgtgatcttgcagtgcatctatgagtgcctgcttgccggcgtcagtagcaggaggactcgagaaatcatctttggtggaggctggccatccctcttgttctacgcaattgttatgggggggccaaccaagtatgagagcggcggctccaaatgttcctttcacgatcaagaagaatgatctgctagacttaccttgctagggaggcattgggactcgcgatcactagttcccaaaaatcaggccccacaagcacaggtacagggaaggaagacactcaagccctgcagctgagagacgccgccaccatggccaatgagctcaccaaagtagtaccgcatcttatgcttccctccaccaatcttattctgcagcatctcgtagaatggttcgctccattgtaccgcatcctcggagtggccctcgatgcgaagtccaaagtcacgaaaagtcgcattgtatgcctggaggtggatgccctcgctctcaatgatgacgcctggtacgggtggtcggagggccagattggttttgggaagaagatgtgcatcatgactcaacgcgcgcagagtacttcaacccaccctccgcgcaccatcacaatcaaatatcagcgcatccgcctttttggcgctccgggcttgcatctgaggcctggttagccttgtcaagttggcagttcttgctggactcctgcattgcgcacagcacggacccacttggggggctaggtggtggaaatcaggtcacatggcccatgtcctcagcgcactattttggccaggaatctttgccaaatcatgttcatgtgctctttttaaggagtaaggccttccatcgctacctgtgctcacctcatcatccatgtatgagctgtggaggttcgacctcgacccatgctctgtccgcatcccgccccatgccatgcctttgcgtgcatagtgacgcctgtttgggagctgacaccgcatggcaaggtcctagacatgtttgcgatgaccgtatcgggacaatatgtgctgtattcgaaccagctagaaatggccagatgatggagcaatccactccacccacccagctagactttccacctgaacaatttctccgcagattcttaacctccgaaaacatacttcgcatcgcgggccccggcagccatccagagtggccccaaggcagtgctcgagtgccggagcggtactcgacagcccatcttcgtcctcccctgcaccttgagatggcatggtccagccgcgggccaccagtggtcgccaggcgctccgcttgagtgtccattgaatacgcgatcatcctgccctcccgcagcgcccaggatagctcaataatctggagaacacgccaagaggcggagtccgaatggctgatctgccattggacgtccatgtgccaaactcgtctgccgggacgccctcgacaacagcgtcgctggtgctcggcggctcctctctgacgcattccgcgtccctcacctccgaggatggggatgtgaacctcgtaatggtgcgtggtttagtatttgttaggcgttcggatgagattttgcccagggcaccgtcctcccgtgtgcgacctcttgtcctcaggcaggcacccccgcgccggctcctcacttgagaggtcgtccctaggggcggcgaacggcacatgatccttcgaacttcacccagccccgtgtacccttcttcgtcgcagagccgggaggaccggcagcggctgggggatgccattgaggatggggcgctgagtgcctttcccattcagcccctgagcgtgggaagccatggcgcgacgcgggtctccttacatcccacaggcgaccccaacacgaccgaggtgacggtgcggcatgccttcaccgcccgctttgcagagggccagaactttgccaacgaaggtgggcgccatggatcagtcggggctggtgtctgggagtgcagggtgggcgtggcgtcgagagccaacgcctgcgatggggcctcatgctgaggctcactcgacctccgctggcgtctcatgagctccctctgtgagaagcgtcgccgacggctcgcaccctgattgcgagactcctcatgctccgtcctggaacgtctcaagccctccaaaccaggctatcagacccctgcccccgcccccgcccccctccccctctcgcaggccagtacaatgcggacgatggcccacccttgcccccgccctcggcccggtcctccagcagcctgctggacaccccacccgacctgccggggctggagtcgctggtgctccacccccgcaccatgaccttccggaagaacctggcgcacctgaagcccgcgctgccacgtgtaccgctgcctgtcgaccctctgccgcagcgccacccactggagctcgaccccaagcacgtgctggtggggccccgcattgccgtgggcggcttcagcgaggtcttcatctgcaagtaccagggcagcctggcggcggccaagctgctgctcaacctgtcgcccaaggggcgcgatgctttcctccgtgaggtggatgtgctggccacgctgcgccaccccaacctcctcctcttccagggctttgtgctgtcaccctacctcggcatcgtcacagagtgagttgtcataatgtagagggtcgggtggtggagggtcgacgatgtcgagtggagaaccgctgactgagaagggtgatgcccctgctgagcgtgcagatgggtcgaggaggggcatgcaagcatggcctgcccttcagggtcacctctgtccccctcccctcgctctacaatctccagtgcactgccacctttatccctcctcttccccccatcctcacctccaccccccccc

SEQ ID NO: 28926 - DNA, 70 bp, Chlorella protothecoides
aaatccctctgccctccaacgacctgcctccccgcatgatgcctccctgttttcaaacccaaccatcttt

SEQ ID NO: 28927 - DNA, 61 bp, Chlorella protothecoides
ggtgggggtgcggaaggagggcaggtggcgcggcatgccgtagaagatgaggaagagccag

SEQ ID NO: 28928 - DNA, 73 bp, Chlorella protothecoides
aagggttccatgtgaacagcaattggacatttgggcttagggtttttgggttagggttagggttagggttagg

SEQ ID NO: 28929 - DNA, 133 bp, Chlorella protothecoides
gttttccagcgctgcctcgtgagcaggcacgtccccacccaggccctcggtgcgccagggacgagggcaaccaaggcagcaggggtgtgcatgtcatggcccatgttcgggctgcgacgccccctgtgtctca

SEQ ID NO: 28930 - DNA, 69 bp, Chlorella protothecoides
gggcaagaacaaccttggcacgaagaacgttgggaactacaacattggtgagcaaggactggagtgtaa

SEQ ID NO: 28931 - DNA, 64 bp, Chlorella protothecoides
cacgctccaccccacccagctgcaacgtatctgggtgcgcaaagggacagcccgtccagtcgtg

SEQ ID NO: 28932 - DNA, 61 bp, Chlorella protothecoides
cgtctcccctgcacacttctcaagaagaacaccgccactgctgacagtactcagccatgct

SEQ ID NO: 28933 - DNA, 61 bp, Chlorella protothecoides
agatgagtttggtctccggcttgaggcatcgcttgtcatgcgctcagctgcctgctcgtgt

SEQ ID NO: 28934 - DNA, 140 bp, Chlorella protothecoides
ctttttgaagtgcctgctgccccttgatggtcagactgtgcctggagccagcaggtcgtgcaccccggccttcgggaccccccgggcgaccccccttccgagagcgccgggtcggagggcgcgaagtccgaaatttgatt

SEQ ID NO: 28935 - DNA, 75 bp, Chlorella protothecoides
tcctgcacacaggtgctggggtccaaggggccggcctcgattcaatgcatgggcatggcatgcgcgctggcggct

SEQ ID NO: 28936 - DNA, 225 bp, Chlorella protothecoides
catgaatggccttcaaggttgaaagggactccataaaacgagcgccgcgaggtgccctcttgctcttcgctcactgattgcacgtctgacacaataattaacaatgtgagtcatacgcggttgatcggtcgtggcaaggagaaggccatgccatgagcgccagcgagtatttggcaagcttgtcagatgatggagatgtgacaaacataagaaaatatacatcat

SEQ ID NO: 28937 - DNA, 61 bp, Chlorella protothecoides
tacatactacgcaccatcactgaaggcacggcgaagttgcagagcttgtctgctctgagct

SEQ ID NO: 28938 - DNA, 78 bp, Chlorella protothecoides
gtgcatcctttgcaaacgccttcttgcccattctgtgagggccgcgggatctcagcccaacccactccctcatctcac

SEQ ID NO: 28939 - DNA, 61 bp, Chlorella protothecoides
cctgcaggaacagcgagatctacaacttccagcaggtggtggcggagcagctgcctggcgt

SEQ ID NO: 28940 - DNA, 61 bp, Chlorella protothecoides
cgggaagcggggtcgtgagccattgggagggggggaggggggcacccagtctctccgtacc

SEQ ID NO: 28941 - DNA, 94 bp, Chlorella protothecoides
tctacaattatgcgaggaagtcaaatggacgaatccaaatcgcaaacttgtgaggtcacaccctgcatgtcccacccacaccaacaggtggagg

SEQ ID NO: 28942 - DNA, 117 bp, Chlorella protothecoides
gccgcacgatcatggcaagggcaggaggagagggagcagaagcacgggcagcaacctggcgccctgccgtcgcaagcggtgcagtgtgttatggcgagccgcagacgtggtgaatga

SEQ ID NO: 28943 - DNA, 72 bp, Chlorella protothecoides
ggcggcaggatccggcgccggcgctgcgctgcttcgccgcggagagagtcggcaggacggccatcagcctga

SEQ ID NO: 28944 - DNA, 107 bp, Chlorella protothecoides
ggtggctgtcggcaccagggtgggaggggagtccgggaggagctggcgtcacgctccccggccagcccagcggtgagaacctgaggcgaggagtggactcctgtcac

SEQ ID NO: 28945 - DNA, 411 bp, Chlorella protothecoides
  modified_base (153)..(314): a, c, t, g, unknown or other
gcctcgcactcgcagcacccgcatgagcaggaggaggtggccagcccggcgcccagcagcatgagcagccggctgtcaggcgctcggcatcgatacggcacccgctcacagagcgccgcgccgcagtgatacttcacgccctgtcccccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcctttgtataccgtcggtctccctcatgtcacgcccggcaccctcgtgtgcatgagagccttgaattttcgccgtggagcggcagtatggtgt

SEQ ID NO: 28946 - DNA, 68 bp, Chlorella protothecoides
atcgatagcttctttcctgtgccccttcgccacaaaactcctgcgatgcacgatgaataagaaactca

SEQ ID NO: 28947 - DNA, 63 bp, Chlorella protothecoides
cactgggctatcacgccccaacatgcctcccacaccgtgtcacctctgcccagcatgccacca

SEQ ID NO: 28948 - DNA, 61 bp, Chlorella protothecoides
cctggggcactgacacattgtagtctgccggcccatcgtgacgggataggttcacaggacg

SEQ ID NO: 28949 - DNA, 80 bp, Chlorella protothecoides
gaggacgacgagccccgcgacatgccgcgctcacgtggggaagggtatgcaatgcgcccatcgcaacgctgggggcttgt

SEQ ID NO: 28950 - DNA, 69 bp, Chlorella protothecoides
aagatcgccattggcgtgatcgcggggaccacaggaccttggatgcaggccgaggcgttccctgccttc

SEQ ID NO: 28951 - DNA, 73 bp, Chlorella protothecoides
agtgtatgcaggggtatgcctcgcaggggcgggcactgtgtcgcgacacctcgcatcgctccaactgtaccaa

SEQ ID NO: 28952 - DNA, 78 bp, Chlorella protothecoides
gctccctgccgacgtaggcttgatgccgcaacttctggaacggcttcccatgcatgtgccaggccaggccccgtcgca

SEQ ID NO: 28953 - DNA, 117 bp, Chlorella protothecoides
agaggtctggaggcctcagtcgccagggggaagagggagattctacagaaggacgcatccacggcaccattgcgtgcggcaggagccccctgccaccgtcccaacaccccccccagg

SEQ ID NO: 28954 - DNA, 101 bp, Chlorella protothecoides
ccctgcccttgccagcatgcccctgtccgacagcctggtagtcggcgttcctgacgctgcttcgtactatagcactgcagaccgcctgagtggcccccacc

SEQ ID NO: 28955 - DNA, 78 bp, Chlorella protothecoides
tgctgggctggggtgtggggaagggtggggtgacgcagggggagggggctagggcagaccagcttgctccttggatgc

SEQ ID NO: 28956 - DNA, 99 bp, Chlorella protothecoides
attgtcgtgcacttggcggtgtaatcactaccaatcaactaaaaataagtcaatcgtagcccatgcgcgtcttcctgccaggccttgaaccgcctgggg

SEQ ID NO: 28957 - DNA, 17217 bp, Chlorella protothecoides
  modified_base (536)..(545): a, c, t, g, unknown or other
  modified_base (1044)..(1053): a, c, t, g, unknown or other
  modified_base (2945)..(3134): a, c, t, g, unknown or other
  modified_base (3955)..(3964): a, c, t, g, unknown or other
  modified_base (4454)..(4463): a, c, t, g, unknown or other
  modified_base (4647)..(4656): a, c, t, g, unknown or other
  modified_base (4780)..(4789): a, c, t, g, unknown or other
  modified_base (5061)..(5070): a, c, t, g, unknown or other
  modified_base (6396)..(6405): a, c, t, g, unknown or other
  modified_base (6641)..(6650): a, c, t, g, unknown or other
  modified_base (6880)..(6904): a, c, t, g, unknown or other
  modified_base (7073)..(7082): a, c, t, g, unknown or other
  modified_base (7166)..(7175): a, c, t, g, unknown or other
  modified_base (7392)..(7401): a, c, t, g, unknown or other
  modified_base (7485)..(7494): a, c, t, g, unknown or other
  modified_base (7663)..(7672): a, c, t, g, unknown or other
  modified_base (8508)..(8517): a, c, t, g, unknown or other
  modified_base (9782)..(9791): a, c, t, g, unknown or other
  modified_base (9933)..(9942): a, c, t, g, unknown or other
  modified_base (12788)..(12797): a, c, t, g, unknown or other
  modified_base (13308)..(13317): a, c, t, g, unknown or other
  modified_base (14971)..(14980): a, c, t, g, unknown or other
  modified_base (15771)..(15780): a, c, t, g, unknown or other
  modified_base (16210)..(16219): a, c, t, g, unknown or other
  modified_base (16364)..(16373): a, c, t, g, unknown or other
  modified_base (17019)..(17099): a, c, t, g, unknown or other
ggggggggattaggagggggtcccttgggggagggatggacgggcagctggcttggtgtttgtggagcttggcatggcgtgtccactttccccgtcgggtcatgcccgagcatgcacaggtcccactcccaatgtccccaccaagcaccaggtaacagtcagaatctcccccaaccctgcaggggccctcacaccttctacctgaagcagagcgggaacgttgaccgctggggtggcgcgctggtcaacctggtgcactaccaggacgccgcgggtctgaccctggcggtgctccagcaccgggggcccgatggctcgcccccacgcggcgagaccttcgtggcctgcgacgacgagcccatcaccctccaggtggcgcagggggtgattcctttagagatcttatctgatttaccgcagtgcggcacacgcatcactgattccccccgctgcactcccgtgcctctgatgggaccgacgatcccgcggacaccccacccacccccctcacacactccgctacgggcgtctgcagnnnnnnnnnntgggggtgcttcctctggagatcttacctgatttaccgcagtgcggcacacgcatcactgatccccccccgctacactcctgtgcctctgatgggaccaatgatcccgcggacaccccacccaccctcctcacacactccgctacgggcgtctgcagggcatcatggatgccacgatggacctcccgcggtacgcagccaccgccgctgggcccctgcgcttcgtgggtgcgccggggagcagcgtgggcaagcgcatgaccaaccccgcgacgcggcgggcgctgggctgggagccacggttcaagtccttccgcgccttcatggcgggcggggccgaggactggtacctggagctggaatcggccctggcagcgtagagacggggccggcggcttggagccgcgggcttcgaagcggcaccgtgatcaaaggaagagcccgtggtcgaaaacctcgagccagcgtcccggccgtcgacccatcattggtgttacaannnnnnnnnncgccgcaggcttcgaagcggcattgtgatcaaaggaagaggccgtggtcgaaaacctcgagccagcggtccggccgtcgacccatcattggtgttacaagggcaagcctgggcgcgtccgcagggaggacagcggtggggtgcgggtcggagggcgtgctactgcagcgtacaaagggaagctgagtggagttgggtgagaaggggggggggaatgtgcttatgcggggagctccggcgctggcggaggcagggcccgcaggagacggatcacgagggctgggagagccgctatgcatgctgggctttgtcggccgcctccatgagcgccacgatcgcagcggcggggtcgttcccgcaggccaccagggcggcggctgccacctgcgactcctccgcgtgccgggtctgcagcagcctgtgaggaggggaatgaggggggggctccaaccacgcagcccaacccctgggagtggcgccagagagtagtggagctggttctggtccaggtgtggtctccgaggatgtacatcctcatcgatctgcccacaccatctgacttcctcgtgccccacaacacaaacatcatctgccatggccccacgcactgtccggtctgggtgcgggcgacagcttcgcctcgcgtcgcgctggcgactaggtccggcgggcacaggctgttgagtaggcggctgcccacgctcagcatggcttcctcccgtttaccaggaggggcgtgcagctggttgaagtcctccttgcagacattcaggcaccccaccagccgcttgatctgcatgttttccgtctggcagcatccgatgcgggccatgacggtctgcaagaggggccaggaaggttgttggggatggctgagtggcagtgccaagttggatgccggaatacatgctcggagacaactgcaacctgcagctgaccagtcgtgcaccttgaggtgcgtctccagggcctgcttccgggccaggagcttggcgtgagtctcctccagggattgcaggtgcttgaggtcgtcccgggtggcatcctccccaggggtggccgtggcgcagccggccctgggcttgctcggatcggacgaatcatcaccccctttctcgggagaacactccatggacaccgtgcgtgaccgcgatttccttcgactggttgaaggcctgtgggatggatcggaagtgggtcgattcggaggggagctcggcgatgatcctacaccgtctgcgtcgcgaccccgggcttacccttgaacaaacaacggggacagcggtggtccaaaggtcttgtggtccaggagagtcgtatctcctacttccatggccatcaatgagctaagggatcaccgagtccgggcgtggagaccagggacgagtgttgttattcagggtgctcagcgtcgaaccgagtctcgggggagcctgtcaccttgagatccaaccggcgggcgatggccgacgaagaacggggtgattgagcgttcggtgactctccaggagagcccatgcggggcctggtgcatctgtcagctgtccgaaatggtaaacgcgcgggcctcggagggaaagtgtgaatgcagtctcttttgtgaggcatttacttggcgcgcccttggcatcaccaacacataacaagtacgactcaaagaatacacaaccctttcaagaaggctttgcttgctttaaagctgcaggtggggactcacaaatctcggcatgcctcccgagaggcagcctgggcatcattggatgatcgcatgagcgtcccagtactcgacagccgccgcgtatgcttctttgtccagtgggacgccacttccgccttcctcccgacccaaagcgttcctcaggatggtgatgggctgagtgcatgatgggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgtgccttgatggagatgatgccccatggcgcatctgggagtgccttttctgcatccccggcagacacgtgtggcagggcggcatgctccttcaccagctgctcgcgggagtacaggattatgtccaggtgcttggcggtgcggggcggcaccgccgacctgggcagccagcgagacagcaccgccagctcctcggggcggcgcttgaggtagccagagcgcagggactgcacattgtcgggcgtgagtctctccgcacccaccgcggcgtccgtgaagttgggtatgaacaggtgcttgcagaagggcgcgtagccgtcccgcagctgggcaccctctgcatgggcccgctccaccctggccacgaagtctgcctgatcccaggtcagcctcgaccctgcatgatctggatcctcccactgtctcttggcgaatgtgtcgaggaagaaggtcatcgcacgggtgctgacacggtgggcaaaccgtggaggcgcgctgaggctgggaagtgatcgtggccaggcggcggtcctcggagcagctcggatcatgtagcgacgctgattgtgttacatgctttgctttgagagaggctagcgtgcatgccaggcattgggcgggtgtttgtcctgggtatcaagcatgcgcgcgcgcgctcacgggatccgcttcaccatcctgggtccaggctatctattaggatctcccaccctcatgatctttccatccttgatcttacatgtacactgctgccctggtatcaatgcctactcctgcccatgccagtgtgcagcgccctcatcaccgcctcccgatcnnnnnnnnnnacttgagagaggctagcgtgtatgccaggcaatgggcgggtgtttgtcctgggtatcaagtatccgcgcgcgcgctcacgggatccgcttcaccatcctagtccagattatctattaggatctcccaccctcatgatttttctgtccttgataatccatttacaccgctgccctggtatcaatgcctactcctacccatgccagcgtgcagcgccctcatcaccgcctcccgatcgaattcgaaggtcttcgcgggtgccatgcccacgacctgcaccgtcacctcggaggccatgggcgcctgggtggggtagagctgtgccgccgcaggcacatcgcactcttccctcacatgctccaactgcgtgtccaaagaggcgagggccgcacaggagtcgctcagacgaccggtgcccttccccgcattcctgcgccgctgccgcttgacgggcgccgccagcttcctgtgggcgggtgcccgatggtagcnnnnnnnnnnacttcgctggtgccatgcccacgacctgcaccttcacttcggaggcgatgggcgcctgggtggggtagagctgagccgccgcaggcacatcgcactcttcccttacatgctccaactgcgtatccaaagaggcgagggccgcacaggagtcgttcagacgaccggtgcccttccccgcattccnnnnnnnnnngcgcagcctgctcaggcgtgcgtgagcagccagagcgtcaccacccccacagggcctttccccgccaagcaccccagacacccgcaagccccgcaccgccaggccctcacctggcaatccattnnnnnnnnnnacgcagcctgctcaggcgtgtgtgagcagccagagcgtcaccaccacccccacagggcctttcccacccaagcaccccagacacccgcaagccccacaccgccaggccctcacctggcaatccattcctggaggggcgatgcgaactgccacactgagaagaagcggagcttcacctccggactgacgaccaggggctgcagggacggagcggtgagggtgggtggacggtgcgccatgcgacgagtctcctggcaggcgtgctccctcgcnnnnnnnnnncagacggagcggtgagggtgggtggacggtgtgccatgcaacgagtctcctggcaggcgtgctccctcgccccatggcccatggcttcatttgtccaggcagggccaccaccatgtccctctgccactgtcttgccgggcacgccatctgctctgcccagctgcagggcgccgcccagcgccttcgattcacgcacctatactcgccctccccttccccccctgctcattccccgcccaccgtcctctcggcgtcgtagctccggggcagggcctccacgggcagccacctgtaggccccaatctcgaacttcgcctgcggggcgaactgggtgtccatgtccacacccgccacgatgtacaggcggatgtcctgcgcgcccgaccgccgcgcgatgcagtcctgttcgctgagcctgccgcgcaggtccagccccgtctcctccagcacctcccgcgcggcgcagtccaggtccgactcgcccttggacagcttgccgcgcgggaagccccaggaggcgccctcctgccagccccgcaccaccaggcagcagcgcagcgtggggtccagcatgatgacgccgcgcacgggcacggcgcgcttgtagtcattgaaagcggagtagatggcgtccaggctgccgcggtacggctccagcccagggcaggcgtcgaagatgagggcgcagaactccttgagccccaggcttgacagagtggggtccttggcccggatgttgtcctgtgggagaggcatgcaggggagggcaagggccgatgtgactgatcttgggcggggaagcgggcgcactttgcaagcacatcggggaggtccggtttgtttggggcaagatggggaggcagcggtgcagctgggggcaccacttatgccagaggaccccagtggcacggcacacgcacctcgtagtgccaccaggccatctcaatcacgaagagaagccgctcaaaggacctgcatgcccagacaggggtgtgggttgctaaggggggatttgggttaacagggggcatggaggctaggctcgcggctcctgcactaccacacagccaccacacatcagtaccacgcactctagttcctcgggagggagattgatgatgaaccgcacgcagatctcgtccaggagttctgccgagggccgcaccatctctgctgttcaacgtcacactagttccagggcatgattcacttcatcaattcgtcataatgatgattttgttaggatgctgagaatcacatcgacatgtgcaggacgtctgtgaggagggtgcagttcttggtgtggaggaagtcatcccggagggnnnnnnnnnntccataatgatgactttgttatgatgctgggagtcacatcgacatgagcaggacgtctgtgaggagggtgcagctcttggtgtggaggaagtcatcccggagggtgtcgggtggtaacataaggggccgctccgccgatctcatacctctcctgccctgcaccttgacgtcacatgcaaaggagcctcgttactccaaccttattaaatactcctgtgggatcctgtgatctgatnnnnnnnnnnttggggcgctctgccgatctcatacctcacctgccctgcaccttgacgtcacatgcagaggatcctcgttactcccaaccttatcaaatactcctgtgggatcctgtgatctgatgctgtgttattagatcccgctcggcctccctgggtgattgcagacagcagttgcgtgagggggccgccccgaggccccggggtcgccgatcattgcatcaggagcccgagtctgnnnnnnnnnnnnnnnnnnnnnnnnngctcaggtggggcctggcacggagggtcctgtaccacgaggcagcatcggtctcggtccgcgcagaagcccatgaatcaccaagggggcggctgtggcttggttgcatgcccatcttcaccgcggtgatggtgccaaccgtgcaggagacggggacacaggagccctcnnnnnnnnnntcaaaatgcgaactccctaccatgggatcccttctcaggggatgttggtgttcgtagtgctgctcgttgccactgccggtgcannnnnnnnnncggctttggtttgcttgcatgcccatcctcaccgcggtgatggtgccaactgcgcaggagacggggacacaggagccctcacccgccggcgccgtcccgggagactcctcctatgtgtgcatctgtctgtctgcagcaagtaggacggcgcaatgggcaggagggtctgcagcacggcacgcatggcaaccctgcagcgcatcctgcatgccgcacnnnnnnnnnngcaaaatgcgaactccctaccatggggtccctccccaggggatgttggtgttggtagtgctgctcgttgccactgccggtgcannnnnnnnnncgccgcaagtaggacggcgcagtgggcaggagggtctacagcacggcgcgcatgccaaccctgcagcgcatcctgcatgccgcaccacgctcgaagcccctgcactcagaccccaggctggcccacggccattcacgcgcagacgagcagcgggacatcgtggactggnnnnnnnnnntgcccctgcactcagacccctggctggcccacggccacacacgtgcagacgagcagcgggacatcgtggactgggcgcggtaccatgaagccctgggcgtggaccggatctatgtggtggactccggggagtccctgaggcccgtgctggagggtgcgggcctggtccaggtcggcaggcgcgggggtgacaccaggggtgggtcgtgctgtgggtggtgccccgactcctcactgcctcagggttcactgtcgctgtccagaggcgaccctcacagcccccctttcctcctcccccgccgcccttgatgcagtcgggcctggtgcgacacatccttgccagcaacgcgacagagctgcaggaggacatcctcaacaccacagggcgcctgatcaatgccaaatacaagcagctcctggcctactccctctgcctgcgcgatttccggctccagcaccgctggatgggtgaggcagggccacagggggactggggtggggggacgtggtcgtgctggccgcccgacacactggtcatcctggttggtgcacatgttcgaggatccccaccggacccagccggcagcacatgtgcccccattgcgtctggagatccctcggcaccctggactggaccacgggacggcccaccacctgcactcctgctcatgctccttgccgggaggaggcaaaggggccctggatccgcactcctggtccgtcaccgtgcctggttcatccccttcaaggcccacgtcagatctccgtctcaccatacaatccctgcaccactacaccccgcgtgacccccccccccaaacaacccagccttcatcnnnnnnnnnntccagcgtacagcacatgcgcccccattgcatctggagatccctcggctctccggactggtccacgggacggcccaccacctgcactcctgctcatgccccttgccgggaggaggcacaggggccctgggtccgcactccgggtccgtcaccgtgcctggtgcatccccttttaggggccccatccacctcagatcttcatctcaccacacagtccctggcccaccacaccccgcatgacaccccccccccccaaacaacccagccttcatcgacgcggacgaatacctgacagtgcgggaggccaatgccacgctggtctccatcctggccgactacgaggcctatggtggggtgggcgtgaactggcggatgtatggtgcgggcgggcggctggagcgcccgcgcgcccccgcccccgacgcctaccattcctgctaccccgtgggcgagccggagaacgtgcacatcaagacggtggccaacacggcctacgtggcgcgcgccggcggcgcgcaccacgccgagtatcggcgcgggtactacgcggtgaccactgaccggcggcgggtactggggcccaagtcggcggcccccgtctacgatcgcctggtcctgcgccactacgtcagcaagagcctgtgggactacagccagaagatcctgcgcggctccggcatgtcgcgcgtcaagaccatgccctacttccaccacgtccagatccgcgcctggcaggactgccggcgcgccgcggcctggcaggacggcgggccggagcaggtcgcgcccgccaccatgctccgcgctttccccctggacgccgaggggaacgccctgtcctgggaagccgcgcttgccacgagccgcgctgcgggcggggcacgtggtgaggaggcggtgagagtgggaaccggccacatccctgatgtggcagggacaggagcaggcgccgtggcagcgagtgcagagacaggtggcgcggcgacaggaggtggcgcgatggagagtgcaggaacaggcggcattgcggcagagggcaccgtggcaggaggcgctgtgacaggaggcgccgtggtaaagagcgcagtggcaggaggcgcggcggcagagggtgcaacgatcggaggcgcagcggcagagagcgccctgacagagggcgtggtcgcagatcgcacgacggcagcggaggtgtccaccactgcgacatcggcggccggcacaagtgccggcggcgcaacagcagtccccgcaggacctggtgctgcnnnnnnnnnntagttcataaatatgaccccccacatgctgcgacaccccgtcatcagcgccgattgaagcaagcttaaatagagacccctttctatcatcccccttttctactgtttttgtcgagcttcttcaaacgatggggcgacagcannnnnnnnnnccagcggcatggccgcaagctccgaggcctcggcccagacaggagcagcagaccccgtagcttgagcagttgataaatatgaccccccccatgctatgacaccccggcatcagcgccgattgaagcaagctttaatagagaccccttcctatcatcccccctttctactgtttttgacgagcttcttcaaacgatggggcgacagcagagcgaggggaggggagagggaggggctgcacacgcaggtcccagcagcgcagggttggaccgcgcaacaagtgaacaggttacaaagaatggtgggagaaggtttgaggcacgcgagtgctaggccgattacagcccgcggcgcgacggcggtgctggcgcatttgggagacggggggattgaggggtcgggcgggccacgggagagcccacactgggggaacccacagccccaccaccgacccaggcctcaagccggggcgccgatgcccatttcaaagccggcggggcgtttccgccgcctgggcggcgcaggcgctgcctgccgcgccgcgacctgctgcttcagcgcctttgcgagctcgcgcgccgccgcctcgcgctcggaggtggaccccggcgcgggcgcggggcgctccaggggcatgccctgcaggtagagccgcgtctggtcgcccaggtgggtggacagcgcgcggaaggcgcccgaggcagccaggtagctccacaggtaggcggcatggtcgaagaggtagcggtccacgcccgcgatcacctggtaccgcgcgttggcaaacacgcccatggccgctgcggcgcccagcgccgacttgccaagcgcgggcacggggacggagggcgcgtaggtggggtcgcgcgcgcgacgcagcgcgcacagcgcgcgccccagcgcggcctgcgcgccgccggccaccaggcccacgccgcagagctgggcgcacttgacgcccagcgccgcggcgcgcgctcctggggtgtaggcgcgcatgggcgtggccgcatcgaacacgttgttgggcaggcgggccagggcattgcgccaggcgtggcgcgcgggcgccggcgcggcgcgcgtcggcgccaccaggtataccagcgctgcgttggcggcggccaggctcagcgtgttggccgccaccaggtccagctcggaaaggaaagcgtcgccgcgcgtgcgcgcctcgtacgccaggctggaggcgattgtgatggcttgctccagcgccagcttctgcatgaaggccgggtcggccatgaggcggcctaccacctcgcgcgagacggtggggggcagcgcgcgcgtaagcgcgcgcgtgaccccgggccgcacgtccatggccatgaagcggacgagggaagcggaggagaccaggcccatctgcaccgcctggcgcaggacaaagggcaggtcgcccacgccgcggtaccactcctgcagcaccgccgccagagcgcgcgcgtcatacagctccgacaggaccttgcggaagaagccatcgtcgccaccgccgtcatcgccctcgccaaagccgccggagtagtcatcgtcgtcgccgccgtcgtcgccgccgccgccgccgttgaacacgcccttgcccagcccaccgccgcccatgccgtcgtctagcttgggcgcggtctgcgtgacacgctgcttcaggctcagcttggagcgctccagcgtcgcgccgcccgaggaggagcccaggccgcgcgccatgccggtggtgggcgccgcaaggcacgtgggcaggggggaggccccactggtgctgggggagccttgccgctcctgcacgcgggggaaggagaggggggtgagctctcgcacggcgccaatgcgggaggtggtgccggggggtgcaggtgccctgaaaacagggcgacccgaacccactccccaaccagtgaccatgtgcttcgcctcgcagggcaatcgccattcccgtctaccccatgcagtgctcacatgtccggcaggcgggctgagggaggcagtagtggtaaagcgaagccggggggcggggcagcccgtgacgaaggccgggcgggcacgtgttatccttcccgggagcaggaggcatggagccttcccgaggtgtggggtagaatgtccagagatgcggctgctggaggcagcactcgcggtgaaggaggggcagacgcgaggtcgggcaggcagggcgcaagataagcctgccatggtcgaggcgccgacgccgctgccgcggggtgctgtgaggttgtcctagtaacacagaaatcgacacacgaacgatcactagctgccgggagtgtgggggaagaggcattgccctgcgcgacgtccatggatacttccgaaggagtctctgcagcatgtgcggatgggatcgacccgggcgctcgatcctctggtaggatggtgacaggcgcagattcgagaccctgcgccgggacgggaggtccaccgatcaagacgcatctccattcctaagatggtcgcttgcatttaatcgtgaaacaaagtttctcagcaaaacggcttgcgcagttgtgctctaagacttgctggcgctcagagtgttctcttgtgaactccctctgtggatccacgtcgacatttcttcctgcaaccactccaaaaactgattgattagtcttggttagcctacaatggcaaatgttcgtcacttcaatgcacaacatgtgatccctgactgagcagaatcagtcgaggccacccgtgcaaaatcgaccatcatgcagcagtaacagctttcaggggcatgaagaggttcaatgctctttctgtcagcaacgcattggtgaagaaacacagcatgcgagtatgctgnnnnnnnnnntccttgcacaagcgaccatcatgcagcagtaacagctttgcggggcatggagaggtttaatgctctttctgtcagcaacgaatgggtgaagaaacacagcatgcgagtatgctgataacctggctccctggctccctgactcgccgtagcccgtccgagtcagcaaacactccatgatttacgacaagccgtgaatagaatttccaaggcatttgatctgacgagcgtgagtactcccgggcacacaaaatacactgtgcttggctttcatcaggcgcgctgatcaagcgattcccaggtccagggagcttgaccggctccagcgactgcctttgcctgggggaggcccggacactgaccgtgcgcagaatcgtcacctctcgcacctgcatcctttccttctgagcagagcgtgtcctaaagtacacgatggcccgcaagaagatcaggtgcgtggcatgggagcgaggtgggtgcgcggggccctacacgccggctctccccgttacgnnnnnnnnnngtcccgagcagagcttgtcctgaagtacacgatggcccgcaagaagattaggtgcgtggcatgggaaggaggtgggtgcgcgggccctacacgccggctctccccgttacgaacccacccacccctccggcatccagggagtacaactccaagacactgctgaaggtgcacgcggcgcgcctgggtgggctggatctccccatccgggtggcccaggtgaaagcggacaccgatttcggggcgctggtgactgcccacccctggctcaacaccacccctctggtggtgaagccggattgcctgtttgggaagcggggcaagcatgacctggtgggcctcaagctggacctggctggcgccgaggacttcatcgcccagcgcatgggcaaggtgggcgcctgtaaagggggatgggtgggtgggaggggccgcatggttaggggacatgcaggcagctatggatgaacgatctccacagcgtctctgacgcagccacttttcaggcattgtgaagtcgtggctccgacacatcctgcacgcctctgctcccctgacacgcctgtccctcaaccccactctcatctcctcccccccccttaggtcatcaacatgggcaccgtatccggccccatcgactgcttcatcatcgagccctttgtgcctcacgacgccgagtactacctgtgcatccagagcacgcgtgccggcacggacctgtccttctccgaggccggcggcgtggagatcgaggagcactgggaccaggtgcgcagcgtcagcctggcggtgggcgaggcggtgacgggcgaggccctggcccccctgctggccacgctccccctggagctgcgccccgggatggaggccttcctggccaccgcccacgccgtgttcaccgacctggacttcacgctgatggagatgaaccccttcacgctgggccccgacggcgcgcccttcccgctggacatgcgcggcgagctggacgacaccgccgccttccgcagcgccaagaagtggggcgacctggagttccccctgcccttcggccgacggctgggccccgcggaggccgccgtcgcgcgcatggacgagggcaccggcgcctcgctcaagctctccgtgctgaacccgcgcggtcgggtgtggaccatggtcgcggggggcggcgcctccgtcatctacgccgacaccgtgggcgacctgggcgcggccgacgagctgggcaactacgccgagtactcgggtgggcccaacgcggccgagacccacgcctacgcgctgcgcctgctggactgcgccaccgcagggcccgacggccgcgcgcgcgcgctgatcgtcggcggcggcatagccaacttcaccgacgtagccgcaaccttcaagggcatcattcaggtgtcttggtgtgtgggtggggggggatccctgtcgggggggctgaggcgggggagcgtccaggggcaaggcagagaccactggcgggggtcagacgcgatgaacccagaggtcgcgcgctgcatcccagacgtccgcgagcaagcgacggacctggaatcgcggccagcacagaccaccagtggccatccctggcccatgcactcgctgacccgacgttgcacaccagtcagtggggccaagcgatcgcagcacnnnnnnnnnnaggcatagccaatttcaccgacgtagccgccaccttcaagggcatcattcaggtgtctttgtgtgtgtggaggggggggtggatccctgttgggggggctgaggcgggggagcgtccaggggcaaggcagagaccactgacgggggtcagatgcgatgaacccagaggtcgtgcgctgcatccctgacgtccgcgggcaagcgacggacctggaatcgcggccattcacagaccaccagtggccatccctgccccacgcactcgctgacccggcgttgcacgccagtcagtggggccaagcgatcgcagcacctcccacccaccccctgcactcaccctccccgcctgcgccaggccatccgcgagcgcgccgacgcggtcaaggcggcgcggctcaagctgttcgtgcggcgcgggggccccaactaccgcgcgggcctggacgcgatgcgtgcgctgggctccgagattggcatcgacatcgaggtgtatggcccggaggccagcatgaccggcatctgcaagctggccatcgaccacctgaaggtcagcgatgcccgcgacgcaaaggctgcccagtgagccgtgcaggatggggactggtgcgtgcgggggggtccctccccaccaacataggtcgccacccgcttccattgccctcctgggtgcatccacgaatccctgctccagcgcccagggggtcctcacacctgagttcgacatacagacaaccaggctgctgtgccccatcccccccccttcgaccttctcctgtgagctgcactgggttnnnnnnnnnnaggatccacgaatccctgctccagcgtccaggtgggtctcgcacctgagctcgacatacaggcacccaggcagctgtgccccctcccccccctcgaccttctcctgtgagctgcactgggttcccaagggatggatgtacaatgtctaagctgtggctggccggttgccgtcatccaggcagccggcggcatgggtaatgaaatctatcggcagggcgtagggaaagggcgccgaagctggcggccccggggggtgggcgaagagctccgtgggtcatggtaggctacaaggcaaggtgcggggggccagaagggggccccacaagggtcacagcacagacgctgcaggcggaggtgggcaacacagggagaacaagccgtgtcgggtatcgtgtgcgggggtccaggtatctgcggacagtttgggcannnnnnnnnnaggggcgaggctggcgccggcccccctgatttcggtccgtggggatggggacgacctggcacgatggagcggccggcttgccgctctcgccgccgccctccatagggcagccgggtggggtgcgcagaggctgcgtcgtacaaannnnnnnnnntagacgctgcaggcggaggtgggtaacacagggagaacaagccgtgtcgggtgtcgtgcgtgggtccaggtatctgcggacagtttgggcaagggtggaagaatgggcagtgagccaagcagcgtggtggggagtcctggcgttgtgctgtggggtggcggggggggaaggctggcgccggcccccctgacttttggtctgtggggatggggacgacctggcatgatggagcggccggcttgccgctcccgccgccgccctccatagggcagccgagtggggtgcgcagaggctgcgtcgtacaaagaagatggaaacacgtgctctcacagggttgatgctgtcgctcggaggtgggtcggccactgggggacctgatgaggtggaggaggggctacgcggcgggcggtggcgctcgccgagccgctccgctctgcggccgcgtcgggccgggcgcgcaccgcagggcccgccagaatctgctcctgcgccgggcacggcgagggtgccgtgcagggggacacgcgcggccccccggcttcagtcttcgctcgggggtgttgggttggggtctgtgcgggggtcaagggcgggtcgatcttgggcagtgcggggggttttgcgggggtgagtttgcgtgcggcgnnnnnnnnnnnnnnnnnnnnnnnnnnnnnnnnnnnnnnnnnnnnnnnnnnnnnnnnnnnnnnnnnnnnnnnnnnnnnnnnngtcggccccggcccccattcctcccggccgccgcggcgctcagcagcgcagcgagtccaggaagcggtgcatgcggcgcgaggcggcccgcgcggcctggcgcgcggccagccccgcg

SEQ ID NO: 28958 - DNA, 61 bp, Chlorella protothecoides
ctgcaggatgctttccagctcgtggcaagatgtggggagtgcacctgacgcacacagccgc

SEQ ID NO: 28959 - DNA, 140 bp, Chlorella protothecoides
gctgtcggtgaggggggctgctgagggggttagaggacgagcgatgcagagtggcggccaatgaagacgaatgtggcgtggttggcgaccctcctgtacaaggctgctcgtggacatgttctagtccgcaagcgcgcctg

SEQ ID NO: 28960 - DNA, 77 bp, Chlorella protothecoides
gtcctgcagcttggccagcaacttcagctcaccctcgccctgaatggcgaggggggggggggggggggggggggggg

SEQ ID NO: 28961 - DNA, 80 bp, Chlorella protothecoides
ctgcatactcatcacacgaggccatccgatggagagttatgcttaaggagtcccagatcgcgcgggatctaaatttgtaa

SEQ ID NO: 28962 - DNA, 61 bp, Chlorella protothecoides
ccgcatgtgtcaagtgctcaggtgtcggattgcagccccaatttgctccaatggcccagca

SEQ ID NO: 28963 - DNA, 61 bp, Chlorella protothecoides
ctgtcggggacggggtttcgcgcgtcctccaccggccactcctccatcgcggcatacctcc

SEQ ID NO: 28964 - DNA, 67 bp, Chlorella protothecoides
gaccaaaacatgcctggagggcgcctcggacccccccactcagccactccctcgcaccccacagcat

SEQ ID NO: 28965 - DNA, 78 bp, Chlorella protothecoides
cctgcccatcctccagccccacaaagacaaccaccaccgctccagccccacccgtgaggcaagtgaagtttctcagcg

SEQ ID NO: 28966 - DNA, 77 bp, Chlorella protothecoides
aacacagggagccgagccagagacactgatttcaagggcaaaatgccagggtcattcccccagcgctgtcaccacca

SEQ ID NO: 28967 - DNA, 69 bp, Chlorella protothecoides
tagtgagagacaggacattattctgtgattatgttggtgaaatataatattgtgtggcgattcaagagt

SEQ ID NO: 28968 - DNA, 64 bp, Chlorella protothecoides
gcgcaaggaggccgcggcgaacgccgccggaaggcccgcccagagcccccagaagccgccgccg

SEQ ID NO: 28969 - DNA, 79 bp, Chlorella protothecoides
tggagggccggctgccctgatgcgggcgtgggtatctgcctgggggggttcctgcaccccgccgcagccccgcagcctg

SEQ ID NO: 28970 - DNA, 61 bp, Chlorella protothecoides
cgcgatgcgtgtgcaggtcgaggtggagggtgaggtcttcagcgggtccacccccacagcc

SEQ ID NO: 28971 - DNA, 101 bp, Chlorella protothecoides
actacggcggcaggtcagggaaatttgacggggccttaataccttcccataagcttgattgctgacatagtgacaaggcccctggccagaggcataaacat

SEQ ID NO: 28972 - DNA, 133 bp, Chlorella protothecoides
aaaaaagatcatggagacctcaccctcagcgggcatcgaatcctgccgcggatggggtggtgaaacgtggcagtggaataaatcttggctaggggagcaccccggggccagcaagttgcggctcgcagcgcaa

SEQ ID NO: 28973 - DNA, 133 bp, Chlorella protothecoides
gacgtggcggggtgtgtttcgttcttggggacaggattgccggggttggcggcctccttctccccgactcctgcagctgagtgacacggtgaaagacccgtcagagggtctgcctcgacctcaacaggacaca

SEQ ID NO: 28974 - DNA, 182 bp, Chlorella protothecoides
gggggtgggcgttgacctcatagccttcagcaagggcggtgttgtgctgaaccaggtctgggctgtgtggatgtaggaccgtgtgcccctgggcctgaaggagagctatatggtggttggccttgaattgtttgttgtggggatgccttaaatgatccataccccatgatgctgaggcaatc

SEQ ID NO: 28975 - DNA, 147 bp, Chlorella protothecoides
gcggctgctaggggggccgagtggctcagcagcgcgcagcgtgccacgtcatctggcgtcggggcggaggggagcagggcgaagagggcgtgcacataccgcgcgcccagggcgtgtgggcctggtccgctcgattcagggtcggcg

SEQ ID NO: 28976 - DNA, 104 bp, Chlorella protothecoides
aagtgcacagcctttgacacggaagcctgggtccaaaatgtattgaaacaaatcacatcctgattgcacaatcgcgcagctccttaactcggaatgagtaggcc

SEQ ID NO: 28977 - DNA, 61 bp, Chlorella protothecoides
cgtgctcagcgtgctcagcgggtcgacccagagcacatggggctcgccctccctggagatg

SEQ ID NO: 28978 - DNA, 242 bp, Chlorella protothecoides
cgccccgcagctcgctgcctgcgacacaggtggcgggggagtgaggggatcaggtgaggattccaaacctttgctgggccctcgagcccacgcatgcgttcttccagctgaggctgccactgccagggcaatctgaccttctcacgccattcaaatcaacttgctgccatgggaatatcccccccctcccaaccctcagccacatcccaatcacctctagcccggaacacgtcgcgccaggc

SEQ ID NO: 28979 - DNA, 113 bp, Chlorella protothecoides
ggggcttgctccgtaagaggtgcaacgcgaccccaaacctgtacagaatacggccgttaaagcgttacttagagttgtattcattcagatcccctaggacaataaatctagct

SEQ ID NO: 28980 - DNA, 74 bp, Chlorella protothecoides
gatggggagcgagccattgactggttctgcggtaagatcaaattcgtacagtggtgggacaaatagctgtgcag

SEQ ID NO: 28981 - DNA, 76 bp, Chlorella protothecoides
gagaaattctttgagtatctgtgttggtcccctaggacaagtctggggggatagagggtggaaacggatggaatga

SEQ ID NO: 28982 - DNA, 61 bp, Chlorella protothecoides
gcccccctacgagtccatcatcatgggcacagccagggtgagaggcatggtttggaggggc

SEQ ID NO: 28983 - DNA, 63 bp, Chlorella protothecoides
ccgccgatcgtcgtattggagttgcaggtgctcacgttgacggtcatgctggtctcgggccgg

SEQ ID NO: 28984 - DNA, 628 bp, Chlorella protothecoides
ccacagccctccgcctcacccccctccccccccaccaacccccaggctgtacgaagggtacaacctgcgtgccaagttcaaggggcacgccaaccgctccacccagatcaaggcgtccctcagccccagctgtgacaccgtcatctgcggctccgacgacggctgggtgtaccagtgggcggtaccctcccggcctggcgcccggcctgaggacgcggtcgtgaaggtgggccaggttgtcagatcgcagcatgcaggagctcaaagactccagtgttcctgccggctacatccaatccccaaccgctgtgtgcctcgcaggagaaggtgttgtcctacgagtgcttcctggctgcgtcagatgttgtgacggtggccatgtttgctccggagcgggcgctggccacatggccgacccagcctggcaagggtggggcggtgggggccaccccccgtgtcatcctggctgcaggctatggaggagagatcaaggtcttcgaggacctccaccagccctgaattgatcgaccatggttacagtacccctttctcttgctacagcaacccttctgtagacacagattgacacagccatggccttttccaggaggatggtggtgtttaataa

SEQ ID NO: 28985 - DNA, 100 bp, Chlorella protothecoides
catgctggaggccagcagcgcggacaccctctgcaggtgcgtgctgagtccgatacgttctgcttatggagtgcatgtccaaagcaatgacatggcttaa

SEQ ID NO: 28986 - DNA, 133 bp, Chlorella protothecoides
gcgcacgctgctattgtcccgaatggtaaagttctcgacactcttgtcccaccggcagtcgttttgggcttctaggtacgcgtcactgcagggaggaatttggttttgcatcatgagtgtggctgcaaggcct

SEQ ID NO: 28987 - DNA, 61 bp, Chlorella protothecoides
gtctgggggtcgtgtggtgcagcagaggtgggaggccccgactcctcgtcgctcacacccg

SEQ ID NO: 28988 - DNA, 80 bp, Chlorella protothecoides
agcacagccatggcagaccccaccgcagccgcgggcatgcaccagaggcctccccacctggcggctttgcccgccgacgc

SEQ ID NO: 28989 - DNA, 61 bp, Chlorella protothecoides
gcttggagaatggacccgaggctacagatgtggagattaaaaaggtcaggagagttcaaat

SEQ ID NO: 28990 - DNA, 80 bp, Chlorella protothecoides
ggacttgggtgggagggggaaggtgggggtctcgtgacaagagatgcagggctgggaagagtgtggccagggcaaactct

SEQ ID NO: 28991 - DNA, 63 bp, Chlorella protothecoides
tggagctcgggggccagcgggtgggtgggcacagggggggcctggcagctgaatgtgatcatg

SEQ ID NO: 28992 - DNA, 79 bp, Chlorella protothecoides
gaacatgccctgccatggaagaaaggaagaagatgagcagcgggcaagaggcatgtgggcagggagaccgtggcggtga

SEQ ID NO: 28993 - DNA, 76 bp, Chlorella protothecoides
gagtctcagggcctgagggtgggaggcatgttacgacggcgcagggttgaggaggaacattgatctgatgcacgcc

SEQ ID NO: 28994 - DNA, 17334 bp, Chlorella protothecoides
  modified_base (477)..(486): a, c, t, g, unknown or other
  modified_base (875)..(884): a, c, t, g, unknown or other
  modified_base (1103)..(1112): a, c, t, g, unknown or other
  modified_base (1389)..(1398): a, c, t, g, unknown or other
  modified_base (2493)..(2502): a, c, t, g, unknown or other
  modified_base (3128)..(3137): a, c, t, g, unknown or other
  modified_base (5297)..(5306): a, c, t, g, unknown or other
  modified_base (5624)..(5633): a, c, t, g, unknown or other
  modified_base (5717)..(5726): a, c, t, g, unknown or other
  modified_base (5858)..(5867): a, c, t, g, unknown or other
  modified_base (6357)..(6366): a, c, t, g, unknown or other
  modified_base (6686)..(6695): a, c, t, g, unknown or other
  modified_base (7449)..(7458): a, c, t, g, unknown or other
  modified_base (7690)..(7733): a, c, t, g, unknown or other
  modified_base (9273)..(9282): a, c, t, g, unknown or other
  modified_base (9864)..(9873): a, c, t, g, unknown or other
  modified_base (10306)..(10315): a, c, t, g, unknown or other
  modified_base (10779)..(10788): a, c, t, g, unknown or other
  modified_base (10918)..(10927): a, c, t, g, unknown or other
  modified_base (11001)..(11010): a, c, t, g, unknown or other
  modified_base (12521)..(12530): a, c, t, g, unknown or other
  modified_base (12911)..(12920): a, c, t, g, unknown or other
  modified_base (13251)..(13260): a, c, t, g, unknown or other
  modified_base (13445)..(13454): a, c, t, g, unknown or other
  modified_base (13955)..(13964): a, c, t, g, unknown or other
  modified_base (14226)..(14235): a, c, t, g, unknown or other
  modified_base (14591)..(14600): a, c, t, g, unknown or other
  modified_base (14901)..(14910): a, c, t, g, unknown or other
  modified_base (15280)..(15365): a, c, t, g, unknown or other
  modified_base (15637)..(15646): a, c, t, g, unknown or other
  modified_base (16297)..(16306): a, c, t, g, unknown or other
  modified_base (16588)..(16637): a, c, t, g, unknown or other
  modified_base (16814)..(16823): a, c, t, g, unknown or other
  modified_base (17230)..(17239): a, c, t, g, unknown or other
ccaccccccaccccccaccccagatcatcttctgcagccgcacccactcccagctgtcccagtttgtgggggagctgcggcgcacccgattcgtagacagcctctccctggtggttttgggctcccgtggcgcgctgtgcatcaacgatgcggttgcccgcctgggctcccccgccgccgtcaacgaggcctgcgccgagctccagcgccgccccgcgccgcgcaagaaggcggggagcggggagaggacgggcgggaagggggcctgcccttacctcgcgcgcggcggcgcgcacgccgccagcctccgcgacatggtgctggcccaccccattgacatcgaggagctcgccaagctgggtgagctggggattgtttcaggtgggtttttgttttgatgaggggtggtggtgcacacttcagggcccctgtcagggtgcaggcgacgtggcaccattgaaccccttgggaccccgnnnnnnnnnngattgtgtctggtgggtttttgttttggtgaggggtggtggtgcacactgcagggcccatgtcagggtgcaggcggcgtggcaccattgaaccccttgggaccccgggaagggggtcccagcccagggcgacctgcagactgacgcactctggttcccactcctggctgacctcatctgcacagggcagcgacgggccgtctgcccgtactatgccgcgcgggatgccctgccggaggccgacatcatccttgcaccatactcggccttgctgctgcgtgtgagtgagggtggatctatggggtgttgcgcaacatccgcgaggatcgggatgagtggcactgattggaagaagcccttggcagacaaccatctggcgccttcacagannnnnnnnnnagtgttgcgcaagatccgcgaggatcgggataagtggcattgattggaagaagcccgtggcagacaaccatctggcgccttcacagagagcacgggtggggttggacgactgaagaggctacctgcacaaagggcatggcaggctgatgccagtgggacgcctcgctttgccctccaacctcactttcccctccgctgacaggagacgagggatgcccnnnnnnnnnnttgatgccagtgggacgcctcgcttagccctccaacctcgctttctccctccgctgacaggagacgagggatgccctgggtctgcaactcaagggcaacgtcttcgtcgttgacgaggcgcacaacctcggtgcgtgcatgctcggctatgcactctcatgagattgttgaggagggttgatcgggggagaggatggtccatcagattagcatgtggccattgccctggccggcgctgcagtatcgcatgctccatgcacaccaccaacacgtcacnnnnnnnnnnggaggacggtccatcagttcagcatgtggccaccgccctggccggtgctgcagtatcacatgctccatgcacaccaccaacacgtcacaccctgacgcacgagctcccatcatgcccctgaggcgacaccatcccagtccccatcaccctttcccctccctgaatctcccaaccccagtcgacgccgtgaacgacgcgcactcggcgacggtcacgggccgccaggccgccgcatgcacggcccagatggagcggtacctcgcgcagtaccgctcccgcctgggcatgcaggcctgcctggccctgcagcagctgcttctggtgtcgcgggcagtggggcgggcgtgcgccgcgcgaccgcaaggcagtcagaccggcgaggcgcacgcgcgctctctcaacgcgttcgtgctcgagcacgggctggagggcgtcaacatcttccagctgctgcggtgaggggcgcgaggagggggttggacggcgatcgctcaggagcatgaggctgtgcagcagtgattgccggtgctcgactgactcggtgccctgccagggctgggggccccctccttggaagtagcatgtctggggtcaggaaaggacgcatgatgtccccccccccaccctccatctcaactactacaggtatgcaagtgagaccaggctggtgcagcgggtggccggctactggcgcagctgcgaaatggaaaactccgggccggggtcaaattcagtgcccggcatggaggctggaaagcccggcggcggcggcggcggccttgggattgaggcggcggggcagggcccgctccacgccctcctctccctgctgcggggcctgcgcagcgcggacaaggatgggcgcataatcgttgaccccgggggggctgatgggggcagtctgcgctttgtcctggtggatgcgggccggctcttctccagcgtaagtgggacccggggcggtgggaggccgcagcttgcccttgcgtgctgccatgggtacctgaggctgcgctggggttaagcatgcgggcccggcgctttgggtgatgtggtgcggtgaaggcatcaatgggagctgcgcctgtgcaaagnnnnnnnnnncacctgatgctgcgctgggggtaagcatgcgggcccggcgctttgggtggtgcggtgcggtgagggcatcaatgggagctgcgcctgtgcaaagtgtgtgccacagagttgacacagctccaactgccgtcctccatcagatcgtatccgaggctcgctccgtcatcctggcgtccgggacgctgtccccgttgggacccctcctcacccttttcccaggcgtgcccatggaccgcctgcaccgcttctcatgcggtcatgtggtcgggaaggaacggtgtgttgtcttgggattcgagatgcactggggagcattgaccttgcctctcagcctggcacatggagcccatctgcccagctggcctctcaaaaccctattcttgcaggctgctggccctggctctggcctccgggtcatccggcacccccttggactttcgattctccaggcggggcgacccggcggtgctgagggagctgggccaggtgctcctgaacgtctgccgtgtgacccccggggggaccattgccttcttcccctcccaccactatatggaggaggcggtggcgaggtacgtggggttcagatgctggacaactgggatgctgggcatgccgtccgtctnnnnnnnnnnacgaggtacgtgggcttcaaatgctgggcaactgggatgctgggcatgccgtccgtcttgccacgctgagtgtgtgtgctgaggtggtaggcgaaggagctccatccgcagtctgagtccctgccccgcttcccggagctgtgcaccactccgcctgatttctattctgccttgggtgtcacatgcacttagagcctcagataacaactgcagaaatggactttaagaaaagggtatgttgtgccccgaaaacttgcttcccacagactccccccccttcccctcaatccttcaacaccacatcccatgcagctggaaagccagtggccagtggacacggctagaggcatgcgtgccggtattgctggagccccgcacggcggccgaggtggatgccaccctggtggcgcacgctgcagcgtgcgccccccctcccacctttggagccctgccatcggggccccccccgcgccgactgggctgcctgctcctagccgtggtgggcggccgcctggcagagggcatcaactttggcgacgcgctgggtcgcgccgtggtcatggtgggcctgccctacccaaaccccgcagacccggagctgcgggagaggctacgcgccatggacgccgctaccgctgctgcctctacaagcctggggatacaggggcctgccttgcagccgccgcccagcagaggccattaccaggacctgtgcatgaagggtgtgaaccagtgcatcgggcgggccatccgccactctcgggattatgcggcggtgctactcctggatccaaggtggggaggccagcgtgcacgggcttgcaggcttgtgggatccgacgctgggtagggcctgtgcctttcaacggaagagcatctgtgcatgacgagcaggagggtcgggtctggtgagcaaatttctcgggccctgaacccgccaaacctcccctcaacagccccgacaatcctccaccttggccgtgcgctcagattcagccaatcgactccctaccgtgtcgcaggtatgccgagagttttaccaagccgttcagaccacccctggccaagctcccggcatggatcctgccttcgctggaagtgcctcagggaggttttgggccggcctacacacggctggtccgatttttcaaggccatgcaacagactgaaggctgaggggctcccctgacgctgtgacgaattgtttactagtgcacacacagtttgggcatggatgtgcactcggtctggacattaaaagcatgagccaaaggctgctttgaggcacccagcgttgcttgagaaagaggggctcactccaggtcagccgtcacccccactgattggctgcctgccgtcttcgtcctccaatccagagagcaccacggtaaaggttgcatcgccatctgctgtcgtcgcggcgttgccgtcactggcagccagagcaccggcaaccaatacttcctccgccatcgccgcggcagcgtcccaggtcgccaggctctggccgctggacgcgaaggacaccagctgctgggcgaagcgcgtggcgtgccggtgcaggaagggaccggccgctgtgccgagccgagtgcagaggtcctggagcttacaaaggggggaatgaggtttgagggttgcagcgagcgagcattgcaccagagccaccctgccgttctcccatctccaaggcgcgcagcacacctccaacaccctcgaccaaaacgggctccaccgcaccgcatgggaggggccaccgccgttcgtcccccgacgagcgccgccaccaagctgggcagcacctcgcagcgtgcccagcaggtgctgacccagcaggtcgacatcgtcctgcagcaggatcgcctgcagctcccgcgtcacccagcgagccacgtcggagcgtgccgccagggccggcgagacgcgcctggcccacggcggggtcatgccatcctcgccaccctgctgctgcacctccatgacatcgccagagaagtagctggcccgccgccgccggtgctggacggtgaggtggaggtcactgcccgtggaggacagggctgcctcgtgagccggcgggcgcagacgttccctcctggggggaggaggtgtgcaggagtgtgtgcggggcccagagggaggtggcttcatcgggatgtnnnnnnnnnnagggaggaggcgtgcaggagtgggtgcagagcccagagggaggtggcttcatcgggatgttggggcaagagctgcgttgccaagctcaggagtcggttccgccctcgtcaccccaggagagcctctacgaccagtgtcacgagaccgcacccctcctgctcagcctgagcagcgcaggcaacacaccggtaggcgtagtcacggcagtccgtgatgaggagcatgtaggcttgtcgacacagcgggcacagcaggggcaggcgcggatcctggttctggctccactgctttatgcactgctcgccaagcaggtgtggnnnnnnnnnnacattgctaagctcgggagtcggttccgccctcatcaccccaggacagcctccacgaccagtgtcacgagaccgcacccctccnnnnnnnnnntgcatgtgagcaacgagagagcagggcagggaccagagggagtttgttggggcccggtgcttgcatgtaggtggtcccccgcccccgcccccagaagggtcaggcagcccccagctgcgtgacttgccttgnnnnnnnnnncgcatgtgagcaacgagagagcagggcaggtaccagagggcgtgtgttggggcccggtgcttgcatgttggtggtccctcgcccccgcccccagaagggtgaggcagcccccagctgcgtgacttgccttgtagcaaaagtggtggtagcaggggtcgatgaatgtctcgtccgcgtgtgctatggcactcaagcagatggtgcacgtcccacacactccactgtggggttgcagcgccatcaggtcaaaacctcgactgctccacatttagcctcgcatgagcgggcatcgtgcaggttgcatagagggtcgtgggtggccaagcctgttcaatggtgctcatgtggcattgacaccgcgagaagcgaggtgtggggacgttgaagcctttctgtcttgcagggaactgaagccataccctgcacaccaaccggcagagggccgttcagggaccccagaggacaagtagggaccgaaacgcacaggatnnnnnnnnnncgcacagagggtcatggggggccaagcctgttcaatggtgctcatgtgacattgacaccgcgagaagcgaggtgtggggattttgaagccttcttgtcttgcagggaactgaagccatacccctgcacaccaatcggcagagggcgtttcagggaccccacaggacaagtagggaccgaaacgcacaggatataccctaccctccctcattccgtgtgagcatatgaggatggaaggtgtgagtaattctcatttctaaagcgcacttggtggtcgtcggttaccacacaaacgtcgcagccagcgagaatctcatggannnnnnnnnngaattctcgtttctgaagcacgcttggtggtcgtcgatgaccacaaaaacgtcgcagccagcgagaatctcatggaagccctggtgcttccgggcgcgacttagcatggtccctcgctgatcctcgcaggtcaagattgcctggcatcatttaaagagtccaggaaactaagccgggagaactacaactcacagctgatgggcagaaaccccaggtcctgaccccaccccctgctccgtctcgacgacacgaggcgggacaccgaggcgtacggcatagtactggcgtctctgaatcccttgttttgagtcgttaagctcatccaaggtcacaacatggcggcgaccatggaggaggaggccatcatcaagtatcggtacctcacacagaccgtgagcaccacggccaatgtcctgcctcccatgaagagcctggccaggaggtgaggtgcattggacggggtagtatgcacttgctgccgctgctgctgctccgtgcctccgtcggggcgctggcccagagcccagaggcccagtgtgcggagctcctacctgcctgggttgccccacccttcttcatgcctctgatccccgccccgagacgcccaggttcttccaattccggaccgctctcacctctggcaccgcggcggaggcgcgggccctgtacgacgacctcctggtggacctgcatgccattcagtcggccctggaccgccaggccaccggcgcgcgcgtggcggagcgcgaggcgnnnnnnnnnncgccattcagtcggccctggaccgccaggctaccggcgcgcgcgtggcggagcgcgaggcggcgctcttcgccgccgagcagcggcgcctggaggcgggcattgccgcgacgcggggcgggatcgaggccgcgcgccgggagctggccgccgcgcaggccgacctgcgccacgcgcgggagtacgaggcgctgcggcgcagcgtggtggcgctggcgcctcgctccgccacnnnnnnnnnnnnnnnnnnnnnnnnnnnnnnnnnnnnnnnnnnnncgcgagatggacggcgcgtgccgcgagatcggtgacctgcaggcccaggcgcgggggctggaggaggcgatggcccggcgccgcgccgcgctgaccgggctgctggccgtcgcggcgggggtggcggccgagctggagagcgaggcgctggcggaggagggcgcgctgccagagacagagacggcggagaccgtcgctgggccggctgcgtcgctggaccgatgaccaggagagggtgggggagcagggaccggagggctcattcaaggcctgaggatctggactgggtgggtgacgcgctcctcgggttcaaaccctggcgacgttattctcatagagggtggtgtggcgagccgctgcatggcatgggctccaaggctacttctccacacagtttcccaccttcctctgacacgcggtgcaacccagccttcaaattcctccgaccattgtggagacgaatcccagcatcccacatcccccttcctctcaccgatgccgtgcttcccagactcagccctgtacagcaacagttctctcgggcagtggatgacaggcagggcatgagaggggacccaacatcatcaaggagggtggattcttcggtagagtggctcgtcaggggggcagcgggtggactgacacgtaatcctcgtcgacatgggtctcaggcgcagtcccgtatgcccactcccatcttcagtacaggctctcctcctggtgggtggtgatggtgcagtcggaggtggggtaggccacacacgtcagcacaaagccgttggagatctggtcgtcgtccaggaaggactggtcggactggtccacgtccccagcatccagcttgcccgcgcaggaggagcaggcgccggcacggcaggagtagggcaggtcaacgccggcctcctgcgggaggggggggttggggacaggggcatgtgaagagacagtgggaggggtgtccgggcccaaggcaaggggcgcaagggtatttgggtccagctgagctgggcagcgcattcggcgcgtgctccaagaccgacagatcatgtgctcgatgcccgtggcgcacacctctgcggcgtccaggatgtaggtgtcgccgtcgacctcgatggtctcctcgccatcaggggtcttcagggtcaccttgtaggcggagaccttgaaggcggtggccgaccggatgggctgtgcatggtgtcagggaggtagggcactttgtgaggagggggggttcgatgcatcgcctcgcgggcagcaaagacgcatgactgtccacagatgggaaacccagttcatggcccgacgatggagcgtgggccgggtggcgtacgcatgacaccccagaggctgcaggaccttcgacgcacctgccggctgacgcgaggggcgaagaccttggaggggcaacggaagcccacgcgggtacctgcagcacaatgcaccgaggcgatggaatcatgagcacggattccaatcagtgactgagtatacatgggggtccggaatacgacccgaggccgaccctgcctcagcagcnnnnnnnnnnccagtggctgagcatacatggggggtcggaaaacgacccgaggccgaccctgcctcagcagcctaccactcagcgcggagagctgcatgactcctggattgacgtctaagattaatctaagtatgaatgagttcctgtaactcgaaaggcttggaagtactggttgattctgcttcgcgacgatgaccatgaaccagaacctcacccagaaggtgtcccgctgccatgttatcgcctatgattcctcgtggccagcacgcgcagcatgcactccccggccatctcgggcgcactgcggcggagttcaggcctaggaaggccgtacagcctgacagcctgacaatcttatatgtgaaactaggaaacggaaacaggtgagacctcggaagggttccatgtgcacacaaacgtgacagcagctgcggacaccccctgcaagtgacgctgggatggaaacttcacaccactaacccggcccacggggctcaaagaaaacatcgaaaccctttcatcagggaccgtttctcgaggatctccagtatcgccgcgaagaccatggagcataggggaagaacgtcattnnnnnnnnnngcctcggaagggtcccatatgcacacaaacgtgacagcagctgcggacatcccctgcaagtgacgctgggatgaaaattccacgccactaacccggcctacgggcctcaaagaaaacatccaaaccctttcatcagggaccgtttctcgagaatctccagtatcgccgcgacgaccatggagcataggggaagaacgtcattctggggctgcgttgtggaggctgggtgctcgcacaccttcgacccccctagtcattccttctccaagctccacctgtcacaggtaggtgtctcgggggtctggggtgagacggggcgtggatgggagtctgggcctgccgtcacccagtcatggttatggctccacagcccccctcgcctgccgaggcgtgaccaccacaccatacccagccctgctgtgacatgtcacannnnnnnnnnatgatggctccacaaaaccccctcgcctgccgaggcgtgaccactaccccatacccagccctgctgtgacatgtcacacacaggccgcgctctccacggatgccaagcccaaatccaaggccaccctcgaggtgaagaccagggacagcctcgcacgggccgtcgtcaccctacgcgccggtaaagtcgagcatgccagcatagacctcgtcatcgacgagcaggtcgtgttccttgcagtgggcgacgccgacatccacctcaccggctaccacatgccagagttcgagggtgaggagggtacggcgggaggggaggggagggggaccgatcttgggggtgctgctgtgtctgcacgtgggagcggatcaagagcctcctgcgagtgcggtgtgcacacacgctgggtctgcacattgcatgatcctgatcgaccaactaccgcactctgcgaggccagatgnnnnnnnnnngcggggtgctgctgtgtctgcacgcgggagcggatcaagagcctcctgtgagtgcggtgtgcacacacgctgggtctgcgcattgcatgatcctgagcaaccaactaccgcactctgcgaggccagatgnnnnnnnnnntgatgagcaggtcgtgttctctgcggtgggcgacgccgacattcacctcaccggctaccacatgccagagttcnnnnnnnnnnagggggaagactacagtgaggaggactctgaaatggatccatacgaaggagatgcgatgggagttggcctggacggtgaggattacagcgaggacagtgaggattacagcgacgaggacagtgacgaattcagcagtgagcgagggaaaggtggcttgccagcctctcaagcgggtgtgcaacctcctgtactgtgtacagggtttgtctccagggcattgactgctccccaacggggcccatccgtgctcagtgccatctcccgtgaaaccgcaggcgacgatgagagtgacctggaggctgcgggggaggtgaggcgcccgacgcctgaaatcagggagctacctgtgagcgcagtgcagtgtgcctttttgatgtgggtgcgcccgctgcgctgagctgcagcagtgcatgtcaaaagtagtggatccgctcagcaggcacagcgcctttggtctacatgagacggccacatctggggtctggaatgccaaggctcaccctttcccccgttgcaggctgatgccggggaggatgacgttgaggccagcgatgacacggaagcagacgacgaggagctggatgaggacgagagtgaggaggaggacgagagcgaggaggaggaggagcaggaaaaggctgctgcccccaccccaggccagaagcggaaggaggcagccacaccagttgcccagccgtcggctaagcaggcgaagcaggctcagcaggccaaggaggccaagcaagccaagcaggccaaggaagcccaggtaaccaaccaggccaagcaggcccaggtgaccaaacagcctgcagcacagacggtcgcaaagcaggcagcccagcctgtggccaaggccccggtcagggctgagaccgccaagccggcaaaggaggcaaagaagcgcaccttccccaatggcttcgagattgaggtcctgaagcaggtgtgggcggagatctgtggggggcctggagggtcgtggactccctaactgactgtggtccttggtgtgacaggcacgcccgcttggctggaagggcctggtgtgcagtctgtgaggtgactgccaccatgagcattgctagcacagggtcgggctccttccacagctcgtgcctcccaagctcagtctcatcaccatgtgtgtgcagggtctgccggatgcaaagtttgccaaggcggggaagactgtctctgtcaagtacacagggcggctgaagtctagtgggaaggtgtttgatgccaccaagggcaacagggcgttcaacttccggttgggagtgggagaggtgaggcgtccttctggtcaggggtacgggcaggctctgaacatgctagggggtgggattgtgagaagcactgtgggtgccgactccgctcgcggtgtccaccacagcagcggaggcttgaatggccctccattgctgccagcaatgatgcagcaggtctgaactttggccctgcaacccttggcaaccccaggtcatcaagggctgggacagggggnnnnnnnnnnacatgatttgccctccattgctgccagcaacgacgcagcaggtctgaactttgaccctgcaatccttggccatccccaggtcatcaagggctgggacaggggggtcgagggcatgcgcatcggcgacaagcgccgcttgatcatccccccggcgatggcgtacgggaccagtggggctggcaaggccattcccccgaatgcctggctcgacttcgaggtggagctggtgaacgtcaagtgatgggcttggcgcaaggcagcttgtggtcttcctcaagtgaacagagcttgaggggacacagcaagatccagagccacgggtagtgaactggcaagtctcgtggaggagcgcactgctcacatgtcacgcacaccaacccnnnnnnnnnntctcaagtgaacagagcttgaggggacgcagcaagatccagagccacgggcagtgaaccggcaagtcttgtggaggagtgcactgctcacatgtcacgcacaccaacccaatctgcaacaccaatcgagttgaattggttcgagtcctgtctgactttgtacgagcacgtatgcgtcatttctgatggcggccacctttgagcgctaaggcttaccaccagggaggtcctgcttcctatcttcaagtaggatgtgcattatcatgcatgtgtgccggctcatgcagcacaccgcatgtgcaccaggggtgcaaagccatatatgtggttannnnnnnnnnttgtctgactctgtacgagcacgtatgcttcatttctgatggcggccacctttgagcgccaaggcttaccaccaggcaggtcctgcttcctatcttcaagtaggatgcgcatcatcatgcatgtgtgccgtctcatgcagcaccccgcatgtgtaccaggggtgcaaagccatatatgtggttannnnnnnnnngtgaacaactacatatgttcaaggtggggtgacactctgtggtgacaaaacatacggaggctgttcgggtgccgtaacaagtgtgcaaacacttatgctaccaatatgccgttggatgggatacggttgcgcaattcctccaggcgcatgcctcgagcagtgaagtggtgaacagggcgggatcatcaaccctctatcccctctggcttcgtagaggctgttcagtatccccatccaactacgttgggatgtccggcggagcccagatctccatacttgcttctccaaaccctcagcaccttgggtgaaagtggcggaaactggagtcttacgagggtagcagaatgccatggtcggaaagcgaagacgaggtacctccgcaccagacagctagtggcggtgaacttcaagcaatgggggctaacctgcgcgatgtactgctcattatggttgggcatagaccaatgctacgactcccgtttcgcgaggcaatggcgtacnnnnnnnnnngatgtactgctcattatgtttgggcatagaccaatgctgcgactcccgtttcgcgaggcaatggcgtactgtcacattaatctcagcctgtattctctggtacttgcccttgagagagaactgtgctgtcgtgtgttttacagtatatccccaactgccacgcaccaacaaggattttctgccgcattctgcggggccctttcaaaggccatctctcgcgcttccgtcgaggtcactgaggcattacaatttgtatcttcannnnnnnnnnagagagaaaactatgctgtcgtgtgtttcacagtatatccccaactgccacgcatcaacaagggttttctgccgcgttccgcggggccctctcaaaggccatctctcgcgcttccgtcgatgtcactgaggcattacaatttgtatcttcacttgttgtagctgatgtggagtcgtatggcctcgagggttcaaacggaatcgacatcgaggaagccgtcggtgcggaaaccctagggaaagaagctgggtagggaagctgagtatcaaacatcagtttcgcaacgcgtcatgttgatctgtacatataccaccgaatcgtgtttgtttaaatcataattctgtattcatttatcnnnnnnnnnnttcaaacatcagtttcgcaacgcgtcatgtcgatctgtatatataccaccgaatcgtgttcgtttaaatcataattctgtattcatttatcatttccaagcgaccgtctcgtcgccttcggttctgccacgacattttgcatgatgacgaggatgcaatggttggccgttgcactcgccacgtccatgatcgtgctagccagtgagttcagcgggacttgagtttgaaataattatcttcgtgatgtatctcttgccggaggcacgttggtttgagctccattcccacctcgccctccctnnnnnnnnnnactagccagtgagttcagcgcgattttatttttaacaatgatcgctgtgatgtatttcttgctgtaggcacgttgatttgagctccattcccacctcgccctccctcgtcgtacaggtgtgcaagctcggccccaccctgacttcagcgaccgctcgcacaaggggcgcggaagagcgcatccccccaagcccgaggatggggcgttccctcccgagggcgagcaccgtccatgccggcccgggagcttctggggtcccgccccggaaggtggccctcatggacctcaccatgggccccatgacggacctcatgatggaccccaccatggacctcatgacggaccccacaaagggccccacgatggaccnnnnnnnnnnnnnnnnnnnnnnnnnnnnnnnnnnnnnnnnnnnnnnnnnnnnnnnnnnnnnnnnnnnnnnnnnnnnnnnnnnnnnnggaccccacggcgggcccgccctgggtccacgccctgagttctgggatgaggatggtccttgccacccctgggacgacatggagggggatttcggtgacgacctggctcctggtggaatgcaccgcttcgatgacggtcctgacggcgcagaggaggacaatggcggtccagaccaagatggtcttaagcgccgccgtccctgattacccgcatgtcatgcacgtctcatgtccttcgacagtctgctgatctcacctccatacatgtttcnnnnnnnnnntcctgataccccgcatgtcatgcacgtctcctgtccttcgactgtctgctgatctcacctccatacatgtttcgccgcgaccaggccccagcatagcagccctccatgtgcatatctgacccattggtcgcctgcactggcttcctaggctgtcacatgaatcctcatcgtgtaattcgccccctttccaataacaggttgccacatgatacggtgctcaatacttcaacagggaagggacgagattccatgacatgcaatcctgctgtccaggagctcctcaggcctaagggcatgccctccaagcagcattgggggcggccagcgcttcgagcagggcacggcccagggcttttgccgctgatcgtctgctacctgggctgcgcgatgtcgccaatgcggatgccgaaggcgagcacggccgccaccgctgccaccagccgcttcgtgatggacgggatgttcgagctcacccctgaccctgccacaggatgacgttgatgccagtgatgaaatcgaggtgaacgaagaggaggaggtggaggagaacgagagcaaggagggggaggaaagcagcccgcagaggctgctggccccaccccatgccaagagcagaaggagagacagccgccccggcccctagccagccannnnnnnnnntaaatcgaggtggacgaagaggaggaggtggaggagaacaagagcaaggagggggaggaaaagcagcccgcagaggctgctgcccccaccccatgccaagagcagaaggagacagccgccccggcccctagccagccaggcacagtactcgtcaggttaccctagcgagatatggcgactgattgctggaagcactcccagatcgttgcttttcattaaaaaccaagttgaagttgcaaacaatgcgcggcgtgccaccgctaatcgaccccctctgagacnnnnnnnnnnnnnnnnnnnnnnnnnnnnnnnnnnnnnnnnnnnnnnnnnngcgatggctactacaaacacctcaggacgcaggaaaccatccctaaggagcgcgtagatgactttctggagtgcgagggccgtatctcaaggacggccctcaattgcgctatttatgctcccaccaaagttcgaagttgaaactatctccagcaggtgccccgtgtgattaacatgnnnnnnnnnnttggagtgcgagggccgtatcttaaggacggccctcaattgcgccattcatgctcccaccaaagttcgaagttgaaatcacctccagcaggtgccccgtgtgattaacatgcagcccgtcccctttccgctgcactcagtcccagctcttcaacacacatacgggactgtttgtcagttcagtactacacgtgcgcccatggtccgggcaaacccgtaatggtggcaaaagacggcgccagccagcgtgaggggcggacgagcctgtcgcgccgccgctctgagaggaccggctgcccgcgtagattcacgatcaagcagctcaggcaagactccaagaagagcattgtttctacactgacattgggcatttgggtcacagtgacgccactttgccgcgtctgcgcnnnnnnnnnntaagaagagcattatcttctaccctgacattgggcattcggggcacagtgacgccactttgccgcgtctgcgcctgtcccggtgggccgttgacc

SEQ ID NO: 28995 - DNA, 71 bp, Chlorella protothecoides
tcttccacggctttggcacggtgaggggggtttaggttggggattgggggggatgagaggggatgcagggg

SEQ ID NO: 28996 - DNA, 61 bp, Chlorella protothecoides
tacgcaatgataacacgtcatcggaggattcgggagtcaaaagccgtccgactcactcgag

SEQ ID NO: 28997 - DNA, 78 bp, Chlorella protothecoides
ccacttctccccctgccactgattataccacgcatacgggccaattacgcagggaactccaacatgggagacctcaac

SEQ ID NO: 28998 - DNA, 65 bp, Chlorella protothecoides
gcagtgggaatttttccttcgggacgtcactttgcgcaggagttgtgcgggcgagtgcctttcgg

SEQ ID NO: 28999 - DNA, 75 bp, Chlorella protothecoides
tgcaatacagtctgagcaacaataggactgaggtttcccgtctggacgcccgtcgtcgccacctgcaccggctgc

SEQ ID NO: 29000 - DNA, 74 bp, Chlorella protothecoides
cgtcgtcgccacctgcaccggctgccgcacaactacgctctccccacacggtggctggcctgtgccaggctgca

SEQ ID NO: 29001 - DNA, 170 bp, Chlorella protothecoides
ggcgggtgcgtgggtgggcgctgtgtgaagactacccaaaaaccgtggggtagggatctgctgccgcggaccattgggcgagcatttactggtgcttactcagaatccaacgcaaatcttcaactaccatctcatcatcccacacatgcaggaggagaaccaccgactct

SEQ ID NO: 29002 - DNA, 68 bp, Chlorella protothecoides
tgattgaattctaggaccagtgctgccagaatggaagagttgaggggcggggacagactgcagggcgc

SEQ ID NO: 29003 - DNA, 98 bp, Chlorella protothecoides
cctgtgctgcctcacagtggccgtagatcaggacggtgcgagcctcaggactcgagatgtactgcccaaataccacagggcgaggtcccttagtgggc

SEQ ID NO: 29004 - DNA, 71 bp, Chlorella protothecoides
aggtaccaggttcgattcctggatggtccatcacaaggacccgggccattagctcatatggtagagcgctc

SEQ ID NO: 29005 - DNA, 74 bp, Chlorella protothecoides
cgtttgatgcggcaaccaaggccgtcgcaggttccgagcctgcgcttgcacttaaatagaccaaatattttcct

SEQ ID NO: 29006 - DNA, 99 bp, Chlorella protothecoides
acgttcgatgcacttgggagctgtcttttacagtgaatgaatggagatcattcacccgcaggaggctttgggactcggagacgctcgggaactcgttcg

SEQ ID NO: 29007 - DNA, 159 bp, Chlorella protothecoides
gtcaggtgggtggcttttcatgctcatgggaatcgcggccggaagagcacttttcaatggcttgtgttggttcatgggcttcacctcctctgatcagcccctggtgggtgggtaagtggctgcgggctgtggaaccgagatcatgcactggtttgctgc

SEQ ID NO: 29008 - DNA, 61 bp, Chlorella protothecoides
tgaaatgtcactgtttcatgctccgcactcaccagccgagaacgcttggccaggctcccac

SEQ ID NO: 29009 - DNA, 68 bp, Chlorella protothecoides
gagtctgcgttccctcaattccccccccccttccccctcacacataacacacacgacgcacgggttga

SEQ ID NO: 29010 - DNA, 80 bp, Chlorella protothecoides
cgcggcggcgcccggaatgcgctgtcagcccggtgtgattcgcacccctccttcgtgccccttcgatcgcgccccagtgt

SEQ ID NO: 29011 - DNA, 83 bp, Chlorella protothecoides
tcttgccctgccagggcagcttgagcaaaatcaggccaccatagaaattctaagactcgctgcccgcaccggggcacggggat

SEQ ID NO: 29012 - DNA, 80 bp, Chlorella protothecoides
ggtgtgaggggtgttgatgcgtggtacctgcggcgcccacctggcccttttctgtgtgcctccacattctgggccctcca

SEQ ID NO: 29013 - DNA, 167 bp, Chlorella protothecoides
caaacctgggcgcgagtgggggaggggggggcagagggtgatttgggcaggtgtggaggggaggggggtgcttgggcagcaggggggaagactgacgcatcccttgattccaggtgacaaggtcggccagccgtcatcccaccgacctgtacttgggggtgttgtac

SEQ ID NO: 29014 - DNA, 105 bp, Chlorella protothecoides
ctgaggagctccaggcgtgacttcttggcctccagatcggcctcggcagcctgatggggttgggttggcaaggccgtgctgcaagatggacagcctgccagtatc

SEQ ID NO: 29015 - DNA, 78 bp, Chlorella protothecoides
ggggacaaggtttgatcacaaggaggaggggttccgcaatgtgccagaagcccaaatggcgatagcagtggtgaagct

SEQ ID NO: 29016 - DNA, 73 bp, Chlorella protothecoides
ctacgccgcctggcaccgtacctaaaaccctagcccctcaccgtatcggtggtcttgttctgtaccatcctac

SEQ ID NO: 29017 - DNA, 61 bp, Chlorella protothecoides
accacgagcaagtgccttgccaatccgatccgactcatcctcataagcactgttcgagtgg

SEQ ID NO: 29018 - DNA, 61 bp, Chlorella protothecoides
gtaatacagccgaccgaccctgcgggtttcgcgcacctgggatacccctgactgactccca

SEQ ID NO: 29019 - DNA, 119 bp, Chlorella protothecoides
cttcttcttgtctgaaaggagggaggcgaaacatcgcgatacaccacatgtgccggtctgtatgcatggcagcttacatgcatatgacgagtcaccagtgcaacatcctgactcattac

SEQ ID NO: 29020 - DNA, 61 bp, Chlorella protothecoides
tggagggcatgaggcactcacggagcctgtcgcccgcgcctcgcgcgtcatgcatgccctc

SEQ ID NO: 29021 - DNA, 78 bp, Chlorella protothecoides
agggctcaaacagtcccagagtgaagagacagtcacggaaaggggggactcgacaggctacttactgcccagcgctcc

SEQ ID NO: 29022 - DNA, 78 bp, Chlorella protothecoides
tcgaagtgcagcatgagatgacaccactgggggggtctggtccctgctgagggggaagtgcagcaacagggtggcagg

SEQ ID NO: 29023 - DNA, 73 bp, Chlorella protothecoides
cttggcacagcaggtggacgggagcgtcagtgtgggaaggtagccatgtctttgaccctgccgggaagctaga

SEQ ID NO: 29024 - DNA, 61 bp, Chlorella protothecoides
agcccagaccaggccgcccccggccccgacaccagccagctcagcaaaggcagtcccaagc

SEQ ID NO: 29025 - DNA, 69 bp, Chlorella protothecoides
gtcggcttgggaggtgcatcacccacgacaaggcccccccccccaatggcgttgatctgagttgtgccg

SEQ ID NO: 29026 - DNA, 75 bp, Chlorella protothecoides
gaggcgctgtcttttgtatgcgcagcctcactcattctgaatcaacatgattcagattgctggaagtggggaatg

SEQ ID NO: 29027 - DNA, 61 bp, Chlorella protothecoides
tcctgggtgacgaggtctacccgggcagcagcatcggaggggggcccatctgtggcattcc

SEQ ID NO: 29028 - DNA, 76 bp, Chlorella protothecoides
tgagaagagcagtataccctgccatgcacacaatgtaaccacagggtcatctgcatccccagcatcctgccaggaa

SEQ ID NO: 29029 - DNA, 65 bp, Chlorella protothecoides
agtccttgggagatgggcttggggagtcctcaggagaggggctgggggagtcttccggggagggg

SEQ ID NO: 29030 - DNA, 62 bp, Chlorella protothecoides
agtgtgatccagcacattgacatgtgcttgaccacactatgtgcagactgaggcgttcacgg

SEQ ID NO: 29031 - DNA, 196 bp, Chlorella protothecoides
gtggtcgaggctcgacttgtgaagatgaagtgaagatcaaggtgtgcaggtgacttataaaggaagactcttgattgacatctgcatgggcttcatgcggcaacattctgagtttaatcattcgagttacgtcggtatgtgcgtggcctgagatccaatacactcgatgcccttctcctccgatgaagacgcaaga

SEQ ID NO: 29032 - DNA, 125 bp, Chlorella protothecoides
gcagttaagctgatcctgattgtctaggagaccgaatcgtcaagtagacaaactaaagccaccttaagactctgagagccctcgcagatgccttcgaagaaatctatgcttggctgtgtaatgtc

SEQ ID NO: 29033 - DNA, 123 bp, Chlorella protothecoides
acggcgcccctgggtggcaggggcgttgtgcatcatggtggcctcataccctgtccaaggtcgcttccccgcctggccctgcccgtagaaaggtttttgccacccccttcccttgtgatccag

SEQ ID NO: 29034 - DNA, 135 bp, Chlorella protothecoides
taacaaatcccgctccaggtgccccagccattctcaatatcaaccccttgtcccaatgcagtctgactggcatggacagggcatcagaccgtccaacacccctacagaccccaggcactcactagcatccaagcc

SEQ ID NO: 29035 - DNA, 164 bp, Chlorella protothecoides
ctttcagcgtgaaattgagtcctgctggtccagccggcggggagccctgtggaaggaggccgatcagcacgcccacaacgtgctgcaagagcctctgccatcccttgaggctgcccctcctccctgcacaagcgggagcagcgtgccctgaggtgtccccagac

SEQ ID NO: 29036 - DNA, 63 bp, Chlorella protothecoides
tgctgaactcgacgtgtctagtccatgaggtggaaccttgcaacgccatcggtgagcttgtgc

SEQ ID NO: 29037 - DNA, 65 bp, Chlorella protothecoides
acgggctgggagacgggctggggctggcctttggcgaggggctgggggagtcctcaggagaaggg

SEQ ID NO: 29038 - DNA, 148 bp, Chlorella protothecoides
tgatgggtcaatcgccggagggcaggcagctcctcgtggccttggatcccaagcctcctctccttcttccctccacacctctggtacaccctgcccccggaacacccacccacggcggcctcaccatgtttcgctccctcgccccgcg

SEQ ID NO: 29039 - DNA, 89 bp, Chlorella protothecoides
cactgggcaggcgcccggattttgagcaaaatatcgccgaggctggcacgccgagtcgggacctgttcgacctgctggcggaccgtgcg

SEQ ID NO: 29040 - DNA, 102 bp, Chlorella protothecoides
ggaatacttgctcccgacttctcatcacaagtttgccatgttgcccagataatgaggtacgcaagacaaaatctcggattacagcccaaacttgcgttgtcc

SEQ ID NO: 29041 - DNA, 114 bp, Chlorella protothecoides
cagggagggagggtggatggcatgtttgtcgatgagcagctcacacagtttgtcatgggatctcctcgacaagcagaccttgacatgcaccaccaggcttgcctcacacctgac

SEQ ID NO: 29042 - DNA, 93 bp, Chlorella protothecoides
ggagcagattttcttgtgtgaagtatcgaagggcggcgcactcgagtgtttgcgtggaaggttggaggtcgttgctgcattgcaacccccccc

SEQ ID NO: 29043 - DNA, 76 bp, Chlorella protothecoides
gtccactcctactaaaatctgaaatcaggctttgcattgcatgcacttggatgccgaacccccgtacccacaactg

SEQ ID NO: 29044 - DNA, 200 bp, Chlorella protothecoides
tgagtacatcaaggtgaggcgttggggggggatgttggtatgtgtattggtgttagtgttgggagaggaaagggggattgttgagcaggccttggtgtgctgggtaggcggcaaggcctatgggacactgccggagggttcctgggcttgggcttggtcatgagcccatacacgcaacattcactgggtcagccaggcag

SEQ ID NO: 29045 - DNA, 74 bp, Chlorella protothecoides
tggggtctgaccaccttggtggttgccgcgcctaagccaccagcgcgctcgacagggtggagggccggggcgcc

SEQ ID NO: 29046 - DNA, 61 bp, Chlorella protothecoides
ggcctggtgacccttcgccgccctccatcgacacgcggccgccccttgcatcctcctcagg

SEQ ID NO: 29047 - DNA, 74 bp, Chlorella protothecoides
gggacccccgtcaaaggactcgcggaagccaggccatccctcttaagtctacttggaagggcaggaacaggaga

SEQ ID NO: 29048 - DNA, 61 bp, Chlorella protothecoides
acggaagtactccaagtgaggatgcaggttatggggagggatcagaacacctgaccagagc

SEQ ID NO: 29049 - DNA, 107 bp, Chlorella protothecoides
cgtcgcgagcaggatagactgtccctgtccgtaattgtgaggggatgtcaacgaagccataggcagtgcacaactcccccatgtcccaaggctcctcagaagccatt

SEQ ID NO: 29050 - DNA, 61 bp, Chlorella protothecoides
cgctgagcttaagatgataaatggctgatccatgggggagtcgctttgccgtttggtggaa

SEQ ID NO: 29051 - DNA, 66 bp, Chlorella protothecoides
tgggactgcggctcctcgcccccaccaccactccggctctctccttgttgaacccctccatcgccc

SEQ ID NO: 29052 - DNA, 101 bp, Chlorella protothecoides
gctgagcccggcgctgtgcggactgcgcattcgcacgcgtcgaggggggggggggcagcgaggtgaccctcgtggctgtgtggaatgccccctccgctggc

SEQ ID NO: 29053 - DNA, 80 bp, Chlorella protothecoides
aaagaggtggtatcacatattccgatacggtgacaacgcggcaatgccctgactccggcccaaccctcaggcctcacgtc

SEQ ID NO: 29054 - DNA, 237 bp, Chlorella protothecoides
ccgaggagatggtgagggcgggcccgtcgaatgcatacagacatggtgcaggaacatgcgcacccctggctgcactgaatgatgcgcatttcgttcgccggcaatcctgaagagcatgactcggccaggtgtaccgagtgcttgtacggcctctaacccaaacgcacacccagctgccccactgtcgacctcacagaggcaccccagcggcccgcgccgtgccacggcgatggcccc

SEQ ID NO: 29055 - DNA, 87 bp, Chlorella protothecoides
aggagggtgtggaatcctggattcacacacacagcatgccacggcgtacatgcagttcaaggtggccggccgctgccaggatggggc

SEQ ID NO: 29056 - DNA, 703 bp, Chlorella protothecoides
tccacccagcccctcccctccacccagcccacctcccccaccccccccgcgggcaactgctacagtcgagcttgttccctctgctggaaagatccgaatgacctgtgtggtgaccactggggggtatgcccccaagttcgtcagctgcagcttgtactcagctgtcttcaagatgatcacctcagcgggtcataacctgggggatgtcgtcaccaccatcaagggagacccacagtctgaaacgctaatgtcagcttatgctcttggaaccgcgtacacattcttaactctggaggacattaaggagatcatgcggctgacgctcatcaaccctataccacctccccccgtatccttctccccaccaccaccggaacttgggtccatcactgggagtgtcactctagcatcagacgttttctcattctcaatcacatttggggacctgaccccggacagcattaggtacgccttcttcaccgctgacggggccctggccagttatggatcccaaaaatacaacggcaaaacgaccacttttaccaccaccctcaaggcggccatattatctttggtgtcgtacgcccaagttgtgcccctcaaaagtacaggcggtagcaccaatgtcctgaccctgaactgctgatcatgcagactgatgttattgcgcgccctccggggtcgatcgacgttagcagcattt

SEQ ID NO: 29057 - DNA, 39733 bp, Chlorella protothecoides
  modified_base (236)..(245): a, c, t, g, unknown or other
  modified_base (561)..(570): a, c, t, g, unknown or other
  modified_base (753)..(792): a, c, t, g, unknown or other
  modified_base (1027)..(1036): a, c, t, g, unknown or other
  modified_base (1755)..(1764): a, c, t, g, unknown or other
  modified_base (2086)..(2108): a, c, t, g, unknown or other
  modified_base (2282)..(2291): a, c, t, g, unknown or other
  modified_base (3688)..(3697): a, c, t, g, unknown or other
  modified_base (4826)..(4835): a, c, t, g, unknown or other
  modified_base (5700)..(5709): a, c, t, g, unknown or other
  modified_base (5873)..(5882): a, c, t, g, unknown or other
  modified_base (6341)..(6350): a, c, t, g, unknown or other
  modified_base (6884)..(6893): a, c, t, g, unknown or other
  modified_base (7484)..(7493): a, c, t, g, unknown or other
  modified_base (7900)..(7909): a, c, t, g, unknown or other
  modified_base (9323)..(9332): a, c, t, g, unknown or other
  modified_base (10019)..(10028): a, c, t, g, unknown or other
  modified_base (10259)..(10268): a, c, t, g, unknown or other
  modified_base (10500)..(10509): a, c, t, g, unknown or other
  modified_base (10794)..(10803): a, c, t, g, unknown or other
  modified_base (11692)..(11701): a, c, t, g, unknown or other
  modified_base (12218)..(12227): a, c, t, g, unknown or other
  modified_base (12563)..(12572): a, c, t, g, unknown or other
  modified_base (12882)..(12891): a, c, t, g, unknown or other
  modified_base (13767)..(13776): a, c, t, g, unknown or other
  modified_base (14322)..(14331): a, c, t, g, unknown or other
  modified_base (15409)..(15418): a, c, t, g, unknown or other
  modified_base (15504)..(15513): a, c, t, g, unknown or other
  modified_base (15673)..(15682): a, c, t, g, unknown or other
  modified_base (16270)..(16279): a, c, t, g, unknown or other
  modified_base (16384)..(16396): a, c, t, g, unknown or other
  modified_base (16499)..(16508): a, c, t, g, unknown or other
  modified_base (17185)..(17250): a, c, t, g, unknown or other
  modified_base (17395)..(17582): a, c, t, g, unknown or other
  modified_base (17648)..(17657): a, c, t, g, unknown or other
  modified_base (17862)..(17909): a, c, t, g, unknown or other
  modified_base (18057)..(18066): a, c, t, g, unknown or other
  modified_base (18131)..(18140): a, c, t, g, unknown or other
  modified_base (19119)..(19128): a, c, t, g, unknown or other
  modified_base (19582)..(19591): a, c, t, g, unknown or other
  modified_base (20994)..(21003): a, c, t, g, unknown or other
  modified_base (21331)..(21378): a, c, t, g, unknown or other
  modified_base (21556)..(21565): a, c, t, g, unknown or other
  modified_base (21625)..(21634): a, c, t, g, unknown or other
  modified_base (21694)..(21703): a, c, t, g, unknown or other
  modified_base (21820)..(21829): a, c, t, g, unknown or other
  modified_base (21919)..(21928): a, c, t, g, unknown or other
  modified_base (23306)..(23315): a, c, t, g, unknown or other
  modified_base (23461)..(23470): a, c, t, g, unknown or other
  modified_base (23655)..(23664): a, c, t, g, unknown or other
  modified_base (24421)..(24430): a, c, t, g, unknown or other
  modified_base (27244)..(27253): a, c, t, g, unknown or other
  modified_base (27678)..(27687): a, c, t, g, unknown or other
  modified_base (28885)..(28894): a, c, t, g, unknown or other
  modified_base (29078)..(29087): a, c, t, g, unknown or other
  modified_base (29671)..(29680): a, c, t, g, unknown or other
  modified_base (30931)..(30940): a, c, t, g, unknown or other
  modified_base (31150)..(31159): a, c, t, g, unknown or other
  modified_base (31446)..(31504): a, c, t, g, unknown or other
  modified_base (32071)..(32080): a, c, t, g, unknown or other
  modified_base (33559)..(33568): a, c, t, g, unknown or other
  modified_base (34386)..(34455): a, c, t, g, unknown or other
  modified_base (34606)..(34615): a, c, t, g, unknown or other
  modified_base (34702)..(34711): a, c, t, g, unknown or other
  modified_base (35218)..(35227): a, c, t, g, unknown or other
  modified_base (35894)..(35903): a, c, t, g, unknown or other
  modified_base (37153)..(37162): a, c, t, g, unknown or other
  modified_base (37466)..(37475): a, c, t, g, unknown or other
  modified_base (38486)..(38495): a, c, t, g, unknown or other
  modified_base (38846)..(38855): a, c, t, g, unknown or other
  modified_base (39258)..(39267): a, c, t, g, unknown or other
ggcctgcggccggggctggcgccggaggtgctgcagcacgtaggccagcacaccgcggggctgacgcagcgggagctgcgcgccgtggctgccggcgcggccgtcgacgccctggccgaccgcctgcccgtgcaggccgtcctggatgggcgcacgacgacctcggcgaagggagttggtgtggcgagcacaactgcagaacagccccagcttgccggggccgaggcccgcggcgnnnnnnnnnncaagggagttaatgtggcaagcacaactgcagaagagtcccagcttgccggggccgaggcccgcggcgacaatcagtccctggacatcacgcgagaggcgctgcagcgcgccgtcgagcgggtccggaccatggctgcctcggatgtaggggcgcctaagatcccctcggtgaagtgggaggatgtggggggcctggaggacgtgaagagagccatcctggacacaggtggggcagctggggaatggttcaagggaggaagatggtgaaacaagaaaagtgcatggcatcacaatgcccttcaatgctgtgtttgnnnnnnnnnnatatggtgcaagggaggaagatggtgagacaagaaaagtgcattgcatcacaatgcccttcaatgctgtgtttgagcattgcatgccgctctcatttggtgactcctggccttctgctcaaagacaagtcactgatgtctgcctcccatcgaaatgccagtggagctgccgctcaagcacccnnnnnnnnnnnnnnnnnnnnnnnnnnnnnnnnnnnnnnnnttccgggggtttgcggagacggtctggcgttctcttgtatgggcctccaggtagatatcagtttgccttgcaggcagtgtatgccgtatgtgatgcgttagatggtgtcatgaaggcacttcccgagctcgtgatcgagtgcacagcattcgaaaagccaggtgcactcacccgccaccagcaccgcatgccactccttcaggcacgggcaagactctgctggccaaggctgtgnnnnnnnnnncatgccctttgtgatgcgtgagatgggatcatgaaggcatttcccaagctcgtgatcgggtgcacagcattggaaaagccagttgcactcacccgccaccggcaccgcataccactccttcaggtacgggcaagactctgctggccaaggctgtggcaacagagtgctccatcaattttctctctgtcaagggcccagagctggtcaacatgtatgtcggagagagcgagcgtcaagtccgacaggtgaagcactctagctgataatgttttgtccaggggttcttgcactgccctctctgaatcgactggaacgggcccttgaccatcctcctgcttcctttggcaggtgtttgagcgtgccaagcgagcgagaccgtgtgttgtcttctttgatgagctggacagtctcgcacctgccagaggaaagggcagcgactctgggggtgtgatggatcgtgtggtggcgcagcttctcgcagagattgatagtgctcaggtgccgtagcgtcgaaggctcctgtgtctgggccttcctttgggcatgaggaggaagggctgctgcaagcattgggtgctggttagagttgccatacactctggctttgctgacggacgaccacgtcagtggggttgacgagccacattctccggcccagtgccctggtcttgaagtctccactctatcgctctcgcagggaggttcaggagagggtgacnnnnnnnnnntgcatagggtgctggttagagttgccctacactctggctttgctgatggacgatcatgtcggcggggttgacgagccacattctccggcccagtgccctgatcttgaagtctccactctatccctctcgcagggaggttcaggagagggtgatatcttcctgataggagcaacaaatcgccccgacctcttggatgctgcgctgctgcgaccagggagactggacaaactcctctatgttggcattgctcgtacgttgggatgtaggggggttggggttgaggatgcctatgatagattttggtgttctgaagtggcttgcnnnnnnnnnnnnnnnnnnnnnnntgttgggatgttggggggatggggttgaggctgcctacgatagattttggtgttctgaagtggcttgcccgagaggcaagcttgcttccccttgcattctccatcaacccagcattctgcgtgggtttcccttacattttccgtttgcccccacactgcccaacagctgagccnnnnnnnnnnttgcattctccatcaacccagaattctgcttgggtttcccttacattttccttttgcccccacactgcccaacagctgagccgtcttccaagcaaaaggtgctggaggccctctccagaaaattcacgatggatgcagacgtggaccttgcagctgtcgctgaggcctgccccccgcagttcacgggcgctgacatgtatgcgctgtgctcggatgcgtggatgacagcgttcaagcagcacatctctaagcttggaggcttgccggctggtgggaatggcaatgcgtcggccatcatggtccgacaggcagacttcctgcaggcagccactacgcttcagcccagtttgggcgaggatgagattgccaagtatgaagtactcagagaccagtacgaaggcggagctgctcggcactgaccgctcaaagtgtgtgccttgctgcatggaccatgctaggatgtcaagttgcacctgcaatttactcaggtgcacactagccacataatcaaccagttacttgccccacagagctcaggtcagaaacaagtcttgagaaagttgcaatacaaacagtcgcagaggattccagcacatctgccgctctccatcagtttcaaatacacaagcaaggaggtcactgtacactcatctagggcctctgtgattccgcacggctcatcttttgattggactcttatgcacactcatcgattcactccactgcatatgtgatggagacggtggcttggacctgcagcgttcctagctccactggagtctctgtatctttggcgttccttgccattgtgcctgtggtgcatgagaaagatgatgctctgcatgaaccaaaggcctgcagatgactctttgcagtcaacttcagcagctacaagcaatacagcccacttcacccgcctcatcccctctcagcctagtgttcccctctcaccagctgctgcatacgcaattggcatggctggcgtcgagttgctgtcctcaatccgctgtgggcggcccaaggtgacttcggcggctgaggcgagtagccgggcggtgtcgcgtgcatcgctcactgcggcacggcgggctgcatccagggctgccttccttgcggtggggctgagcgagagcgtcacgctggtgatttgcagggcgttgccgccggcacgcaccgcgctgtcgattacgctggagaggaggtcgctgctcaagtcgcgcacggtgacctgcagaaattacaaggggaagagcatggaattcggacagatgcatactttcagggctccgtgcggccctgtggctgagggtccactgcgtgctcctatgctacagtgaggtcaatcatcgcaaatataacactcttgtaccagtgcctctacctggaggttctgagannnnnnnnnnagctccgtgcgcccctgtggctgagggcccgctgcgtgctcctcatgctgcagtgaggtcaatcattgcaaatataatactcttataccagtgcctctacctggaggttctgagagaatgtgtacccggtgatggtgctctctcctgtctgggagttgtacacctggggacaatggaaaagtggaggtgcagcatgaacgacatggcagagacatgagacaccttgaagaggacagggaggattgttccttgtatatcagaagacattcggaagctcaccatctgggggttgacattaatgtcggtggtcttaatgtcggaggttcgatttatgcccgagattccactaatggaggtcagcgtcgctttggtgagttccgccgcccgctctcgcgcatctgaggccgtatccttggtgctggatactgaaagagacactgtggccatgttgggctcggcggatacctggccctggcccacgacgaacagcgtgccattgctttccgcccggctcatagacagccccatgagagtgagggatgcgaacagaacgatgccggcgccgcgtgtcacagacattgttggatttgattcacaaataaggcggcatgtgctgctcttggacagaaggggttgccggcattttgaaacgcgtttgttcgcagtgtcgtacgctccggtactttcaataggtgggagaagaaggggcgatatcccgacatggatcaagctgtacaccccctgaccggtgcatcacgtctcatgacaggacattacaccacaatgctgaagttcaaagtgccattcaggtctcgggaatacaaaagtagacaggtgccatgggaaggcggccccttgcgagtatggtcatgcatggtcgtcgcttcatcgtcaggcatgggagcaggatcttcatacaagcaaacacccagcgctgggtgcaatcgtgtgcaacgcagccggatcgaacatgggaggtgtgcacctccaggatccgctcctccgagcgagccagtcccagtggggcgcaggggcgccgcccgccgccgcagcggctgtggcctcccggtggggatgggcgcccggcctcacagcgcgtccagcagcctcagtctcagcgcgcggagcnnnnnnnnnntgatcgtgtgcaatgcagccggctcgaatatgggagattcgcccctccaggatccgctcctccgagcgagccagtctcagtggggcacaaggacgccgcccgctgccgggcggctgcggcctcccggaggggatgggcacccggcctcacagcgcatccagcagcctcagtctcagcgcgcggagctccgcggccttgccagatgcggccgcctccgcctgcaggctccgctggctgaaggcctgcccgttggcccgggtccactgcatgcactgctgcacctgccccgccatcttctccacctggcccagattagcccggatgcgctgctggatcagcatctcgctcatcagattgcccaccagcacgtccaggaagatgccggcggtgcacgacttgaccagggctggctccacgtagggcagcgtgggcaagctttcgtgcacacgcaggatctcggtgccggcctgggccaccatgtcgttggcgcggcgcacgttgcccatctgcacggcctcgcccagcaggccctcgcgccgcatggggccgccgaactcgcggcgacggaatccgatgtcctgtgcgcagtgagagggggtcccactggggaggggccgcggcacatcgcaacccaaagagcatggcgcctggtcgacccacgagcgccatgaggcctggggcttgcgggcttgctccaacttgggcgaggcccattgcacatctcaggcacctcccggccatatggacaggccagccgcttgccccacgcagtgggcccctcgcacctggaccatctccacgcgaccgaccatctgagcggtcttcagcatcttcagggcaccctgcaggttgcccagtgcccgcnnnnnnnnnnaggggtcacactgggaaggggccacggcacgtcgacaccccaagagcatgggcccctggtcgacccacgcgcgcagcgaggcctggggcttgcgggcatgctctccttgggcgaggcccattgcacatctcagccccccccccccccccccccccccaaccacnnnnnnnnnngccgacaaactgagcggtcttcagcatctggagggcaccctgcaggttgcccagtgcccgctgcaatccgttctccgcggccgcgtactgcgccgcccagccattgttctgtgcggcgtccgcgcgcgcggccgcctcggcctccgccagcgcacgctccgcttcgctgcgcgcggcggcagcgttggcgaagagggagtccatctgcgtttgcagcttggcacgcaggctgtgcagcagggcaacctgggggtgcacagggatggcaggtgggctgggaatgggaaattctgtggtcctcaatcaaggcaagaggaatactcatgcttgacgtccagtactgtgatggctgagcatcaggaacttcaggcaggttcagggagagccatgtgccgatccgttgaaggttcgattccggtctgtgtcgtcctcccattgtacgcacctgccccgaggccnnnnnnnnnncggctgagcatcatgtgtttcaggaaggttcagggagagacatgtgccagtgcgttgaaggttcgattccggtctgcgtcgccctcccattgtacgcacctgccccgaggcctccgcctcggcagcctgggcaacactgagccgctgctgggcagccttctgctccgtagtagcagcctccagggctgccttgacggtttcgaccttggattgaagctccttcttcttctcctccttctttgccttggaagcaaacagggctccgggagcccaatcgcccgcatgctctaaatcgtgagtggcttgggcgagctgggtctgcaggtttgcaacctcctgggacgccctggtgagggctgcgctggcattctcagacgcttgtgaggcttggctctgccggccttccacctttagggtgagtgcacaaggggagcaaggtccctgaaaggtctcaatcaggcatgccaggaagggcatcacagtggtacggaaatgggtgtaaagtaggatcacgccatggcatcctcaaagagnnnnnnnnnncggctgcgcgggcattctcagatgcttgcgaggcttggctctgccggccttccacctttagggtgagtgcatgaggggagcaaggtcatcgaaaggtccatatcaggcatgccaggaagggcatcacggtgatacaggaatgggtgtacggtaggatcacgccatggcatcctcaaagagccgcagccacgatcagcatgggcattttccaatgcacagaagatcgaagagcaccaaaccctccgattctcacctgcgcgttttctaggcgctcaatctgggagcgagtgtcccttgcctgctgggccagcgcgcctccgctagccgactgcgcagaggctccagggatgggaagtgtgccatctgcggcctgaaccatgaccgggggtgcggcagctgcagccatgtcggggtttcggtacagcgtacggaaaggctagtttcggcagaagggtacgtgataggccagggttgggtccacggcacctccaacagcaggcctaagtgtgaagtgtgatgtcttttacgaaattttatgtctggtttcgccagcaggtatgatgtatagggcttgtgtgcaccgcgttggcnnnnnnnnnngggtatagtgtacggaaaggctagtttcggcagaggggcacgtgacaggccagggttgggtccacaacaccttcaatagcaggcctgagtgtgaagtataatgtcttttaagagattttatgtctggtttcgccagcaggtgtcatgtatagggcttgtgtgcaccgcgttggcaccccgcaggttccgggggatccggaaattgcgcttcgatcttgttccctggatcgaattccaccttcatcagaagctggcatcatctcgcagctcacacccgcaggacagttcaggtgtagttcttaaaaagctcaccataaggacgcagtgcttcaatgttgatgagtaagcaggcaggcggagaatgtagttctcacacagctccctgggcaccaagggagtgaccgagnnnnnnnnnncgctcactcccacaggacagttcaggtgcagttcttaaaaaggtcactataaagacgcagtgcttcaatgttgatgagtaagcaggcaggtggagaatatagttcacacctagctccctgggcaccaagggagtgaccgaggagcatgcgtcaatgttcccagcaccccgcacctcagttcgcagggaggaggctgagcctcagcgcctccagctccgcggtcttggcggccagggtgctcagagcagccgcctccctccccctgaaggcgtcggcattcgccttggtccagcccgcgcactggctcacctgcccctccatcctctccacctcccgcaggctgcccacgatgcgggactgggacagcacctgcgtggccaggctgctcaccagcatgtttgcgaagatgcccgccgaggcgttgcgcagcagtgccggctccacgtagggcagcgtgggcagcgcggcatgcacgcgcaggatctcgttggccgcctgcgagaccatgccgttggcccggcgcacctgcaccatctggatcacgtcgccggtgatggggccgcctcgggaggtccccgtgcgacgacgccggcggacgtcctgcacggcacgggaggggtgagtggggggcttgaggcatcacagggccgcagtcccaggacgattgtgccgggccgcacgaggggcatacagtagactcaggtctccaggaagaaagggcccatgccaggcgtggcagccagatcagccggccgcagaggtccctccagagaagtgcaacacagggacacacggctatcgtgctgactcatgagcggaaaagcagcagcgcgtgcttcctcatgcaccgcacctggaccaagcccacggtgccgacccggcgtgccccactgaggctttggagggccgcctgcagcaggctcagggccctcctgagcccggcatcggcggtggcatactgcgccgcccagccagcgttctgggcggcatcggcgcgggcggcggcgatggctgcagacagggaggccatgcccggatgggctgcaaatgagggcgactgggagatggcctccagcaggctggctcgtctggcacgcaggctctgcagcaaggcagcctgcgggcgggggggcaaggggttgatgatcttcgacctatcacgagtcttccttcatctttctgcgggcacaggccagaccttggaagaaaactgtgccagcaagctcaggcgaaatgcccaggttcttagcaaaattctctgccgcattccctcaggatgcgagtcggtcccaccgcactcttttcctcatttagacccaggcatggtgatcctggaagaccactataccaatacaagcatagagcattctcacctgtccgttaagctgcgcttcctcgctctgagcatgagccnnnnnnnnnnagggcaaggggttgatgacctccgacctatcacgagtcttccttcatctctctgcgggcacaggccagacctcgggagacgactttgccagcaggctcaggcgaaatgcccgggttctcagcagaattctctgccgcattccctcatgatgcgagtagatcccgccgcactcttcccctcattcaagcccaggcacggtgatcctgggagaccaatataccaatacaagcatagagcgttctcacctgtccattcagctgcgcttcctcgctctgagcatgagccaggcgggactgcatgtccgccaccacaccctcagcctgcctcacggtagcgttggcggcgtccagcgccgcctgcccggcctgtgctcggccctccttcttcgcactggaggcaaaccagttgcttggacgtagccctgagtccaggctctgcaggtccttctgcgccttagcctgagcgacgcgggccttgctgagagaggcctgggcactggtcagctgctgctgcatgctcatgctctgctgggcagcggctgacctccggccctcaagctatgccatggggtggggggtgtgggtctctgaggggccggccactggtagggttttagacatgcaatgcgtggtgatgtgggggccgaaaacggctcaatcggaccagcaggccaggtgtacgacggcnnnnnnnnnnatggtagggttttacacatgcaatgcgtggtgatgtgggggccgagaacggctcgatcggaccagcaggccaggtgtacgacggcatcctgaagtgtgtgacaggcaacttgaactcacattagaagcctccagggaagcaatctgggcttgggtcgaccgacattcctcgatctgggcttgcgacatatatgctccttgcacgacagcacgtgaatgctccctctgcagnnnnnnnnnnccctgaagtgtgtaacaggcaacctgtactcacattagaggcctccagggaagcaatctgggcgtgggttgaccgacattcctccatctgggcttgcgacatatatgctcctcacacgacagcacgtgaatgctccctctgcaggaacttatcaacagagtttgggttctttcgtgatattactcgatggtgttggaggaaaatctagccttttgcttttcttgtttctatnnnnnnnnnngactaaccaacagagtttgggttctttcgtgatatcactcgatggtgttggagggagaatctagccttttgcttttcttgtttctatcgggatggtcttgggccgctctgtcgaggttggcggtaagaatccaaaagcaattcaccctttgtcaggttttaccatgacgtgcctcttgtgactccaggctcattgatggaataatgatagctttctaccattagcaatggatgaggagcttcccgttccgaaactgctacgcaaatgaggatctccgccgggccnnnnnnnnnnagcggtgagaatccaaacgcaattcactctttgtcaggttttaccatgacgtgccttttgtgactccaggctcattgatggtataatgatagctttccaccattagcaatgggtgaggagcttcccgttccgaaattgctacgcaaatgaggatctccgccgggcccctccactcaaatcgccctctgttgcacgtggcatcttacaaccgagaattctcaggcaggcatcagcggcaccgctccttccagctcctcggggactccttccccagctccgtccacagtcgcctgctggcgggaccagagctccgcgtaccgcccacccgcagccagcagctgggcgtgcgagccctgctctaccacccgcccctgagccaaagtcgattgcatggcatattgtttgtggagaaacaacatgccagtcaacccatcgagcctcttggagcaacaccctctgtcgccacacccctcccccttccagcaaccaacaaggtaacgcgtctcacctgctccaggaccacgatcttgtcgcactgggcggccgtggagagccggtgggccacaaggagggtggtcctgccccgcgccagcgcaaagaggctgcccaggatctccttctccgtggtggagtccagggcggacgtggcctcgtcgcacaacaggacgggggggtccttgaggaaagcgcgggcgagggcgacgcgctgcttctctccgccgctcagcttcaggccccgctccccgacctcggtgtcgtagccgtccgggaaggagaggatgcggtcgtgtatggcggcctgagggggagcacagggtgtggatgcagcaagcttgtatcatgagtcgtgaagtggactcgagggagaggggtgccgccccggcgccgnnnnnnnnnnatgtggatgcagcaagtttgtatcatgtgtcgtgaagtgaattcgagggagaggggtgccgccccggcgccgcagctacagcgcgcattcccgtgcctcgtggggtcatatctccagagacacccatggcagatcagtgtgcttccccgctccaaacgaccacagcgcctcaccttccgcgccgcctgctccacctggctctcgctggcacccagcttgccgtacgcgatgttgtaccgcacggtgtcgttgaagagcaccaggtcctggggaacggcgcccaggcgcctcctcaggctcgccaggcgcaggtccttgatgtcgtggccgcccacccgcaccgtcccgccctgcgcatcgtagaagcggtagagcaggcggagcagcgtggacttgcctgaacccgaagtgcccaccagtgcgacgctggtccctgccggtaccgtcaacgagatgtcctgaggacaggggggatgctggggggtgggttctgtgcttgacaactggcagccggcannnnnnnnnnaggcgggggatgctggggagtaggttctgtgcttgacaactggcagccggcagccagcgagttttgggacaccacactaccaggaagctgcaacttgctggaggaatgtcatggcaatgccaacagcacagtacagcatcgctcgatcccttgcctgcaggatgggctgatccgggcggtagccaaaggagacattctcaaaggtgagatcgtagccactgggttcctctggcaggtcgatcgcgcctgcaggcggtagggcactggagatagtcagagggcagctcatccgccctgatgactcgacacgccaccttctgtgccttttagcatgcnnnnnnnnnnggatagtcagagggcagctcatccgcctggtgactcaacacgccaccttctgtgccttttagcatgccttcacatgctgaatgccacacatacacccacccccagcctcacctgccctgtccttgatggctgtctgctcctggagcagtgcaaacatggcccccatatcgatgaaggactgcttggtctcgcgatacacactgcccaggaagttgagaggcatggacagctgcgcagagggtggcgatggaaaagttgctgtggttgagaagcacttttcgagcattggaggaggccgcccagccaaggnnnnnnnnnnaggaaaagttgctgtggttgcgaagcactgtgcgagcattggaggaggccgcccagccaaggctgtgggagtatgattgaagccaaaaacggcttggacgtgagcaactcttacagagcaccaggcagtgcccatgtcattgcttcccctcatgaaccttctaagtcccacatgcttcaaaacctcgcatccacaagtccacacctggaggaggagtccgttgaccatgaccatgtcacccacggtgagcgtccccgcagccacgccctgggctgataggagcatggccaccgctagggaggtggaaaagatggcgctctgaccaaagttgagaaaggacagtgactgctgcgtctccacggctgcgagttggtaggacgccatgcactcgtcgtatctgcgcaggtgagcagcaagggcctgggtgagatggatggtggtctggagcctgggaatcaaagcatgctggagaggtacttggcaactcaacagatgatgcacggcggtcaagtctctgggcaaggaacctttcctcaagcaccctgttggatttgcgcaggtggtgccggcaaggaagcctcacatgcacaagccactccaagccgtatcacctccgcttctcatgctcctcggcatcaaagtacttgacggtctcgtagttgatcaatgagtccacagctcggctgctggcctgggactctgccctgttcatctgccgcctgaactgggtgcgccactgcagggagcagcaatacgagagatggaggtgtgcatggggaggatacgttgaagcatgcagtatgctgaccagccctttttcattgcactggtctagcaattgagagttgtcccagcagcaagcagcttgcatcatcnnnnnnnnnngcgagagatggaggtgtgcgtggggagaatacggtgaagcgtgcagtatgctgaccagcccttcttgactgcactggtcttgcaattaagacttgtcccagcagcaagcagcttgcatcatccaatacatgatgactgcctaaatttgtgtcccagaaaccaagaatgcttcattccagtaccccacacgccacatccttgccccgtgcctgtgtgatcgcaaaggtgaaggcggtgtacaaggctatcgtcacccctgtgagcgcagcaaaggccgggccgcacttgtaggccaggacccctgccaccagggccacctccagtgccgttggcactagattgaagaccatggagctggagagatgggtatgtgcgagcagtgggtgagcaggatgctccatcatggaggggccatgacacatgtggcttcgtgcagctgagatcacagaagcttcctggtcaaacaacagtgcataaggctaatttgggaacaaaccacacaaatcccagagccgctgcccgcaaacacatgtcacacctgagcannnnnnnnnnggctgagatcacagaagcttccttgtcagacaacagtgcataagcctaacttgggaacaaactacacaaatcccagagccactgcccgcaaacacatgtcacacctgagcacgaaattgatgcctcgggagcctcggtcgatcacacgcgacacagcccccgtctgtctggaaagatggaacgccaggtccaggttgtgcaggtgagcaaaggtgcggaccgccacattgcggatggtcgactgcgcaacctgtgattgggacggcatggaacatgttcgcatcagatgctttgagactttcatagctcggatcagaaggcatataattgaaacatcaggttccggcaggtcttggcaagtttggtactcctaaaagggaccaagtcagtcttgcagctgctgccagagtgccactccctgcctttctagcgctgtaatgctcaccgaggcaaagacagcattccgggcttcgctgcaaaaggatgcgccgatgcgtgccagcccataccccagcaccagagaggtggggcccaacaccatgaggcctgccactgaggctggcgtgaggccggaaggatcagcgttcagtgcgtcgactgcataagaggtatcgagggcgcagtcaaatgaagtggcagggctgcatgaacacgcatgcatgtatgcgtgcttcaaccagtctagggagagcttgtccgcatgacgatcatgcaaggatgctccctctaccaattctgaaacgtggtgcagcgccttcaagccctggttcacctgtgtacttgaagaaaaaaggaacttgtatgttgaggagcttgcccccgacgagcaatgccacggctatgcctgcccttcgtctgaactctggactcgtctctgtattaaggtatctgcgagagtgagaatatactctgtgtggcaggggccctgggcacattgccccgaattcgctggctgccataatacactttcacaaagcacatctttgctcggcacatgatgagcctccacggcagtgcaccaactcactttgcaatctccttgactatgtgcatctcactcatgcgctcccccttctcnnnnnnnnnncctgcgagagtgagaatataatctgggtggcaggggccctgggcacattgccccaaattcgctggctgccataatacactttcacnnnnnnnnnnttctatggtgagatgaggttgtgtgccctggggcctagcttggggtttaccatcctcgggaagggttgccattgcccgcgcggctgctggtagtccattctggccagcatgggcctgaaagaatgggacgattaggcttaacacctcaagttccccatcnnnnnnnnnnctctatggtgagatgaggctgtgtgccctgaggcctagcttgggggttaccatcctcgggaagggttgccatcgcccgcgcggctgctggtagtccattctgtccagcatgggcctgaacgaatggggtgattaggcttaacacctcaagttccccatcttggcccttcccgtctgcctcacaaccttcatggcctccctgaacccttgccaggctgctgcaggctctcaccgcagagctcgccaccagataggttgcgcggtgtggagctctcagacatctgtaagcctgctgaggattgaaggttgtccatttcgctgcagatgagaagcttgggggacgtggtcaagccaatgtttccgtgcagatcccagcacggccaccccatgcacccgacctgcagtgccggcaagcgagtcgcgggatccgcttggatggacgaccaggcgcgcatgcaccctgatagctgcgagctagtaatcctgtatcctagatttgcggtccatctcatgccgaggcgatgaaggacctgcataaggacagcagtacagatggaggattcacagattaaaacatcgccgagatgtnnnnnnnnnnaataggttgcgcggtgtggggctcttaaacatctgcaagcctgctgaggattgaaggttgaccatttcgctgctgatgagaagcttgggggacgtggtcaagccnnnnnnnnnnnnnactgcaggagcgcgagcacagggaagccctcaatgggtaaaccgttacgtgatcatccctggcaattattagtccctgcccgtcatccttgtcggcttgggannnnnnnnnntcgcatgcaccctgatagctgcgagctagtattcctgtatcctagatttgcagtccatctcatgccgaggcgatgaatgacctgcataaagacagcagtccagatggacgattcacagattaaaacatcgccgagatgtaagggacgaagctgacccagtctttgtacaggtagaggtagccgtgattagtactttgagtgttgctcaggtcctcgctgcaggagcgcgagcacagggaagcccccagtgggtaaaccgttacgtgatcatccctgccaattattaatccctgcccgtcatccttgtcggcttgggaggtgcatcacccacgacaggacctcccccaatggcgttgatctgagttgtgccgacgctgtgcccgcataagggggatcagctcttacacgcagtatgaaaggcaggggtacggagggctatgaccacacggcatgcatatatggccggttcagatgcagggggaaaacagtttgaggcaccagtcgggacaggtatcgatcgggcaacacaggaaccaaaggttatgggataagaggtgccttcgtacgggctacaaagaggaaagttgtgcactaaatttcgtatggatcggctcaacgcgggtgcaagggacaggcagagtttgtttgtgatgctcaagcaggctgccacatcagtnnnnnnnnnnnnnnnnnnnnnnnnnnnnnnnnnnnnnnnnnnnnnnnnnnnnnnnnnnnnnnnnnnatgtggggggtcactgcatgcagcagagtggggcatgggttgcatcatcgtccgttctatatatgggagtaggcatctgcgtagggctagctgtgttctaggaatgggggacgatgcgttttggagggaaaagcgacggcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgaggacggctgtgggcgagattattaatctggggaagatggcggggacttgtgtgtgtgggnnnnnnnnnnttaggcatctgcatagggctagctgtgttctaagaatgggggacggtgcgttttggagggaaaagcgacggcaaggagcccctgagggcgctgcctcggccagaagagaacaagcttctgtgatggagaaaagactgagaggggattttggtgacgcatggtacatgggcgtgggatgggagcattccacacgcgcaggagggtnnnnnnnnnnnnnnnnnnnnnnnnnnnnnnnnnnnnnnnnnnnnnnnnctgggcgtcggaggccacaggggtgctccaaatgaacccagacgacttgggatggggcgcgcattgttgcacccccacctgccgattgcatgatgtttgaccggcgaagacccgcaaggctcagtccaagtttgccggcacagtgtgnnnnnnnnnngggtgaggatggctgtgggcgagattattattctgggaagatggcggggacttgtgtgtgtgggnnnnnnnnnnacagcacccccacctgccgattgcatgatatttgaccggcgaagacccgcacggctcagtccaagtttgccggcacagtgtgtgtgggtacaaacgtctccgtgggcagtccataccccatgtcgacgtactgctgcctgagcttgcggaaggccacctgaggcaggtcggcccgcacgctgcagcagcgggaagggaaatggtgggggttgttggaatatcctttgtgatgcaaaattaacatgatactgcatgcgaggtggtgtaaagtgtcaggcactcaggaccccagatgggcagaggagctcgctgcatgctccagcgcgtcaatgagtcgagaccgctgatcctgctcttggcattcaatgtcgtcaccctgtcgtcacccctttcaccacttcacatcctccctttcctccccacaccaaaaatcagcccacctgtactcggcggggaggaggtcgtagcgcagctgctccaccatggccttgtcctcggacaggatcttgcgcattgcgtcgcgcgccatgccgtcccagatgcgcgcgttgaacaagcccgtgcggtcggaggccagacggcggatgagggcgaagcggttgacggagcgcgtggcggtgaggggcacggtgttgacaaaggtggtgaaggacaggcccgcccccagcgtgaaggtcaccacggaggtggagggcaggaagacgcgcgccgtcacaaacacctccggaacctggggtgtagtggtgatgtgtgtggtggtggtggggggggtttccgtgtgccccttcgtgcaagagacagccagcaccaggtgggtgcggaaaaggcatccctgccccaccctgagtcgcaatgagccagcagcaatgcgaaagctgcgtacacacggcttctctgcgtgcatgggaatagcgcttgcagccatttgcctgcccgcgctacgtcttttggaccccagtttgccatgctgccaaacccnnnnnnnnnnggccatctgcctgcccgcgctacggcttctggaccccagtttgccatgctgccaaaccctccaagtcccctttccccggcggacctggaacatggaccaaaaggcattcacgggcttgttggtgatggtgaaagtggcggtgatgccataggcgtcgctgactacctgcatgtccttgatctccggcgcgtcggcgttcccaaacgagtcgccgtgcaggtagtggatgtgtgcctgcacacaggcggaaaacatgtgaggaggggatgaaggttgaaggagaggagcaggaagatcttgggctgacgggacactttgctcatcatccataagaggatgggcatctgggatggacaaggagtccccacaaattcacaccgcagactggaaacgagaatatgtgccacccctcccaccctggaaatcaggcatccagcccacccaccatgtcgannnnnnnnnnggcaggaaggtcttgggctgaggcgacaatttgctcatcatgcataagagaatgggcatctgggatggacaaggagtctccacaaattcacacagcagactggaaacgagaacatgtgccacccctcccaccctggagatcaggcatccagcccacccaccatgtcgatggcgttctcaaacacgccaaagtggttgcactcgaactccatttcctcatacaccgcgcgccagccgccgtcgtccagctcggggatgtaggggatgggtggccgctcgttcacgggcatgcggcggctgccgtagaagagccagacgaagccgcccttctcctccacgtcgtacacgttcatcagcgagcgcttgggccactcgcccttgttcatggcggcctggggatgagggtggcggaggcatgacgaggcttgtttggagagtggaaagggggcaccgacaaagccactgagcaggctgtgaggactccatgaacactgtgagaccatgtcgtctagtctggcacgcaatggactggctgtacaaacccctattgaagcagaagcagcagatcccctccccgctatcctgatccccctaccccagcgcctcctggccccctctccaccccctcccctcaaaccccgacgccccccttaaaaccccggcgccccccctcaacaccctccgccactcactggcacatccttgagcgccccagccccatccagggcccagccatggtaggggcacaccacgcacgtccccgactccttctctgacagccagcccgaggagagcggggcgccgcggtgggggcacacgttgtccagtgcctgcacatcccccgatgtggcgtcgcggaagagcaccatctcgcgcccgcacagctgcaccttcaccggctctttgctgccgacgttggcggagagggccaccgcgtaccacatgttcttcaagtagccgcttcggtcccgcagctcgcgcgcacgtttggccacgcccgccgccatttcctcggctgaggagggcgcgcggggcagggggacagaggtggccggctgcgaggcggtgagttgcagggggcggggtgaggagaggtacagcaagccacacattgcgatgataagcaatgttttcagagacagactcatggtgtgtacagcagatacacagaccaggaacatacacacgttgcgccccacgaatccggaacactgctcactttgcgcgggggtgctctgaccacactgttttctccctggggtcggacgaccgtcccgccccgaggcatgggctccaccagggtgctcgtggcaagcttggtggcaggctccaccatcgcttcagcatccactgtcgctgtggccttggtgccagtggcttcggaggccgacgcaaggaggggcnnnnnnnnnnccgcttcagcatcaactgtcactgtggccttggtgctggtggcttcggaggccgacgcaaggaggggcttggtgaagcgggactcgcgggagaagaaaggcagacggggaatgaggcgctttggcagggtggacaggtttgcgaggtccttggcctgaagacagggagaagggatgacacatgaatttgactgcgtgtgtgtgtgaggtgctatacagaaggggcatggtaaatagttagccgcttgccaaggatcggcgtaaaataagagctaaaaatatcacctggccagggttcagcacaactcacaccagacagagcagaacannnnnnnnnnnnnnnnnnnnnnnnnnnnnnnnnnnnnnnnnnnnnnnnaggacggcagctgcctccaggaaatacagcccaaaccagctggtgctgcaggatgacaagggaagcccggtcaacaacaccacttgcggccagcagcacgagtaacaaatacattcttggccaacctgactccatctgttcatgctggacaccttccttccacccccatcgactcacnnnnnnnnnnccctgaagcgtcatctcaccgctgcctgttcatcaccattgtagcgcttgagcaccgagnnnnnnnnnnacctgaaccctcatctcaccgctgcctgctcatcaccattgtagcgcttgagcaccgagnnnnnnnnnngaagcccggtcaacaacaccacttgcagccagcagcacgagtaacaaatacattctgggccaacctgactccatctgttcatgctagacaccttccttccacccccatcgactcacnnnnnnnnnntagcaacccggggaagtatcgagtgcgtgtggtatgcaataatcttggctagcgacatggtggtctcgccggctgccattgcccacccannnnnnnnnnaatgccagaatatggtctgccaccagggcaggggagtacgaaaaggcacctaggtcctgacttccaagcatctgcgggtgacaaatgaaaagacagctcaacttgtgagcaacccggggatgtatcgagtgcgtgtgctatgcaataatattggctagcgacatagtggtctcgccggctgccattgcccacccacctgcatgaggacatgggctccttccagcagcaggccgctgcctatcccgagcaggaacgagcgcacaaacggctcccggaaggggacatcggcgacctgtgaccaggggtaccatattcggaggggctgagcacaagcgtccacatcaaccctcgtcgctgcccgtccgcatcaccgctcgacagcagtacaggatggtcatcatcgagcaccacgcaccagctgcaaagcctttccatgcgcactctccagctccgattcggaactgcgcttgtgtagtgccgcctggactggcaatctgggggcccgtgccctcctgcacggcgtcgaagccgttttaaaacctgtaccgcatcgcagactggcaggcctcgggggagcgcgatgtggcaccacaccgctctgaaaacgcattgtgacctgcatgttgccttacaccggctgtcgggctcgggcttgtcctcacaaaagggttccgaggcacaaccacgactgcttctcgcaaagtgcaaaaagagtgccaccttcgtacagcacagtttctttgtgcaaggtctcgaaagttaatctgttgtttggtgttttgtcgtgtgctctgtttgttatcttcgagcttcgactgtcccttcgatttccaacattccaagccattcctttcctctccgaaaccctccgcgcgggttccgtgcggctaccccacagcctgtggcctggagctcccctattctacatcaggggcccccatcacgcacccctcagcacggaatcgtccagctgttccaagttgggcagggtatgctccagcctcaggcgatactgggtttcttttgcgcagggattaccccccaggtagaggcaggtgaggctgtcgcggacatgctccagctccgcccctgcctcgtcgagcgacgccagctgattatcgttggcccacaggtcggtgagctgggggaagccttggaggccggccagggatgtcagtctgttgttggccacgtccaggatgcggaggttggccaagccctcaaggccctgaggcgggcagggggtgacgtgtcagctgccgcagcgctcagcatgatcatgaaactgctcgcgggagcggcatgcacattgatactcatgccggccgtaagcgagacctcctcttcacagcatgtttgttgcctcacctccagggtnnnnnnnnnncttgatattcatgccggccgtaggtgagacctcctcttgacagcatgtttgttgcctcacctccagggtggtcagcccgttgtggcttaggtacagctcttcaagtgccgtgcacccactcaaccctgatatcctggccaggcggnnnnnnnnnngaggtatagctcttcgagtgccgtgcatccactcaaccctgatatcctggccaggcggttgctttgcagggacagacggatgaggcggctcaaactgcacagggagaggtgcaggtggcaggtgtgggcggcggcttgctgccgagaaaactcaggcaggggcacggctgaccggaggaggtgtnnnnnnnnnnggcaggtggcaggtgtgggtggcggcttgctgccgagaaagctcgggcaggggcacggctgaccggaggaggtgtacatcacagggtccagatatcccggcacactcacgtccagcccatggtgggctctagtatcgcggcgccatccggccgcaaacatggtctcaaaacatgacacggaggggggccgcattcatccagtcggcacaccacccgctggcccctggccccgcacctgctcagcccattgatctgagtgatccgattccggcccagccacaagctgtccagcaggcacatcccttccagcccctcaatgcagcgcaagcggttactcccaaggtccaggactctcagacctgtcgcaagtgggaggatcctggcatgctgagcctgtgatgtcgctggtgaacgagggaggcatgcacctgggtggcgtgcatgcctcgcatgggccctttcggggaagtatgaggacagccaccccctgtgccaagcacccacattcgaggtgtgcgatgccctccatggaagcgatcttgttggcagcgcagtacaggtgcgtcagcctgggcccaggcaggctggacaatgcctcgaggctcacaaactggttgtaagacatgtccaaggttgtcaaggagaaaaagccacggaagttcgggacctgcacagcaagtcaagaagagggagagcagggcacatcaggaagggttctcttgaggaaggctgcgatatgggggtggtgcggcatcannnnnnnnnntttgtcaaggagaaaaagccgcggaagttcgggacctgcacagcaagtgaggaagagggagagcagggcacatcagggaggattctcttgagggaggctgcgatatgggggtggtgcggcatcatggcacactccaattcaaaccggaggagcccaccccgaggagaccacgacctgtgtgaattggttgtcccggagatccaactcctccaagcctgcagaggtgtacgttgatctttgagcaacaagtctccacaagaccttgcattgtgttccacaggtcactgaaagcctgcactctccagcctacaaactcacagggcgcggaggccagcgcctccacttcctctgcggaggtcagcaggttctgccgcaggcacagcttcgtgagcccgtccagccgcagtagcgcagcctctatgcttttcagacggttggccgtcgcatccaagacctgcatggcgtgggcgagggggctggacaggcctacagaaaagttgctgggctgaggctgccaggttccaatttccaggcccatcacaccacccacccgcagggtgtttggcaaggacacctcatccaatgaatggaggtgggcattggtgagatctagatcgtatagaacggtccctgcatctggctgggattgcccctccacctcgtcctgcatcggcacacacgagtcctgcgtcactggcttttcggagcttggacgatacaatccagtgcaataatgatattgtggaattgaggtgctctcgcggcgcttgcttaatacactgactaccgtctgtatggagatttagcgaatccacgagcagggggggccgggggcacgggggcgccatgctcgaaccgcgcagaatcttgcagggaagatttggcatgggaacccccgcccctgcaaatcgctgataaggcacggcgagtctcatggagcttactacatcaattgtgaccctagtacagcgtaacacgcactaggtagacgattagagataggcctttcctgcccatggcgtcgagtacaaccaccacgtctgcccgcacgtcgccccacccatgcctaccgaagctccctcgtgggctacatggtgcccggcacaggtttacgcggcattcagcgcccttgttagaccattgcacgcgtaaacggaacctcacgcgggccatgagggccaccatgaccccgtctgtcgccgaggcctcggcgacccaagatccgatgcatgtgatcatagccggggctggcattggcgggctagtgctggccgtgggactgctcaaggcgggattcagggtcacggtcctcgagcgtgacctgaccgccattcgtggcgaggggaagtaccgcggacccatccagctgcagagcaatgcgctggcagcgctggaggccctggatgagcatgtgggccagaggatcctggacgagggctgcatcacgggggacaggatcaacggactctgtgacggcatcacaggggactggtgagggggctggagtgcccaggggccggggggcgaggaatggcatgccagactgcctcgcttgcggagacagcggcaagcagcacagtgcagtgagagggaatggaggtcgtcttcatcccaatcactctccccctttccttctcaggtatgtcaagtttgacaccttccaccctgctgtgggccgcggcctgccagtcactagagtcatcagtcggaccagattgcaggtgagatgctgggccgcccttgcgtgcccaggatagtacccagcatgcaggtgactgaggatgcaccggattgcagattgcttcttggtgcaattgcagagggagctgtccatccacagtctgccacgctcctttccacacgcacaggagatcttggccgagcgatgctgcgagctgggcggacctgatgccatctcaaacaatgccaacgtcgttgactttattgacgagcgggatgctgcgggtcacgtcactgccatcctttcggatggacggcgggtgaagggggacttgctggtcggggcagacggcatttggtcaaaggtgggttggccaggggggatgggggttattatgccctgtcctgtggtgtagcctatagcattcactgttgtcaccgacgctgcttcgtcagattgccgttcactgggattcaatgagcctgtcaatcagcttcccaaatattcgaatccccttgagcccagcatggtctgtgctgcatcctgatgtgctgctctgttccctcccccgtccaggtccgatccaagctgctaggcgattccaagccaaactactctaactacacgtgctacactggcatagctgatttcacccccggtgacattgatacaggtgggtgtcgggtttggcagtgctgcatggagggtgtgggtcggctctttgattctttgaggacaaggtcctttctgctgtgcagctggtatcatagcctgacggcctgaatggtcactgagttatcatcccagcagttgcacccctcgcatggcagctcctaacccacaaacctctgtaccccgcagtgggataccgggtgttcctgggcaacggcaagtactttgtgtccagcgatgtgggcggcggcaagatgcagtggtatgccttccacaaagagccagcggggggctcagacccgccaggtcagcgccaggaacgactcatgcgtatctttggctcctggtctgacaacggtgagacctgcaaggaggcggtgggttgggaatgagggggaagtatgtgtgtgccctctcggctttgcaccctgattgggttccatgtatgttcccctctcttnnnnnnnnnngagtacgtgtgtgccctctcggctttgcaccccggattgggttccatgtatgttcccctctcttccgcacagtgacggatctcatcatggccactcgagaggacgacatccttcggcgcgacatcttcgaccgggcccccaccatgacgtggtacaagggccgagtggttctgctgggtgattcggcacatgccatgcaggtacagctgtgcgtgtgatggcatggggtttggtgtccggacacatgcaaagcgatcgctgtgctctcagcggggctccaatcggtaagactcttcagctccctgcagtggtccccatatgcagtggcaagcatttccacagcggcatctggggccccccgactccccctccaaaaaactatctccccacctcctgcgcgcagcccaacctgggtcagggagggnnnnnnnnnnacccccccgactcccccccacaaactatctccccacctcttgcgcgcagcccaacctgggtcagggagggggcatggcgatcgaggatagcttccagatggtgcaggagctgcggtccagcggcagccgctccgtggcgcacatcctgaggcagtaccagctgcggcgcatgctgcgctcctccgtggtgcatggcatggcgggcatggcggccttcatggcctccacctacaaggcgtacctgggcgagggcctgggcccgctgagccgcatgacggcctggcgcattccgcacccgggccgtgtcatgggtcaggtggtgatgaaggcgtccatgccggcggtgctgggctgggtgctgggcgggaacgaggcctcgctggcctctgcggagcgtgtgccgcgctgcatgctccgcgacaggccctccggcttcgagccgggccagttcgacaccctgctgcgggacgacgccgccctactgcgcgccgccaaggcccactgggtcctggctcccatggccggcacgggagctggggcggggaaaggggtgagctgcgccggcaatggggcggggagcggcgcgggcagtggtgccgccggccagccctggacccggctgggcgccgatggccttgtcatggggtctggcagggatgcggggattagagaccccgctgcagcgctccgccatgcctgggtgcagagccatgagggcgactacctcgtgaccgaccttggcagcggccagggaaggtggtgtttgtgggggatgaagaaccctgtccctggtctgtagggacggtgaggggactggccatgccctcatatcaggtaccggcttcccctgatgagctgcttttgccaaggctgctctgctcacccgcctcgacacgcatgcatccccccacagggaaccttcctgaacgacaggcggctggtcccaaatgtccccgtccggctccagccgggggatctcatccggctgggtgcagcaaaggacagccccgccttccgagtgaagctgcagcatgtatccatggctgatgatgtggaccgcagcgcatatggccaggagacggacaggcccctggtgggcgtatgatgctccagaaacggatggtcctggagcccccgccatctttttccacaaggactcacaaccccgctagtcaaagagagatgatgacggcccccnnnnnnnnnngcagaaacggatggtcctggagccccccccacctttttccacaaggactcacaaccctgctagtcaaagagagatgatgacggcccccacttttcccaataagcgtattctttacgtgttgagctccaggacactgtggcgcactgcaaggtcatattctgtaatatacaagagtgtggttttnnnnnnnnnnaacgtgttaagctccaggacactgtggcgcaccccaaggtaatattctgtaatatacaagagtgtggttttcaaacatctcgaggttcacgtggcctttcggaggccgggcagcgtgtgccggtctgaagaacagtgtcctccctggacgaaatgctgggccaatgaatcctgtcactctcgtcagtagacattcatacaacacccgaaatacagactacgcgtgcagtcatttcctgcggcactcccagccagatcgggggcggggcagcttatgtcgaccttcctcctccgccctatgagaagcttgctgagcactcccaggctgggccctcgattggccccgcgatcagctcgtgcgggatctagcattgggctcgccacgaatggccatcgggtgggggacagggagtcggcagacaccctggaactggcccatacctttgtccaggggctattggaaccctacttgggtgtgtggggttagtggcgggtttgacgggtgtcgggagggtggctgatttcacaccagcgtgctgattgtgcctgctgaactaccatgattgcagtggatcatcacagctnnnnnnnnnnggggtgtgtgggcttgaaggcgggtttgatgggtgtcgggagggtggctgattccacaccagcgtgctgattgtgcctgctgacctaccatgattgcagtggatcatcacagcttcgctggcaacttttgtgggatcaggactcgcgggctgtgctccggcaccccttcccttccccccatctccaccccgtccccacccccttccagctctgaaccccacctccctggctgctgcggagatgctgacggagcagtaccccaacggcgacctggtgtacgaccacctggccttccgcacgctgggcgtgcctgggctgggcatcgattcgctggcgcccaccttcctggagctgggctggcgggcgcgcgacgagctgcgcttcccggccaagaagctgcgtgcgcgctggttcgcgccgccctgcccctccctgccccgcatcttcatctcagagctgctggtgggggaggtggacgccgccgcacgcgaggccatcgccgccgcgctgggcgccacgccgcgcactctgctggcgcggcactcgctgctggccgccgcgggaggcggcacgccctggcccgcaccctcccgcgcgcagtacgcggcggtggccgccaagagcgagtacggggcctgggtgctcgccaacggcgcggccctgaaccacaccacgctctccgtgcacgccatgcgggacgtggcggggctggacgacctcatcggccgcctgcagggcgccggctttgcgctgaacgcagagggcggcgcggccaaggtgtccccagacggcctgctgcgccaggcctccacgcgcgccgacgcgcgcctgttttctttctcctgcggggcctccgcgctggtgcccacctcctacatcgagttcgcggagcggctggtcctgcccgagttccaggggctggcggaggaccaggtccaggagcaccaccgccgcgaggggtttgaggtgggtaacgcagacaagatttttgagagcacctactcctccaaagcggcctgaggcggggggtgcgcagccatgagacggcacaaatggatgggaggtcggcggatgcactgcatggcggtgcgcggggcaccaggggatgttggtgagcttcaaaccacatgtggaccgcgtgttcgcctgttgggctggcgccccactgcaatgaaaggcagtccctctgcgttgcacactgagccggccatgtatgcgataggttctttctacaaagacatttacgtccannnnnnnnnntgtcgcacactgagctggccatgtatgcgacaggttctttctacaaagacatttacgtccaggcaattgaatgtgatccactgctccttcccatcccgaatgtatggactgtcagcactccttcaaagatgcgagtcggtggggaccgagaccattacggttttgctcgccagccttccgcgaatcatcaaagctgttcctcgcttgccnnnnnnnnnnaactgtcagcactccttcaaagctgcgagtcggtggggaccgagaccatggcggttttgctcgccagccttctgcgaatcatcaaagctgttcctcgcttgccaccgggcacttggtcggatactgattgctggacgcgatcgctttagacactcattctacactcgctccatcgaccaatagatatcgttttgtcctggtaccagtattacttcggcatcctcccacaaacccacgggacgagcccagtctcggcgtgcatctcctgtgcttcgcacgactgtccnnnnnnnnnnnnnnnnnnnnnnnnnnnnnnnnnnnnnnnnnnnnnnnnnnnnnnnnnnngataggcaggttttgtcgtgtcaactggccaacaagaaaactaaaaagaaccaaatgttctggggtaaaaagaaggaccccaagccagatgtagccaggtgggcttgaccggatagtggcggtatgtcggtgctccgacggaggcggtgtacttcctgacctctgcatggcgacacctggtttccgtccattccagcgcctcattcaacctcgatatcatggaagtaaccacttgattcccttgtagtccgcctcctcagccaccgagggagggaccggcagggaggcagagtggggttgttaaggcaggtggaagtgggatgcaggctacgcaggcaccaccagcaaacctgctctccatgtttgagtttccgacgtgagtagttggagagtttcttccttggaagtgatgaggaggtgcatttttggcggttgtgatgatatacccgctgtgcttgtacggcatacagggtagcatccctgcaaagtttatgcgttgaggttcatgtcgcaaattcctctcatatgacgatataaaatctacttgcagctccaagcagaagactnnnnnnnnnnctttgtcctggtaccagtattacctcggcatcctcccacaaacccacggaacgagccctatctcggtgtgcatctcctgtgcttcgcacgactgtccaccaaaaaattaggcagatcttgtcgtgtcaactcgccaacaagaaaattttatagaaccaaatgttctggggtaaaaagaaggaccccaagccagatgtagccaggtgggcttgaccagatagtgtcggtatgtcggtgctcctacggaggcggtgtatttcctgacctctgcatggcgacacccggtttccgttcgttccagcgcctcattcaacctcgatattatggaagtaaccacttaattcccttgtagtccgcctcctcagccaccgagggagggaccggcagggaggcagagtggggttgttaaggcaggtggaagtgggatgcaggctacgcaggcaccaccagcaaacctgctctccatgtttgagtttccgacgtgagtagttggagggtttcctccttggaagggatggggaggtgcatgtttggcggttgtgatgatacactcgctgtgcttgcatggcatacagggtagcatcactgcaaagtttatgtgttgaggttcatgtcgcaaaatcgtctcatgtgacgatatcaaatctacttgcagctccaagcagaagactcctccatcagcagtggggctcagcggaatctgcagagctgacgacccaaatgacatccaggcgtgcgtctggagcatcgaccctctcgagaaagagaatgacactcccctcttcaggatctacttttgagcatctcagctgctacctcctttgtcttcctcggtttacctttcaaaaactggtgtagactcggcctgggactttgttgcaacctacatttccccgcctggctgtcagtcttgtcgaccccttgaggaaccgccccagtgaagatgtgcaagggctctgccatgggtacccttcgtggcatgagggtgtaacagaacatgtgctaccgagctggtcacaaggatttacaaaagcattggaaaaagatggtatcagaaatcgcgacaagtttggtgattgtttgccctggggccgcccggctccccatcacggctccaatgtggcctttgtttcggaagcgagcggcccctgtgatgacctggtcctgttcacctccggtggcggggggtccctgccatgcacctgctgcatcttgatctgctggtaccagcagaaggacgccacagagccgccataccccacgccctgcagcagcgtgaccctctcacccaggagcgcgacgccgagcagcaccaccaccgagttcttcacggtgccgaggacctgcggtgcggtgaaaaggggggttgaagggggctgaagggggaggattgggcttcgagacatgcttggcgtcccgagcatgcagatacctcttggtgtcaggtcctaggagtcagcaccgaggctccctcctcannnnnnnnnnggcggtgaagggggggggtgaagggggctggagggggaggattgggcttcaagacatgcttggcgtcccgaacacgcagatacctcttggtgtcaggtactaggagtcagcaccgaggctccctcctcatactgcgaggccgtcgactgatccccctgcacgatctcctcccctccaccaacacccacacccacaacccatcaccttgagcgtcagggaggaggaggcctggatgacgatgtaggccaggctgttcacgccaaagcccagcacggccgccagcacaaaggtggcgggctgggcttggacgacggccagcgcgtctgcgcgtgccatgcgcggggcctccaggaggagggaccccaggcccagccagaggaagcaggagggggccaggtacatgagcccctcgatggggtggaaccgcatgccctggagcaggcgctgcgtcaggaccaggcgcaccgcctcgaacacctcgctcagcatcatgatggccacgcccaggacgtccagccgcacctcccccgcagccgcgacggcggtgcccaccgcgatccccgccacggcggccaccaggcggcgggtgggggtttccagtcccgccaagaacatggcgagcatggtgatgacaggggtgaaggccttgaggatctggatgaaagccacggtgaggtagaggtaggccaggtttccgcacagcaggttcagggccatcagcgcccccaccggcatcacgccggtgaggtagaagcgccgagtgacggtgcgccgggcatccaccaccttgaacacctggggcgaggcagagaggggannnnnnnnnnnnnnnnnnnnnnnnnnnnnnnnnnnnnnnnnnnnnnnnnnnnnnnnnnnnnnnnnnnnnngcggtgggcgccctgaccatctttgcaacaaggccatacgggacccctctccaaggggactggggttggcatgcgctgtattggatcctgacgcagaggagacgacaaccatgatcggacccccccctgcgcacagccacccagcgcaccnnnnnnnnnnataaggggttggttgggaggcgcatatgaatgtgggcactgcaacaggatggttcacatcaggacttggtagtaccaccgcgggcgnnnnnnnnnngtggggttggcatgcgctgcattggatccagacgcagaggagaagacaacgacgatcggaccccccctgcgcacagccacccagcgcaccctgcatgctaggtagctgcagactccactaaacagcatccccagggacgagagggccatggggtagggaaagccgccagacagcagggctttgttcacgaggatgagccaggaggagatggtcatccatagcagggaggctgcaacggccaccaccatgcgggcttggggactggtgccgccgaatatgtgagatccgtctccttctccatgtgagcttgctttcgtgaaagaaaaggcaggagggggagagggccagggcgctgtcgatgtttcgaccgtcatgtccgccgtgcccggctcgcggacagactctagtcaaggacgcgccacctctatcctgaagagagaattagattccaaagtacttccagaacgacttgggttgaggatccgcactccacggagggctgttcgnnnnnnnnnncctttcgtgaaagaaaaggcaggagggggtgggggccggggcgctgtcgatgtttcgaccgtcatgtccgccgtgcctggctcgcggccagactctagtcaaggacgcgccgcctctatcctgaagagagaactagattccaaagtatcgtccagaacgacttgggtcgaggatccgcactccacggagggctgttcgctgccactcctttgagtgggtacgagatggttgacgcacaaaaaggaaagaggtcttaataagaagatgtcaaagtcacccgatgtattgattgcacttttgtggtatatgaatttgtctcctatgattctctgaagagctggacgagtgggggggattcttccctttcgaagtgatcgagagaatgtggtctgacacctctgccccatgatgctcaaagattcagagatagaattggctgctgtgcaactaaagtgctctgtcaacattccgaggatggcagatctggggaattggccaacaagttagaccgcctggatgacactggatgtggaatggcgatgccaacttgtcagacatgcatgcatcaatactgaacccatcttgaacgtcaacgagcccgcggccaagcctatgtgctctcctctagcccatgtgtcatactgttcctgaatgcgtcaccaactgnnnnnnnnnntgtcaacgagcctgcggccgaggctatgtgctctcctctagcccatgtatcatactgttcctgaatgcgtcaccaactgcgtctggaagtgggtgcaaaggcatccatcaggagacgtcttgcatgaaattatcacaccatttgcaggcatgcaagcagagcaaagaccatgagatgagtgccaatgtgctcccccttctcatggcactgcagcattcttccccctcaaccactgcggcatgtggagccgacctctgcttcataccttgaactgcttcaggagcaccgccaaatcaatccagcccatgccctagcacagtgagaattgaggctgaagtgtcggagggaatgacaagaaacactttgacaggtcacagcatagtagaattagtttcccagctggtatggagaaggaacatcctaggcaacatcccccatctgtacaccagtgtacctgggcaaatgaggaggccgaagtggcatggccaatggcctcccttcttaatttcctcacagttgctaaagatttgacgccatagcgttggccaacgacctcgtcttcctcctgtgggtaaacggaagcacagggggactggtattcatgcctgagtgcggcgcttggactgatgaaagtttttgtaacaccaacctggcatgcgctatagcaatttgccacatcgcaggactcctctcaaacaatcatccccccgccatcaggccctcctcacccctgctgccatgtcgcgcagctgtagtgccgcaaaatatcggtaggaggtgcgtgcacgggggtgcaggctggaccagccctcctgcaccggcatgccttggctgccaccacccaccatcagccgttcggtgatataccgctgactcaaccccacagctcccgcggttctcgcctccgaatcctgcattcaccattgagtagtttaccctgacacacagaacctgtggcacccatgccaacaggattgcccaagcgatactggcaaaagatgcaagcacaacttgggtatacacagaggcagcacgatcaagttctagatgcccagatcctcccacaccaacccgtgcgctgatcatgaattgatgcagggcttgccagttgggctgaatgctccaatcaaggggcacacacctgcggcaggagaggaaggggtgatggtcaccgaatggtggccttcgctggtcaccacgtgtatgaaaggtatgcccatgctcatcatcccctctcacagatatgctannnnnnnnnntggaaggggtgatggtcgccgaatggtggccttcgctggtcaccacatgtatgaaaggtatgcccctgctcatcatcccctctcacagatatgctatgtgcagctgggaggtgaggatgaggctttcgcgtgcagcaccgagttctctctgcattgaaaagtgtctggtagcatgagacccatccgttcaaacacaggtttgatgcacaggtcaccacccatgcactccaggcagcagactgtgctcaagtgcaaagcgaagaggcactcagtgactgccaacccacctgcaggaggccggccnnnnnnnnnngccacccatgcactccaggcagtagactgttctgaagtgcaaagcgaagaggcactcagcgactgccaacccacctgcaggaggccggcctgacatgggtggagatttgcttccagagccgtgcttcccagccgagtgagggtataccgagccgttttctcactccagctcgcaagcttggcgtccttcaccagccagcagagggcggcctgggcagctgcagctgcagcctgttggtagggaacgagcagcaaccacataatgtatgacatcagagcaccatatccaggatggactattgcactctgcagcgttttgattctcagcttggcagcagtaggaagatcaggcattgtactgtttcaaaacatcctgggaacattcctaactcaccacgggtccatgcagcacgctcatcagagtgcagccgacgtaagtcttgacatccagcgcggtgcaagtgaactgcctccctatgctgacgaggagcgcctgcctcatgttgccttcagaggccaggcaactcgacacttcagcgttatcagccgcaagaaggcccatgaggtcagagtcggccacacttgaagctgatgtcagaatgcactccctgccctgtgcaccccgaacagagtgcaagaggcggtgagctctgcaaggggacaggcaatccacgaattaatgatggggaagggatcaagcaattctgatgtaccattccccagtcaccccagcttacttggcgcaggatgagcgttcctggctgctgccctttccaactgacgccagtctgaaaatgctcacatcagctgcccagctgatggaatgtatcgaggccgccgttgttatcagcacggagatgagaccatgagtgactgcagcttccaccaggccccgttcctgggcaggaaggcctgacgttgggcggagatgaggttgagaacctaaggcaaggacgcattccgtcactcttcctcctgacaagcccacaccaatccttgccgtcctgccagnnnnnnnnnnagcaaggacactttccatcactcttcctcctgacgagcccacaccaatccttgccgtcctgccaggttgcagctgccctgagcctcgttcctacctgcatggtaatacgcaaagccttgcactaccagagcggcgagcacctgcgaggatctcctgcccagctcccgcagcttggcagctatagattgcctcgactccctgccggggctgccatgtccttgatgcgttccttccaattctgcgcaagcctccccaagagagcccgcccatggatctcgcacaaacctacagggagctcgattcataaagggaaaggtatactaaagataaatgcatgatatggcagggtgnnnnnnnnnnattcgattcataaagggaaaggtgaactaaacacaaatgcatgatatggcagggtgtacagatacaaggaattccgcagaccctctcctttcttcagcccgcacctggcaatctcatgagcacaggcttcgggagactctcttgtatcacagtacacaatcactgtcttcccacggtcaaggtaaccctgaaaagaaaaggattgatgagtgtgagtgagggcaacctccaccatggccaagcggacatatgtgcgacaaagagcacccgcaagtcctccatatagggcagttggactcaaccatcacacctggcaaaactctggaacgttgtccttggtctataggaagttggcaagggggttgctgggtcagttaccctgtcaagttgtgcatcgccagtnnnnnnnnnntctgaaaagaaaaggattgatgagtctgagtgaggcaacctccaccatggccaagcggacatctgtgcgacaaagagcacccgcaagtcctccgtatagggcagttagactcaaccatcatacctggcaaaactctggaacgttgtccttggtctataggaaattggcaaggggggtgctggtttagttaccctgtcaagttgtgcatcgccagtggtgtcccacaatgcatggttccaaggacacctgtaaaccccctcgacaccagtaactccacacgctttgagagcgctgactcaccatcccagcaagggtctcctcacaggacagcttgcgcagtcgtgtcatgtgagttgtactagatccctggaaatgctcccaaagccaagattggttgtctgcattcactctctttggcaaaggaggtgggatacggataggtatgtaggcaaggagcacatatagc

SEQ ID NO: 29058 - DNA, 61 bp, Chlorella protothecoides
ctctccagcatccagccccaagacatccacacccactgcctcgactcccgccacctctccg

SEQ ID NO: 29059 - DNA, 61 bp, Chlorella protothecoides
cgtgatcgtgcctcgcagatcatgcattacttgggaacctgagtgaggcatggacgaggcg

SEQ ID NO: 29060 - DNA, 80 bp, Chlorella protothecoides
ccccagaacgtgtatgagctgctgtgatgctcgctgtgatggactgtgagcctgggaagtgacagcaggctgctggagca

SEQ ID NO: 29061 - DNA, 61 bp, Chlorella protothecoides
gcttacagaattacctccagccaagagacgtgaagctggagaccatgcatcaaaaatctgt

SEQ ID NO: 29062 - DNA, 61 bp, Chlorella protothecoides
acgcgtcgcgcagctgcctttcgtcagcagtgcggcagaggcacaggtccgctgacacctg

SEQ ID NO: 29063 - DNA, 61 bp, Chlorella protothecoides
ggaaagcatccacctttggcataccatgcacatttgctgcaaacgtaacgtgttttacagg

SEQ ID NO: 29064 - DNA, 80 bp, Chlorella protothecoides
cgcggattgtcagaggccgacagcgctgtggtgcatccggcagcagtgcccccaagcaccgggcacttgggcctgctgtc

SEQ ID NO: 29065 - DNA, 99 bp, Chlorella protothecoides
ccgtgtcgcgaatcgacgggtgaatctcttgagcaattatactgtctattcacctgtggaatctgctgccgatcagcagtgccggcagatgccttttgt

SEQ ID NO: 29066 - DNA, 229 bp, Chlorella protothecoides
gacagtgccgcgctggtgtcgccctacccggtccgccagcagaccttcaaggtggggcggcacgcttgagggaactagacgtacaggggttgcacaggcatccaagcggctgacgtcgctgatttcggtggccgccgtgctgggcggtgaccgccagcccttccatggagccccaccacaactcgagcaactccccccacgtgccagatggaactgggcaggattgagt

SEQ ID NO: 29067 - DNA, 76 bp, Chlorella protothecoides
gcaaaagcaaatccctcagtcccaaacaatattacgccgtgcagctcaagattcgctcatcactcccagaccttgg

SEQ ID NO: 29068 - DNA, 61 bp, Chlorella protothecoides
ggagctctacagccatcagcgtgcatcccgacaccctcaccagtacaccctctcacatcac

SEQ ID NO: 29069 - DNA, 145 bp, Chlorella protothecoides
atgcctggcgaggatcgtcttcttttgcacggtgaaccatttcaaatatggtcataccccagtgatcttccaaatcaccggggttgaaggtacgctgctcacacctgccccccgccaacgtcaccagggtggcctggggtggctg

SEQ ID NO: 29070 - DNA, 68 bp, Chlorella protothecoides
tgtcggcccaatcacgtggtgacgaccgagcactgtgaaacgaaacacagagactcgagcctcgagcc

SEQ ID NO: 29071 - DNA, 72 bp, Chlorella protothecoides
tatcgataggatccagtctccgtagctcagcagcggatcaccgcgggggtcgccatgtcgtcgccaccgccc

SEQ ID NO: 29072 - DNA, 159 bp, Chlorella protothecoides
gcgcggtgttgtcagctggagaccatggggagagaccagtggatgcgggtgttgcacctgcctgcttcgctggatcgaccgtagcccaccgagcatctcatcacccctttttctcaaccacacgcaccactcccaaccgcctctcctccccacctggcc

SEQ ID NO: 29073 - DNA, 80 bp, Chlorella protothecoides
gtgaggaggagacgggagtgcggagggggggttgactcgatgtgtccacgcgaccagccagtcctgcaatagggagagca

SEQ ID NO: 29074 - DNA, 61 bp, Chlorella protothecoides
ccaggtcattctcatgggcctggtggagggttaccgcgtgaacggcgggcccgccggcgag

SEQ ID NO: 29075 - DNA, 61 bp, Chlorella protothecoides
ccggtcttgcgctgccagaccagaggctgggggcaaggctgcacacagagggcaagatcca

SEQ ID NO: 29076 - DNA, 1076 bp, Chlorella protothecoides
ggcggcgcgcgcgcggcgcagctcgccacgcgcggccatgccccgaaaggccgactggatgcgcagcgccgaccccgccagccgccgcccgcgcgcgccctttgagagaggtgtgtgtgtgtgtttggggggggcgacatgctggaggcgatctgtcgcgccgccacagtgattcccaccactgccacgtgaggcctctcgaatccctctcagacaccctgcgctccctctgttgtttgatctccagcagtgcgacacctggtcaccaccctctgcactccgcgttccccccaaatcacctcaccccacccccccaaaaaaaccacgtacctccagctgcgccagctgaccggcgcgcaggaagacgcgagtacggcccagctgccagccctccatgccggaggtggccaggatgcgtcgcaccaccgccaccacctggagatgtgttgttgatatgtagaggagtggggtgcaggtgggtggggctgggaaccccagggagcatgtgctgctggacgagtgtggctcagcaggaataaccctggcccccaggctgctgcagcccccatctctccaaggatcacatttcgccacaatctcccccccccttttaaatacacacactcacacacacacacacactcttcccgacctccccagacttgcctgctcgtcgccggcggcgtaccagtccacgaagccgcgcggggtgaggggcagctccaggcgctcgcgccagccgtcgggcagcgtgagcgcatagcgctgcgcgaagggcaggaaggccttgcgcgtgggaaaccccgcgcaggcgatgcgcaccgcctccagcacgccccccgcccgcagctgctccagcacgtaccccgcggccagcgtcccgggcacgctccccgggttgggcttgatgcagcggatgtagtgcgggtggcacgcgtccagcgtgcccatcagcaccgccagctgcttccggaagcggctggccaccgtgctgagctggaaggcggagcgccgggcggtggtcagaggggtgctgctggtgggggctcccgagccggcggcagcacccccgcccg

SEQ ID NO: 29077 - DNA, 61 bp, Chlorella protothecoides
cctgccccaggcgcccctctacgcccaaaaggcccggctcttccccggcagcgtctttgtc

SEQ ID NO: 29078 - DNA, 237 bp, Chlorella protothecoides
cgtaatacaacgcacagagcctgggcatgacagcgaagagcaagggagggagggggagggatggtgcgacgggccaggagtgatcaacacgtgagcaacataagtggcccccgtgcaatatgctggatcttccagcggcatcactcaacgctcaggtgatggtcgaaattggaaaaaactaaaaggcaggatggcagggacctattctaccactaaaccaactgcgctggttgggag

SEQ ID NO: 29079 - DNA, 61 bp, Chlorella protothecoides
caggtgtgcaccgcatcgaccagcatgggcacccccttgtgccttacgcagacgtcaacat

SEQ ID NO: 29080 - DNA, 124 bp, Chlorella protothecoides
cgacgcaagggtcaacagtattcgcaatccgcgcactcaaacctcagctgccccctcctcgctgcgcagggctggtggagcccctgtccctgagcatggacgaggagtcggacgaagatctgca

SEQ ID NO: 29081 - DNA, 61 bp, Chlorella protothecoides
ccccatccggtcaaacaccgtatggcggggattgttcaaacctcccgggatggcccctggg

SEQ ID NO: 29082 - DNA, 98 bp, Chlorella protothecoides
gaagccggtggccggcgtcaccaggaccagccgccctgcttgtcggggacgctgcgcctctgcggctcctgtaaccacgccgtggaccccagctgcct

SEQ ID NO: 29083 - DNA, 77 bp, Chlorella protothecoides
gcgcacctgtctggccgggcacccgctgctgtggtggtttcagttcaggaggccctggattcagcgggagacctgga

SEQ ID NO: 29084 - DNA, 167 bp, Chlorella protothecoides
gggtggacccagccgcctcgcaggagtggcggcttttcagcaagctcatgatgacatccaggtccgagcatacgctgacagccccccacacgaaccttgcaaagcgggagtgcgctgccgcaacctgatcggcatcgggaagctcggcccagctcaggccatgcgtg

SEQ ID NO: 29085 - DNA, 61 bp, Chlorella protothecoides
ggaagctcggcccagctcaggccatgcgtgttctggatgtcactttctgacagggatccca

SEQ ID NO: 29086 - DNA, 73 bp, Chlorella protothecoides
gaatcaggaggacctgaggcgtgcgatctcctctgatcaggcaggtcctctccacatcccatccacggcagtt

SEQ ID NO: 29087 - DNA, 61 bp, Chlorella protothecoides
cgtcgacctccaccccatcggtgaggctggggtccagggcaaccgccaggccggcgatgcc

SEQ ID NO: 29088 - DNA, 116 bp, Chlorella protothecoides
caaggagaaggacgagatgatccaggaggtcagcagctgctggcgagctgtccagcaacctatattcttctgggcgatgaaataatcctgcgcaagtgcctgacgctacagggccc

SEQ ID NO: 29089 - DNA, 61 bp, Chlorella protothecoides
gaccacgcgccagcgccgcatggaggccatcgacaagctggtctccctgctcatctatgtg

SEQ ID NO: 29090 - DNA, 61 bp, Chlorella protothecoides
ccacctcgtcactggcgtgtcgacagcggcagcctgaaccgctgcagagtcctcgatgtcg

SEQ ID NO: 29091 - DNA, 70 bp, Chlorella protothecoides
aagggaatgggaagatccgtcggcaccccaaatctgctctctcgaggagcgctggcctcctcttgcatga

SEQ ID NO: 29092 - DNA, 79 bp, Chlorella protothecoides
cgctcagccagtcttacctgaccctcctcacttcaggggccagggggggggtgacatctatgccgcgttcaacgcccac

SEQ ID NO: 29093 - DNA, 137 bp, Chlorella protothecoides
gccatcctcgcccatgctgggctccgccattgatcctgcccgtgtttggaggtgtcagtgagacaccatggaaccagagtggttcagatctgtgagggatttcctgtgacattgccactccacgagcatacctggca

SEQ ID NO: 29094 - DNA, 18557 bp, Chlorella protothecoides
  modified_base (467)..(476): a, c, t, g, unknown or other
  modified_base (2161)..(2170): a, c, t, g, unknown or other
  modified_base (2805)..(2814): a, c, t, g, unknown or other
  modified_base (4614)..(4623): a, c, t, g, unknown or other
  modified_base (4852)..(4861): a, c, t, g, unknown or other
  modified_base (5415)..(5424): a, c, t, g, unknown or other
  modified_base (5843)..(5852): a, c, t, g, unknown or other
  modified_base (9138)..(9147): a, c, t, g, unknown or other
  modified_base (11412)..(11421): a, c, t, g, unknown or other
  modified_base (11877)..(11886): a, c, t, g, unknown or other
  modified_base (12476)..(12485): a, c, t, g, unknown or other
  modified_base (14271)..(14280): a, c, t, g, unknown or other
  modified_base (14927)..(14936): a, c, t, g, unknown or other
  modified_base (15953)..(15962): a, c, t, g, unknown or other
  modified_base (16396)..(16405): a, c, t, g, unknown or other
tcgtgctcggcgtctgcgcgctggacggccgcgcctgcgcggaggccggcgcacagcagaccgccgctcgccttgccgacgtcgtgcgtggggcggccatgggcgagggcacgtaccgcggcctgacgcaggcgctggcgcgccacgccagcgtgcgctgcgcctcgctggaccggctcaccgcgcgcgacgaggaaagtggggcggaggtcctggtcctcacgccgcgctggggcgcggcgctggccgactgcgccgcgcgcgtggaggccgggctgttcggtgcggcgcctgccggtgacggggcgtgggcgggcgggtaccatggccagagcctggaggcggcgccgcctgtgtcgacatcagccgaccccgcgccggcccgagacccgcgccatgctgcaagctctgcctctggagattccgatggtcgaggcattgcgccacccccggccctgcgccctttnnnnnnnnnnggacccgcgccatgctgcaagcactgcctctggagattccaacggtcgagacattgcgccacccccggccctgcgccctttgcctgcgatcggcgcgtccagtcctgcgctgtggaacgcagggcagggagcgtcatcaccatcatccggtccccttccaacccaccctggacctcaagcgaccttgcagccgcctgctcagccccctcaacccaccaccgactcgcccgccacgctggcggccctggcggaggcccgggccgcgctgcaggacgccctggcagaggccgcgggcctgcgcacgtccctgcaggcctcccgcgacgaggccgacgcgctgcgcgcctcgctgggtcggctggagggggagatggagggcctgtcctcggcctactcatccctggacagccacgccgcagagctgcaggccgagctggcccgcctgcgcaagcgggagcaacacggcgcggcgtcggagggaggcggcccatctgaagggcccggcgcggctccacctccagaggacgacgagctcaccgacctcctggtgtgcctgggccaggaggaagccaaggtgcgcatgtggatgccgggaggggggtgggtttccgtggctccagtgactgcgctcttcgacgcggccgcagcactgggactcgcccagcgctgcatggcgagctggcccgcgggtgctctcgcgccttaaccctcctcgcgatcccactctgtaacccaggtggctgtcctctgtgcccggctggaggagctgggtgtggactccctggccctgctggaggccgccgcgcccacactcgagcttccccccgacctgacgtgacccccattgcttcttgtcatatgctatactgcagcgcattttccagcagggaaagggtagagggggggggatgcattcgctgcatatgcatgggggagggacgagtggatggaagggcaggggcctcagcccccctgttggtgtgccgtgccctgggcacagctcctccaggtcctccagcctgagtggtcaagaggttccgattcataccgcccagcatgcctcacgccacatacttgtacatggcagtgtctttctcatcccgctcgaggaactcgcgctgcggcaaggtaatttgtgcgagatggcatgttcaagaattggcttcagtgaaggcgctcggatccgaggcacggcggcatcgatgacgcacagaacaggcttttgcaggaggccacatgcacacacactctgccacacccacctcgattagcgactcaatctgcttctttaccagcttgacatctgctgcaaacatcttctgggtctggcccaccacctcgaccagcagctcctggtgcttcatcaccctccggctcttcatgatgcgcacaatggtggcttggatgatgtgcacccggtccttgcccacgtcctccttcaccttgcgccggtcctccagtggcggcagggccacctgtggaggatcagggtgtgggtaaggatgcgtgcaattgaggcgtcggggccggggcgagggggcggcccagggtagattgcacatgcatgcgggatgggacacgtcccattcccgaaccctcggtgctgagcactggcccccccctacaaatcacagcacgcccagcgcctccccgagtaacccaccgactcaccctgattcgccgcnnnnnnnnnncaaggatgcgtgcaattgaggcgtcgggaccaggacgaggcgcggcccagggtagattgcacatgcatgagggatgggacacgtcccattcccgaaccctcggcgctgagcactagggtccccctacaaatcacaacacgcccagcgcctccccgggtaacccaccgactcaccctgattcgccgcatccgatccttgaaacccgcgttgtaggcaaaggtgtctgtactgttgatcgtccggcccatcggctccttgctcagcagcttgtgcttggcaaagacaagcgaggccagcgtccgctcaaggtcgtcagaatctatgttggtggcctcctggatctcaatgtacttgagcgacgtcgctacaggcagtgcgggaaaagaggagtgtgcaggatacctagtgtcgtgctggcgagacagggccattggggcgaattcccgccccgcctggctgtgtcagcatacgcacgcacatcacagagtcttggacccctcccgaaagcaagcgctcagcagctcgccatgccaactttccttcctgctcaaacaacatccagtgcctatcccattcagaatgtgccccccccagacaatgcacgctccactcaccgtcattgaacagggcaaggnnnnnnnnnntagcatacgcacgcacatcagggagtcttggacccctcccagaagcaagcgctcagcagctcgccatgccaaatttccatcctgctcaaacaacatccagcgcctatcccattcagaatgtgatccccccagacaatgcacactccactcaccgtcattgaacagggcaaggatggtcgcctgggtgggtgtcaccaccagctcatacgtcttgtcatacgtcgcgcggaccaggacgttgccatgggtgtgctgcatgcagggatgggtggcacgaggagtaaagggcatgggccaccaggcacagggctggctttcagcatcaagtgcagaccttacgagcaccatactgaatggccaggcggccaccacctcaacaggccctcacatgccacgtcaggcgccgggagccattgttgatggcctcgtggaactgggtgaactggttcatcgccatcagcatctcctcaggcagggtgggctcgattttctgagaaggggtttgagagggagtccgggccgtgagcaccaagcgactcttgcccctcggttgcatttgagaatgcagagcgaggtgatacctcaattgttccaaccatggagggatcagtcccttgtcgcgtccacgagccctgcagcttgctgttccaccccaccaggacccgtccccctcgaccccacaccttgaaggtcggccagaagccaacagtcaggacggtggcgttcagttcgacgggcagagtgacgcccctcttcttctgccacctcacaaactcctccatcttgtccttggcgtgcgcgaggtcgtgcaccatgccctccatctgagcgcatggaagatgcggaggggcagcaccttgagatgtgtgcggaaagaggagagacacaggacggcagcctcccatgctgggacatgcagcaagttcaggaagcgtgcacccaataacgcgccgacaggccgtgacgcccgcgctgcatcctcgcttgtctgcgtcccgtccttcccccacaaagcctcttcgcaccctggaagtgaactgggtcccacactgctgcttcaggcggatcagcacccccttttcgagctcctcggacgccatgtgggttcccagtagcctgcaaggttacaggacaggtgtggcggggtgatgttgatacaactatgcagacacacggggggtgtgcacctggtgtaccctacattcaccccttgctgccaccagtctcccagtgcagcattgcgaaatgggatgaacatgcaggctgggccaccctattattgagccggcatcgaagcctggcttccatgcaacgcctcctccgcagaacccctggctccgcgcgcaccgcttgctgagcttggtcctgtagaactcggcaaagaggtccttgtcagagacatacgccagtagcttgacgacctggcaggggaaggaggagagggaagggcgtcagtgcaattgccagggaggccagtcacattcagtgaggtactgccagcctctgcgacatccacacgcggccaagcatccacgagtctgcgccgtcaacccacactcactctgtccagcagactctccacctcgtcatcagtcagcttctcggaggtggacccctggtgcaaggggtgaagtgagtcgcaattgagagcctacttccacagtgtcgcaatgcagtgcccagcgcccccttcccgaaattctgtgtccatcggattggcaatgaaatggatacagcggagcaacatggctctacagaagtgcacccaggctgcagccacgcatggcgcccaccttgcgnnnnnnnnnnatggcaatgaaacggatacagcagagcaacatggctctacagaagtgcacccacgctgcagccacgcatggcgcccaccttgcggagcagggaatcgcagaaggatgccatggcttcggcgaccgtggccctcccaatctgcacgcggcatgctccatggtatgtgaggggctggttgatgctgctccacccgaggcttcagcaatgtggagtgcctgctgcctgatgnnnnnnnnnntgtggccctcccaatctgcatgcggcatgctccatggtatgtgaggggctagttgatgctgctccacccgaggcatcagcaatgtggagtgcctgctgcctgatgagccatccctggcaccagccctggcaccagccggtcccaggaatctgtgcccagccagccatgccccactccacgataacgcacctgcttgttgcaaaacgtctcaaacgcctccttcaaggccttgtggaagagcgaggcactgccaaagtatgataccacgtagtcagagtaggtgtcatgaaggtctatcgcgacgcggatgaactggtgctctggcgcggcggcgccgtccttgccagctttgcctgggcaggggacaggaagcggggggcgcaggggtctggcatggctgcgtacacgtgcatggttttcgagatcttcgtgagcaacgcttgtaggacaggggaagaacgtctcgtgtccaggctgctgacgcccacgcaccgcacttggtcccaggactgcgaggtacctcgagttcacccccacccacctgcatccttttnnnnnnnnnntgagatcttcatgagcagcgcttgtgggacggggggagaacgtatcctgtccaggatgctgacgcccacacaccgcacttggtcccagcactgcgaggtaccttgagttcacccccacccacctgcatccttttccttggcctgcttggacccagctgcctctgttgccgctcgcacatgcgacatgcctgggaagggggggtgtgatgggtgtgaggctcagggctcgccctagccatgtcagacaccctgcaggagctgtccggccggcagcgccttgtcctccatcaatcctgctggtatggttggccgcttcagtagaacagccccgcgccaaccttcagattccacgaaatctttgaaaatcgcggccatgggctccaggcccttggggatgcgaccaaagagccggaacatgnnnnnnnnnntaccttcagattccacgaaatctttgaaaattgcagccatgggctccagacctttggggatgcgaccaaagagccggaacatgcgagccaggtcctctttctgtggaggacagtgtgggaagttcagggagtggtgatttttgggacctggggtgagatcatacgctggggacatgggccatactcctggttggctgcgatcaacagggcgctgctcttggcaaaacgcctcccagcacatgatcctcagccttctgtgatacatccactggttgccttcaaggcctgcagagctggcaagcagaccatcaaacctcccacggattctaccttgccatcgcgcaacagggcagcacagccagatccttccttctccaggaggctcaagctgtgctccttgagcagctctgtctccgtctatgcgggggggtgtgggggtacaggaggatgtggcatacgttcattgctgcaagtctgaccagggccacaacggagcctcacagccagtgccacgggtctcaacacgacgccaggcatgctgtatgccaatccgtacgggagcatgccagcctggcctcggcacttcttcagctactcacggtgctgaggagcttggtgcgggtggagacgtggaggtaggcatccaccctgttctcctccgccttcaggcacgcctctgccatcgaaaggaactcgggcgtggaatacgtctgtgcgggcgggcagggaagaagtgggaggttggacatatcactgccagggacgcagaccaagggtcgctaatccccatgcaggcatgtgcagcagagccagctatcactatccgtgcagctgttacattctggaacccacggaatggccaatgctgtgtaggaacagcatgcagctgccaaggtggacggctgagcccccaggcaagccgcgatgtgccggcgaggcagtaggaaaagctgcgtctcccacccatcaccctcagtgcaagggatgcgctcccccaccacgcccgcctgcccctcacctccagccacccggcgctctttctcttgtagtacttggcggtggtctgcagcagtgccgcctcaaagtctttctcgtaggcatccagcagccccatgcccacctcctggtaggtggccaggctgttcttcagcagggggcagtccacggcctcgccgtctcgctcccgctccaccagctccaggatggcgtccgtcacgcggctcttaatcacttcgtgcaccacctctgcgccaggatggagcgggacaggagcagctcaggcactgcactcgagacctggcaaggctgcacacccctccttgggcctccttggccaccagcatcatgcacagcatcagatttccatgagcctttcagcaccagattcaccccgtccgttccaatcacgctcctcgcacttgcacagaccattgattgagcaattcacttctgtcaccaggctgctgttcccccgcaggcatgcactgttgagcaagagaccatggcccagctctcctgagcccaatcctcaggctcacctttccaaacgaggagacccacttcgttcatggaattcagattgtgccgctggacatagtatctgtccaagtaggaaaaaatgcgggacatccagcggaccatgagcgtgtggttctgccaccgcctgcacagtgttcgcagcaggctcacgcccttgaggtccttgagggagggaaccacgcactcttcaatgtagttttgcagggacgtgcgatacctgtgagggtagagcttgggggaggccctggattaatgcggctgggccaaagtaagccatccggagcagagcttagatgcatgctctcagccgcaatgctcgaaatctatgcaccctctcaaagccctgtcagagccgctcagagtaggagggtgtgcagtaccttgcatagagctgctcggagtgatcatacgggagcttctgggtgcacatgttgtatatgttggtgtctgtgagagcgagaggagcggtggcgtcttgcgaaagcgcttgtgaggagtgccacagacccagcagacccccctccagtgagtcgggcacacaggctgcggcagcaagggaggctggactgtttgctccatgttggcttccatcaactcagcaccactcacaaagctgcatgtactcctgggcggtgaatgcctgcgcgtgttgctctacattcttagatcggctgttcaaatgcacaggtatatgtctacaaatggcagcgtggcgtgcaagccagggacctcgccgatatgtctccctcacgtgcccttacctctgtcttttcgccctccaacacccgcttcagcttggtgataccgccctgaaaacatgcaaaatcaatatgaatgaacgcaggaaagatatgaaggagctgtgccccaacttcgccgcaccatacccacctccatcattgcccagccctcctccagcttgataggtccatcaggtttgcccatggctgctcctcctcgccaagcaaccaggacgatatccgatcgacgagtcgctgattgagcaacgggataaacgcaatgactttgtcggggcggtcaccgtcgccgggcgaacacgaggtctgtctgagatcgcttgcctctaccaccacggcagggggtccctgtcgggagaagtctgctattgcctttgcagaaagtcaattcgcctacactcaaaaagatgcgattgggagtagcactggtagcttttcgtgggcgaggcaggtggatgaggcgaccttaggcctcccgagacccctccgttgggttctgggcgagtctggtgacggaagggccctggcaagatactcctaggctgactcatgcactgagaccagctgcaccgtgtttctgaatggatttgtacagacccctacttgggataatttcctctcaaattctgtccttacgaagtctttaagagagcgtgcataccttgctcgtatatgttcacccggtgtctttgtagacaacagctttgagaccgcagtcgagcttcaaaaacagccagcttctacgctttcagtggcagcgtttcaatgacaggtaattgcacacttgcacgcttgaacccatgggtcatcaggtgggaggagggcgtggcccccccacttgcatgcacaacatcaaaatcttaactctctggacagccagccccccacccagagttctgggtgagtgcaagagccataacaggtggcaggtgtgctcttcaccgaatttcactacaaactttacaaagaaaacatgaccttgatggctnnnnnnnnnnagccataataggtggcaggtgtgctcgtcaccgaatttcactacaagctttacaaagaaaacatgaccttgatggctcctgtttctgcaggctttgaagccgtttcgaagccttgcaacacctccttctccgtgtagtcatgccggtgggtgatgaggggcttgacattgatacggccagacgacaggaggctcaggcatgtgtcgtactgcagtggatgaggtttttgggggatgggcggtcactgataccgtggcttcaatggctatggaatgagcgcaggtgacgtcactgctcatggaatgtgcagggtgggcacttgactgtcgtgctgcagttcctcctctgacgcagcaaagcctccctgtgccgcttcagctgtacacctggccacaacacccaacatgagaaaatcccatctccatctactgaccgtgtttttgtaccggaacgatcccaagatgtccacctccctgatcgaggccgagccgaggggcagcttcatctcggcctggcccatgcccaccaagaccaccttggcccctggggcggcagccgccagcgcggtctgtgcttgaggcgtggtgtgcatgcctgagtgtcgagctccatccccatcgcaggcacgcctccaagtgcatgcgctgcgcgctcctgacgagtgtgtcctttattcgcccccccgcgaatcagggacctgctcatgcataccatgccgtgccttcccggactcgagccgcccagacgccgacaaacgcacctgcatggtagactcgaaccctgcgcagtcgatgacgatgtcgaagccgtctggggctgcgctctccttcagtttccgcgcagcctcctccggcgtctcgccatgcaaggtgcgctgggtcacgcgggctcccagctcctgggcgaggtccagtgcctcctgacggaggtcagtgatggccacgcagtctgctccaaaggccgaggcagacagcagcgccacgaggcctgcgggaggggggaagagtctttgcatgcgctgagaccagcggcgccgcagagcaatgacacagagtgaggtcaggcaggttatggatgaatgccaccagcccggactagcgctcccatgaccatcttcctcgggagctgtgctggcaggccagggtccagccaggccccccctcgccccgcccccggcgcacctatgggtccggctcccaggattaggacccgctttccgggggacacgccagacctcctgcatgcatggatgcccacgctgagcggctcacacatggcgccgtcctcgtagtcgaggttatcaggcagcttgtagcagaggtaggctggatggtcaatgaactgtgcgatggtggtgggagggtgcggccatgacgagggggactcgctgcgcacggcggaggatcctgcagtgcatgctttcacgtcgctccaccacaccactcaagcaggggcatctgcagtccctggcgcccaaacagcgcgccggcgcgcggcaacaaccttctcccgcatgccctcacattgcacagggagccatggtgtgggggtgtggcaaagaacttgatgtctggatcgaggttatacgacccactcctgctgggtcgaaagggggatacgtgtctgggctgctagggacagtggacggctgccattgtttttctcaggtcttcatgaaagggttgccggctgacgaatgagcccccagtgcgcctggaccatgcactgcaagaagccagcctgcctggacagtcgatgctcccagcaggggatgccgggctcgagagccactctgtccccgacgtgcagggcagtgactccaggccccacgcccacgacctgccctgctgactcgtgcccgatcaccatgggcgcctctaccacaaagtgagcgatcctgccctgcgagtcgagattcaaggggtgtactttggcatggctggggcagcgccgaggctggacgagggctcgcagcatggccgccctgcctgcaagcaacaattttctgacagcgacgcacgcctcctccatatccctcacatgcttccagtagtggacatcgctcccgcatatgcccacggccttgatttgaatcctgacttgtccagggccaatctcgtctgcacaggggtgcagagggtggcctctcacgcattcacatgccagggacggcatcctgtgtaaggtgtccttctataacgtgaagttctatatagtacaccgatgcgttctcagtctttctcacccgagagtggccactcctcnnnnnnnnnnacctctcacgcattcacacgccagggacggcatcctgtgtaatgcatccttctacaacgtgaagttctatatactacaccgatgcgttctcggtctttctcacccgagagtggccactcctcgtatctaaggtcatcttttccatgcaggaccaccgcatgattgattagggatgttgccatcgacctcgtctggggggaaaatgcgacaccctggattccaaaaccctcgagtctcgggaaaatatagcctgggacatgcaagagagggcgcgtgcgtgcttgccagcgctaatgagctggacgatcccagccccgccggatcgcctggcgatctagcttgtgggcccggtgtttttattgttgtaaccctggatccagcagcagtgaggatgtcacttctggcccagaattacgccgttatcaaagggtttactccagatcttcacatctcgannnnnnnnnngacatgcaagtgagggcgcgtgcgtgcttgcccgcgctaatgagctggacgatcccagcccagccggatcgcctggcgatctagcttgtgggcccggtgtttttattgttgtaaccctcgatccagcagcagtgaggatatcacttctggcccagaattatgccgttattgaagggtttactccagatcttcacatctcgaatcaaattgtcaaacgccaccaatgtttcctgtgtcttgcaccgtggaattgtatctgccgacgtctgtccagtggcaaggggcccccctccagaaagggcacttggatttggatgaaaggccttgcatgcacacctgttttggaagggtccaggctcatgtgtctctagtacacatagacccccagggcggtggacatctcccagcccagggctggttcaggcagacttcaatcatcacgacatgtcccaccctcattccaattgattcggcaactgaagctcatcagaatcggtgtcactgtaactcgaaaatacatcttttgaggacgcccagtttccgaatatccctacacacagtgtgcttgcggccatgggggcaccttgtgnnnnnnnnnnccatgtcccaccctcattcccatggattcggcaactgaagttcatcagaatcagtgtcactgtaacacgaaaatacatcttttgaggatgcccagtttccgaatgtccctacacacggtgtgcttgcggccatgggggcaccttgtggtagtcccgggtctgggtactacggccgctccctggcgagtttgggcaccacactcttacacagtccgcacgccgtgacaggtcctttccaggtcgtgaggtggctacttgaatcgactagaatgggtgagaaggagaggactggcgcgaggcggggaaggttcggcggcctggccagtccccgggcggtgtgttgccgatatgcgggtacgcgagcgcgccaggtatcttcaccgttcacgcgttcctccccctgattgcagccaaggtcagggcacatgagctgcggcccaagagcaaggccgagctgctcggccaggtaggaaggcgcatggagtgtcgggtgatgctgccctcgacagagcagacggcgtgccttctcagcgacaacgattccttagaaacatttcctcaatttcactcttgcagctcaaggacctgaagcaggagctcgccgctctgcgcgtggccaaggtcaccggtggcgcccccaacaagctgtccaagatgtgagcactaattcgttggttggggtgtggctacctcgatggattccagagggcaatcctgactggcagactgttcgtgcctcagaggttcccagcctgcacttgtggccatgtttgctgggagttggtgagggatgggtgctgaccattcccactgcgccccttccatccttgcagcaaggtggtcaggaagtcggtggcccgcgtgctgactgtgatcaaccagaaccagcgtaatgccctgaaggaggcctttgccaagaagaagcacatgcccctggacctgcgtgtcaggaagacccgcgccatccgccgccgcctcaccaagcaccaggtggggctcccagggttgagataaaacgtacgactgcgatgctcgacacgtgcttgccggagcagtgaggttggcagagtcgccgccgagcgcctggcgtccacgccgatggtgaaactgtctgctgggtggtccaaaacagtgcctgaggcccaccctgatctggacacaacctcttttcgtgcacaggctgctgccaagaccgagaagcaggcgaagaaggaccttgctttcccccggcggaagtacgccgtcaaggcctgatctggattcatggtctgtaagaagtgacgctcggctctcgctacgaggacatggcgacagggtacacgggctgccgggtgcatgggagagtgctggtcaaaatacggttgcagcagcgagggtgccagcacaggtggcaagcgggcgagccatggcgtgaggtgtgcggcaccccggggatagggtgctcaggttatgagatgaaaaatggctggcccattccgcggtgcgggtcttcttagcctcgattcagacaacacaactgtgggtctgctcatccagcagcagccgtgcctgcttcacaggccagcctcctcgggcgtctgtgtggtcatggcatcgacggcatgtaccgtctgctgcatctcctcccagatggcctgtgtgagtgagaggggagacggcctgatcgtcaagtcagcatgggcatgccttcctggcccctaccaccgcccatgctgacgagtttgcgccaggctccgccgcagtaccttgtacaccaggcgttgtcgggccaccgcattcttgccgnnnnnnnnnntagggagaggggaaacggcctgatcgtcaagtcagcatgcgcatgccttcctggcccctgccaccgcccatgctgatgagtttgcgccaggccccgccgcagtaccttgtacacaaggcgttgtcgggccaccgcattcttgccggcaaacgccgcggagacaacatggatctccacatgcctgccatcgccgcctgcatccacgatgtccacctcctgggcttccagcgccgactggatctttgacctcatgccggcaatgagctcagactcgctgctgctggcgctgctggcggcccgcaaggggctcatgaccagtgggcggtgcagggtggacggcgttcgcacaatctgctgccgaacccagccagcacgcgccatgcgcacggctcccgacatacgcatcatggcgaacgatgtcattttgtctgtgcaacgtaggtcagcgttggaaattgtcggaggggattgtacgaggaggtggccactgtgtggcgcccacgaccccattctgactccagtcttacctgtacctatgttgagatgaagcacagaagtgatgcggtgcttaatgattatatgtatggtagttcatcgatcagcatcgctcctatcagagtaagggctgtcatttgtcgacagcacannnnnnnnnnatatatgtatggtggttcatcgatcagcatcgctcccatccgagtaagggctgtcatttgtcgacagcacacgattagctgcgcgcgcgcggagctggctaggctggatcgtgctttgtgaagtgcgctgcagttgagcatacgcgcagatttcgcaacgtatgtatgcatttggcctcaatatgtgaacgatgtcttcatctgtgcattctcacagacctggggtgctgtcgcctggcaccgcacgcgtcggctcccctagcctgcactcctaagtctcagtgacggcaaggagcttttggagaaatgcaggaccctgatgcggagtctatcgtgggaatcttcaaccaggtaggacctggatgagaagctggatggcttgcagctcctcgtgtgcaaagtcaaggacctacgtgccctccctgcgcaggtgcacccccccactgccgtccagcattgcgctgcgatctggctgacggcaccagcacaggagggatgcctacctgaacttgtggtctcaaaaggcaccctgctggaggtatacactgccaggtgacgatggcaggacagcgtcgagtgattctggacagatggagacgaggatagcgctgccgtgggcactccgcgatctgcacagccactccggggtacaggcaacgctgcacccatctatccccaccctgcagctgcgctggagctgatgtgaagctgatgctcatcgcctccctcacgctgcctggccttgtggagtccctggcctgcatcccgtatcgctaccggggccgcggccgggactccatcctcctcagcttcaggcaagtgcggagggggtgcagatgatcagggttactgaggatcttcagacttaggatcagactctctgatccaggtttgcgagggtggcaagccggtatccacagcaagtcggcttgagtgcctcagcccaaacactgcccaacccaccttctttccctcgctctatcgcacagggaggccaaggcctcggtcctgtgctgnnnnnnnnnntacagcaagtcgaattgagtgcctcagccctaacaatgcccaacccaccttcttcccctcgctctatcgcgcagggaggccaaggcctcggtcctgtgctgggatgcgacctcggcggggctcgtgacctcgagcctgcactactttgaggccgacgagggcatgcggggcggccgcgccgccttcacccgcgggcccctggccgccggggacccgctgggccgctgcggggcggtggtggtttacgacaacaagctggcggtgctccccgccatggtgcccgagctgctggagctggatgaggcggcgggcctggcaggcgcagggagggtgccggaggcgggcaccgtcggcaacagctatgtggacgatctgggcggcgccctggacatccaggaggtgagggtggggggcctggctgtcctggcggctgnnnnnnnnnncgtagacgatctgggcagcgccctggacatccaggaggtgggggtggggggcctggctgtcctggcggctggtttcacgtggtggggttactggggcgctgcgctgtccagccgtggcgtcgtgtgctttatggggtccctgtactcccagtcatgcgctgcgccccagggcgtctgcgcctgggggcgcaatggccgtcgcggcgatgcgcctgaggctactcgcaccccccctcccccccctcccctcgttcaacaccccgacctgcctggtcactgcccccccgccccaggtcaaggcagccaccttcctgcacggctactccgagcccgtgctgctggtgctgcacgagccccggcccagctggtccggcgcgctgcgggacggcagggacacatgcgtggcctccgccctgtccctgtccctggcgcgccgcacccacgcctgcatctggtccgcgccgggcctacccaccgacgcccggggtctggccgccgtgccctccggcggcgccctggtcctgtgccgggatggggtggtgttcgtggcgcagggccagagcctggccctgctgaccaatccccggggacggcccggccccgcgcccccgcccctcgtcttcgaccacacggggacccagctgccgggcaacacggccgccgcctacgcccgcgcccacctccagccgcacccggtgagggtggggggttgtgggacgtgagctgcgacggggagcgtgccgtcaagcagggcatgttgtgcttgccagcccgtcggccctgcaagtcgacaaagtcatgcatgggactgatgcttgatcatctgcgatgctgtcgtcacgtccaccatgcccgtgatagcgagggctggcgatgctgccaggcaacgtggcagaccttggtcgaggccctgaaacgagcatgctcggatgcgccactctcccgccccctgcatccagcgcgtcatgatcccacaactcctcacaggcgacgctcgcaacaatgctgtccaccagcccggccgcacccgggctggacgtggagtgcgacaccggcgcgctgggctggctgacggccagcactgcattcctcagtgtgaagacgggccagctggtgatgctgcgactggagcgcaccggcggcgccgtaacctccatcactgtgagctgcaggggaggaggaggggggggggatctgtacagtcccctgaaatgtgagctcagggcgtgccttggggtggattatttgggtggccctccgctttgggacctgccgccagcctcttctgaatcttgattcgacgtgggtggaggcaaaactggcaggcaactcatgtgatccccctgatccgcacggtatcatcttcacagatgacgctggccggcgcctctccgccagccacctgcctcgcctcggtcggcccctccctgctctttctcggctcagcactgggcgattccctcctagtgcgcgcagaggcagctgctgccgcagccgacgcccataatgtatcaatgggcggtcagggcggcgccccctccccgcacagcaacctggagctgagcgggggcgaggacgaggaggacattcttgagcgggatggcggcgaggggccgggtggcgccgcacagcccatggaggtggacggccagtacgcagcgccggcctccgccggcgcgcccgcctcggccgacgacgaggaggacgaggccatgcggctgtatgggatgtccctgggccaggaagatggggcaggggcgtccagggcggcggagcccctgcgctacgccctgtctgtgctggacgcgctgataaacgtaggccccatccatagcatcaccatggcaggtgcgggacgagggggccaagtatgatggggcaccctactaacagcgaagaccttctccatgtcacagttgggaagaacctggcaaaggcagtgggcaggtgcatggtccgcaaaacctggcacccccccttgacctgggaccctgctcacccatcctcagacgtgccgggggagcgccccttcctcctgacgtgctccggctctgagaagacgggagccctgtgcatgatgcgccccagtgtcacacccaccgtcatcacccgcgtgccgctaccaggtggaggaagggggggcggggggggg

SEQ ID NO: 29095 - DNA, 255 bp, Chlorella protothecoides
tgaagcgggcctcctcctgaggaggaagacaggggtggttgtgaggggttgagtggagcggggtgtgatgggatcaggaggtctgcattgtgtcttgaaaggcactgctcaaggatgcaaggttaatccagacatgcccgtggcaaaggcagtacctgcagaatatctacacacgcgtgccccaatgagttccttccaccactgcaaaagccctcgactccccactaccctaaccacgcataacacacacctggt

SEQ ID NO: 29096 - DNA, 61 bp, Chlorella protothecoides
aaaaggtatagttgttggaagaggctgcagcatgcacacccagccggcgcaggcacaatct

SEQ ID NO: 29097 - DNA, 61 bp, Chlorella protothecoides
ggggaagaaggcgaggcagtacgaggcggggcggcgccatgccgccgcccgcctcgctgca

SEQ ID NO: 29098 - DNA, 242 bp, Chlorella protothecoides
tggggtgggtgggagggagggagcacggggttcttctctgtcgggtctgcagaaccttgggtttcaaagcaggacacctcctttgcgggagagcgagccgctcaggtgtgatgtgatgcccacacattcaccgacaccctccctcaaccgacactccggcagatgtctgagggcagtgtgggggctgcgcccgaagcccgacaaaaaggggacagaggagactcgggaggctttccccttcc

SEQ ID NO: 29099 - DNA, 72 bp, Chlorella protothecoides
ccccctgtccctcatcgttcgacggtgtcctctacatatgctcgcagatgaagcagcacctgagggaggtgg

SEQ ID NO: 29100 - DNA, 61 bp, Chlorella protothecoides
ccgcacctctgtggcaccaaatatctttctgagatccacctccttggcagcctcgggagag

SEQ ID NO: 29101 - DNA, 61 bp, Chlorella protothecoides
gtatgcctcgcaggggcaggcactgtgtcatgacacctcgcatcgctccaaccgtaccaac

SEQ ID NO: 29102 - DNA, 61 bp, Chlorella protothecoides
gtctctacccaccaagagcacatgggtgagagtgggattgaagccggaggggcttcccagc

SEQ ID NO: 29103 - DNA, 61 bp, Chlorella protothecoides
gcatcctccccatccccggcatccagccctttggcctcgccatccccagcggtcagccccg

SEQ ID NO: 29104 - DNA, 119 bp, Chlorella protothecoides
tgagagcgacgacgacttcgacatgctggtcaagaggctggagaccctgaagcccgacgagcacatcctggtgggtggaagggtttccagagcttcctactgcttggatctgtggggtc

SEQ ID NO: 29105 - DNA, 119 bp, Chlorella protothecoides
gctggcagtgtgggtggtggcaggcagggcgcagcctcccaagggccagccgcgtgtgcgtctggcgtgcgccaacccactccatggcgtgatctcaccgcccctgctctgctgactgc

SEQ ID NO: 29106 - DNA, 74 bp, Chlorella protothecoides
ggaagtgagcgggtatggggcgcgaggagagccttgcgagtccagactgtgatgctgcgtgtgaccgcctctgg

SEQ ID NO: 29107 - DNA, 75 bp, Chlorella protothecoides
caggggaggtggactggaaaccacgggaggtggactgaaaaccaggggaggagggcttggtgggcgaggtggtgg

SEQ ID NO: 29108 - DNA, 112 bp, Chlorella protothecoides
tgaacctggccagacccaccagacagccagtcccgccctccggcatccccttcagcctcccagatcaggacagagtgcaaattttcgaaaggctcacatcgatgatgctgcg

SEQ ID NO: 29109 - DNA, 75 bp, Chlorella protothecoides
cggtgtccccggagaggggcaccgcctgctcaccgccctccgtgccggctgcctcccccgccgccagcgcagcct

SEQ ID NO: 29110 - DNA, 67 bp, Chlorella protothecoides
caagctcgccagcgagggcaagaccgtgcccggcaaggcggcgtacgagaagtggatcgtctccagc

SEQ ID NO: 29111 - DNA, 116 bp, Chlorella protothecoides
ctggagatcactttcgaagcagatactgcagcatagctcctccatgcctcgacactgagtcgcctacattatggtaaatatacacttatcatgtggacaccctgcgctcacggggt

SEQ ID NO: 29112 - DNA, 61 bp, Chlorella protothecoides
aagggaagtgttggtctcagcaccactgtcaactcacctctcaaagggtgtggcaacacta

SEQ ID NO: 29113 - DNA, 169 bp, Chlorella protothecoides
ccatctacttcgagtccacctccggtgaggcacaccggaatcgaggcccaccagatatggatattatgtcagatctggcgtgcgggcatgtttgatagggcaggtagcagccaagcgaaaccacctgattcgcttgtggtattttccgggcgcgagaacctggttgctc

SEQ ID NO: 29114 - DNA, 76 bp, Chlorella protothecoides
tgacttgggtgggcgcgaggttttgacatgctgagaaacgcttggaatgccttccattgcacggactctgtgcaca

SEQ ID NO: 29115 - DNA, 1581 bp, Chlorella protothecoides
  modified_base (182)..(258): a, c, t, g, unknown or other
  modified_base (398)..(407): a, c, t, g, unknown or other
  modified_base (1200)..(1209): a, c, t, g, unknown or other
  modified_base (1429)..(1438): a, c, t, g, unknown or other
cggcgcgccgggcgggcgtgcgcgccgccggcgcggcgctgatgtggcgcctgcaggcgctgcaggaggccggcgccgcggctgccaccgaggagctggaggatctggcgcgggagcgcgacgccctcgtggccgcactggagctccggctccaggaccgcggcgtggctggcgacgaggtnnnnnnnnnnnnnnnnnnnnnnnnnnnnnnnnnnnnnnnnnnnnnnnnnnnnnnnnnnnnnnnnnnnnnnnnnnnnntggttatcagggagcgcgggggaggaccacctgatcgtgctcctggcggcctcgtggtcccacagctcccccacacatgcgcaccacgcccaccccggccccgcccctgcccccccctcctcattcttcacatgtcagannnnnnnnnntccacagccacccccgccccgcccatttccccccccctcctcattcttcacatgtcagacctgcgagacgctggccgacacctacctgctgttcgggcgctccctgcacaacagccccctggcggcactggcctacgagcccagcgctgccgccgtggcacgcttctggcgtgggtgcgaggatctgatccgctgcctggaggcgacggggcccgagccgacaggcgacgccctgccgccccccgccgggacggtgagccctgggcgcgtgcgccgcctgctcctccgcgcctcgcagctggtggtgtttggctccgtggccgccgcccccctgctggcggcgggcgtgctttcccactggggctgcgcgccgccggggctgggcctggacgacctggcccgggagctgacgcgcctgctgcgcgccggggactcgggggcgctgcccgccgcgttcctggcggccatgcaggcggcctgggagcgtgcgggggaggcggagccgcccgcgccgggggacctggaggagggggaggagccgcgcgacgcctgcctccgcgacttcaacgcgctggcgcaccgcttcgcgcaaaagtactcgggcttcagcgccagcgccgccgccaccgcgcacgtcgtcaaagggggtgtgacctgggcgctgcagggcgccccacaccgcatcgacttcctcatggtgtgttgatcggggggtgagcggtcacaacgcctggtgggtgcgttctttcagcccgtggcactgcaggggatgaggggaaggcatggtcggagnnnnnnnnnngcgcctggtgggggcgctctttcagcccgtggcatggcaggggatgaggggaaggcatggtcggagtgctgggagaaggctttacgaggggatgctgcggtggctggcagcataggccctccgatcatgcgaccccgactcgcgccaggagcggttggctaacagcgctgccgccattttccctctcggcacactgcacacagggcgtcgcacactttgnnnnnnnnnnctggctcacagcgctgccgccagtctccctctcgtcacactgcacacagggcgtcgcacactttgtgaccaagctgccacccgacacggcctcccaagtccttgcattcgtccaggcgaccgcagagaggggtgaggctgtga

SEQ ID NO: 29116 - DNA, 167 bp, Chlorella protothecoides
gaacttccctccatgggccagtcaaacgtatcgagccgccgtccacgagccaccccgcgcagcatcccgtctccgtgcccacgccttcccccgcccagcctgaccctcaacggaccctgcaccccagacactctccggccctcacctgctggtccgccccacgcctc

SEQ ID NO: 29117 - DNA, 62 bp, Chlorella protothecoides
catcgaaggggcggcggagggcaaaggtgacgaagtgggggggggggggggggggggggggg

SEQ ID NO: 29118 - DNA, 67 bp, Chlorella protothecoides
gacgtcgcaggtgacctccaagcgcgtgaccaacgctaagagccaggagttcatccgcacttccctg

SEQ ID NO: 29119 - DNA, 79 bp, Chlorella protothecoides
ccctggtcaccttcagcgcgcccacctgggtgtactaatgagcttgtacttgagtttaaggacactcacctggctttcg

SEQ ID NO: 29120 - DNA, 61 bp, Chlorella protothecoides
ccccctgcaggaatcgggagagggacagacagatagcatcgcctatggattcgcggggatg

SEQ ID NO: 29121 - DNA, 64 bp, Chlorella protothecoides
ctctgctaccaacaccatcgttccgctggtgcaacagcgcttcctggagctggaccgggacggc

SEQ ID NO: 29122 - DNA, 61 bp, Chlorella protothecoides
accctagtgcgtgtcgctgagcctattgcatccctcgcaggaataagtgctgaccctgcag

SEQ ID NO: 29123 - DNA, 97 bp, Chlorella protothecoides
atggcctgcttgggctgccctgacagtggctccccattgccctctcagccttacaccaaggaagccgacccccatcacacctcgcccccctctgtcc

SEQ ID NO: 29124 - DNA, 61 bp, Chlorella protothecoides
ttgggcactcgtccacgaagacatcgatgatgatgtctcccttgctggtctccaggatcac

SEQ ID NO: 29125 - DNA, 131 bp, Chlorella protothecoides
ctttaatttgtctgccattcgcaatacacctagtaagcctggcgcgcatgtatcggggggagtgtcactcaaggattgccgcaacggactctggtgcggttggcaccccgtacagatctgctccacctttc

SEQ ID NO: 29126 - DNA, 80 bp, Chlorella protothecoides
caggacgcactccatgttggctgtgtcctcctcactttgccgatatctcaataccattctgagcatcgattgaacccctc

SEQ ID NO: 29127 - DNA, 77 bp, Chlorella protothecoides
tggggcgcgggaggggtcgagcacaaagattaggattagggtgacgcgctgctcacaggcgccaggcatgcgtcgtc

SEQ ID NO: 29128 - DNA, 79 bp, Chlorella protothecoides
aggacgcagcaggcagcggtgattctgcctcagatgatgccagcgaggatgaggcaggagcggctgaggcgaatggcgg

SEQ ID NO: 29129 - DNA, 61 bp, Chlorella protothecoides
gagaagaccattgcgaattggcacgcaaagaccccggactatgtcaagaagctgcaccagt

SEQ ID NO: 29130 - DNA, 242 bp, Chlorella protothecoides
tgctcagagctccatgaacggccttgtttgactcaggtcataccatgctcatcgactccagtgtcctgagatcagggcaatttcgtgcctcatcccgggttcatgattcagcggcggggctgcgcgacagcagcgtcgacgcgcagagggctcgcccagcccccttgcacagtcagctcatctcaccatcgcaccgcccatcttcccctcattgcagccaagaacttcacaaaggcgaggga

SEQ ID NO: 29131 - DNA, 111 bp, Chlorella protothecoides
gagcctgtgcctgcccaagtcgtgccaggcgggcctgcagccgccgcggatccacggcaatcgccgggcccccaaggcactgccacccctcgccgcacgcagcgacgagat

SEQ ID NO: 29132 - DNA, 76 bp, Chlorella protothecoides
acccctctgggcctcatcgctggcaacgactgtcgccaccaatgacccatcaatccgtctcgggcctcgagaactc

SEQ ID NO: 29133 - DNA, 79 bp, Chlorella protothecoides
tgtccctgcaaaggtgtgaggacctggtgtacgtcctgttttggggtcggtccaggccggagactgataccgaaacgcc

SEQ ID NO: 29134 - DNA, 76 bp, Chlorella protothecoides
cccagctctccgccttgcaatgatggggggggcactggaggggccgaatgtcgcgctcaggccatcgtgtggctgg

SEQ ID NO: 29135 - DNA, 205 bp, Chlorella protothecoides
ctcctgtgcgatggatgcagggcagggggggccttataagcacaaatacgcgtgcagcaggggaccggcagcggggttccaagtggctgcatgacatcattatctccaagcagtctgcatagccctccttcgcatcgctgtgctggcctcatgagtgcgctctcagacctcggagactggctgtggggactttgggctggcttgc

SEQ ID NO: 29136 - DNA, 73 bp, Chlorella protothecoides
tactacaaccaggttggtgtgtgtgtgtgttgggggggaggggggggagagacgaagaggaaagggatgggga

SEQ ID NO: 29137 - DNA, 118 bp, Chlorella protothecoides
tcggaccctgtctcaccatctgaaagggcgccttaaaggaggagtctctcgcgcaaggctttctgggaccccactcaaacgccgcctacccctcccaccgcccccgagcccctcgaca

SEQ ID NO: 29138 - DNA, 121 bp, Chlorella protothecoides
tcaggcagtgagaaacagggctgatagaaccgatgctttgaatgagatgaatcatgcgcacgccggatatgttcgaatcctgagaaacttctgcaagatttccagccctcagggcagcatg

SEQ ID NO: 29139 - DNA, 88 bp, Chlorella protothecoides
cgtgacgctgtagccgttcgtccgccagtggcccgcggagtaccacccgcagccctcaaagcggctaaagttgaagaggagggcgaag

SEQ ID NO: 29140 - DNA, 5600 bp, Chlorella protothecoides
  modified_base (568)..(577): a, c, t, g, unknown or other
  modified_base (1526)..(1535): a, c, t, g, unknown or other
  modified_base (2386)..(2395): a, c, t, g, unknown or other
  modified_base (2703)..(2712): a, c, t, g, unknown or other
ggcggcagcgcgtgccgcacaggcggggggcgcgctgggctttgcggcgctgggcgcgctgcggggcgccctcgcggtggtctcgcgggggagcgcgctgcagcaggccgcctgcctctgcctgatgagcgggctgtggggcggggcgcagggctatgcgcgcatgctaggcgcggggctgtcgctgccgggcaggtgcctgggggcgctggccctcggggtcaggctgctccgcctggcgctggcccggaggcggtgaggctggtgcggcgccgcgtgggggaatgagacgaatcatcaccgcagcccagtcaagcgatcgactgttggctgcaggactcgccacgagcctccacctgtttttctcgccttgtctgcgcaatactttcacgtgctgtaccaccccaagctcccctgtatctggccagcatgtatgctttctggccgccgcattcctgttccaaccctactacccacccgtaccacctgccacagctgtacccaagaagcagcagcgctccatacctgccagtgcacctgcctgagtctcaggcgctgtacacgcagnnnnnnnnnnactccacacctgccagtgcatctgcctgagtctcaggcgctgtacatgcagagaccccaacaagcgttccctgacccagccatggtgcccatagcatgtcaagagctgcagcatgggtcaggttgagggggtgcaagggtctgcggttcctccatcgggcccatcccagtctttacatctgtcctggctggggggtgacatctgctcaatcgcaatcacagacggtgggggatggggcaggagtgcaagcaacagggcgtggaaagaaacaggggcgaatgtgccggttcacaatggccgtgggcagcacgaagctatgtgccgcaaatgagcaagcgagatcttgctgtggcgcctgttgacaaggtgtctggggatggatcctagcactccgaaatttggaaagaaggcaactgcagacaccgggggcggtgtgcatgagcagagcaactgtggactgggtctccaatgtgaagccagccgacgtcaggggagggtacgtcgtgtggaggcaggccgtacacggtcaggtgggtcgggtgtttgcggagcaggtgtcccgcagtccttgaacagaaatcggccgaggagctgtgggtgcaggtgggtgcatgcaacgtcgtgtgtggtatgtgtgtgtgtgcatctgcgagaaagagagtgagagtgccatggaaaaggaaggcttggtagatgatggtatcgggagtgcagcagtgcaggaggggagcctgaaatatcagtagaagaagggcccaggctgcatggaaaaggagggagcccctgggagcacgaagctccggggcacttgcctgcccagggtgtctcggaacagcgctcggccctgggagggagtgggcgggtgggtcggaatggtgtcagcggtggatgtggggttatggtcgtgttcttgtccttgtggccgttccaccacctagtattccgcccnnnnnnnnnncaatgccatggtcgtgttcttgtcctcgtggccgttccaccacctagtattccgcccttgcctgcagcgccccatgccagtctccacccctcacctcggcggactggccaatcagccgcctgcactctgcctcgcactgcgacacgtccatcacctgtgcggaggtatgtgtacatgtcagatgcatgggcgtgatgtggactccctcagggccagctgggcagctggcaaatccttgccccagttataccccatgcaagcacgccttagccgaccatacttccacaaccgaccctcctaccctctgtccaaccccttcccagtatccaagccccgcacactcaccgcgacgatgctcatggacttctcccggccaaacacctggccgatgccgcggcgggagagcgcaaacacgacggggacgccgtgacgcgcggcggcgctcagcagcgcagtcaggatcttgaccggcttgatggcggcggtggcggaggggcggacgtcgggggccacgatgagcaacgccgcattgggaaccaccttggacacctccttgagggagcagaagaagcggcggggggggctaaagccgggggccatgccctgttccaggctggtgagctccttgagccgggacagcagccgctgggcggtgaagttgagctcgtcgttgatgatctggttgcagtagggctggtaggcaccctccgtccctgtcagcacctccgccggctccggctcaggccaggtgtaggcggctgtcatgtcggagataccgctgctgcaggggctgagcacgccaaggggggagaggcctgcatgcgggctgtacaccgcctgcaggatcatcnnnnnnnnnnatgtaggcggctgtcatgtcggagatcccgctgctgcaggggctgagcacgccatggggggagaggcctgcgtgcgggctgtacaccgcctgcaggatcatcgagagggaaagaaggtaggaggttttgctgtggtaccatcgtcgcacggcagtggggtgtggctggggtaccaaagaccgttgccctggcatctcgttaaggacagctgtagcatgcccgccgctgccactggctgggtcctcgtgaccacgcccaaagggtgcataatagttacgcaaagcaaatcactcgagcaaacccactcnnnnnnnnnnaggtcctcatgaccacgcccaaagggtgcataatagtcaagcaaagcaaatcactcgagcaaacccactctactcccagtacattattaaaagtatgaatgagtatcggcgagtcccacgttgagatttcgatcccttgtttacccattccccgcagctcccacccaacttaccttgttgaggtcgaggctgttgcacggagggtgggccctgaatccagccgctctcttggcttcattctgcccccagacgctgtcgatggcgttgggataggagcggggggcgaggggagggactccggggtagggaagggggagatcgcaggcccggggatatgggtgaagccaggtgcagtcgcggcctaggctcacgacatccgtcggactatgcgaacaaagggaaaagtgggtttttagagtctattatagagggaatatagcagcgtggcctgctcgccctggcccctgtggtacgtcgggtcacctggtggggtgggcacatacgattttgccatccggctcgagcggctcctcctccctgtcgagcagggactgtgatgaagtgcttcgctcgccgcttgcattgctcctcgaccggttgacgagctccagcgacctgaacaggtgctccaccagtcgctgtcgatattgctcgtccagttccatgaggtgaagaatctaccactgcagcaagccagaaacctgctgcgtgattttcttggaacccgctttgcgtatatattggagtttacgtccttttcacgatgtccatgtttcgtatctcccaacgacattttcaacttaaatcctccatggcaggttcatgttgtgtccatgaagcccgtcccttgccgcctacatgtccctccaaagttaacggggacccgctcgacgtgtcgcccgtcgatgagcccatgcaacccctacaagggccatctgcaacgggtttaaggctctcgtttacatggtacaattatacaaccatcaagtaattccgacgacagacatccaggccccatgaaggcgagcggacggcctcatgtctccgtacagcttccgtattgtgcaaatccaaaagattcggggcgtcagtgtcgtgtccggggtcgccacccaaccccgcgccagcatggttcaggagtttctgtgtgcagcgcctgaccatgcccccgcagctttcaaggcaacctcctcgcatgtgactgccctggagaatcttggcctaccaagtgtctggcgcatgggttcgcattcgtacagcagcaggccgcattattcgaagcgcattcaggcatcagcagcagagtggtgcacaagacaggcttgtgaccaccgccgcgtgccccgtctacttgtaaaactcaaaggagtcggatgacttcctgaccaccaccttgtacgccttctcaaagtccttggggaggatgacgtagcgatttttccgcaccgccagcatccccgcctcctgcaccaggagggcggtgggtaggctcggtgtaggggcagatttgttggctgactcggcgaatgggaggggagcattgccaacccagatcgacagcgatcccacgatggagtgctccttgcagcagatgatgccgccgtacaccccgggattcaacaccccgtgccagcctgaaacccacgcatccacgccctggcatgcgtcgccgggggaccgcccaaccacgcaggtgcacgcacctggcagatggaggagatctcggcgttgttgatcttgtcggggcgtgccacgtagtcctccaggtccacctccgggctgagattcatcttggaggtgcaggactggaaaaccaggcgcttctggcgccggtctggcagtgggaactcaatcttgcggtccaggcgcccgggccgcagcagggccgggtccagcgtgtctgcccggttcgtcgccatgatcacctgcgacgatgtgggccttgttgctctggggcctggagggaagtatcctgcccggtcccccgcctccggctgcctaggggagcccactctcggcctgcacctcggtgagcatgtcccgcacatcaaggcccccgagaatccccatgccccaccaccttcccccccccttcctccatgcaccttgacgtgtgtggcctgctcgaagccgtccatctgggtgaggagctccatgaggatgcgctggacctcgcggtccgcgcccgtctgcgcgtcgaagcgcgcggtggcgatggcgtccacctcgtccacgaagatgatggagggcgcattctccttggccaggcggaagacgtcgcgaaccatgcgcggcccctctcccaggtacttttgcacaaactcggagccgacgacgcggatgaaggcggcggtggtgtggtgcgccaccgccttggccagcatggtcttgcccgtgccgggggggccgtagagcaggacgccgcggggcgggtcgatgccgatctgctcgtacagcccgccctgggtcaggggcagctccaccgcctcccggatctcctgcttctgcacgtccatgcccccgatgtcggcataggtgacgtcgggccgctccgccgcgctcatcaccgagatggtgctgtccgcctcgggcggcagcacgtccaccagcgcgttggagtgccggtgcatggccaccgaggcgctgggcttgagcagctcgcggttcagcgtggacaggatgcgcacgtaatagttggagccggtggtgctgcccacaatgcccgtcactgggtccaccatctccaggaactggccgatgaccagggggacggcctggatgcgcttcacctcctcctgcgcgcgcagcagctcgttcttgaggctgcgctgctcctccttgatgtactcctcctgtgggaagagggggggtggggtggggggtggggt

SEQ ID NO: 29141 - DNA, 112 bp, Chlorella protothecoides
gcgctggctctccaggtgcgatgccaggctggaggcggtcttgcactacccctaccataccataccattgctctgctcgcccgcaatgcgatttgaacctcttccaagccgt

SEQ ID NO: 29142 - DNA, 130 bp, Chlorella protothecoides
gttggcgtgaggatgatgggcctctaggaagagtctggtgggaaatttattggccaaggggcagccctgttccaccttcgccacgatccatgtgcccaatcctcccgcgctacccacctgaccagctctc

SEQ ID NO: 29143 - DNA, 230 bp, Chlorella protothecoides
gggccgagtctatccgaccagggcagcagaagtagattgtttatgcccagataatatatgttgatgtactcgaaagagccctttcatatgcgtccattcaccacggctaccgacatggcgctctgatggacccacacccggtggcgggggattgcggagatgcgagcacgcaagactgatcatatgcttttggtctcctgagcgaccgctgctgagttcttctacactct

SEQ ID NO: 29144 - DNA, 61 bp, Chlorella protothecoides
gatgatcctccccacctgggaggcatcatctccagcatggatgatcctccccacctgggag

SEQ ID NO: 29145 - DNA, 575 bp, Chlorella protothecoides
  modified_base (167)..(176): a, c, t, g, unknown or other
cctgccgccgccgggccgcctgccgccgacgcggcgccgctcgccgacgcggcgccgctcgacgacaccccctcaccctcggcccccccacttcccgccaggtcgggctgcgcgccgctgccctggcccgaacccccggagcgcagcgtggagatcttgtaggtggnnnnnnnnnngcggcgccgctcgacggccctccctcaccctcgacgcccccgttccccgccaggtcgggctgcgcggcgctgccctggcccgaccccgcggagcgcagcgtggagatcttgtaggtggccaccacgttggggtggtgcaggctggccgccagcaggccctcccagacggaggggcccagggccacgctgccaggcccgctctgcaccaccttgacggccacgggcaccccgcgccagcgcgcacggtacacccgcccaaagtcccccgtccccgccagctcccccagctccaggtcctggagcacgccgaacttgacgcgcatgcgcgaggccgccagcgcggccgaggccggcgccggcgggaccgcgggcacgtgcgaggcggccggcgcctcgccc

SEQ ID NO: 29146 - DNA, 61 bp, Chlorella protothecoides
tcggctccaggttcccggtgacgaggcagggcatgaagtctgtgtcttcctggtgaccagc

SEQ ID NO: 29147 - DNA, 93 bp, Chlorella protothecoides
ttaaggctcatcgcccgcggcgtccgaataaatagccccaagggtcccccctgcggagctgtttccgggattgtggcaccctccaaggtgatt

SEQ ID NO: 29148 - DNA, 61 bp, Chlorella protothecoides
ggctcacaggcttgccagaccaaccccgcatcgtgctccgcaatgcacagatgaacccgga

SEQ ID NO: 29149 - DNA, 153 bp, Chlorella protothecoides
atctcccagcttctgtggggtgcgattttcctgtatcctaagtctctgtatctgtacggtgccacatccatcttggacttgtggcatgtgtaccattttgggggacaccctcatgccaccacgagctccctccgcaatgacgacctgcacatg

SEQ ID NO: 29150 - DNA, 120 bp, Chlorella protothecoides
ggtaccaccctgatctggaggaaatccaggtagacatgttgcagagtgtctctcagacctgcaagaaagtcacggaatgcgccactccttcttcctagagagtcccagccacgggacctg

SEQ ID NO: 29151 - DNA, 61 bp, Chlorella protothecoides
caggaccgccctgcgttcttggcagccgcttgcacgatgcatggccaccaaggagatcgct

SEQ ID NO: 29152 - DNA, 182 bp, Chlorella protothecoides
gggggggggccaggacgcggtgctggggaagggaaggggtgatgggtgtcgcggcgcggcgagcctgggacagggcagggacgaatgtgctgcgtctgtgcgccggtgtgtcggccgtgcagggcatcctggggtccccagagaggcgaggcagtgcccacgcaggacggggcagccgcgcc

SEQ ID NO: 29153 - DNA, 61 bp, Chlorella protothecoides
gggggagttccctcccaccacaggatcgtggtggctctggcagccggccctcatcaccccc

SEQ ID NO: 29154 - DNA, 120 bp, Chlorella protothecoides
cagtggctgtgcacaccttgcatagcaaaactactccactgatcactcaccaatgttgtcattcccaacattcttcgcgccaaagttgtgcttgcccttgttgccagagccaatgttgcc

SEQ ID NO: 29155 - DNA, 80 bp, Chlorella protothecoides
aagaacagcctgccctgcctgcacaggaggaggaccgcgcgagtggcacccacatgcccccagcagggcagcaccagcct

SEQ ID NO: 29156 - DNA, 74 bp, Chlorella protothecoides
agtcagaccgagaagaaggaacaactgccagatccagattgattcacatgttcgggttgcccttctctgtcctt

SEQ ID NO: 29157 - DNA, 61 bp, Chlorella protothecoides
cgcatacattcaattccttgcagcctgggaccccatgtgtatctgacaacggtcgacagtg

SEQ ID NO: 29158 - DNA, 492 bp, Chlorella protothecoides
  modified_base (147)..(259): a, c, t, g, unknown or other
gtccgccctggtgagtacactacatgcatggtggttacccacgcatccactcaattttaatgacatgtagagagtagcctgatactcctagacgcctcaatgcattgctatgcgccacacttgcagatgccgcccttcccgtgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcctctggccctcgcggcagctccttatccttcgagtcctcttccggcagctctgccagcaccagcaccgggggcgacggatgggcatcctcctctgtgaagagtcacattccctccccttcaaccagcggcagcaatactggcagtgatgatgaggcctccggcaccaagtggggccacccctggaccccctggaccaagtccaactggcccgcagactggccttcct

SEQ ID NO: 29159 - DNA, 61 bp, Chlorella protothecoides
aggaagggtgtctaagaaccgcagcgcacgacccgatgccaacacgagcgggctgcaggcg

SEQ ID NO: 29160 - DNA, 79 bp, Chlorella protothecoides
gtataccgaggtcgcttgtatgtccatcttgcccccaccacccctgtcccgctcctatccggacatgggaggccccgga

SEQ ID NO: 29161 - DNA, 61 bp, Chlorella protothecoides
atggaatcagcaccagcgaccaggcaacacactcttccattgctggcccccaactcccctg

SEQ ID NO: 29162 - DNA, 80 bp, Chlorella protothecoides
gggacaatggcgcacaggttgggatttgggagcagctgtcgtgtgccttacagccgtgctccctgcatccgctgcaggcc

SEQ ID NO: 29163 - DNA, 182 bp, Chlorella protothecoides
cctcctcctcagctcctcgcctggtgtcctggcaggcgcctcctgctcaatgggtttggtactgacgagcatgaggaatccacggtgaagcgccaagatgtcaagtcagcctctttccgctccagaggaagggtggtttctgcctagctcctccccacccatcagactcaccatgggtccag

SEQ ID NO: 29164 - DNA, 9634 bp, Chlorella protothecoides
  modified_base (1206)..(1215): a, c, t, g, unknown or other
  modified_base (1465)..(1474): a, c, t, g, unknown or other
  modified_base (2548)..(2557): a, c, t, g, unknown or other
  modified_base (2847)..(2856): a, c, t, g, unknown or other
  modified_base (2950)..(2959): a, c, t, g, unknown or other
  modified_base (3507)..(3516): a, c, t, g, unknown or other
  modified_base (3761)..(3770): a, c, t, g, unknown or other
  modified_base (4227)..(4236): a, c, t, g, unknown or other
  modified_base (4836)..(4845): a, c, t, g, unknown or other
  modified_base (5184)..(5359): a, c, t, g, unknown or other
  modified_base (5447)..(5456): a, c, t, g, unknown or other
  modified_base (5532)..(5770): a, c, t, g, unknown or other
  modified_base (6787)..(6796): a, c, t, g, unknown or other
  modified_base (7301)..(7310): a, c, t, g, unknown or other
  modified_base (7783)..(7792): a, c, t, g, unknown or other
  modified_base (9138)..(9147): a, c, t, g, unknown or other
cgaggcggggccgccggcgctggccaccctggacctggaggccctgaccgccgccagcggcagcgaggagcacggaccgccgggcgccgtgccggacgtggccacggccgccgcgctgtccagccaggcgctgacggtggcctgcgccgcggacggcggctgcctgctgctcgcggccggtacccctgtgccggaggccgtggcagccatgcgccggggcgggcacaccgtgtcggtggtggtggggcccggcggcgaggtggtgggcgtggtgagtttggtcaccctggagcgcctgctgctcgccgaggcggcgaccgcaggcggggaggaggcgcagtgagcgggcgctcgtagcttgactcaagggccctgtggctgaaagtctgcatcgcctgcagggtatgtgtttcaacgatgaattatgttcctatgacgccctagtcctcccccacttcccacttgcttcccctcgcatgcttctgatgcccggcgcgcccgtgtccaaagcacacgcagcgtgatgttgctccaccgacggaacagggccggtggcacctaatctgggggtatgctttattgctagcatcttactaaagttaaataccattcatcatcgggaccttacgagctcgtcagcgtggcacgcacattggtggccccgcactgtcgtgaattcgtggcgcagcctggggtcgcagagcgagctgatttatccaaagtactgcggccgattaaataatcgagcgacctggtaaaccaccttcggcgtggggctgggagctctgggtcgacgactccgaacacaccaccaaaggctcgccaccatgggtgttcggatacgcctggctcgcttcggacgcaaggtgcagaggaatagtgagcaggagaaaagtgatgggagtgggggttagctccaaggatgcaaactgaacctgcgtgctcctcccaaacccctgccgctgcagaacctgcccttctaccgcatcttcgtggccgactcgaggagcccccgggacggcagacacttggaaatcgtgggccactacgaccctcttccaggtagggggctgggtggtgtgatgccgtatttcctgcaatggtgccagggttggagggtgctcagtgcatggttctttgtttcctttgtttgccaggtcgatgggttgcctctacctctgacttgccttttaactccattgctcnnnnnnnnnngtgcatggacttttccggcgcaggctggaaggcaggagtcgacgacaacccttgcacttgccgagctttggtttgggctcgcaaccgtgccgcccaccgacggtgtagccctcattcgtggcatgcacaaccccagcattgagagtcagcatgggtcgtcagtgctctttgccatacatgcagtgccttacagaggttcatctgcatgcttttggttcagcacggtatcatgtgcagtcctggtccttgnnnnnnnnnngtgtttcctttgtttgccatgtcgatgtgctgactctgcctctgacttgccttttaactccattgctctgtgcaggtcaggacgggaacaagcagctgggcctgcacattgaccgtataaagtattggctgtcggtgggcgctcagccatcgaacaccgtgggtaggctgctgggtcaggccgggatcatcccgaagccgccggcagccctgcatgctggagtcgtcaagaagcccgagaaggagcggaacaagaaggcctgattggcatgcatttttccggcgcaggctgaaaggcaggagacgacgacaacccttgcacatgccgagctgtggtttgggctcgcaaccgtgccgcccactgactgtgttgcccccatttgtggcatgcacaaccccagcattgagagctggcatgggtcctcagtgctctttgccatacatgcagcgtcttacagaggttcatctgcatgcttttggctctgcacggtatcatgtgcagtcctggtccttgggaagcaaaggatcattcacagcacgcaaggggtctacttgtaaaaaggcaccaaattgggagggcagatggtaccagaagccatagcagaatgtatgcgagcttcatcatctgaccgtcagattagcaagccgttggagctcaagcagacgggctggggtatcgagctagaaaagtggtggcgccacagaggcatgggattgattgaaacacttggtatccagggtcaaattgtccctggcttcattgccacagaggatggtcatatgcactgcactgagaaggtgctctcctcatcacgaaacctggatagtgatctgcatcccatcctgacagtggacatccacctcacaggcaaagtagtaggtgcccgccgagtcaaacgtcttgctgaaatttccttcggtcgacagtgcgttgctcaggacttgcaggtcgtcacagcgcccggcgccaggggcggatgccacattgtgggggacaccgccgtcccacgaccaggtcacctttggggttggggggagagaggtaaaaactgaccgatgtgctaaggatggtgannnnnnnnnngccgccatcccacgaccaggtcacctttagggttggggggagagaggcaaaaactgaccgatgtgctaaggatggtgaaaatcagcgctcctcagcaagattcccagcaacacacttgccatcgcacggtcacgcccacaaccccaccaaaactcaccgagtctccagatgggatgttcagcgtggggtatgtcacccccagcttccaggagacggcatggtcagctggcgagacatgggaagacgggatatgtcagatcatgcacctgtcgtggcaggtgcaaaggccnnnnnnnnnnggtcatcgctccgtacgccatggtgcggggtcaagcgaactggtatgatctggccaaacgaggatcgaccttcgagaaccgatggtgcgctatnnnnnnnnnntcaaatccgatcacacaccggcgaggaggttccttgatgcaaccgattttgagcccaggctgaagacacagagcagcaatgatgctgcaaggagccggctgctagtcatcgctccgtacgccagggtgcggggtcaagcgaactggtgtgatctggccaaacgagaatcgaccttcgagaaccgatggtgcgctatttgtgtgtgaaggcggtccgcttttgtgacataatgaggggcaaatttgccttcatattttcaaattcccacggtgttggccgtgcctcacctgatggatctgcttccaacgattcgtgattctgctccgaccattacaaatcctcagcaccatcctccgccttcattatgggaaacctcaacggagtttttcacagtgcgcccttgcgttcccacttcctgatgtaaagcttcgcgtagaactacacttgcgccatctggatcacaaacacttccatgggcgccaggtacagcttagaacctgtttcatgaccgatggtgacccagggggcactgccgctgcgtaatcagnnnnnnnnnnctcgccttcatattttcaaaatcccacggtgttggccgtgcctcacctggtggatctgcttccaacgattcgtgattctgctccgaccattacaaatcctcagcaccatcctccgccttcattacgggaaaactcaacgaattttttcacagtgcgccgttgcgttcccacttccttgtgtaaatcttcgcgtagaactacacttgcgccatccggatcacaaacacttccatgggcgccaggtnnnnnnnnnnctgaccctcatcgcagtggtcgccaaccgagcacgcaaagaagtaggttcctgccgtgtcaaaggtctggctgtacgtcccctcctctacaggatccccgctgatgggcgtcaggtcagtgcagctgtctgctgcagtcgcggtggagacgtcatggggggatcccatggaccaggtccaggttacctgtgcgagaatagggatgagggtcagattacatggaatggagaatgagcgatgcaaggaggccgccgctgattgctaccagccatgccatcctgatttgcgagctctgcttcatggcagagtgcttgccgcaaactcacggtgtcgcccactgcaatttccagtggtgcatagggagtcccctccatccaggtaatgcttagctcctctgtaagaggcaagggtgtaagaggttcatattctgaaaggcatggaaggaatgcgtcgcagnnnnnnnnnnctcccctccatccaggtgatgcttagctcctctgtgagaggcaagggtgaaagaggttcatactctgaaaggcatggaaggaatgcgtcgcagctctcgacaacgtatgcaagcctcgcattggtgcctgtctgcaatgcaaggtcgaattgagttcatttctagcccaacataaaaggagggcagatttggtctgtggcacagccttgtgagcatgactgctgcatgaacggaggcaatgctggggctgacgagtcccgcccacgataaaacccttgcgcgtggcgcacccgcgagtagcttccggttggaggggaggccctggacgaggacgagcccgaccagcgagatgatcagcaggcatgatgttgacttcatcctgcgcaagaaaaacatggtggtagccatgagggtgtacaaggtcggtcgggcaaaattggtcggttgggcaaaatcggtcggtcgggtccttgcggccactcatggctcactgaaaatcttcatgggaacaaggacaacaccctactcttatatcatgtatgtaatgcaagtatcctacatggatagcgcatacgactgggcatgtagcatgaaaagggnnnnnnnnnnaaaaacctttatgggaacaaggtcaacaccctactcctatatcatgtatgtaacgcaaatatcctacatggatagcacatacgactgggcatgtagcatgaaaagggatcatgggtcatcatcccttcacaattgttggtgttcatgggacgcccacaaaagcatcgtaccttgttgttgaggctgttttgtcgcagatgctcacgagggtcaccgtgtttcttcaggcagaagttttgtgttgcctgccttgtaacgaggatgctctcaacgcaggctttgccgacgtgtgcgctacgcgcgcgtaccccttccgatggtgcagtacaacgctcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcaggttccattcccaccctttcttttgccccacaaatcgtctccggccgtccaggacagtcccatccaacgtttgcgtacaggannnnnnnnnntcatggtggaagccatgagggtgtacaaggtcgatcgggcaaaactggtcggttgggcaaaatcggtcggtcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcttcaggcagaagttttgtgttgcctgtcttgtaacgaggatgctctcaacgcagactttgtcgacgtgtgctctacgcgcgcgtacccttccgatggtgcagtacaacgctcggtactgcggatgatcacgagctgtcaatgcggtctgccggatcatcaggactcggcgctggtctgctgactggtaattattgttgcgattcctgcagatggacgaatgccatgcgcaactgccttctattcacctgacgaaggtggaaatatcctaggcagtttccatacccaccctttcttttgccccacacatcgtctccggccgttcaagacagtcccatccaacgtttgcgtacaggataatcttcgactttactcgggactttcacggtccctcaagaatgtgtatggcaggcccacacactgcctcgcggccgtctccccacctccatcaacgtggccgggatccggatccgtaaaccgggctcatttttctcaacgaatctatcagactaacactcaaaacctgtgtgtactaggctaacaatacatattaagggttcatgctcagcaaatgcatgaacgcggatgtgcgaagcgcggtgcacagggccagcgacgcccgaccctgcaatacagtacattcccctctgtcccgcctcctccacccaccatctagaccctgccgccgctgcaatacaatctgagaaagaaggcttgatctccaacatattcaatcgtcttcccgaagccaatccagtgtgcaagagacttacatctgttctgtccaccactctcacccgcttgcactggtcttgcgtcatctcatgacgaaatgtaggcttcaccttctctagcccctttcagctcgtctttatcgatttcaccccgggcttattgggttttgccctcgcataaaagctatacgaacgttgtactgccagcattgctgttcatgtggagcgattcagagacacggcttaaagtctcctgcctacaattttcagctgatatcannnnnnnnnntgcgattcagagacacggcttaaaatctcctgcctacaattttcagctgatatcaagcagcaagccttctgtagataaaagattacatatccccagtaaaggcctgctcgtcgttgccaagtaaatgcatgttgtggaaggggaaaccaaacactgcatttgcaatctgaaatgcagggggaacctagatctcaaggtagaactagagttgcttgaaatgggttagctaaaggagaacgccgagattcatcatctgataccgtgtggatgagggtgtggagcccaaactaggtcgccaggtctctcaggtgggagagtgttgcttgagagggtgaggcgctgacaccaccgtcaaatgtgattctcacaggaggaggagaccggatcctaaaacctgttccatgcttccctcatccgactgacccacagttacagtgtcatccgctgcacggccgtgatatgcctggcaggcatagtgattactgagaggataacgtaccatccnnnnnnnnnnaaaatgcaggggtaacctagatctcaaggtagaaatagagttgcttgaaatgggttagctaaggaagaacgccgagattcatcatctgataccgagtggatgagggtgtggagcccgactaggtcgccaggtctctcaggtgggagagtgttgcttgagagggtgaggcgctgaaatcaccgtcagatgtgagtctcacaggaggaggagaccggatcctaaaacctgttccatgcttccctcatccgactgacccacagttacagtgtcatccgctgcactgtcttgatatgcctggcaggcacagtgattactgagaggataacgtaccatcctcaacggcatcgttatgcacgtgcagagttccattacttatcaatgtgcaaggtgttgtcatgccaatatggcttttggttctgatgtctcgggttcatggtgatgtaaaggaggtgcaggcgtccatctcccccagnnnnnnnnnnatgcaaagttccactactcatcaatgtgcaaggtgctgtcatgctaatatgacttttggttctgatgtcttgggttcatggtgatgcaaaggaggtgcaggcgtccatctcccccagtcactgctccccgccccggatgacgaaacagtacctcgtgagaaatgcccagggatccatcccccttgagctgcccggttggagctcgtaatccacaatcttccccagagcagcttcagagagtagctccaggttttgcatcaagcataccatgtgctggaccaattcttaggggtgggtggggcgcgccatcacccccccgagcggccccccggcctgcgacaccatggacgcgagcgaggcctggagcggccagtccgatgcgagcgagaccaagtgcgtattgcggggaccgtgtgcctgggaggatgttcatgcccgaaacaatcccagtccgtccacccttgggtctgcctcgtccctagcgcgcgagtgctgaccgagcgcctgattccagcggatggactgctgtctcgcgaccaacagcaagtcaatatgatgcatcatgcttactccaagcctggcaattggtggcgcggcccgcctcactgtctcacccaccttatcaccccaggctttgggcggggttagagcccaagctcgccggcagcaccgggacttcggccccctcccaccccaggtgcatgctgctgccggaagaggtcgtagtgttattgatggcgagaagggaagcatgtgtggagggactcaacactgcatgaccgccccaccggcggcagccagacctcagcgcatttgtgtcccctggctcccccctttccagacaccgcaaggccccgccgggtcgggcaggacggcgcagccctcgcgacacgcaagcgcctttgcgtgacagggaggaccagcgcatgcgtgagctgctggactccattctgtactccttcctgccggccgccttcgagaggctcggggcctccgctccaaccggcgagctctctgcagacgattgccgggtgagctggacgccgcttgtgtgattggtttgaggagggtgtgtttgagagtggacttctgtcttatggtggctgcctgtgttctgggctccgaaggtcatgtgccatacccgagcatggcatgcatgatgcaccggtaacagtagaccggcatgccctgaggcatccctccccccacccctgccatgcacatgtgaatatggtgcttccctgccccacctccgggtccacgagccaagcatccaacctggcgccacgagacagttccccctccccccctgacgctcaggccgtggcgtgcgccgcgctggtagnnnnnnnnnngttccctgccccacctccgggtccacaagctaagcatccaacctggcgccacaagacatttccccctcccccccccctgactctcaggccgtggcgtgcgccgcgctggtagcggcggcactggtcgctgcgccggccggcttcctggagttcctgctctgcgtgccgtggctgcagctgggggcccagctggccgcgagtggcggcgccccgcccccagagctgggtccctggggcgatgcccccccgctcctccgcccctccctggccgaggcctcgctcctggtcaacgtcaggctggacgcacggctgctggactgcacgctggacttcctgggacgcggactcgcgctgcacgcactgccgcccctcctcgccgccgcgctgggtgcaggcggcgaagtgggggtggccgacgaccgcaccgcgggaggatccgccgccgccgccgccgccagcggtggcgcccttgctgcggcccccgccg

SEQ ID NO: 29165 - DNA, 121 bp, Chlorella protothecoides
acaggccccagcaaaggaccagacaatgggcctgcaccccggcgcactcctctttgcgtcccgccccctggccccgcagctcctcaggccagcgccccacgcccccgcacgaagcgcgtga

SEQ ID NO: 29166 - DNA, 70 bp, Chlorella protothecoides
acatgtggcaacagaatttgtgggattgcctccgtggaggtttgcaggcatgccagcgggtgcaccgcaa

SEQ ID NO: 29167 - DNA, 78 bp, Chlorella protothecoides
cgggtcctgtgagggggaatgtgggtgtgtaaagggttcgtggggtgaggttgaggaggtgggaggtggacagcctgg

SEQ ID NO: 29168 - DNA, 75 bp, Chlorella protothecoides
aatggcacgaggacttttcgcccatgccttaagagtgtggtcgcggggtctagaggagcttgagttcctaggatc

SEQ ID NO: 29169 - DNA, 73 bp, Chlorella protothecoides
acgtgctgctgcgcaaggagaaggaggctgccgacctgctgggcatcgtgcagggtctcatcacgcagcacgc

SEQ ID NO: 29170 - DNA, 80 bp, Chlorella protothecoides
ccatccagtctcagcacgccgctctcatcggacatgtgcagtcgggtcgtcgatcggcggggcgcgcgggatcccgcatg

SEQ ID NO: 29171 - DNA, 61 bp, Chlorella protothecoides
tcttgccagttgccatgagcggcctgggggccaagcaaggtggaaggtgctggagagcaag

SEQ ID NO: 29172 - DNA, 69 bp, Chlorella protothecoides
cctgcagtgtgcaagggggagcgatccctgcttgaggatgcaccggacacaggcgaaatgccaggcaga

SEQ ID NO: 29173 - DNA, 121 bp, Chlorella protothecoides
cacgttgcccagctctgcgcccgacagccccggcaggtctttcgccagctgggcgaggtccacgtccgggtccatgctggtccgccgcgcgtggatgcgcaggatctcctcccgccccacc

SEQ ID NO: 29174 - DNA, 79 bp, Chlorella protothecoides
gggcctgccccatctggatcctgaagtcgaacgagaccctgctcatagccccctcacaacctcgttctccaccgctcta

SEQ ID NO: 29175 - DNA, 76 bp, Chlorella protothecoides
attgcgaggcagattctttttacataacatgatagaataactaaggttgcgagtgatcggccgatggtgtgcactc

SEQ ID NO: 29176 - DNA, 587 bp, Chlorella protothecoides
  modified_base (215)..(224): a, c, t, g, unknown or other
aagctgccgccggcgggcgcgccgccgccgcccacgcgcgcctcgcccaccgtggcggcgggcacgcccgtggtcgaggccctggccgtcgcctcggtctggatggtcgccctgctcaaaggcctgtgccaggtgggttgaagggcgttcttttggccggggtgtgtgtcctttctcccccactggttgccagccgcgccatgccttcgcccggnnnnnnnnnngggcctgtgccaggtgggttgaagggtgttagtttggccggggggggggggtttccttcctccccccccccggttgccagccgcgccatgccttcgcccggcgccctcccctgccacggttccacccttcgccccaccagtcacccttccctggcgccccccgacgcgcgcaggacaagcagtaccggggcctgatgtcggtgggcgtggccgcggtgtccgtcacgggggtagcggccttcgagcccaccgacgccgcgcgctggacggcggtgctgggcagcgtggcgccgcgcgccccactcgccacgcccggccgtgcgccggcgggccctggcctgggctccccgccctcccccctcg

SEQ ID NO: 29177 - DNA, 61 bp, Chlorella protothecoides
gaagcagctagagcggtacaaccctttttgaagttctctcgataggatctacgatgcacat

SEQ ID NO: 29178 - DNA, 76 bp, Chlorella protothecoides
aggatgatgtggggcgaggaatgaggtagtggatcgtatcaattcctatctgaagcgcaaccctgcagtagacgag

SEQ ID NO: 29179 - DNA, 61 bp, Chlorella protothecoides
tgttccacgttataaagctttcggacctggagatgggcggtcgggacagggacccgcccag

SEQ ID NO: 29180 - DNA, 161 bp, Chlorella protothecoides
tttgagaattcagggatgagcatgcggtttatgcgggtgaccaagggatgggtggcctccccttacaaatagctgtctgttggtggtatagaaagcccacacggaaggctttacactctggaggaagtgagtgggttgaacagggcaccaccctgatgtgt

SEQ ID NO: 29181 - DNA, 105 bp, Chlorella protothecoides
ctacctgtcaggacactcgtaatggctgtgacaacaaagaagttcatcactttccgccagcctgagatccctcattcgcctccccttcagcgtcgcaagcctcac

SEQ ID NO: 29182 - DNA, 77 bp, Chlorella protothecoides
gaccctgcgtgggccgagtgggaaggctattgatgcaaggccgaggtcaagcaggatggggtggggagggacgggtg

SEQ ID NO: 29183 - DNA, 160 bp, Chlorella protothecoides
gtctgtcagcatgtgaggtgataacaggattccctcatctgtgcgacggttgtgtgaggggtcgagtgtcacttgtcggcatgcaaatcatgagctattgaaagagagaatcctagtgttcaacttgaaaacatggcactggtgggatggagtccttttc

SEQ ID NO: 29184 - DNA, 115 bp, Chlorella protothecoides
gggcgcgttggcatccgcacagaagctgcgcaggtttatgtggccaggggtggagacgatgcgaggagcaggattttggcagagacactcagagacgggaggctcctcggaaagg

SEQ ID NO: 29185 - DNA, 152 bp, Chlorella protothecoides
cggcggccagcagctcctcgccgccctcgccggcggcggcggcggcgagggcgtctccctccgccagcagcgcctcgggacgggggccgtgggccaacgaccccgggcccgcgccggccacggcgccggcggcggccagtagcttgtccatt

SEQ ID NO: 29186 - DNA, 86 bp, Chlorella protothecoides
ctggaagccgcaacatacatggcaagggcactatgtaggaggttatgctttccaatgagggtctgaggtttcagcgattggcaggg

SEQ ID NO: 29187 - DNA, 109 bp, Chlorella protothecoides
ggagcacaccaggcggtacgacgagcagtatggccacaaggtgtacctcccgcaatgagcggaggggagtgcaggagtgcagggcatggcatgctggcatgggagccag

SEQ ID NO: 29188 - DNA, 67 bp, Chlorella protothecoides
caatctcggcatcgctccatggcgagcacagaggccggcaagccggcctggctaggtccgacctccc

SEQ ID NO: 29189 - DNA, 104 bp, Chlorella protothecoides
atttgtacgcgacctgggagctatctcgatgaatgcaaggaggtcaaggaatgcattctgaatcttacggaattagcaaggtccccagcgccaaggaccccata

SEQ ID NO: 29190 - DNA, 61 bp, Chlorella protothecoides
ctcctcccagggcgctggagggcgccctgacgaccaagcacgagacgcaggcggctgcgga

SEQ ID NO: 29191 - DNA, 78 bp, Chlorella protothecoides
gaagagacagctgatccaacacacatgaccgttccttgcaaactcaattatgcgctcatagacctgcgcgttctggtc

SEQ ID NO: 29192 - DNA, 100 bp, Chlorella protothecoides
cttgcagcgactgagatgcctcagcacaaaaaggcagcaggccgccgagggcgaccgtctcatggtgattccaacggggcagccttgtgcggtgcaccag

SEQ ID NO: 29193 - DNA, 190 bp, Chlorella protothecoides
aagggaaaaggagagagagggaccatgcgcattgcgccagaagggcagggcaccacccttggaccaaaatccatacgccccccctcgttcgtggcccatcctgcacccagaagagtctcccaaagccccccacctgccctcctcgacggcccggccagcggcggccagctctgcgtcctgggcggcgggg

SEQ ID NO: 29194 - DNA, 76 bp, Chlorella protothecoides
cccctccaggtggaagcatactgatcatttggatctgtgggtgaaatgaatatcgcaacgacagcatatgcacgcg

SEQ ID NO: 29195 - DNA, 77 bp, Chlorella protothecoides
ccccattctgctcttccgtcgcggtgcacccctgcctctgccaccctcgtcagggcggcacgctgcgcattcatgca

SEQ ID NO: 29196 - DNA, 61 bp, Chlorella protothecoides
aatcgggctgtcggcaccgttgaagagttcggcgttgctcagaatcgtctgggggtgggcg

SEQ ID NO: 29197 - DNA, 106 bp, Chlorella protothecoides
ggtgctccacactacaacactcccctctctcagcttgcgtgaatgcactcatggcaaggacctgcaccccagcaatccttcactattccataccttccccgagctt

SEQ ID NO: 29198 - DNA, 115 bp, Chlorella protothecoides
gggggagggcagggcgctgggcacgccaaaaaggcaggccacggcgaggagtgccggggcgagtgccaggcctttgccattgccgccgccgcagaagtcgatgccatccaaccag

SEQ ID NO: 29199 - DNA, 61 bp, Chlorella protothecoides
caacctccgcacacctccctttcatctcacaactccaccaggcaaggagctggaggagcgg

SEQ ID NO: 29200 - DNA, 70 bp, Chlorella protothecoides
cgagcgcgggccggcacgcaggatcactggttggggaggcgggttgggcgcgagatcggaggttgtcctc

SEQ ID NO: 29201 - DNA, 61 bp, Chlorella protothecoides
aggccccaaaccccatgcgacccggcgggctccagccagtatgtggtctgcagacggcgca

SEQ ID NO: 29202 - DNA, 89 bp, Chlorella protothecoides
ctgcgtggctatgcccaggtgtgtgtgtgtgtgaatgtgtgttttcgcggaaggggggtggggggggggatggggcatttgggttaggt

SEQ ID NO: 29203 - DNA, 240 bp, Chlorella protothecoides
gcccagccacaactctgagccaggcgaagacaagttacacttcaggctcttgaaagcctaacatgaacatgattggcgaagaggtaccgtatcctctgcacctttcctttcacattcttgatccagtgaaagtctgccaactaccaacgttccagcatggattgatttgcctaggtcccctaagtcttgaagtccgggcacactgtaatggatcctcagctttactctcagggcaatctt

SEQ ID NO: 29204 - DNA, 114 bp, Chlorella protothecoides
tgcaccacgtgacagattcgtctcgcgcgctgagttgcccatatcgacggacaccctgagagctcagatgcacaacggagcgatttgatcccgatgtccaagcaggaagcttcc

SEQ ID NO: 29205 - DNA, 66 bp, Chlorella protothecoides
cgcacccctggcaccttttccatagcccggccaaacacgggtatgccttggagtgggggatgagag

SEQ ID NO: 29206 - DNA, 441 bp, Chlorella protothecoides
ctccacctcgcctacgcgccgcgcggtcagacctgcaggagcaggagcagagcattaaggatcttcagtgcatcccgtcagtcagatattcaacactaacaccttggacaatacggtcctgccagtccctggcagccatcacggggatgccatccaaagcatcaggcctaccctgcagctcatggagctcagtgatgacgccgatgatggacccgcctgcccagccatacagggaggccttctgtgcccgcaggatgagggtcttgttctgcaggatgcccgcctgggaggcccacacaatgttgtcacctccaaagtagatggccatcagcaccgacttgagctgaggggcagggagaggagagggagggatgacgtggaatctggacgcttgggtgatctgcgggcaaggcaccctgcacaccatgcagggaaaccctc

SEQ ID NO: 29207 - DNA, 61 bp, Chlorella protothecoides
ccatcgcaacacacccccatattcagatgcacccccatccacacgtcaactcttgcaggaa

SEQ ID NO: 29208 - DNA, 145 bp, Chlorella protothecoides
tgactgcctggaatcaggcactggtggatccgcattgggctcagatacgtgagaagcgagaccagacgatgaagcagggcatgccagcggctcggcacccctcctcgctagaacgcagcgggcagctggacccatgtgtaccaat

SEQ ID NO: 29209 - DNA, 806 bp, Chlorella protothecoides
  modified_base (107)..(116): a, c, t, g, unknown or other
  modified_base (677)..(686): a, c, t, g, unknown or other
aggagggggattcggggggggtgggggaggtgatggcgatgatggtgtcgccagtgtgacggtttcactgttatgtaggtactcgacctggcaggggtcagagctgnnnnnnnnnngtgatggcgataatggtgtcgccagtgtgacagtttcactgttattcaggtactcgacctggcaggggtcagagctggcccagttgtggcaaactatgctgtcaccggtgttgttcgaccccacattgtagtcgccgcagttcccgttccctgcacagcagtggggtgggtggttgggtgtgggaagtcccaggcaggggcacggtggatgggggcgacttgagtccccactcacccctgttgaagtcgccgacgttcttgtttcccatgttctcgttgccgtcgttgccgttgccgatgttccccttccagtcggggccgcagccgggggtgtacactgtcgagcacatgaccacctgaaggtatgcgcaggcctggtcgtcggagggggtgcagaccttgcgggtctctggatcaatagtgctgatgctgaacccggtgaaggggtcatggggcttcaaatttgcgctcttgggggtcccaatcgcgtctgcgccaaagcccttgagcctgcagtagggtcaccgagggggacgaagggtgggggggccagggtcggtnnnnnnnnnngtggggcttcaaatctgcgctcttggggatcccaatcgcgtctgcgccaaagccctttagcctgcagtagggtcaccaggggggggcgaagggggggggggcagggtcggtcagaggatg

SEQ ID NO: 29210 - DNA, 142 bp, Chlorella protothecoides
ggggggggggccctagggggggttgcctgaacaggatttggcatgagttgaagccccgtgtcgtgggatccctgaagagatcagggcatgggaactcctggcagtgccctcctcccctccttgacatcctcccttgagatct

SEQ ID NO: 29211 - DNA, 104 bp, Chlorella protothecoides
caagacccttggggagaggggtgcatcaggccccctcctgacatcctggggccaggcggcaggcggttccgctaatctcgccagcaggctcgatgcaggctccc

SEQ ID NO: 29212 - DNA, 61 bp, Chlorella protothecoides
cttgtagggcgctagctccgcagtgcagcgtcggaacaccaggcactgcgcctggatgagc

SEQ ID NO: 29213 - DNA, 198 bp, Chlorella protothecoides
ggcctggcagaccagaccaatcgagggtcaaactgctgccctggactcgccctcggcacgagcctggggccctcgccctggtatgacaatgggcacgctccaccatgctgccggccgcaccccctcaagcgtgtgctcgaaccacacggtatacaccccaacagcacacccctgcgcatgcaccgaccccgctcaccc

SEQ ID NO: 29214 - DNA, 73 bp, Chlorella protothecoides
gggatgtcgctggcgcagttggttgcctcattcggcgaaccagggggggtagggggcgaggggaatggaaggg

SEQ ID NO: 29215 - DNA, 123 bp, Chlorella protothecoides
gtttgcccattggccggtgtcgcctctcttccaccacgtgagctgggtgtcatgagggtagcctttgctgcgcgcatgagaccatccacactagcacagtgagaaggcttgagctgacgcagg

SEQ ID NO: 29216 - DNA, 120 bp, Chlorella protothecoides
ctgtaatgtatcaaggttggggcagaggactctgctgcgtggccagctggctcatgaggaagggggggagccacggatggacactggcaccgttgaggctggaacatggagaatgggtgg

SEQ ID NO: 29217 - DNA, 115 bp, Chlorella protothecoides
gatttggaggcggccgcctgtgatgggtgtggaggaatgtcgatgcctgcttcttcggctcgcacacgggaaccgagcctcagtgcggtagcacatcatccccaccgctggcgca

SEQ ID NO: 29218 - DNA, 80 bp, Chlorella protothecoides
agatcttcacttggaagagtgcgtggtccttgagggtgcccggcacacgagggggactccctctgtgttgtgcctcgccc

SEQ ID NO: 29219 - DNA, 62 bp, Chlorella protothecoides
tactccttgcatctttgtggaatcatcatctctggtgtttgggggccagatgcgtgagcgga

SEQ ID NO: 29220 - DNA, 113 bp, Chlorella protothecoides
gggggggggaggggggacaaggtgagggcatgtaggttgtaagtgagggagggagagcaagtggagcgatatgagctggagggcagcgcaagtggcccttgtgaggacggatg

SEQ ID NO: 29221 - DNA, 118 bp, Chlorella protothecoides
tcgacaatttaatgggcgttcgtgatagatttcttacggtcgtggatccacctaaaccggtttccccggcatggtgcgcttgcgtagaagtggagtccacgtcggacattctgtgtcc

SEQ ID NO: 29222 - DNA, 61 bp, Chlorella protothecoides
ttgggggttatgcgtttagaagggggggggtaagaagggttagagtgagggtggcgtaggg

SEQ ID NO: 29223 - DNA, 462 bp, Chlorella protothecoides
  modified_base (133)..(352): a, c, t, g, unknown or other
gacagggcgatcagaatgccaggaacagccaaagggaggaatattgacagagagtatggacgctgaacaaaagttcttgatctatatacacgccaaaccctgactcaagcatcgcactccccacacaccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggaaatgggggggagcttttctgggggatgctgaggtggagggaatgtgtgctgtgcaaagccagaggagcatgctcgtacccgaccaggcagggctgggcagccca

SEQ ID NO: 29224 - DNA, 61 bp, Chlorella protothecoides
cgccatcatcgggtacctggtgcaggcccatggcgacaccaacgagctgtggaactcgctg

SEQ ID NO: 29225 - DNA, 89 bp, Chlorella protothecoides
cttccagcttgtgttcctgccataaatgcatcaaaaccagcatcatggttggatactgaaagtgagcttggtatatgttcatgggtagt

SEQ ID NO: 29226 - DNA, 121 bp, Chlorella protothecoides
aagtgagcttggtatatgttcatgggtagtgtgtgactaggctctctttggggcttcacactctgttgctatacgaaggtgtgtctagtggacatctggtagacaagtgaggaaatggctt

SEQ ID NO: 29227 - DNA, 65 bp, Chlorella protothecoides
gggaaggaggagccgtctagcggcgcggaccggccacgatcaccattgccagccccgctgccgcc

SEQ ID NO: 29228 - DNA, 70 bp, Chlorella protothecoides
attggaggccttggcttgcccggcatgcgtcacttgggcagtgggaacaactcggacgctgctgggagca

SEQ ID NO: 29229 - DNA, 67 bp, Chlorella protothecoides
aagctgagcattgctccatcgtcgacaagcggtatccgtgctccggctcacagacccaatgatatcc

SEQ ID NO: 29230 - DNA, 1495 bp, Chlorella protothecoides
  modified_base (406)..(415): a, c, t, g, unknown or other
gtgccctggaaggcgaagccgctgacgccgaccaggccgcgcaggggcgcgcccgccgcggcgcgcggcagcagccagcccccgcccctggcgtcggcccgcttggccgcggccacgtccagcagcgtggcgatgtgggggttcactgtggtcaagtgcacgatgccctgggtcagcgcgtggctgaccgccagggtggcgtgcgccaggcccgccacccctgcggcggcctcggtgtgccccacccaggccttggcggtggtgacgtgcaccggggtcgcggcgcccaggcccagcgcgctggccgcccccatctcgatggggtcgcccaggggcgtgccggtaccgtgcagctgcagggaagcaagagctgctggcgggcagcccgcaaaggccagggcggcgnnnnnnnnnngctgcagggaagccagagctgtcggcgggcagcccgcaaaggccagggcggcgcggatcacgtcctgctgcgccgggccattgggagccgtcaggctcgaggaccgtccatcctggttcaccgcgctccccctgatcaccgtcagcactgtcagcggggcagtgcggtcgtcgccgccctcggctgcccactgcaggttgagcacacccatggcctcgccacgcgtgtacccatctgcaggcgagtgaggtttggaggtgtcgttgggtgggtgggagcgactcgattcgggctgtcatgcacatcatttgcccttggggccaaggtgattgtctttccaacagttggccccggcgattatcaaaccattgaacacatcgacagcaagcacacattaccccaccagcctcacctcccgcggcgtccagggacttgcagcggccgtcgggcgcgagcatgcccgccttctggaacatggcggtgggcgagggcgagagcagcacgcccacgcccgccgccagcccgcccccggcgctgccgccccagacggcccccgccgccaggtgggtggcgaccagggaggaggagcaggcggtgtccacgcttacggcgggccccttgaacccaaaggtgaaagacaggcggcccgaggcgacgctgggcgcgccgccggtggcgctgtaggcgctgacccccgtggtccaggccgggaccagggtgttgttgtactcggcggaggcgatgcccaccgccaccgccacgcgggcggtgcgggcgggggacaggcgtagcacctcccacgcgctctccagcagcatgcgctgctgggggtccatcaggtcgcactcgttggcctgcaggccgaacagcccggcgtcaaaggcgtcgatgccatccaggaagccgccgaagcgggcgggcaggctcgcgtgcgtcggcgcgtccacgtcccagcgcgacagcgggacgcgcgtgatgacgtcggtgggcaggagggcgagcagggccgcgtcgcgcgtgcgcgtggccaccgccgtcaccgccagcgccccgtcggctgcggggcccgccgcggcgccg

SEQ ID NO: 29231 - DNA, 116 bp, Chlorella protothecoides
tgcagcgagcctcttctcttcagattgcatatgtgcgtgagcacggggacccatcctccgcctgagttcctatgcacttgagcatttgtcgctgcattgccaccgagaatctaccc

SEQ ID NO: 29232 - DNA, 159 bp, Chlorella protothecoides
tgatcttattccgcaacgctggtcaccccctcctcacaaggtgcaacaatcaaaggtgctgcaagcaacctcgctccacgcaatcccaggagcaggcgctcacccgcaggactgggcgccctgccatggcggacgtggcgtggccaagcctgagctcac

SEQ ID NO: 29233 - DNA, 73 bp, Chlorella protothecoides
ctgccggcccaaggcacactgcatagccaaagcactgcaaccacatgccgtcccatgctgtgccggaccctat

SEQ ID NO: 29234 - DNA, 98 bp, Chlorella protothecoides
cccctgcaaccccatccagtcgcccggccagcggtgcatgcccctccctccaaccccccccttcttaaccccgccgcaccttgatggccatccaggag

SEQ ID NO: 29235 - DNA, 82 bp, Chlorella protothecoides
atttgcagtcaatgcctccatgagtgagatggccaaggttgtgccaagatatggtgcccccaaactagcctccttacctcat

SEQ ID NO: 29236 - DNA, 79 bp, Chlorella protothecoides
caaaaacttctaatctgctgacagcttcacatatcacctgcccattgccctaggcccctagtgatgctactgcggcagg

SEQ ID NO: 29237 - DNA, 8088 bp, Chlorella protothecoides
  modified_base (957)..(966): a, c, t, g, unknown or other
  modified_base (1454)..(1463): a, c, t, g, unknown or other
  modified_base (1538)..(1636): a, c, t, g, unknown or other
  modified_base (2055)..(2064): a, c, t, g, unknown or other
  modified_base (2168)..(2177): a, c, t, g, unknown or other
  modified_base (2269)..(2278): a, c, t, g, unknown or other
  modified_base (3868)..(3877): a, c, t, g, unknown or other
  modified_base (5892)..(5901): a, c, t, g, unknown or other
tacgcagagtagcttaatctgcaagaacaatgaaggagtctcgccgattgccgcagactttgcctatcccaacgtctgtggtgcttcgtctagtgcagcctgcaagatctgcatgcaatgagagtggtaagttatgttggcttcttatgcaagaccaaaatatgtatcaaactggcccttgtgatgctccgtccccttctcaagccgcattcgcatgcatgtgaactcccaggcctgtcagcacagcgccgagtaaacatcctcacctcagcgacacgctcactgcagcgcgtgttgatcagggctacgctggtggacatcctcgcgtaatctgctgacttggccgcctgccatgccaccagctcctgcggcgatgtaaggcacatttggttcatgacccgatctggcacagcagggtacgatcggattggtgggattactccttacctcttcgtttcgggatttgaccttctcatactcggcatgggcggccacaattgcagcttccgcagacgcaatctcattctccagctgagcaaacttcctggccttagaagggtttcctccgaacctcgtggcacctgcgggcaccgcaggaattgagagtcagtcaaaatgggatatgggctatcagggaactttgtacagcaagctgtctcacatggatcacacctgcttcttctagagctgcagctgcttgctgtttcttctccttgtcttcttggatcagatgctccgtcaatagagcagcttcccgttccttgagggcagcaacggcagcctgtggcgattataagagaggtgtgtgttgataaacatgccatgtggctaagcagacagggccgcctgctacgcttttctagacccctgcttcattggcatgactcactggtgccagcgccagctcatcatgaaggggagccagtgcttccgtcagatgggagactgccaagcgcnnnnnnnnnntgcctgctacgcttttctagatccctgctttatcggcatgactcactggtgccagcgctagctcatcatgaaggggaaccagagcttccgtcagatgggagactgccaagcgcgccaatctccgacatcggaccgcagcctgcacgagtgtgtggtagcatgcgtgagcattggccaaaactcgtccatgtttgcttcgtgcagctcagaagtgagcaactccggaacccaccgtgccaatcctccttgactcggtggcaatccctctggcgtctgctccaaagtcagtgtagggtccagccctcgtcccctcagcctcctcatagttggccagtttaatcaaagacatcccgaggtcgcccatcactgcaaaacggggagagcatgtgctggagcatcttggccgggacgagctgaatctcttgccggcggtggtaagaatgggcaagcagcctgagtgcatcaaccagccctcactccatacctgnnnnnnnnnntcaaaactcgtccatgcgggcttcgtgcggctctgaagtgagcgactccggaacccaccgtgccaatcctccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcactgcaaaagggggagagcatttgctagagcaccttggccgggtcaagctgaatctcttgctggcggtggtaagaatgggcaggcagcctgtgtgcatcaaccagccctcactccatacctgctccctgtccttcaaactccttgacgaggtattcagctttgcgagaggcaagcgagagcttggctagatatgcctcgatgtttgcctttttattctgcagggaacaacacaaggtgtcacagagcattttggccgacacttccttaccttgaagatggacatacttcatcagaatatctccagccagcgccctcctttccccacataaatcgctcacccgtagatcggcctccttctcgcttaggtgaggagcgctgttgccaaactcttggcgcattcgctctcccatctcnnnnnnnnnntttttggccaacacttccttaccttaaagatggacatgcttcatataaatatctccagccagcgccctccttcccccacataaatcgctcacccgtagatcggnnnnnnnnnnccggaacctcctcaaaaggtcgttcgtgtcccttgcattcaaggttgcctctgtggtggacggcaaggtaggctgtgttcccagcagctggnnnnnnnnnntcggaacctcctcaaaaggtcgttggtgtcccttgcattcaaggttgcctccgtggtggaaggcaaggtaggctgtgttcccagcagctggctgggcagccttgcaacaccctcaagcaggcctccattgcggaggggggacagtccctgccactccagagagttcaagaggttgccaggtgccgtcaaaaagacagccagctcctgcagtgagggcaaggagcgatgtgggagcagatcaagtgcagttcagaggcctgcttctttccaggcctgttagggtgccacgaccatccagccagaattatcatattttcgacccacctcgcccctgccgacaatggaatgggaggccagatgattcagataccgtgtgatgtcagccaccctgcttttcacgaggtcagtggcccccagttgtccttccagtgtgttcttgtcgggccgagggaagagaaaatagccgcgatactttgtggacagcagtgtcgcgagagcctgagagcgcaaaggggcagccgttgcaagggaatggattgcaagcactttcagatattgtggcggaccgaccggcaatgcaaggccatattctccgctggactcaccacaacgtctttgaacctgcggcgaacctccacacgagtgcgctgctctgtgctgctgctgctgatcaggtaatcatagtggctggaagacaggcctgggatcataccttcctgtgatgagacatgaaatgggaggctggtcgaatgatttgggtgccagcgcctacagttaccatggcaggtaatcgtgcactctcatacctcgctgcgcttcacagggtcagagacggtgatggtgtacaggggtttggacttgacgccaagcacttcttcgctggcagtgccaaagaggccaagatcctcccgattggtgtcggtcaggctgtggcctcggactgcctgaatgcctgatgagcttgcgccctgacgtgagttcccactgtagctgcttgggctgatgaaatgggctgagggcccctccctcacattgccttctgtgaccccagcagcagcagaagttgaaggctcctggaaggaaccaccttcagctccttgtgtggttgactgcatcatagtaaataatatgctgcattaaaaatcatagatcttgtagtggttctcccactcttccattgagcactttgctcaccgggctggtgtgatcgggctcgtccacgtcaagaggaacatcctgctggagctgatcctgtggtggcgacgcggtggtgtgagtcgagcacctcgtggagtcagacctagggatttgagcctgcctacctcgtcatcttcgagcccaaagcgcagggggtcctgaacagacatggtcccgtggggcagcttctgtcgccagcctttcttgggcgattacaggctggatcgtacttaacgagccttcggagtcgcttttgcgaagaatttcaacagttttctcgggcgtgtctgtgtcgggaggcgacggagcgcgtccgattcacatgtcgggtctatgatgtgcatgaatcgcagggccctattagatatagcacggtcgactggctcgcctggnnnnnnnnnnatccaattcacatgtcgggtctatgatgtgcacgaatcgcagagccccatcagatatagaacggtcgactggctcgcctgggtgcaagcatccgccaaaagacccaaattgaagaaataggattggaaaaggatgatgtacagctgcatgagcttggcgagatgtccaacatcattacccccacgggcagggctgctgccaacagtcagggccagggtcctgctctctgcccctcaacagtgcgcacgtcacatctgccacggcaaagcagagaataatgagactgtgaagagtgaaggtcagcggcgtgcgtgcctcagcacctgcctttcaatctagtgatgatgtgtggatgaggaggcgtcctttacccctgacgccccatgcagaccagggcggagctttggaagaggtaggggcagaggtggacaggttcacgaagatgacagcctcgacctttgctcctcggccatcaggtcctgctccaaatcctgctccaccgggtgaggatgtgggtgggaatttgagggggtagacttgagtgcctggctgaagggtgcacgtttacaggagtacacagaacatggtttaagcgcaagcatctcctgcccatacaggaagcatcctgtacacagtctttgaggttcaggcctgggcggctttggtggtgggcggacttttgtcatataatgtcctgcttccttctgaccacgctgacatcccacgattgattgggtaagtttgtagctttgtagcatctgtacggccagccactgtttcagcattggacctttctaattctcatcctgtcctcctgaacctcgttctaccatgatctcacaggatgtggtctatctggattttcactgtgccttccttgcgggcacggcaatgcagcagtaaggagaaggaggcactcaactacctcttcctggccatccccctcgtcaacattgccatcccttttgttgtcagatccttcccactcgtcttcacttgtgacctcctgctcctcgccgggatgtatgcctggaaaggagtgaaaccactgtcacagcttccttcaagcaagtaggctggtccctttcctgactttgaaaagagatcctgtgaacaagatgctcgctgacaatggaaaaggggttcttgtaggacgggagctaggcaatgtcagagccccaagtctctggcctccacacttccattgacaattactataaggctgagtcaattgacttgccatgctggcgtgagtgcggaattacaactatagcaacattcttcaagtatgcgtatactgctgattagttcttcccagttggtttgcagtcaggtaacaaaaaagggcagctcatgcttacagaccagccaagatgccaacgcacactctatcacacagcgaccagctgctggcccatgaccttctggctgtactccttccatgggatgatgccgcccacgacctcctgcctggcgtctgtgctgggctccacgccagccaggaatttgtccgtggcagccgccgccccacggccctcagcaatggcccaaacctggagggatgattgcatgaggtcagcgatgattaaagcgctcaagcgcttcattgcaccctcctgcccccctcggccccttggccctgccgcctgcacccaccacgagggactggccacgccggcagtcgccagctgcaaacactccatccatggatgtcgcaaactggccatactctgccttgaagttggagcggggatcggtctcgacacccagggcctcggccagggtggcctctggccccaggaaacccattgcgagcaggaccatgtcagcctcgatgatctgggcaggggtgcaaagggaaggtgaggtcagcaaggatttgaactgccgatttctatgggcgtgagtgacgtgcatgtgcaactgtggggttgcatgcacggactggcaccacaatcttctggacaccctgacaaatcacaaaatgcagcgccgacctccttctccccagactnnnnnnnnnngaggatttgaactgccgattttccacgggcgggagtgatgtgcatgtgcaaatgtggggttgcatgcacggactggcaccacgaccttctggacaccctgacaaatcacaacatgcagcgccgacctccttctccccagactctgagctggcgctgctgaaggatgtcgcccgccccagcaccgatcatccagccccattgagcacactcaccctgttgctcccagggacctccacgaacttgggcggtccgcccgcggtggccggctgccactccacgctgacaatctccaggcccttgaggttgccctggccgtcgtcgatgaagcgcttggtcagcacctcatacacacgcgggtcggcgccgtacttggccgcggcctcggcgtggccgtagtccaccttgaacacgcgcgggtagtagggccaggggttgctggcggcgcgcgtcacagggggctgcggcatcagctccaggttgatgacgttggtcgccccgtggcgcacgctggttccaatgcagtcggtgcccgtgtcaccgccgccgatgaccactaccgtcttgcccttggcagagatggccttgccatcctccaggccagagtccagcagtgacttggtattggcggccaggaattccatggcaaagtgcacgcccttcagggacctgcattgtggggtgagggggtgggcggggggtgggccgggccgggaagaggatatcggggttgggtgggctgggttgaggacgctgggatgaatgaggggaaagccaggagcaggtgggtgtcccacgcatcagcatgccacctcccacaatgccctctcacctgccctcgatggggaggtcgcgcggcttggtggcccccgcagccaggatgagggcatcggaggaggcgcggatgtcgcgcacgtccacctcgcggccgatgtgggccgaggtgacgaactggacgccctctgccgccatcaggtcgacacgccgctggacgatgccctcctgcaccggtgaggaggggttgcatgctggctggctggccgaggggggcacgcaagctggtatgagcgcaactggcgttcagctgggacaccatgaacggcactgccggctgagacacaatgctccctagaccaagcacatcccccacgagtaccttgtcggtcttcatgttgggcacgccatacatcatgagcccgccgatgcggtcggcacgctcgtacagggtgacggtgtgccctgccttgttgagctgatcggcggcagccagacctgcgggcccgccaccgatgatggacacacgctttccggtccgcaccgcgggcggccgcggcaccatccagccctcctcccatgcctggagtgggagggggagaagaggttgtgaggtgtcaggggtttgctctgggtgctcggccgacgtgccggctcgaaagggccccttgctcctttgctgacgagatatagctttggcaagcagtgcgtggtgtgttcggccccccccccaacaccattttgactccgggtcataacctgttctgcccggccccagccccttcgggcagccagtgtgcagatctgccccccctaacacccgcctccttttccagccaggcccagagcgtggctagaagcacccaccttgtcgatgatggagacctccatggtcttgatggtgaccgggttctggttgatgcccaggacgcaggacccctcgcacggcgcggggcacaccctgcccgtgaactccgggaagttgttggtctccagcagcctgtccagtgcctcacgccaccgcccctgccagaccagcgcgttccactcggggatgagattgcccagggggcagccggtggtgcggttgaggcagtagggcgtgccgcagtccatgcaccgcgccgactgcgtgttgagcagctgcgcgtgctgctcggcgggcaggtgcgcgtgcacctccccccagtcagccatgcgctcctgcacgtcgcggaagggcagcggcgcgcgctcgtaggccttgaccccgccgctcttgaccgcggccaggccgtcgacgaccgtggggcgccccgcctcccacagcgctgggcggccgccaacgggcacgccctccgccgcatcgcgcagcaggcgcttgtactccagctcggcctccgcggcggcggcgccggccggggcaggcgcgcgcgc

SEQ ID NO: 29238 - DNA, 80 bp, Chlorella protothecoides
ccatccagcgggcagccatcgcaccgagtcgatggaggggtcccagggatgtgaagacccgacatcagctccgccactgc

SEQ ID NO: 29239 - DNA, 72 bp, Chlorella protothecoides
accctgccagggttccggatcgttgtgaaactgtgaaggctaagcggacagcctcgtagcttgcgtcacacg

SEQ ID NO: 29240 - DNA, 61 bp, Chlorella protothecoides
cgttccaatgcatgtctcaattcagcaaccctttccataaaggcacctacccctccccccc

SEQ ID NO: 29241 - DNA, 61 bp, Chlorella protothecoides
ctgcagtgcacgatgtcaccacagacggcaactcacatccttgagatgcagggcggagaga

SEQ ID NO: 29242 - DNA, 142 bp, Chlorella protothecoides
ttgctgcacgagctaaatccttctcctgccatgcgccggaccttcctccctcacactgaagtcgtcgaggacggatgccggcgcaggtgcagtgccacccacagaccctttcttgccatgtctgcagctgcatgtgtaagcg

SEQ ID NO: 29243 - DNA, 61 bp, Chlorella protothecoides
acaggtgcacttgaggggcatactcggctcccgtatggtgggcctcaagaaccgatgggga

SEQ ID NO: 29244 - DNA, 68 bp, Chlorella protothecoides
caacggagctgcccaactgatcatcggcgcagctggaacaacggagctgcccaactgataatcggcgc

SEQ ID NO: 29245 - DNA, 66 bp, Chlorella protothecoides
ggagccccagggaaccctatcccatgaaccaggtatcccccccccccccccctccccccccccccc

SEQ ID NO: 29246 - DNA, 141 bp, Chlorella protothecoides
atgcgtcgagcggtgtctgccatccccctccctgctcgcgccatatgcaatctggtgcaacccccacaccctccccagccccatctgtgctggagcaccctccctttccttgaatcttcctcaccctgcctgcttgcaccc

SEQ ID NO: 29247 - DNA, 63 bp, Chlorella protothecoides
cgtgagcggcgacagaggtcacggagtcccggtcgtgagcggcgacagaggtcacggagtccc

SEQ ID NO: 29248 - DNA, 63 bp, Chlorella protothecoides
gggggggggggggggggggggggggttgagctgtactcagcgcttgcaggaaccgacggcagg

SEQ ID NO: 29249 - DNA, 75 bp, Chlorella protothecoides
ctgccaatactgggcctcaacacacgatgcaaatgccaaccaagtgctcctcaacccttactctccacgtcaagc

SEQ ID NO: 29250 - DNA, 61 bp, Chlorella protothecoides
acgccgtcgtcacctacattggctaccaggtgggtaggagtgactgatcgttggtgcggcg

SEQ ID NO: 29251 - DNA, 80 bp, Chlorella protothecoides
tgtactcccacccgccccctcctcccacaatccttgttccgcgcagtactatcaagtttgaccgcaacgcgtgcgtcctg

SEQ ID NO: 29252 - DNA, 165 bp, Chlorella protothecoides
gagctggtgtgtgtgcttagacagggtggggccctttgtggcacgtcatcctttgctggggaataggtaactttagaggccaagcacggtgtgcagcctctcgtcccaagtccttggcctcatgcgccatgcacatcccctccctgcccagtcccgggagccgtt

SEQ ID NO: 29253 - DNA, 3810 bp, Chlorella protothecoides
  modified_base (122)..(153): a, c, t, g, unknown or other
  modified_base (465)..(474): a, c, t, g, unknown or other
  modified_base (875)..(884): a, c, t, g, unknown or other
  modified_base (1388)..(1397): a, c, t, g, unknown or other
  modified_base (1826)..(1835): a, c, t, g, unknown or other
  modified_base (2797)..(2806): a, c, t, g, unknown or other
  modified_base (3345)..(3354): a, c, t, g, unknown or other
gctgctgctgctgaatggggtggggggagctgggcgcctgataggcgggggaggggtgggccgggcgggcgagcgggtgcggggaggcggatgcagaggggctggggggggcccgggggccnnnnnnnnnnnnnnnnnnnnnnnnnnnnnnnncccgcggccacgcgcggcgcggcgggcgggatggagggcgcggtgtcggggcgccgcacgaacagccagttgttgacgttgcccagggggtcgggcatgaagggctgggtctcgtcgtgccgccactcgccgtccacgatgaacttgtactggtggtacctggggtggagggagtgggggagcgaggggagcatgcctgggtaagggtggggggattgagcccagcagcgcccacacggccacagagggagcagggacgtaggctatgcagactggactgggctttcatgcgaggaccagcttggactgtgnnnnnnnnnnaacgtgggctatgcagactgaactgtgctttcatgcgaggaccagcttggactgtgggctcgcagcctggcccgcagtggaaagtacccacatccagcaattattgatgatcgtgccccatccaggtaggagcccacacaggtcacagtcgcgccgggctcgaacaccaaggacctctcccacacgcactcaccctgcagggagctggacgatgaccgagaaggcgccaggctgcccctccacgggcgtcatgggcaccgtctccacccatcgcgtgaaggagccgcacaggtgcacctggggtgggtgtccacgccatgatcagggcccaccacagcgagaccatggtgagagtgatgcgaacaggcctgcccacgtacctgggagcctccgaaacgccnnnnnnnnnntcacagcgagaccatggcaagagtgatgcgaacaggtccgcccacgtacctgggagcctccgaaacgccacaggaacctggtggggacgtagaaggccatcccccacagtaccggcagcacctctagggaactatcgccgcctatgtttcatttcttgcaggatataccgagagggcgtggccagtccggtgcgcgagggatgctcagccaacagttccgaaaccgctccctcaccctcaaaggagcaagggtgtccaccgagtgcacggataaacgaggagggtgaccggtggaaacccccgaacgatggaatctgggcccaaattcttaagatcgagctcctcgaagggtgcatgaccactttgttgggagggtcacgagtgcgaatgtgagtgccggtgggggggatggcacctttcccgcgacacaaggtggttgtgtccttgatttgtcactcccagcatcagcctggaccccctcggcgtcaggatactcgcttacannnnnnnnnngtctgtcactcccagcatccgcctgcaccccctcggcgtcaggatactcgcttacatcatgctcaactcagaagcatattcaccgtcgcgccttcgcttgcaagggccctgttgagaaggcccaggtgacattgattggctttgcatacagctccttcccatccagatcatcgatggcagcctgggcctcctccttgctgccatactcaatcagcgcatagcccttgacaaaccctgcacattcagcgtgggaggatcggcattggtttgtatggcaggcaatccagcattctagaagccttgaatggaggtgagaaactatcgacactgggtcttgcaacatggggtacacaaccacaactcccggcaccagccaattcccaccgctgagccctgcattctcaccggatcgtcgatccaggttgaggnnnnnnnnnngtcggcattggtttgtatggcaggcaattcagcattctagaagccttgaaagggggtgaggaactatcgacactgggtcatgcaacatggggtacacaaccataaatcccggcaccagccagttcccatcgctgagcccagcgttctcaccggatcgtcgatccaggttgaggtggatgttcttgatgtccccaaactcagcaaaggcttcgtgcagatcctcctcctgtgcctcttcatgaacgcctgtcaccaggagtacccacccctccacagctggacaaggagggagtgcagagagggttgtcatggtgtttgctcaacagcgcggcgcgttgccaaggatgtctagccaaggtgccaccgagcactgaatgttcctgagctgcaccccgcttcccctcctcagtgcacccggagagcgtgcgctcaatcacacccggcgaccaaacctagatcgcctgcactcacacttctgggggccaggcccagacccggcagagggaagcctgtcaaaggtgcccccctccaacctgtcggcaaggctggtctggtcgcggaagccccggccctgcatgggtggggagatatccgtaaacacttggcttattcgaagagcgcaccatgcttcaagagagttcacgagcgctcaccttctgccttcgctctccatcgacctccatcgcttggtttctgcaaggttgataggggcaagggctcaagcagaatatagactgtgatgacagcttctggaattgtgggtaagattacactcgccatgcgccacacgccgcagcgttgtcaccacacctggactctggggagaggatgtctattgttggtcgcaccgtcagtcaaacttgcacaagataccactctgcatatgtatactttgtggtcactaaagcccaaagtgctcgctcgtttagctactggatcggttgcaggtgctgctcgacatnnnnnnnnnnttgtgtatgtatactttgtggtcactaaagcgcaaagtgctcgctcgtttagcaactggatcggttgcaggtgctgctcgacattcaggcgcggagtcactcgggtctcagcgtagcccctgctggccaacatcctcaaaatgatcctgagagtccttgggtgaactcaagccttaatgcgtcctgcggtcccaagatgtctgccttctctacattctcaatgttgtgctattcgtgatccaaagaattgcctcaaggttgccggataatctgtctgaaggtgagatttatgcgcggctcctccacacgggctctcggcggcacagcatgcatccagtgatcttgcgtgctacctcccatcaccagcagtgttccctggcccaaagagtaggttcttttgcaagcatggtcctcattgctccgtaggatgaaatcgcgcgcagctccaaatgaaaccgatgctgttgaggagggaattgcatgagactgacatggcactgaggggcatcattatgtgcgttgcacgcatgcatggacgnnnnnnnnnnacgacatggcactgaggggcaccattatgtgcgttgcacgcatgcatggacggctagcatccctggctacggcagactgtcatagagccagtgcaccatgataaactctgtcaatgaaacgcaagcatgaggtgcattgaagctgtgatgaccctcattccccttccaaaccatcagcatacacaagttactgctcacctatcgtaggctcagagccatacagaggctcattgtcgctgtgccatgacatcttgtccttcccatctcggtaataattcaggaggcagctgttgaaggaggtcccgagacaagcttccacacgttcctactccagatcagaggaggggttagggtgaccatgggcacacctggaaaaagatcccctgattgcatgcacctttctccatttgtcaagctgaacacaggacctagtttcaccttgaccgccagaacaac

SEQ ID NO: 29254 - DNA, 76 bp, Chlorella protothecoides
gcgcccgtcagcctgggcgaaggggccccgcacgatgtctggtcgcagaggccagtctgccctgccagcttgtctt

SEQ ID NO: 29255 - DNA, 61 bp, Chlorella protothecoides
ggcgcagtgggacaggtcgaagtcggtcaggcgcaggtgccccgactccagcagcaggatg

SEQ ID NO: 29256 - DNA, 61 bp, Chlorella protothecoides
atgttagaagtcgatgtcgggcacggggggtgcacagcatgaaagcacaggccctaccccg

SEQ ID NO: 29257 - DNA, 61 bp, Chlorella protothecoides
ggtaatcccagttcgtctgcgtccacatagaccttccactttccgtcatgcagcttcaagt

SEQ ID NO: 29258 - DNA, 99 bp, Chlorella protothecoides
ctccgggtgcaggtaaagcttgacgtgcatatacatccgcattgcatgttgtgcagtgtacttgcatgatcatgtccatgtcccgatgacacagccaca

SEQ ID NO: 29259 - DNA, 107 bp, Chlorella protothecoides
tctgcaacgactgcctgtgagtgggtcatagggtggtgcgttgagtaggatcaccagaagggtgtcaaggtcgaatctcatctgggcagtagttcagttcaaggtcg

SEQ ID NO: 29260 - DNA, 114 bp, Chlorella protothecoides
cgtctccgggaactcgacctccacaggctctgtcagcgccagccgctcaatctgagaggagagggatgcaactgttgggaggctatgacgacgttccagcgtctcaagcaccat

SEQ ID NO: 29261 - DNA, 106 bp, Chlorella protothecoides
tctaaagcctggggatgcacagcgcttcgtacattactgtgagacgcacaacctgctgagaccctgtgccagaagtcactgaccctggacctcccatctcctaact

SEQ ID NO: 29262 - DNA, 61 bp, Chlorella protothecoides
ggtgtacctgtcagcttctcgagtccccgcctccagcatggccccccctccgcacaggcgt

SEQ ID NO: 29263 - DNA, 25918 bp, Chlorella protothecoides
  modified_base (25601)..(25640): a, c, t, g, unknown or other
tgggggacgggggtggggggcgggtgtgttgggtgggtgtctgttcatacatgcaagggggcgtgcatgccttcctctgagggtcgagcagccccatatcgcgcgccacggtctactcttcagtcgggcggcgccggcagcacgctcaccattgagcaggacattgtcgcctcggctcctgtccccctctcccctcatacctggaaaccccagagcccggaggtggggttggcccccacgctctccacccgcccgaccaccagtgggtgggggaactggtcggtgtcggcgcggggaacgtagcccagcctgcgcccggtcaggtcgcagagcagcaccgcctgtgcgtcgtgctcattgtcgggctcctgttggatgagcaggggcgagcctggcgggaggaaaggggggaacgggcagggtcgggtgggcacaaatgcaggaggtgcactgcttcttacagagggttccaacccctgcacctcacgacgctagtccgacctcggtaacacctattgaccactgtgtcggagcatgcgaatcccaggcagagctccatcgcagcatcacctggttgcagcagcttgacggcctcctgggctccgccaaagctcaccccgacggccctgtacctctgaaagggctggcgcagggccagctggcgccggctcgacagcacggatgcccactccggctggagcgatgggggtgcccctgctgggatgacacgacatgcttgccatgcatactcacttcatcacaatcatatgaatggtatgcacagaggtacgaaagcacatgcaggcacacgcactctcccgtccacaaacccaagcttgagcccccacatccagcagaccttcatcaagtatctcggagaatctgtcgcgccttgaggcaagacacctggcttgcaggtgccgagcaggcagcctcagtggaggcacaccgctcctggtgaagcattgtgagctggtggccgcccatatcgatgcctgcggcaccgcacggaacatgcgcaagccttcaggagccagtgctgccccggtatttttgccaccagttgcaaagccaagaggaccttgctttgaacgaacagcacccggttaacaactacatataggcttcagtcattcgagtttgcatcgtcgctgcgccctctgtttggtgcgagggatgcacgacatttacgtcacagtcgaaaccccacgctgcgcatgctgcgctccctggtctgaagtccgtcctccctgagcgacacaacatgcattcaatattcagactttcaatctgccatgtcaatgctgtggtgacgttactgtagggaggaggccggtgctggccgtacctagtggggtcacgggatgtcgtgcatcccgctgtacctccgcgccctcaagtaccctggcgcgtcgtccttcccgtctgatactagagcctcaattgaagtggaggcagcacgtcccttggtcacctggctcgagaaccagaagatccggcactacaccatcccccagcggcagggtctcctggccacatctgccgatgactggcgggctgcctacggccagtatctgaccgcactggagtgtccatgctcgtcagaaggcctgccggcgaccctccagtggctctgctcgcgagcgggtgcgtgagatgtccagggtgagtgctctgctgaaggaagcactccctacacaaaatgttcccctacaatcgcacctccacacgcccttgcagtgtccctggagtatgcagaccgcaacgagcagctgaatgcctccacttccgcggcagtggaggttggcggcgccgtctccgactggtcggagcattccctgccaccctttgccgacacagcctcccctgcagtggcggctgcggtgatgcgcatgctgcgcacgctgcacatggaccaggaagaggtgcgggttgttaggtaaacgtttgggtgcacaggcgcccacctcaggcgccttgattgtcatcatcctgggtggggcaaggccccggtatgcaaagcctcagcatttgtaggtgttagcctccttgtacccaccacccctgttgataaccccacgatcagcaggtgaccccctccaccgtggagcggctgagctcggtgctggacacccaggtcctgccggccttgcctggggacgaggacaccgcagccccctccgggactggacggcagggcgtctcagccgccggcccgatcgcgctgctggccggcttcccgctcggcttttccaccggatcgccgctctccgacgcggcggctaccatcctgcgcatgctgtacctgcgcgacctgcgcggcctacaggacgtcgtggatcgggagctggagcgggtgcaggcgagcaccgtgggggccatggcggacaaggcctacggccgcccggcgcgatgacagcgcggcgacgagtcgctgggaggacaacagcggtgtggcgcgtgtagcccggcgctccctactcatgtgatttcctcttgccgtgacttgcatccgtacaatggttgagcgccaatgagggtctgcgggacacgtcgacaagcatgatgctggggtagaaggccaagccctctgaccaagcaccatggctgcagcgccgccgtcgtgtggctccggtccctgcgtcgcgcggatggcaagcgatcaggcgcgcccgcgccggcacggcacccacccccttcacggccccttgagccagtggtcctcgtgcatctcggcgcggtactgctccagcgcagccgccgcggctgccgggtcccggatcgtgcggatggcgccgtcgtcccagatgcgcagcgcgtcgaagttccagaccacgctccagctgtccacgaagttgaagtactcccagcccctgggtcacaggggaagggttgggatggggttcgagtgggggggtggggatttgtgccctcatggctcgcaaggggtgtctcggctgggcagggagctcggtgattctggccacgatctacagggtccaacttcacggtcccctcatcaaagtgtgccttgtttgtgttccgagttcatcaggcagcgtcgctcgtgcctgcccacaggatcgtcagggtcccgttccacggcgcccaccccacgttcactcctccacgccgccctctcctcaaacaccccccccctttccaaggcccctcccccgcacctctgccgcttcatgccgctgccgcggaccatcttctgctcaaagtcgcgccgcgacttggtggcgtagtggtgcagggccaggtcgacgtgagtgggctcctccgcccgcggcccctcgatgggggacccgtcggttcgcgccacgctctgcccgctgcagttgtggtggaaggcgtgcgggctccaggccgcggcggtgcagtccagccgcacgatggtcttcaccagctggtgctgggcgtggcgcaggggcaggcacttgacgaaggagcgcaggacgccgctggccgggcggtccatgtggcccgaggagccaaacaggatccagtgcacggcgagaccttgatggtttcggggggaggggtgggggaaggatagggtgagtgaggccgatcttttgggtgggaggcaaggggagttgcatcaagcaagcattgccacaggtggaagagccggcgcgaggtcagcccctccggtgagacgggctggagcgcgatccggccagcatcccgagccacctcgcgccctggccagagacctgctgcctgcgagtgcttggtggagaggtactggcccaggttcctgatgggccctgcccccccccggaagatgaggaactcgtccacgtcgatgaagcccatccaggcatgcagcgggcgcccctcctccaggcacctgcggggcggcgtggaagtggaacggtggggcacagggcggctgacgccggggggtgggcggcttgcttcacaacagaaagcagctgagggacaggaccgagcatgaggacccaggggcgcaggtgccttggtgttcgggtcgagagtatgcagaggccaacaggtttggacatggtgagcggtcgctgcactctgcatggcccatgatgtgcggcccaagtaacgccaccccactgcctccgcggcacctgtcgtaggcaaagagctgtggagcacccgtggggtgcgtgaaccgatcaaagtagttgtaggccacgaagccgctggcgatgtgggcctcgatggtagcgttcatggggggaacagacttgttgtcccagaggtagacacgcgtcacccccagcctgatcgagtcggtgcaaggggacaggacagtggaaggatacagtgcactgaatcgaggcatgcaggcgagcgcccatgggcatgtggttgggagagatcctggtctggttttcaaacagcaagcatgggcttctcttcgggcaggcccagccatgtgtcaagccgcacctcccccaagcatcccaggcaagaccgcctctgccaatctcgatgcatgtccaacctcttgtggtggagcagccactccaggatgtcctcatgggcgtctcgcacggcgagacagagtgccaccgaaccgggtgccacctggtcacctgaccatgagggaggagggggaagagtgattgctttgattacattccccgtttgcatcacctaggagtggttccatctctggacagggcatgcaacgtagcgattgcactgcaggcagcccaatgacccaattgcacaccccacaccgtgtgtcagaaatgtggaggaggtcagctcctcaggactgggctgcatgtcctgcatttccagagggacctggtacggcgccggggttgactcaaagtttgggagaggctccgaagatggtggggaggggccggcctcctggggcatggtagggtgaccagcttggcctgtaccacctccttctccattctccggggaattaggggcgtcgacaattgcctgagctacagcctctgctcctgcctcggaaacaagcgaggctgtgtgcacaggctgggggaaagggggattgttgccaatttgattgctgtctgcagctcctccagtctcctggccacaggcgagcagcgccaagcagccgaggcaggcgaagatcagcaccagccctgatctccttctcatctctcttctattcacagcccgcgtcagggatcgaccgcatcgctggccctgtttggtgcaacaactacacgggagtccgtatctcgcttgcagtcttcgatgagatggagcttgccatgccggtccagggaaccaatttcccgtgctttaatattggacgagtgttaaggtcaggtgcgtcgggtcacgggcattgtttggggtggtgcagagcgttgttcggcaatgacgcgctcggaccaggatgttgttgtgccgcctgttgatatggtatctgtcgtagcctgggatccttcagtcaatatcactggaacactgaacatgctcttcattggatttcacctcggtgtaccccaaataaggcaccctgtcctggagaggctggcatgcatctcaaagctgcatgcgacgccacctcatattccccccacgggttgcgccaccgcactcacgcccagctctcgcagaagttcgggggcgggcgccgcataccaggccccttcttcccggagaacgggacgtgcgggcgccaggaacaggtcctgtcgccaggcggcgatgctgtccggcacggcatcgctccccacccccactacagtgctgccgctgccgctcatgaacaccgcgtcaaaggccccactcccttccagccggcccttgatctcggccagctcctccaatctagaggggcgttcatcgaattggtgggaggaaacctcatggccaaggagtgcacaatcatgaacggatcatcgacccttgcacacagcgtcgcagggcccagctttcattttctctaatgggcggtgcgccagggcatccggtcaggaccccaccgggcacacctttgccttccgcgccagtacttacccttgttagggctgcgaccctgcataaatcacaatctggcaccccaacagagaactccaactcacagctggaaggcgggtgcctggaggtcgttgacgcagagggccgcgctggcgcgacgcagcccctggaggccctgcagcaggcgcagcgggtcctcccggctgcaccgctccaggtccaggcgcttgaagacggccggggtggggagccccgccggcggcttcaccagcagcaggggggtgttcgtggagaggggcaccgggcgcacatcctggaccacctcccctcgccccgtgcagtaggagcagcccgatccgaagaagacgctgatgtcggacccgatctccccggaccaggccagcaggtcgtcgtccgcggcggggcggcccgccagctggttggccgcccacagggccgtggcggcgttgccagaaccgccgcccagcccggcgccgtgcggtacccgcttgcgcagccctacgcggtaccgctcccggctccccgtcttgcggcggaacaggtccagtgcctgtgtgtgtgtagtggtttggcggggggttatgcgatgagcgtgctgcgagctgtgctgtgttgggagcatgtgatgtaggcctgtatacgtacatgtattgattcatgcatgagagtgggaatgcgtgccagcaatgcgtgcccccagcaggctcagcttgctcagcagtgcatccctcttaaccaatggggctggcctcggagattacgctcagctgcaacccctgcaccggctcacccctgctaccacaaccccatcattgccccatccatgtccgaccttgatggccaggttgctgctgtcggtaggcacgtccggcatgttgcaggtgaggacatccgcgccggcgctgctgcccagcggctcgaattccatgtcgtcgccccagctgaccacctggaagagcgaggccagatcgtggaagccgtcgggccggcgccgttccacccgcaggaagagattgatcttggaggggcacatgggacgaggggttgggatgtaagctcaacggggtgtatcttaggatgcaagggtgtgcagaccacaatgcttgcctcatgggattagcctgcggctgggtgggacacccctgcaaccccgcaccttgcatggtgagaagaggtgtagggtagtgtcgttccccacaccggcacggcagacttgcgcgctcgcgcttcgctgtcgcaatcgggacgtgcctgccgcctctatacgccgtgtgtgacaaagatggacagtgctggaaatgttcctgcccctggcctgcacggcaggctggcagaccgcgcaggccatcggcctagccgagcgctacacaagcaagaagggacggggttggcggagcagcgatgcagcaatgtatgattcgagtgttcaagttcaagctggaacactcgtcgagattgagaggagcgtttagggatcccattagagttctgcaactctcaggattgcgcgctggtgggtccggaagatatccccttccatgacgatccgaggcgagaagtgaacatgaagcaggccggcggcatgcaggccaattgtacatgaacccgatatgacatgcatcgtgaaatcgtgatgtcgcaaggaagcatggcactattgcatggggtgcagccccctcgtgctgaggtgcaccccgggcagatgcccttgcccactgcttgccacccattgcggttgatatccggccgtgggatcggccatgggcatgggctctgtaacagactgtatgccacgaggaaggtgtgtctgcagcaagactggagcttgtacagccctgccaatgtgcacgcctcagcctcgactccccatgcacacacgatctggctcccccatggcctccatgccacaggctgcagatgacctggacgtcacgagcaccgtcatcagcccctccttccgttcggcgccctggaaccaggaggccaaggccaccttggcgggtgagcccgagccatcctcccaaaccctggtcttgtttgtgagcgagagcggggtctgccgctcagccctggccgccgccgccttccaggccgcgatccaggctgtggggctggaggacagggtgcgctgccaagcggtggtgagtcacgcatgtgtttgagctgtggtctgggcagggtcaggagaaggtgaggatctgcagctgtggggaggcatggcttgtggctgggcatgcgctgcctgcctggcactcatctgaggcctctcatcctcccacaagactgcccctcccgtagtgctgtccctgcgttcgcgagagtgaatgtgcaatctggtcagcacccccgatcacctggagcccccccttcttcactggccctggcctctgctgcccccgcccatgcatgcccctcccccccctgcgcgcaggccacccagtctttcaacgtgggcgagggtccggagcgcgctgccgtcaccgcggcgcgcgccaggggcctcgagatcccgcctgacttcgctgcccgccagtttgacccgggggctgacatggcgcggtgcgacctggtgctcgtcatggacaagttcaccgcctctgacgtcctgcgggaggcgagtgggctggctgtggggtttggggggttgaccccgtgggtgtctgccgacgctgagcaaggaagggccaacaccggtgtgagcattcatcatgtgcctcaccaatgaggaccagctgcacttccatcgtcgcaccctgcctcttctcctcccagcgcgaatgcccccaccccacgtcccgcccacgcagatcacggtcttcgactccatcgacaccgaggggcggtacagcacacgcgtgcgctacttgcgccagttccagccagacagcccggagggcatgaccgagatcgaggacccactctacggtttgcctgggcttagctgcgggggatcaaggatgcgcccgggatgcccagtccacgtgtggtggaggagatgcgcatcagtgcatcatacccgtcgccgacagctgtggcaccagtgccatctgatcgagtttggcccctgcgctccacaactcccctcaacccccctcccaacccttcactccacaggcaacaccgggggcgcgggcgaggccgccgcgatgagcgccgccgcctccctcatcgtgccctcctgccagggcctggcggccttcctggccgaccttaacgcggggtgcgaagacggcgcggccctgaaggcacgcctcgcggagaccgtggatggcatgcagggcatcgactggctggtgcctccccttctccgcgccggcacctagcatcaggatgtggggggaagacagcgcgccgtggcggtctgtcgatctctgttgcccgtatatccccgccccgcccccgcacccatcgacagacctgccccacccccctctgagtaccttgatgctcatcatgttcatataacaggcacactatgtcgctggaatggctgctaagaggtacattttccccggtgcattgtcgggacttgggtggggaggggcacccggcaagcatgaaggcagggtttgggagggaaggcgtcggggtggcgggggtgggggaagttgtgggagctgacagattgtgcacgagctgcaaagagttggaaaaggggacacagtgaggaggccagcacccagctgcgcgacccaatgcaaaatttctccaagcccagccgctcctctgcactcctccatgcaccactctcagtggtggaactgggcggcctcggtggacccggccagggcggtggtggaggactggcccgaggtgatggcgttgctgacggcgtcaaagtagccggtggcggcctcgcgctggtgccgagcagccgtgtacccgtgcttggcgtcggcaaactcgcgttgctgcagcgcggagtaggcggtcatgcccgtggccttgtagccgcgcgccaagtcgaacatggagtggttgagcgcgtggtagccggccagcgtgatgaactggaacttgtagcccagggcgccgatggcgcgctggaagtcggcgatctccgcgtcgctcagcttggccttccagttgaaggagggggagcagttgtaggccagcatcttgcccgggaacttggcgtggatgcctgcggcaaaagccttcgcctcctccaggctggggtcgctggtctcgcaccagatcaggtcggcatagggtgcgtaggccagcccccgcgcgatggccagctccacgccgcagcgcacgcggaagaagccctcgggcgtgcgttcgccagtgcagaagggtcggtccacctcgtcgatgtcggatgtcagcagcgaggccgagtgcgcgtcagtgcgccccacgatgatcgtgggcacgcccgccacgtcagccgccaggcgcgcggcgaccaggttgcgcaccgcgtggctggtgggcaccagcaccttgccgcccaggtgcccacacttcttctcgctggacagctggtcctcgaagtgcacgcccccggccccggcctcgatcatggccttcatcagctcgtacgcgttcagcgggccgccaaagcccgcctccgcatcggccacgatgggcagcaggtagtctgtggtcaccttaccctccgcgcactcgatctggtcggcgcgcaggagcgcgttgttgatgcgcttcaccaccacggggacggagttgacggggtacagcgactggtcggggtaggtatgaccggcggtgttggcctcggctgccacctgccagccggacaggtagatggccttcagaccggccttggccatctggacggcctgtgggtgtgttttggtggttgggggatgattagacgggtggttaacctggctgggaggagagggtgggtggcaaggggcatgaatgtttgtaatgcggagggtgtcatgggggggcgaaaagatatgcatggcatggcaggtgccccccgtcaacagtacacatactcccgctcagcagcagcacctggttgccggagagggcgcccagggcgggcacgtagtcctccgtcttcagcagctcccacagcttctcagcgcccatgcgggccagggtgtgttccaccttcacgctgccctggagccgcttgacgtcctccgcggagtaggggcggacgatgccatcgaagcggccgggagcggcaggcacggaaatgccgttggcagacatggctaggacctgcagggtgggcggaggggagcaggtttacaatgataatagtttcggagtcattactttgagaaggtgcacattatcggcagggtgagagcgacgccaagggggctcctcgacacgttgacaccatgaccaccagcgcaccttacggaatgcagatgtattgggaggtaagctcgaggacgggtgagcttgcggtgatggtctccttgaaatggtttgaaatgtgggatgtgtgacttgcgagcatgcaacccgtttcataaagggtacacgggtgctcctggtgttgtcaagcgcatctacgtcagcacgtcgtgtcactgccgcggggagaatcacgtaacgacctcccgagagaggaggtgggtagacacccaccagcaagcagctcaggattccaggaaacagcctttgatgacactgatgagttactgtcttgagacctagcctgccagcccgagggatgcaggctctggctctcgcatggcgcgctggttgcatcagcacggtgccgctggggttgaaactgtgccccaactcccctccaggcgccgggatgacacacaatgagggcccacggacatctgacctgactcggagcaccaccgatgacatgtgcactcccctgctcttgcatgccgtggtggccaggcacctagtcgctgtactgtgctcccccctccatctgatgggtgcagctgtatacatgcagtgcacacgacacaggttctaggggcgcctttcagcaatgtgcaggagattctataagagcagagcgagaggcatgaaaatgaggatgacccaagggccccagtaggcgtgtgcagccgctcggagctgcatgctgccggggacgagggtgtttcctcagtgcagcgtggggtttgttggaggggcatgcatggtagggtcgggagcactgatgagctggcacggcagcacagggcggagcagccccgaggcgggtcagccgaggcataattgggcggcgagcctggacacgtcgacccaaccagcgccctgcagggcctcttcgtctcccggccgcgctggccgggggacctgtgagctgcgtccagggtccagcagggggacatagtgatccccacctctacgcctgcgccaggcgctgcttctcaaagtagcccgtgatctggtcgctgaccgcccagacgatggcctggccggggggggtgcgcgccaggcgcggcgtgagccccttccagagcgcgccgatgccctccgtccgccccacggtcagcaggcagtcggcgaagccggcgtagcccgcgcccgatcgcgtggcggcctgcatccgcgtcttcaccacgtccatggggttgttcagcacggggccgatgcaggcagccaggaagcccgaggccgccgactgcacgggagtcagcaccttgccatcgccgtcgcgcttgccccagatcagcccgtccgccaccgacttgccccagaacatggacatctggttggagccctgacggatcgtggtggccgtcgcaccggcccagagcttcatggggccctcctcccgcgccaccagcatggcggtgtgcaccgggcccttgtacttgagtagggccttgtcggtgccgcgctgctgctgcagccgggtcttgaccacctcgaagggcgtgacgatgagcatggcctcggagacgcccgcgcccagccccgctagcaggcgcgaggtgttggtcagccggccctccttgtcgcgcagcatctccaggaagaaggcgttggatcccatgcggagcgcgtacttgagcgtgagctggccgacgaagggggtgaggcccttccacaggctgcgcacgccctcctctgccgcgatggtccggccgcagtggaagatgccagagtaccgcccgcggctgtccagctgcagccgggtcttgatcacgtcgatgggctggagcaggaccgcctccatgatgccgcccagggaccccgcgatggccttcacggtggggctggcggccaccaccgtggccacgggggcgggctgcaggggctgggactgcttccgggcgctcatggcgtgcacaggtgtgtggggtggggctggacgcgtggggaggtcgggcgaggagactgggttctcaggagggcttggggctcggctgtcgcaatgatctgcatgaagagagggtgatgatacgtcgtctcgcttgctctgtatcctggagcgccaagccgcgtcaagcgcgtgtcactggagggtccaccggccacaaccacccgaggctacgcgcaggcagggacgcgtgcccggccgcaatgcggccaccctccaccccgcaacagacagtgtggccatgaataaaaaatgggaagacgaggcaagcgtcccgtgggctgcccaccgggcacagcagcactgcaaggaagcggacaccccgacaccaaactccgcagtccatctcacctcgacacaatgggctacaacctcaattgtttatccaaagccatgctcctttcaggtggaagtcttcgacgtgaatgcgccccatctcccgagtcatgggtttatgaatgcatgtaggaatcggtagtgaggtttcgagcggtcccggctgacgtcagcggccacctagcctggagacatgagtcatagcatgcgaagctgcgtgcagcgagctccgtgggtgtgcgcggtgcggacacaggcatggcaatcagaacttcaccagttttattcgacggactcaatatactctgacatatgctctgatatgcgggaaggctagaggccatgatactcgtgagtatttgataaggagctttggctgctgccagaaaatctacgagcaagggtcccacgcgatgtgcctaagcaccctttgagtacaatatctgagatgccaatcaccgcttgcatctaattttaaacaggggttgccattggccttgtccatggcgaaaatgttgtcggataggtagcggggagtattttgcagcaatggtccaggcctttgtcaagacagtagcacactaaaccttggcagcacattatagagtgatctaacacgtatctacagcaacgctgtgccaggtctggctgcacaatctgtgcatggccttcgccccccaaaccacacaaaacctacgactcccatccaagaatggcgttggagactttccactgtacagccactcacgcattgcgcatgtgattgtgaaggcatgtttgggagatgtggagtgaccgcttcctatcgccacggaccaacaacctggcgcttatgcttgaagtaccacccactgtggtgaacttcttcgcctctacctggcaatccctaatacaaaaaggcgcagtacatcgtcacaaatactccgaagccagcataacttgtccaaggcgatgtggtggggatgttgctataacagacctctgcacgtcgacataacgccgcagggagaacttcccgaatctttccgtgtccattatgtgagcccctcttcgtttgcccgcacgacgggtattaaaggatggcacgtaaacacacatatatatattgaacaaacacagtaggcaaaagaagacttccgcttcgtggttcctttacggatctaatggctgatctgaaggttcagcgtgcaatcgtcttccgcacgctgggggacacttctgtgctggaagacgtcaaagactggcctgttcctgttcctggcaagagacaaattcttgtggcggtgaaagctgcgggtgtgaacccagttgacgcgagtattcggggagggaaggatttccccaaggcgatcacgaagcttccacaggtagtcaagggttggagggatggatagcaaggggggcagtagagagagccagcgtcgatggggctgtttgatgacaatacgagggtttgagctttttcagatggtgcgtacgggagggacgccgtgccactccggtgttgcagtcagttcattccctcaagtggcgggaaatcctggcgatggcaccattgcatcctctccaccatatatgaggtgcatttttctcagcctgcaaagggtgtcctcgctcactaggcctcaatgaacccacgctggtgccccactcctttgggtcgagcccctgctgggcgctgagcactcttcatgcggcgctgttccatgccgtcgcaggtgtctggctgcgactttgcagggaccgtcgcggccattccagagggcacagagaccaacctcaaagtcggcgacagagtgtatggtctggctgatggttgggcgccctgggcctccgacggcagctttgcccagtacaccgtggtcaccgccgccaacgcggcacggattcctgaaaaggtgtcgtataccgatgccgctggggtccccatcgcggggctgactgcctggcaggcgctgaatgccacgggactcgatgccgggagcggcaagcgcatcttcatctctgccggggctggaggggtgggcacctttgccgtccagtttgccaagctccggggcctgcacgtcaccacctccgcctcgcctgtcaatgccgacttcctcaaggtgggtgaggggaaggtgcaaggtgggctgggggggctcagtgtcatacatgccagacacgagtccagccgttactgctatcaactaccttttcaggatcttggagcggatgaggtgtacgactaccacaagaagaacctggtggagctgtacaaggacaacccattcgatgccgtgatcgacagccgtggaggtgggtaaagtgtggagcgcacgctgtgcctggcagcctaccctgactcctgaacgcacggtaggatgtctctgttgtgactgtcaactgtccccctctcactcactcaggcaaagatctgtgggaggcgcgaaaggtgctgaagcgcgacggtgccctggcctcggttgagagcaacggatacgtccgcgactatggctgggggggccgcgctgtccacgcctacagcttcctgagacagtgcgtggctgcaccgtggggcacaggggagagggcctcccatgaggctgatgtccagcatgctgccatgatgctgcccctgtgtgatggcggtgtggagtgctggtcagcacatgtgcgctgcggtcccatggcacactcagctcctgccccaccattccaatgtgcacaggaaactgaccgccatcgcgcgcctgggcccctctttccaccccatcttcggcagggcgagtgggaaggatctgacagacatcgtcggcctcgtcgctgaggggaaggtgaaggtggtcatcgatcgcaccctgcccctgggtcaggcggcagccgcccacgagtatgtcggcaagggccacaccaagggcaaggttgtgctcactgtggatgaggaatagctgcctggacaacgtgtaagatgattgccagtgcacaggcctcaaactctgttgcgcccatcagcagcgctgtcgttgtgccgttgggtatgtatcctttgcatgacctcctctgtatacttcaagaacccatgaagtccgtgattgtacatacagaatgatgactgggcaccagaggcatcacactgctggccaatcccctcagcaccctgaacttgccaaacacttcttgctgatgtccctggcgctggcctcgaccagtcaaaagtgtttggatcggcttacacacacatacattctcgggcacacaccgatttcaccctgcttgagatcactatgggaaacactgcacggggacgacataccagggaggtttcactccccatttgacaacaaaatttgcacatgatttgggtttgcggccgatcagcaagtcacgggggtgaacttgcagagggggccggtgaacgaggtgacgccctggaggccggtggaggtggtggagaggcccagggtgccgagcagggtggggatgctggcgtcgcaggggcagcgggcgccgtcaaaggccttcacggcggtgcagcacgcctcggtgggcaggtcggcgggcttggtatcagtcacctgctgcacctgggcggcggtggggggcgcggtgctgtccagggggtagatctcgcgcaggaaggacctgtggggggggagcgcggaaaggcgggtggttgagattgctaggcgcggcgggggggatgatggacatgctaagggggacgtcggtggagcgtgcgcacaattcgcgccggggtcgaattaaagggcccacccatcccgaagccgaaactcggcccgaccgggacctccacgcccacgcacagctcagcgtcgcagatggacagcaggcgtccacccaggggcacacattggttgccctggcctgtggaagcggggtcggagacaatggggtgaggggggcggtaacattggccgacaaagtagattcccctcatggaagccgaccacccttccgactctcgcagcagaccgaacccgaaccttggcggcgcgaaaagcagtaccagcaaacttataatgtattgtcacgacatgaatgccccccgaaatccctccacgcctcaccgttcacggcaacgacggccagagagaccagcaggaggatggcaaccttggaagacatggtggtctcgaagagtgtatgggagggaggaattaagaattatagaggggaatggtttgataaaaaggaggttgtgtaccatttgccatggtgaagccccgcttatatgctcccaggtcctgatgtcccgttacgcaagccgcggccatgagctgacgtgggctggaagatctgaggaatttcactttcgccgcccagtagccgtacggcacagaccgggggaaacctcatgaggcatgcctttcagcctctgaacggtatttaccaaatggatcagctgtacgtgggagtccatggacaaaaattcgtgggtcggcgaatggggtgtgccacgtgcctttcagcaccttctccaccgatgcagggtcgagggagccttcacaacgccccgtaccatgcgctcatccaatccaatacccttttatatctcacgacgcgtcccataattacaaaattgcaacctagaagtcgctgttcgattcgtgtcacccaagcatgccagatcgcccctacgatgaccaattcaaacaaggagagtttgatatgcacttggcgcactgctccagcgagactctgcactcacatacaatcacgcagcgtacattgcgctcattctcaataatccgatgtttggggggcatagtcttgggattgtgtgagggagtggcttgtctgatcgcacatgatggagggctgggggcaggatccaaggttgccgagcagcagtgttaaatttgatgcacactctgaagctttgtgctataacagacgctggaatatgcagaagcaagcccttgccagtgccctgaacaaggaaacacggctggcctgagttcatggtcaaatgaaaactgtcccagactcatctcaaccagactcactaagtctctctactgtattaaattaactttcaaacagcaaattcatctaatgtagtggcagtaggtaaaatgttactggagcattgaactgtcgagcgcatggcttggggggggaggggggccagcgaatctacaggagaggccagaagacccgtgccatcgcaccgtgtcccttaccctaaggccagcggggctgcgtcactcatcgctttacctcggtgtttagactgtatattgaagctaggcgcatcatgacggtgagtgggattctttgggagagggctggcccgaggtggccatggatcaataagatagaccagggcctgtggtgttcgagggcgcagaggtccatgcacgggctctggtgcactgacaccaagctcgcacattcgtgcagggtgtaaggatgttctctacgccgttccaggccccgcgggccgtcacaggccagagggtcgccttcggtgcctcgcgcccggtgcgcgttccccatcgccatgccctgcgcaccatcccccgggcatcagtcgctgacgtagcacgatacctggcggatgccgcggcacagatcttcaacccagcggagtcggatgtcaaatgggagggcaccagctctgggtttacaggtggggcctgccccatggatggctgtgcatgggtccctggacagggatacgcctatttaccatcctcagccgcttcatcattggaaaacgcgacgtaggggagatccggcaccacgatgtgccgcgtctgaggcagctggcctctgtggtgcgacaggcgcggagcgagatcgagggtggggcgagtgatggggttggatgtgcttgattctttgggggtccggaactctgggcagtgagcgagggattggggcatgttgatgtcacgggcttacccatgctgttgcgcgccagtacatgtcccagaccgcaggtctctgggtaaaggtaacagcagatcgtcaccctctggcccattgacacccccattctcaggctgtacgaacccggacgccatcaactataacccccaggcggggcaggacgatggttcttgcattgttgccgaggacgggccccccgcgccggagggtggtcaggagctccaaggcttcattagcaaggcaagaagcattgttttgaggggtcgcaatgcaagcctggggggtggacagggatttcggaggacagtcacttacctcacacttggggatgctgggaaactgcacagcaccatgattccagggcccagtgctccagctttgcaccgtgtggaacgaatcaccaccacatttcacccaccattcgacccctcgtggatatgcagaccatcgccaacgtgttttccgggaacttcaagggggatgacaccgagcccagctcctactccggaacaggtaggctcatacttggagagcaaagtttataaagtcatcttgacggcactcatcacctcaagcagtgtgctttttgtttctagaactgagcaagcgagtgtcaaccttcacccccgctcacgacagggtactcataccggggccgctctcagagggacatccggcgtcgtgtcgaccgcctccagaagtttgagagggtcattgaacaggccatcgagcgcgcagaggagaagaaggagtcctgattcatgaattgatgtggttgtagctgtgaggcgcgattcgaggaagagccgggcccctgcgcaacctggaggtgccaagactgtgtgccctgccgctgccttttgggctacacgttgcccagagaagatgtaattttgtgaggcgttgaaggggcttgggtgtcccagcaaatgctgcaagggcacgcgggtgtgctcttggggacggggcggatgcagagcatacacttggcggcaatttgggaagaggatcggtcaagcggctgtgcatggcaccaccgccttggcgcctaggctgagcatcgccgttgacccgagggccttgcttgctccaagagacatcctccctgcctcactaggactcagtgcctgacgccccggcgacttgaatgcccgggatcgatcccagacccacccgctcacgcccgcccgcctcgtctgcctttcatcgcgcacgtcggcggcgacaccgcactgcagcgcccgttccagtcgaccgggtgcgcacgccggtcagtgcgtcacaggctgcagcggctccgcccggaggccgtcaaagtcgagctgggcatcccgctcctcgtccacctctccgatgacagctctgcggagagggtgatgagaggcagggtcaggcgtggacctgcggaccagctctgccctccaaaggctgcagcgcccggtccctgcacccaaaccccagtccccgcacatgttgtcgccacggatgacgtagaggcccagcaccagctgctccacccccgccttggaggagtagacgcgctcgtgacactcatccaggatcaggttgcacgtctggtcgaagcctcgcaggacgccctggagggggatggacaggggcatgcgggtgtaggcatggagctgtcggacggcgtcgccatcaggatatcctgggcgccaccagccagcacccaacctcccccagctcagtcccggcctaccactatgctgcgaccgtcgttggtaatcaccgagatggttgctgcggtgggtggaggatgcgggagtgtgcatggccgggacacgagaggaaagggatgtaggccccggcccccctccctggcactcactgtctacatatggtcgaatgcccgcctcgttggacatggtgtgctggctctctcccctcacccacactgcagtctatgcggtggtgcaccggagctggcgatatatggcgtgcaggggagccctggccttggcagtgtctcggacagaagttgccagtggcacaggcgcgtcccgatggggatgtagcctcgcagattatgactactgatgcccctacgtcaattttcaatgtatctcaaccagatttgagtagaagtgccttgaacagaagccgtacgtagatgctggggcggcatcgaccatcgcgccctctccatcccggtgcgtttctgggtacgaccctgagtaggagcagcccatttcgaccatgtctgccacctccaggcacgtcgctgctgtggatagctgtccttacaagacgaaggaatgcccaaaattctcaaggaaagaatccaagtggtcccccgtccagaggcatcatgcatgcgcagccagtgccagggcatggcggccgcagctcctcgcccacccctccccgccagatgcaaccacccaccaatcagagctttgaccgcgtctgggaggccttgctggcgacgatggcctcgtccccgttggcggacgagggcgcggcgtgcttgcccgccgtcttggccgggcgcttgatgcccagcagctcggcctggcgccgcttgagacgctggaactcggtgcggacgtagtccagcagggtgttggggtaggatatggcggaccactcccccaccgcgccccggtcccagcgcgagatgatgaccttgtaggcggacacgtgggccaccagctgcaggaggcgggggtcgatctctgcagactccagaaggttcacgtggtcgacgatgatgtcggccgcgcgctcgttcagcggctgcatcacatccttcatccagtgcctgacacggggggggcgggggggattttgggggaggggctaagggcttgggttgggaggggggtcttagaggtgggtgcagggttgacatgtgctgagcagggcagctgccgctgtgacaagcagccctcggtgtttaccctgtgctgttgcatgtgtgtgcaaccctctagactttcacacaaaaagacggagccacctcgcaagaggctccagaaacccctgcaggcatggcaggcagggcccccatggaggttcactcgttccatgacatgcgcaaggatcaccccactcccaaccccacctgtaggcggagccctcgtgaccctttggatcccggcgcatggccgccaggaacccccccaccgtgccgtcgggcgagtgctggcgcaccatggccgcgtaggcagcgcgcgaagcgtgcacgcaggccaacagggggccgtacagcaggcggacctggtcgttgatgcgctggatctgggccttgcgctcgtccgccttcttggaattgtagaaagtgaacaggtagcctgagtgggatggggtggggaaccagagaggggtgccaggaagagactgttacacgacttcccaacactttcagacctagaaggctggagacccagaaccaacatctgattgtggtgtggtgagcaggagcctacccattacaccaatcgggaactgcattctcccccccccctccccccccaaaagttgtaccagggccccgctcacctcccagagctggcagcacagcgctgcgcaggatgctcagggagggcccattgtccttcatccactccaccgctttgcccgtcagcacccgcggggtgacagggctttttggccccgccagcctgccttcgccgctgacctgcgcagctaccgcgcgatcctcaaatagacggttgtgggtcggattgacatcctggttatgcaaccgaccaactgcaccgcatgacggatggggatggaggaggaagctgaggacctcacgctcgccctggtaccattacggagctccgggagctgactcggccgcatcttccggcgcccatggcatcagacatggcaggagtaggtgagggtgccactgttcgctcacccttccagatcgggaacctgatattacatcaaaattatcgcgggtctcctctcgtggtgagactgccaattgcatgttgaagtcgtcgcagcggcaccgaccctgccaggtcaggcggccaccttggccttctcgcccttggctgaggaggccacgatcgtctcctggatgtgcttgggcacgacctcgtagttctccagctggcgtgatggaatgcgaggagggagcggtgggagcgcatgcacctggaccagagtaccagccgtaaagctcaagcatgcaccaaacccctcctgcgtgttctgcaccctgcctctcgatggtgcgagcgcatgactcagcccctcactcatacctgcatggtgtactgtgcacggcccttgctcattgaccgcagggtggagacgtagttgaacatctccgccaggggcaccaaggccttgatgatctgtgtacagaaagagggggggaaacacgtgagatcagccatgggaatgcttacgccgctgtcgaacagggagctccaatgtggtctgctgctctgttgtgagtacacccagcacgtctgcccaccacgaggctcccatggatattcatctgcaacccccatcccaacccttttctggtctatattttgcgagactcggccctccccccgccaatggccccctcgtcacttccgagcacgccctctgcccaggcttcgcactctatcaaggtggggccccccttcgtccctggcccaccttgatgccgcccggcttgtccgtgaactcctggaccagcccacggcgcgagttcaggttgccgatcacgtcgcccatgtggtcgtcgggcgtaaccacctccaccttcatgatgggctccagcagctggacccccgccttgcgcatgccctcccggaaggcggcgcgcgccgcgatctggaaggccatcaccgaggaatccacgtcgtggtaggagccgtcgtacagaactgcacgcacatccaccacggggaagccggccagggacccgcttgacatcatctcctccaggcccttttgggggggaggaggggggcaatggggaggaaggagagggctcaggccattgaagggggaaggagtgagtaggatgcgagggcaagggcagacaagcagggggaggggaaaggaacagagggaacagtgctgcagtctggtggatgttctcccagagatgggtgcctgagcgaaggagtcaaacacttccattcatcagatacagcaagaccctcccagccagcatcaaatccctgctcactaccgcaacgacaagggcgctgacctttcaaaattccctctccttatcccctccctcaccttcatgacgcctgggatgtactccttggggatggcaccacccttgatctccgtcttgaactcgaagcccgacccgggctccccaggctcaaagcggacagcaatatctgttggtttggagggacgagggaccagtgaggggcgttgtgtggcatatcgagaatgcttttatggaggcagtcaagctgggaatgtgatgcctcaacacacatggacgcaggcacgaacgagccctgcatccagcaacctctgcaaagtcgagtgcacgctgcaaggcaccctaagggcctgcggcttccgcacaccctgccaggcagctttcactcctggaggtcctccctccctgcctcctgcacctgctgtttcttagacgcccccccgccccctccacacgccccccctccaaaaaacacaatcccaccaagcccacccacctgcaaactgccctgacccgcccgactgcttcttgtgcacatagcgcacgtcggaggcccgggagatgccctcgcggtagttgacctggggcgcgcccacatcgcactccacacggaactcgcgcttcagccggtccacgatgatctccaggtgcagctcgcccatgccctcgatcacggtctggttgctctcgtggtcgcgcgagaagtggaaggaggggtcctcctgcgccagcttcaccagccccgcccccatcttgtccaggtcggccttggaccgcggctcgatggccaccttgatgacggggtcggggaactccatccgctcaagcaggatgggcgcccggtcgtcgcacagcgtgtcccctgtcaccacgtcctgtgtgatggtggggggggggggggggggnnnnnnnnnnnnnnnnnnnnnnnnnnnnnnnnnnnnnnnnaggaaagggagaatgtccggatgagaaaagggagggatatccacgtgggggtcccggatgctcgggaggcccggcgtcgcagagttctgcccattctatcagatgttcacttctaactaagctgcgaccctgtcatgcgctgctcccgcaagcacagcgcgccctgccttccgaagtgggcaaccaagggcttcagaatgtgtctaaaacctcccttcccgacacaagcttggccctgctcttacccatccacccacccaccccaccccacccccacc

SEQ ID NO: 29264 - DNA, 122 bp, Chlorella protothecoides
ctgttgagcctcaagtctgcatgcatcggtacatggggttcgagaggacatgccattgattattctgcagcctatgagtatgccccatcggtgccaagaccgttccgagctctccactccac

SEQ ID NO: 29265 - DNA, 61 bp, Chlorella protothecoides
cagtgctccagcccggtgctgagttcccggaccctgtcccgccggcgaccctgtgcctgag

SEQ ID NO: 29266 - DNA, 247 bp, Chlorella protothecoides
ccctgtcccgccggcgaccctgtgcctgagcatcgcagcgaccagctccggcacgctgagcgtcgcgtatgctgcctcggggtcctcctgaaaggcggagcgggtgaaggtatgtcaggatactaccgctgccccaatggcaggtccgaggcacagcccgccagagcgggtcagcacatgcatccgatcggctggttcttctgcgagcacagcggcgtcccctggcacgacctcgcccaggaacaaa

SEQ ID NO: 29267 - DNA, 68 bp, Chlorella protothecoides
agcctacttcaggatggggttgccgctggggtccagtggccagggattgccgtcgacatccacctgcg

SEQ ID NO: 29268 - DNA, 78 bp, Chlorella protothecoides
tgaaatgaagaaggcgtgcacgatgggcacacgcttctccacaactccttccaaaatccccggccacacgatgacgaa

SEQ ID NO: 29269 - DNA, 172 bp, Chlorella protothecoides
gcgggtgtctgggcggagtacgagtgaagggctgtcccctctcgacagtgatcgcagtggccttgctacagggagcctcgcatctggtcgaggtgcctgcttgctgaattggtttcactgaatcaacatgcaattggtaaggagttgtagcatcgcatgcagcagctcgatg

SEQ ID NO: 29270 - DNA, 61 bp, Chlorella protothecoides
gcaactcacggggctggcgctgatcggcaggttcatctcctttgcttactcggtgccctgg

SEQ ID NO: 29271 - DNA, 72 bp, Chlorella protothecoides
tggagccgcgagacacatagcatcgtcgcctcggcacaccgcaggtaaccttgtcgcagagtgcgataccct

SEQ ID NO: 29272 - DNA, 61 bp, Chlorella protothecoides
tgggggggagatgcaactggtgggggggaggtgcaactggtgggggggagatgcaaatggt

SEQ ID NO: 29273 - DNA, 74 bp, Chlorella protothecoides
cctgtgcacgtgcgatgcattcctcagtgaagaagggaacactatacacttgtggggcccatccagcaaagtat

SEQ ID NO: 29274 - DNA, 76 bp, Chlorella protothecoides
gccccccaccccaccccactctcccaccccgcaccccatctcgtatagtgctatactttgccatcggcagcgtgtt

SEQ ID NO: 29275 - DNA, 63 bp, Chlorella protothecoides
gccccccaggcgccttcagagaaggcgccgagccatgcagcttgcctgttgcgaggccagggt

SEQ ID NO: 29276 - DNA, 136 bp, Chlorella protothecoides
tgggctgaattgcgagccgatacgaatggaaagctggctggcgggggagaggggatggggttgggcacggcccaggcagcaccctctggccggaggcgggagggacgatttcgtatctgagagcgccctccgtctg

SEQ ID NO: 29277 - DNA, 150 bp, Chlorella protothecoides
agagtcttcatggagttacttgtgccttgggttttcccaagttcggccgcctggagagcagcaattttgtgtcgtgttataagttcataatacgatcttaggctgctgagcagtacatcccccacatttgatgaggagctgcacagattc

SEQ ID NO: 29278 - DNA, 131 bp, Chlorella protothecoides
gggcatcgtgctgcccacctccgccacctcccgctcggtgctgggggcgcacatggagcatgtcctcctcgccatccctggtgggtgaagatgggttgtgcagtaggttgggagccttgctgggtgaggct

SEQ ID NO: 29279 - DNA, 80 bp, Chlorella protothecoides
tcatgttgccatgcccatggtatcagatttggatgactcatttcaaaagcatgaacccccttcccgcagggcgtgcaagg

SEQ ID NO: 29280 - DNA, 75 bp, Chlorella protothecoides
tgcgacgtgcgcctccacgttcccgtttgtgtgatgagagctatatggttcaactcgaagcagccagctgcgtat

SEQ ID NO: 29281 - DNA, 77 bp, Chlorella protothecoides
caggcgtgggggccgctgctgcgtccccccgtccatcatcccacactcgctccgaacccaaatctgctccgcaggca

SEQ ID NO: 29282 - DNA, 73 bp, Chlorella protothecoides
gccgggcccacgcccagttggtgcgccgccagctgagacgcgcggcgcagctggcgccgaggccgtggggacg

SEQ ID NO: 29283 - DNA, 61 bp, Chlorella protothecoides
tgaggactccccaagccccagccctcaggattctccctcccccagccccgacgactctccc

SEQ ID NO: 29284 - DNA, 223 bp, Chlorella protothecoides
aatgggtgggagaggtcagtgggctggccaaaatggctgcaaggcaatcgaagccttgaaaagagcgttaagggaaaggctggctgaaccacaccagatagctttattctcctcatcgtgtacctggccggtggacttgccagatacgaggtcgtacgccaccaatcccttctggccgcacccgatgagaatttgggtaccattccggtacagctccatgcag

SEQ ID NO: 29285 - DNA, 128 bp, Chlorella protothecoides
gggctaatatgtgtaggcaagggcgtggacagctctacaaacatgaaggaagagcagggtaagattcttcacaggagtcccctgtgaagacatgtcagacgttcatgatgctctaggtaggcctgagc

SEQ ID NO: 29286 - DNA, 122 bp, Chlorella protothecoides
ttggggttggcgtagaggcggttgtcttgcagcgcgtccagcaccgcgcgcaggtgcgtcaaatgagtctccatatcccgggagtagaccaagatgtcgtccaggtaggcgacgacaaagtc

SEQ ID NO: 29287 - DNA, 62 bp, Chlorella protothecoides
cctaccatgctggcatgcattggtgcctgatactgaaaacataccctgtgtgacatgacaag

SEQ ID NO: 29288 - DNA, 73 bp, Chlorella protothecoides
acaagggcatggcggtcttgacctagaatgtttcgagtgcacttgaggccgctgtgacccccatgaggattgc

SEQ ID NO: 29289 - DNA, 152 bp, Chlorella protothecoides
gccgcctcaaaggggctcgggccgggcgggaccccgggatgggcggcctcgggccactgcgggaagtggcgaatgggtctcgtggcgggccgaatcggtgatgtgattgcggcaaaccattcccattggcaaggctgtctgaactcgttccc

SEQ ID NO: 29290 - DNA, 70 bp, Chlorella protothecoides
cccagtcagtcttatcctggattctcagggcgaaatgaaccctcattccctccagcaacccccaaagttc

SEQ ID NO: 29291 - DNA, 164 bp, Chlorella protothecoides
tgggcacagtctggacgaggggaggggggtggtccccgtgcggtgctccgaccggaagtgggtggcccgcatcactccttcggaggtccgccagctcgagtcggagctgggggaggagtatcaggcatccctggaccgactcaagcggaggtggggccccgggt

SEQ ID NO: 29292 - DNA, 92 bp, Chlorella protothecoides
taaaccgatgacagccaagtccccccaaagtgtctctcctgtgacgtttaccgctaaggtttaaatttgtgtccatctgcgccctgcttttc

SEQ ID NO: 29293 - DNA, 62 bp, Chlorella protothecoides
actgcccatgatcgtcctccagaatgtccagggccatgaagatgagaggctgcaagtgtgct

SEQ ID NO: 29294 - DNA, 79 bp, Chlorella protothecoides
ttcacctgcagtggaggcgaactctctggtgtcatcggaaacggagattccgtaccgatactaccggatgccgttctgc

SEQ ID NO: 29295 - DNA, 240 bp, Chlorella protothecoides
gtccactgggacctgccccgtgccagggcagtggaagtgatcctacgagaaggcacatcgcagctatgctgccagagatggggagtgaacacacgaggtgatgcacctacggagcacgctgcctcgcggggcgccgcctgcggctacctgcgctcctgcggcccgctgctgggaggattcttgcaatctggaaggactcaggcagcctgtcctagcccaggatggcgtcgcagcaccgcc

SEQ ID NO: 29296 - DNA, 61 bp, Chlorella protothecoides
acctgtgaagaggtagttgttgtctgagccataccgattccggtcaaggttggtcgagtac

SEQ ID NO: 29297 - DNA, 80 bp, Chlorella protothecoides
cccacctcccagaaagcccgacggcaccagtccatggaggtcagccagagcgcgaggccgaagaaccaggagatggagcc

SEQ ID NO: 29298 - DNA, 61 bp, Chlorella protothecoides
gcggagcggtacgaggagacgctgtccttcacccgcctcgccaatgtgctctggcgcagcc

SEQ ID NO: 29299 - DNA, 94 bp, Chlorella protothecoides
ggaggtcgtttgggggggaatgcggccagggacccccctggtccctccgctcgctgcaagtccattccgcgccatccatgcttgcacctgcagg

SEQ ID NO: 29300 - DNA, 124 bp, Chlorella protothecoides
tttgaaggaagcctggcgctcgctccggcagcatgcactgacgggcaagatccctgttcttagcacacgtccaccctcgtgcatgccacaacacgcgctgccctccacaccccagatcgcggga

SEQ ID NO: 29301 - DNA, 293 bp, Chlorella protothecoides
gggcagcgtccagcgcgccagtgcgtgccccgggggcggctgagaggggaggggatcattggggggttgggttagggccgggggtgctggagcgggaacggcgtttggtgcgccaggttgcaaagggggggagaggagggagggcacaactgggaaagagacacatgcgcaaatgacatgcaagccatacggccccacgtcagcgcgtgaaccccccgccagccccggtctcaaccctccagccaaccacctgcggcagatcgtctcgggaggggtccaggaccaggagggag

SEQ ID NO: 29302 - DNA, 91 bp, Chlorella protothecoides
ccgacgatgcaggtgtgtgggcgcaggaggacggggcccccccggtggccagcgtgccgagcttcctcgttgccgcatgtgatgcctgtgt

SEQ ID NO: 29303 - DNA, 75 bp, Chlorella protothecoides
ctgcccctgccgtgaaggaagggatgcttgacctccggagacctccagcgagtgttgcgcccttgatggatgctc

SEQ ID NO: 29304 - DNA, 74 bp, Chlorella protothecoides
cgtttgatgcggcaaccaaggccgtcgcagattccaagcctgcacttgcacttaaatagaccaaatatttccct

SEQ ID NO: 29305 - DNA, 124 bp, Chlorella protothecoides
catgcctgctcggccaatggataccctgccctgtccccaatgcacaaacacatgttcgccctgtgagattccccccctgcccacctccaatgaaccccctcactctgacaaccccatcacccac

SEQ ID NO: 29306 - DNA, 61 bp, Chlorella protothecoides
gggcgccgtcgctcaacgctaggaacccccaccccccccaactccatgcagcgcccccgag

SEQ ID NO: 29307 - DNA, 139 bp, Chlorella protothecoides
acggttcgaaggggtgggctgggttgaggatgtgacgaccgcttaccgtgcgtaaccgggacgagcgccggcgcattgttgcaggaccaggcaggcagtgaagagtacgagagtactttggaggcgcgacattgctgca

SEQ ID NO: 29308 - DNA, 65 bp, Chlorella protothecoides
ctccccatgaagacgctaccttgtgccgacgctggcatggctgacagcgaggctcgctaagagca

SEQ ID NO: 29309 - DNA, 61 bp, Chlorella protothecoides
ctccagcggctactggatcgtgagcatcgcatgccgcgaccgtcccaagctcctgttcgac

SEQ ID NO: 29310 - DNA, 454 bp, Chlorella protothecoides
gccggcgcgtcggcgggcgcgggcgccggccgcacctcacgcggcgcatccagcagccagcgcagcaggccgcagggccccagcaggtggcgcaccaaggccgggctgcccacctcaaaggaggtcagcaggcgcgtggcggcgtggtgcagcgcgttgttgaaggggtagcgcagcaccagggccatggcacgctgcacgccctccgtcgccatcactgcctcctctacaagttttttttgggggggggggaaatgaaggtggtagaagtaaggatcggaggctgggacaattttagctataggccggcccgcctgcaccctgaacaccccgcttgtggagagcaacggttccggaacgatggcccctgcaagcaaatactgttgccctcctttccctccttccagatacccccctcccacagtgccatcactctgcgggccccccccctccc

SEQ ID NO: 29311 - DNA, 69 bp, Chlorella protothecoides
aagactcgagcgggggtgacctacgtctcactcaataaggacagccacgtcctgcagctgcccgaggtg

SEQ ID NO: 29312 - DNA, 78 bp, Chlorella protothecoides
tagcaccaagcaggaaagtgaacttgggagacgtttcttctcccaaggagcatcatcgcaaggcgattgggcctctgc

SEQ ID NO: 29313 - DNA, 80 bp, Chlorella protothecoides
gcggccgcgcactgcgaaggagcaggggctggttgacttgagaggttgggagcccgaaactcccgccttcagctctgcgc

SEQ ID NO: 29314 - DNA, 74 bp, Chlorella protothecoides
ctggcgggggggcgctgcaaaggagctgtccaccaggacgcaccggtgctgtgacctgtgccagggcctctagg

SEQ ID NO: 29315 - DNA, 76 bp, Chlorella protothecoides
actccgaaatttcgagctgacatggcagtaccccatcggggcctggcacacccagcgcacagtgagcatggtgtgg

SEQ ID NO: 29316 - DNA, 70 bp, Chlorella protothecoides
attgccctgacagagaaccccagcatgctgctgtccggaccacgctcgccattcaacacctttcaccgcc

SEQ ID NO: 29317 - DNA, 61 bp, Chlorella protothecoides
cctcgtcgtccacggccatgtcgaggcgggtgatgaagaagtgctgatggtgcgcggcgtt

SEQ ID NO: 29318 - DNA, 79 bp, Chlorella protothecoides
cgctggtgaggatgcctgggcggtttctgacccctcgcttgcagtgggcggagaacgggcggttggggatgggtgggca

SEQ ID NO: 29319 - DNA, 143 bp, Chlorella protothecoides
gaggagaagagaagagtgctggacggcagcttcaatgcctgcaccacgcttggactaggaatgttcctggcagcgcagcgcacacagagctttttaatgcacagaaccctaggatcatcctctcagactccctttcatgtccc

SEQ ID NO: 29320 - DNA, 61 bp, Chlorella protothecoides
tcagcatgatgaggtccttgtgatgaggaagggggtttgcagggcaggcacacccagccta

SEQ ID NO: 29321 - DNA, 75 bp, Chlorella protothecoides
aggacgcattcagccaagtagtccaactggagcggagagtgtaggcttccgcagggcagccgacctcacccgcat

SEQ ID NO: 29322 - DNA, 97 bp, Chlorella protothecoides
gctttgtggagctgcaggtgagtgggaccaagaagggaggggaagggggaaagagtaggtcataacctcgttgtggccagacctgtcctgtgacttt

SEQ ID NO: 29323 - DNA, 120 bp, Chlorella protothecoides
gtgacgcagccaggcaaagggccatgggcttttccctgcccagcagacccatgcgcttgcacaggcaccccagcagcctctgacccctggccctcaccaccatccctctccaggtctggc

SEQ ID NO: 29324 - DNA, 161 bp, Chlorella protothecoides
acgccttgctcccccacagcgccgtgctcagtgcctcgaactgcgcgcgtagagaaggcaagggtgaaccccccttcctttgcaggtacaggtagcgagaaggattgagcccccctgccggctacaccctcccgcagatgcctacctgtgagtcaggcttg

SEQ ID NO: 29325 - DNA, 136 bp, Chlorella protothecoides
gtcagtgtggatgggccccactgggaggtgctgcaccattcaagaaacatccatggcgttcgggaaagagggcattgattttgtgtgccacggttgttcagagcggcagaggacccaatctaaattcatgtgttgc

SEQ ID NO: 29326 - DNA, 79 bp, Chlorella protothecoides
gaagcgcggcagctcgcgcttgaaggccggcttgcccacgtcgcggccaatggccggcagcgagcgccagagcgtctgc

SEQ ID NO: 29327 - DNA, 61 bp, Chlorella protothecoides
tgcagctgggcccaggcttcagtgctggcaggcgcatgtggagtcagcgaccatccctccc

SEQ ID NO: 29328 - DNA, 195 bp, Chlorella protothecoides
gtgggccgaggcggctggccgccgcccccttgcagtcgttccctgcctcgatccttcacgtgacccctctcgatccccctccccgtgcctcccacctcgcgcagctgccatcggagtgggtcgtcaaggcctacatggccaagaccggcgccaaggtggagttcagggtgggcctgggaggcgtccccggcgccc

SEQ ID NO: 29329 - DNA, 343 bp, Chlorella protothecoides
  modified_base (104)..(271): a, c, t, g, unknown or other
tgccattgtccctggggaccggcaacacgacggcatggctactggcactgggcgagggaggggccggagccccaggctgcccgctgaccatggggttgtaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccggggggacagcgcttcacgggcgcaaggcacggaagcccggcagccctggtcagcctgttcggagcag

SEQ ID NO: 29330 - DNA, 85 bp, Chlorella protothecoides
tcgactgcgtcagcgccgcgtgtcatgcagtatgatgtgcatgacctttgccccttggcagagcctgcaggcatgcagacggtgc

SEQ ID NO: 29331 - DNA, 109 bp, Chlorella protothecoides
cacctgcaatgcacacctgtgtgagccaaggtgccagagaactgattgctacatcgtcgcccagagccgagcaggggtgccctgcaccaggcgtccactcacaccttgt

SEQ ID NO: 29332 - DNA, 128 bp, Chlorella protothecoides
cgcggggcggcctcggccggcaggggctcgtacccgtgtggcccaggcgcgccgctcggcacgccagtgccctcctgcgagctctgcccgccgccgcagtccccgggcgacgcgggggcctccagggc

SEQ ID NO: 29333 - DNA, 147 bp, Chlorella protothecoides
tctgccgccgatcacaccctctctttcattcagacctgtaacgcatcaccccgccttggtagcaaggggcagtcgcggatcgccaggggtgtgactgcgcagactgcacctgaggacctagttgtaatgctctgttatagcagaccc

SEQ ID NO: 29334 - DNA, 120 bp, Chlorella protothecoides
taggcgcctgctgacgcctgtggtctgtgctgggtcattgttgccaactgtctagaatctaatccagtctcccgctcaatcccatcgtctctgtcgccctcctgctctgcaggccagggc

SEQ ID NO: 29335 - DNA, 61 bp, Chlorella protothecoides
tgctgcgtggcggcgcaggcacgcaggaggtgggcgccctgctttcctccctacaggccgc

SEQ ID NO: 29336 - DNA, 61 bp, Chlorella protothecoides
tctgcagaaggatctgcgtcaaggcgcgagttctgagtttgcgcgccctgagaggagcccg

SEQ ID NO: 29337 - DNA, 64 bp, Chlorella protothecoides
ttctgcgcgcgcacccggctcggtcccgttttaagtgtgggaatgagtcccctagccagtcgac

SEQ ID NO: 29338 - DNA, 99 bp, Chlorella protothecoides
agtgtcgccgcacacgatcaagctagagcatatgttgagcagctaggaattttcgaggcactcgcgatcacgcgtctgcgcgcttgcgccctcgactat

SEQ ID NO: 29339 - DNA, 62 bp, Chlorella protothecoides
gcaaacaggagcgcagccagtgcacagcagtgagcagggacatgggccccggcactctccct

SEQ ID NO: 29340 - DNA, 77 bp, Chlorella protothecoides
tgcaggctcctccagtggggcattggctcagcccttctgtgttccatctccctccacacccctccccaggcgcggca

SEQ ID NO: 29341 - DNA, 61 bp, Chlorella protothecoides
gccggaggagcacagtgacgttatggcaggggaggactagtctcagcaacgcatgcaagga

SEQ ID NO: 29342 - DNA, 71 bp, Chlorella protothecoides
cggagactgacatgaggccgggggagcctgcatgccatcgcaaagagctcttgagccgccttaaagggcgg

SEQ ID NO: 29343 - DNA, 126 bp, Chlorella protothecoides
gctagattggattcgtgttggtattcgccattgcttgatggtgccaagagaggcctgtcctgcaatgtgacccctcgagtggggtactcgtctccacggcagcatccgttttcaagtggatgcaga

SEQ ID NO: 29344 - DNA, 430 bp, Chlorella protothecoides
gcgccgcgcccgcgcgccgtgcgctcgcgcagccgcagcagcgacagcagcagcgacagcgcgctgcccgtgggcgccacctggtctggcgccgcctcgcccgcctcgatgtccggggacgagggcgagggcgcgtgccgccccgtagcccccggcgcgctcatggccagcctggccctgccagcgcccacccgcgcggcaccccactccgcgctgcacctctcctgccacgccttcagctcggagtgcgagcaccacctgctccccttccacggcaccgtgggcttcgccgtgctgggcgccgcgccggacgccggcgcactgcgcgccgccgtggcggcctactcccgccgcctgcaggttcaggagcggctgacggtgcagctggcggacgaggcctgggcggcggccgccggcgcggaggccctgc

SEQ ID NO: 29345 - DNA, 61 bp, Chlorella protothecoides
gtagtatattttttgggcggggaagcgcgagcagcccctgttttttctttttgggcctagt

SEQ ID NO: 29346 - DNA, 73 bp, Chlorella protothecoides
cgaggcagaagaggaggtggaggaggggcctgcccccgccacacccttctccgtgtccatcgtcaagggcgac

SEQ ID NO: 29347 - DNA, 61 bp, Chlorella protothecoides
gactcgcagggtgctgtacagactcctgtcaccctcccaggcccgatcatgaacgtcgcct

SEQ ID NO: 29348 - DNA, 61 bp, Chlorella protothecoides
tgcagcagtggtgggacatcgcgggccacacgggtgcgtcaggggcccaggccatacattg

SEQ ID NO: 29349 - DNA, 179 bp, Chlorella protothecoides
tgcagacccctatgctgggatcgtcgatccggctgccccccggtccgggccgcactcaatcgcgaaggctgtggtggagccggccgccgtcgcagccagggcacccagcgccaagcagccgtcgctgccggaggaggtgcgccgacggctggccgagcaggcgccgaccctccccaccg

SEQ ID NO: 29350 - DNA, 77 bp, Chlorella protothecoides
ttctacggaaggcttccccaggctagatggctgcgcaagtcacaatcgtcggtcgatggcgcacccctccctgcagg

SEQ ID NO: 29351 - DNA, 61 bp, Chlorella protothecoides
aaggagcagtgcagcctgaaaccattggccatgtcatccctacgacaaaagatgggaatgg

SEQ ID NO: 29352 - DNA, 130 bp, Chlorella protothecoides
ccttggcatgggcggctacagaccgctgcatctgctgcacacgctggagtcgcacactgtggaaggggggacaaaagaaaagcatgcaagggtgcctggcgggcgtgcaggggtctcatgattgtgtact

SEQ ID NO: 29353 - DNA, 95 bp, Chlorella protothecoides
cagggacgcctccctgcatcgcactagctgactctcaagcccgcctttataccatatttcgaggtagactgcacctgcactcgaagaacttgttt

SEQ ID NO: 29354 - DNA, 91 bp, Chlorella protothecoides
aaagattacatatccccagtaaaggcctgctcgtcgttgccaagtaaatgcatgttgtggaaggggaaaccaaacactgcatttgcaatct

SEQ ID NO: 29355 - DNA, 72 bp, Chlorella protothecoides
gggggacgacagccggaccaaaggctcctctgtagccagattaagcccctggctagctgcagcgtggacaag

SEQ ID NO: 29356 - DNA, 164 bp, Chlorella protothecoides
cgccccgccgtccctgcagccgccggcgcccggggcagccgcgcacgcgtacgacccgcagggcgcacacctgggcctggaggccggctccagcggcgacgcggcactgccgccgccgcccaagggcatgtcagcctggccgccgggcttcccccggcccccgc

SEQ ID NO: 29357 - DNA, 61 bp, Chlorella protothecoides
acatatctctgcttgaaggttgccagcgctgcagccaccggccgctccagccggacgcagc

SEQ ID NO: 29358 - DNA, 68 bp, Chlorella protothecoides
ccccgaccgcagaccaccgccttcagtttcgggggaggggctcccgtgacccagcgaacagggtcggc

SEQ ID NO: 29359 - DNA, 61 bp, Chlorella protothecoides
tccaccagtaaaagcttaacgaagccgcatcaaagggtagtaggagagcgatcatgtccat

SEQ ID NO: 29360 - DNA, 417 bp, Chlorella protothecoides
  modified_base (100)..(292): a, c, t, g, unknown or other
ccaggctgccatccacccaacagccgtgcagggcgggacggctccatacaccggcgggcacgtccccgcgacccaagcctgcaggcccttgctcggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactccctgcctccatgcaaagagcgacatgctggaccgcgctgtctccatcccttcttcccactttgccacacatgcactcacctgtgcgtcccattgatgcagagctgcagactcgaggtggcg

SEQ ID NO: 29361 - DNA, 75 bp, Chlorella protothecoides
cgcccagtccctgccctcgctggctggcacaggatactgctgaggggactccaaacctgcgacactgtcttgagt

SEQ ID NO: 29362 - DNA, 199 bp, Chlorella protothecoides
atcctgcccctgtggcttgctggtgggtggtgcgggtcgggggttggtgtcggggggagggcccctggcctggctttggtcgaatgccgggcccacatgcagactctcctccagagaacatcactggttatgggatccaaaccggtgccctgtggggcatgctggccacgcggatcccgtctgccaccctgctgcggct

SEQ ID NO: 29363 - DNA, 69 bp, Chlorella protothecoides
gaaaggctggggtagcacactcccataggaaatccgccatgcaagccagacaggatacagcagacacac

SEQ ID NO: 29364 - DNA, 96 bp, Chlorella protothecoides
atctcggccttttcgagcccccctccccctaggccatccccgccaccaccgccacccattccttcacccccaccacccgagcctattgtgtttgac

SEQ ID NO: 29365 - DNA, 61 bp, Chlorella protothecoides
cctgcacacgctgctggtcacacccgtggccgcgtcgcccagcgacccggtggtactggtg

SEQ ID NO: 29366 - DNA, 121 bp, Chlorella protothecoides
cctaacgcccaagaggcttccaagcacctattatcccatgacagtgactcgcatataccagcagtatccccgccacacctccctttcccttctcatgccaccacatacctaagggagacct

SEQ ID NO: 29367 - DNA, 90 bp, Chlorella protothecoides
cggcatctgctgcatcgacgagttcgacaagatggatgtgaaggaccaggtggccatccacgaggccatggagcagcagaccatctccat

SEQ ID NO: 29368 - DNA, 67 bp, Chlorella protothecoides
ttgggcgctgtacaaactctcaacggattgttttactcttacatcacccggtttccggtccctgtca

SEQ ID NO: 29369 - DNA, 143 bp, Chlorella protothecoides
gtgtgagatgaggtgtatgggggggagtggcaggaaggtaccggattatgcaaggaatgggggatgccacgatgagcaagccttccatggtaacataccgcaaggggcagtacaggtcgccagcatggctgtctcccatctct

SEQ ID NO: 29370 - DNA, 61 bp, Chlorella protothecoides
attggacaagccccgatgccctcaatgatggcttcagtttgacagactggaccggcagcga

SEQ ID NO: 29371 - DNA, 102 bp, Chlorella protothecoides
gccgacacaggctgtagctgtgcgcagggaggtcgtcggtgtctggaccctgtaccgcgcttgctcagatttcgagatctaaaggatgcacacgggatacca

SEQ ID NO: 29372 - DNA, 78 bp, Chlorella protothecoides
gccgccaagttccgagaagctggtgagggacttggctgggggacgagaggaggttggggggaagaagggagagtgggc

SEQ ID NO: 29373 - DNA, 64 bp, Chlorella protothecoides
tggtaggtgggggtggagacttcttggcgggggctggaggagattgcttggcagtcggcggagg

SEQ ID NO: 29374 - DNA, 103 bp, Chlorella protothecoides
ctccggtagttggcggctgtggcatgtgggaagggtttaatttgggtaggaaaaggaatgaaggagatgtggaaacgggacggcagcaagagaagcaagatgg

SEQ ID NO: 29375 - DNA, 61 bp, Chlorella protothecoides
ggatgcgcacccacacgtccacgggcagggagggcaggggttccggcaccgtcaccgccgg

SEQ ID NO: 29376 - DNA, 63 bp, Chlorella protothecoides
accaccaagctcctcatcgaacccttatgaggctcatcacgggctgaactcgtggccacaatc

SEQ ID NO: 29377 - DNA, 69 bp, Chlorella protothecoides
tccatgcatgcttggccaggtgctcgcataaggcgcactgaatgtacttgatgtccccccgtcggggag

SEQ ID NO: 29378 - DNA, 75 bp, Chlorella protothecoides
ttccgcgcccccgacgaagctcgcgcgcgcccgagaccccacgtccgcaaactctatgccgcgatgaggcaggga

SEQ ID NO: 29379 - DNA, 68 bp, Chlorella protothecoides
caggatcggctttgcacccgggatctgctttgttttagggtgtggccattgtatttggcacagcgtcc

SEQ ID NO: 29380 - DNA, 74 bp, Chlorella protothecoides
ttaccctgcgcttgttaactacgactgtggtgcagtcctcctcgtcctcccttacagcatcccattccatcagt

SEQ ID NO: 29381 - DNA, 69 bp, Chlorella protothecoides
gctggtgaggggctcaggggtgggagtctttcctttgtgggagctgtcttcaccacctcttccttatgg

SEQ ID NO: 29382 - DNA, 135 bp, Chlorella protothecoides
aacgtaaagcaatgtcgtggaacagagttacccccatcactcacacattccccatactgcctatctgggcggactgtacccaccaggcgccttgtaccatgaaaattggaaatcaaacgagttagaggaccattg

SEQ ID NO: 29383 - DNA, 70 bp, Chlorella protothecoides
gctcctgaactttggctctgacgaggagggacagagtgaagacgacgtgagcgaagatgacgaggaggaa

SEQ ID NO: 29384 - DNA, 168 bp, Chlorella protothecoides
tgcgtgtgacgtgatggcgtgggcagtccacgggcatcagaagggccgagcaatgcgtgcttcatgcgcccattgcgcagccagcaatacctcggcgtcgaacaagcacatggggcgccagccgccgcagcaacgcaacgcagatttgctctcccctcttgtccgagc

SEQ ID NO: 29385 - DNA, 79 bp, Chlorella protothecoides
caatcaccactcacttgtgcagctccttgacgaagtctggggcctttgtgtgccactttgcgatggtcttctcccgccg

SEQ ID NO: 29386 - DNA, 106 bp, Chlorella protothecoides
atcgacggcgtccaaaccattcaggtgggaggtcgtgagatcatgtacaaatgaggcggtgttgtcctgaggacccttggactgggcaggggcccaggtgcatcag

SEQ ID NO: 29387 - DNA, 205 bp, Chlorella protothecoides
ggggaaccccgcgccggacagccggcggcacacccccactacctgccggcacagctctggatgggggggggttggaagggagggagaggggggaagagtgacgagagtggcttgaagaattttgtgatggggggagcgggtcacgacagccggctatcctggagggctgagcgccgcgcaagagcatccctgaagcgcgctgcag

SEQ ID NO: 29388 - DNA, 71 bp, Chlorella protothecoides
ccggtagcggcatatcttcgactcgtgcgctgcatatgttgcatcaagtcccactcgtcctgacgagcgac

SEQ ID NO: 29389 - DNA, 75 bp, Chlorella protothecoides
atcaaactggattgcatgctgtctccaacatacattggatgatgatccttcctgtcaattaatgtgagaatcacc

SEQ ID NO: 29390 - DNA, 61 bp, Chlorella protothecoides
gctgcttgctggcgtgaccatcgccgagggtggcgtgctccccaacatccagtcggtgctg

SEQ ID NO: 29391 - DNA, 112 bp, Chlorella protothecoides
gcaggtgccaacctgccacgctcacaccaacagacatcccagtgtgcacctgcacacccgcctgtcgcttgcacggccccttcagctgtccgggatacacacctagacacgg

SEQ ID NO: 29392 - DNA, 73 bp, Chlorella protothecoides
aaccctctgggtgcatgcccatgtgcacggatgctcttgaattccggtcctctttccctcattccatcggctt

SEQ ID NO: 29393 - DNA, 109 bp, Chlorella protothecoides
tgcctgctggggcatggcctgcaccccctgcccgtaccgctcctgccaagctcctggactcaggtgtctggctggtgcgtgaccccagccacatcccaaccccacccag

SEQ ID NO: 29394 - DNA, 95 bp, Chlorella protothecoides
aaatcatcctcactctgcgctgggcgggcctagccccgtgggccactgccatatcagcacgaaacttcggagtcgaatttcgaaaatgtgatttt

SEQ ID NO: 29395 - DNA, 93 bp, Chlorella protothecoides
tcgaccatcagacccccatccagcaggtcggattgtgatggtcgtgtctccatgtaccacaactacactaaataatcgatgggggatggatgc

SEQ ID NO: 29396 - DNA, 931 bp, Chlorella protothecoides
accccccccccccgcccgactctgtcgcagcctccgtgggcggcttcgtgggcctgctgctcctcgcctccatccccctggtcatctggctggtgaggcggcgccgcgcctggctgcgcgagcagtcccgcctgagctccggctccgacctggaggccgggctggggtcgggccggcgcagcagctcccccctggccaagcccgcgcccggcgatcgcggcgacggcgacggcagcctgagcacgcgcccctccaccggcatgctgggcctgctgcccctgctgggcctgggcgcgcgggaggcaccctcccgcatgcagttcatggtctccggcggcggcggggctggtcgggacccgtcgcggcgcgggatcggcagcagcgacggcggggccaggctcggcgacggcggccccagtggcgcggcgtccgcccagacgccgcgcagtgggatggcgcgaggcggcggcggcggcaggagctcgagtctcacggacagtgtctcgcccccatccccttcctccggcgccgcgccgccggcgccggcgatggtggaggacctgctggaggacgagctggcgccgcagcgctcggcggcgagctcgcagctgtggcccggcggctcgggtgcgctgccctggaccgacgggcgcgtgagcgcggaggagatcaccatcgtgctgcgccccgacggcagcccctggctgctgggcgccggcgcgtacggccgcgtgtaccgcgcgctgcgcgatggggtgcagcccgtggcggtcaaggtgctgacggggatggagaacagccggcgcagggacgagttcatacgcgaggtcacgctgctgcgctcctgccgcgaccacaacatcgtccagttcatcggcgcctgcatccaggtgtgtgtgtgtggtatggggcatggtggggggggggggga

SEQ ID NO: 29397 - DNA, 93 bp, Chlorella protothecoides
ctgcggggagacatgggaggcaccatggatgaagcatacgctggtgggtacattggttggcgagcgtcgcatcgaggctggcacatcggcagt

SEQ ID NO: 29398 - DNA, 62 bp, Chlorella protothecoides
acatcgtcgtgagatgtgctcacggttgtagcagaatgtcagagcgaactccgatccgtgga

SEQ ID NO: 29399 - DNA, 122 bp, Chlorella protothecoides
ttgtccatcccctccaaaatcagtgtcgaaatctggaggtgaaacatgaggtttcgatccagtggatttttctaacagctctgtgtccagctatggatgtcagatgaccatcggattcatcc

SEQ ID NO: 29400 - DNA, 114 bp, Chlorella protothecoides
cgcggggcggcaggggcacaggagggatggctttccgcccctcctctggaatccccgtcgctccgcgcagtcccggcaccagcgggcccttggtgtaggttgcctggcccggcg

SEQ ID NO: 29401 - DNA, 64 bp, Chlorella protothecoides
tttgcaagtcgcttggctggtggggaccgcctgaacagtagtcgtggcaccacagcgcagcccc

SEQ ID NO: 29402 - DNA, 292 bp, Chlorella protothecoides
gacctcgatcacgtcacgctgggagttgagtttctggaactggcggtccttttgccaatcgttgccggcacctggtcgcgggatgggggcgcacaggagggaatgaggagataggagcttgatggccttggagctgctgggggaacaacaagcctgagggctggatccaaaatcttaaaaaggaaaccatcagggcctgcacgccttgccaacacagcctcccaagagcttggacagggtgctgtcccaggaatcctccttccaagtcgcatcaacccagtagagtgctctg

SEQ ID NO: 29403 - DNA, 107 bp, Chlorella protothecoides
acgaggaggaggaggaggaggaggaggagggcgagatcacggtgagctgactggagggcttggagtggagtgatggggagggccccgggggtgtgcctggctggccg

SEQ ID NO: 29404 - DNA, 65 bp, Chlorella protothecoides
ccgaaaggcactcgcccgcacaactcctgcacaaggtgacgtcccgaaggaaaaattcccactgc

SEQ ID NO: 29405 - DNA, 63 bp, Chlorella protothecoides
atcttgggaatcagaggtattgggtgtccaagaggctgcctgagggcatatcttgctgtggtt

SEQ ID NO: 29406 - DNA, 79 bp, Chlorella protothecoides
caggtgtctccggagcttaaacggccgggcaacatcctggatatgactgggctcccccactcgggatctgaagggagcg

SEQ ID NO: 29407 - DNA, 127 bp, Chlorella protothecoides
ctgctgtagtgtgcgagcttgcaagcaagagagctgttgagcgggcagcagttgtgaatgtagagtgggaaactcggccacatgtgtgcaataagaattgtctctggcaagggtggttcgggtgacg

SEQ ID NO: 29408 - DNA, 61 bp, Chlorella protothecoides
atgcgccccatccccacacactggcgtcccaccgcctgcaatgtgcagactctggcagaca

SEQ ID NO: 29409 - DNA, 61 bp, Chlorella protothecoides
aaggcactctcctcccccaccaaggcactcccctcccccaccaaggcactctcctccccca

SEQ ID NO: 29410 - DNA, 76 bp, Chlorella protothecoides
ttctgacagactgttggatgtggttggaaggttgctcgaacttccaaccacctccgcgtcagaccgatgggattcg

SEQ ID NO: 29411 - DNA, 134 bp, Chlorella protothecoides
gacgggcatgccatggtgatgctgaggggggttggtaggtcatgtgaagcaagggcacaagaggcacagcctgcagtggctcccaggcatggaagacatgaaatttggtcgtgaaacacccctcctcaaccccc

SEQ ID NO: 29412 - DNA, 61 bp, Chlorella protothecoides
gagatgggcaatgcttgtgtctctccatgcccttgccatgcctacaccatgtggcccctcc

SEQ ID NO: 29413 - DNA, 79 bp, Chlorella protothecoides
cttgccatgcctacaccatgtggcccctccccacccccgcccacccttacaacccgtaggccaaggagatcatgtacca

SEQ ID NO: 29414 - DNA, 109 bp, Chlorella protothecoides
ccgtgccacccaatccagaccctgtaggcaaaaggcgggcgagcaggtgtcaaagatgagggaatgaactgcatgagggtgagaataggtctccagttgccctggaaag

SEQ ID NO: 29415 - DNA, 72 bp, Chlorella protothecoides
caacaatggccaccagatccatggcaggcgacgaaggccaaggcggtgacccacattgctgcctgcgcaagg

SEQ ID NO: 29416 - DNA, 339 bp, Chlorella protothecoides
cgaagccctagactggtcggcggagcagataacaccgcccagtcagcgcactcacaatcagagggtaccagtcgacctgctaataacgaagtattcgtcagtcgttgagcagcgatttggtgtgggtgtgaagccctatgaaagggagggaagaggtttgagccttacgtaagcgtccctagggtgatctgttctatgacgacatgcctgcccattgattggtcagaactcgctgactaccttatttgatagagttggtgtatccgcaccataattggggatctctttacgcattgttgtggagcatgatcgtcagaatccgtcaaagtattctacaag

SEQ ID NO: 29417 - DNA, 61 bp, Chlorella protothecoides
ctcccctgcctcgattgccggcagcctgctgggcaagggctaccaggtgcggcaggtctgg

SEQ ID NO: 29418 - DNA, 77 bp, Chlorella protothecoides
ggtctccgggagtggcgctggcgtacagtcgagcacagttggtcatgatcgcaaacagtgcgtcaggccgccgcaaa

SEQ ID NO: 29419 - DNA, 100 bp, Chlorella protothecoides
ggaataggcatacctgcaaagaacagggctaatgatgttcaagccctatcccatgacagttgtggagtcaccttgtgctatggaacgtcctccttcatgg

SEQ ID NO: 29420 - DNA, 72 bp, Chlorella protothecoides
ttttggtccagacatgtctcatgcccccctcccaccagagaatgaaaaggtgtggcatgtgggttgagcatc

SEQ ID NO: 29421 - DNA, 61 bp, Chlorella protothecoides
tggacacgccccgcctgacgtgcaggggggtgagcagcttgggatcctcgcacaccaactc

SEQ ID NO: 29422 - DNA, 174 bp, Chlorella protothecoides
ggcagccgctccgggtacctgcagcgttgcaagtggggatggggctgatgggaccggtggctgctggggtctgcactggagaaggttgagaccagtctcctgtgtttaggtgttcacgctctccaaaccacgctgccatcgccgtaccttgcaaagacgttggcggacacccca

SEQ ID NO: 29423 - DNA, 70 bp, Chlorella protothecoides
ttccgaaacggcttctcgtgcatgtgccagaccaggccccgtcgcaggtttgggacgatccacaccgccc

SEQ ID NO: 29424 - DNA, 137 bp, Chlorella protothecoides
caggctgccgcggcccggtgtcccatccccatggcgctcggctgcgcgcagctccaggtcccctcgccctgcacccctgtgggtggggtgggtgggaccggggtcccctgcgccgctcccagccagtccctgagttt

SEQ ID NO: 29425 - DNA, 152 bp, Chlorella protothecoides
cctcccggatcgatgagagcaaaatgagtgtgccgtgcgcgcaggctcctccatttcctcccgcatccctccccgccccacctgtcgttgatcatgatgtttggcatgggcctcacccagacgtggtccggctccatcatgaagatgtactt

SEQ ID NO: 29426 - DNA, 61 bp, Chlorella protothecoides
gcatttggagcagcgacaccggcaggggagggttcacgcttgtccgagatggctttgccgg

SEQ ID NO: 29427 - DNA, 103 bp, Chlorella protothecoides
ttccggaagccctcgatgtcaagatcggtcttaccgtccctcgtgggaacgttcagacacacgccagcacaccttgatggtggtctcaagaatagagcggcta

SEQ ID NO: 29428 - DNA, 61 bp, Chlorella protothecoides
gctggggtttggagccacacaccgatgcacacccgccctgccccagccactcgaacattac

SEQ ID NO: 29429 - DNA, 71 bp, Chlorella protothecoides
caccttcctgtgccccgccattgaggtgtggcgtttttgggcttaaccaggacatgcatgcagctggtttg

SEQ ID NO: 29430 - DNA, 255 bp, Chlorella protothecoides
catgagggactgacattctccataggcaaattccaggagttcgccaaggcccagatggttggataagacgacgctgttgttttcaatttaattcaccgatgaggagctcagtggcagcagtccatgcacacatacgttgagaaagctgccagtgcccttctctgtcatgtacaaaccaaagatgcgtcccctcgaagactgccacagagaatggtgctcatcatcgccatgttacctcctcgatagacaattgtc

SEQ ID NO: 29431 - DNA, 143 bp, Chlorella protothecoides
gggcagcctgtgcctcgccctgcgcaggccccttcctcccttccttccttcttgccaccttcaccccccttctatcctcagcactggatgaccctcctgcgccccaccccataccttttgcacagcgccctacaagctgacca

SEQ ID NO: 29432 - DNA, 93 bp, Chlorella protothecoides
cgtgcgctcatcgcgcgggggagtttcctcaaactcccaaaccaggcgctgggagccgacgcagagggccagcggggcgtccaggccggggga

SEQ ID NO: 29433 - DNA, 89 bp, Chlorella protothecoides
gctgccaaggggtagagggttgcaacgtcttgggtgctgggctgtgtgtgccacccccgggaagactcgtttgtcttgagattatttgc

SEQ ID NO: 29434 - DNA, 105 bp, Chlorella protothecoides
ccgagaccgtcatctgtcaaatggagatatggaataggagtttgtgacacatggtgatcaccttgcaccaaaatttgggctggcaagcagggcctgcaggtgtgc

SEQ ID NO: 29435 - DNA, 63 bp, Chlorella protothecoides
ggtgctttgggcaaatctacacacacacacacgcacacactcacgtggcctcatccacccagt

SEQ ID NO: 29436 - DNA, 61 bp, Chlorella protothecoides
gtgctcgcaggtctgctctcaggggacgtcacctgccgctcttcttgtatgaccggctcac

SEQ ID NO: 29437 - DNA, 61 bp, Chlorella protothecoides
gacccccgcactcgccgcaggcctacccgcaaatgcaccccctccccttcctcctcccttt

SEQ ID NO: 29438 - DNA, 80 bp, Chlorella protothecoides
ttgcccagccccatctcgtccgccaggatgcctgcggtgcgaatgggggcaagattgacgagctcgaccaaaggaagtgc

SEQ ID NO: 29439 - DNA, 61 bp, Chlorella protothecoides
gcccagtgcagggtcacacagagcgcttgcgccggccgggccctggcagcaagctgcacgc

SEQ ID NO: 29440 - DNA, 152 bp, Chlorella protothecoides
tttatgatataatccttctgttgcacaatacaatatagcatgcaccttactgcctgccccacatatcattctggtttcacactgagcgcctgcctgttgtgggggccccatctccggaggctccccctttccacctgcatccgtgccctgcg

SEQ ID NO: 29441 - DNA, 227 bp, Chlorella protothecoides
cggcctcccctttgtcgggtttggcatcatagacaactccatcatggtgagattctaagcgcatttcagagtggtgaaggggggtcccaacgtgtgggccgcagggtgctgggtttggtctctcgatggtcgcggcgcgctcagctctggaatgcatgtgtgagcggcggctcagagatatccccccacctccggatcgccgcctcaattcaccagatcatggcggg

SEQ ID NO: 29442 - DNA, 72 bp, Chlorella protothecoides
ctgatgccggcccatgctgcctggcagcttgaacccgatccccccccaaaagatacatgctcgccgcgccca

SEQ ID NO: 29443 - DNA, 61 bp, Chlorella protothecoides
gtcatcaggactcaagcatgaggtggccgtaccactggcagcgttctggtgattgatgttg

SEQ ID NO: 29444 - DNA, 89 bp, Chlorella protothecoides
gtgtggtttgttgggtgtgagggtgaggtgaatgggtgggggccagaggtatattgatgaagagggtcccagtgttggctgcagaggta

SEQ ID NO: 29445 - DNA, 62 bp, Chlorella protothecoides
tgcaagccggccgccctggcgcctgggtgccctgcaagccggccgccctggcgcctgggtgc

SEQ ID NO: 29446 - DNA, 71 bp, Chlorella protothecoides
tggacaccgcggtggcatgccaccaaatcgtgcccccagaacacacttaccatcccctcccagggcgctgc

SEQ ID NO: 29447 - DNA, 173 bp, Chlorella protothecoides
agggcgctcttcctatctcaaggtgcaaggaaagacccgggatgttgtggctttacatgtcagagtgaggcacccctcagccttgccgagaaatcgtgaccagaatgtggacaagaaagcgacctgcttgccagcaagcaattcgcagtatgcatgtgcactcttcggagagt

SEQ ID NO: 29448 - DNA, 1916 bp, Chlorella protothecoides
  modified_base (906)..(915): a, c, t, g, unknown or other
agccccccgccgcccagtcccccgcctccaccccccgccaccatctatgggacagtgcactttgaggcctatcccaacgaccccaccagcgtgctcgccacctacacgctcacctgcattggctacgtgcccgtatacgtggagggccacgtctacgacgccagcctcgtggagtccgtggggcagcgggcagaccccagcgtggacggctcgcccacctccaccgtccaggctcgccacaacctggcggatgcggtgggtcgcctggtgtacggggccacggtctccttgagcgggctgacggcgtggatcgaggccgggcccctgaccatcaccagcgacctgacggtcgagcccccgcccgtggccccgccgccgcccccggcagccggcatcagtgggacactcgcccagtcgggctcatccttcaccctgtcgatgacggcagatggcgttgtcccctacttctacagcgtggccttttgctatagcaccgacgggatcttgggcgtgcggaggatcgtggtggggtatgacaatccctccacctcctccttctcgctgaggaacaacatttacgccaagtattcctatgtgaaagtgatcgggctcgacactgacagcaaccctgtgacgagcatgatccagctgttccccgtgccaatgtaggggcactgggaggcatgccatatgccctcccctcctcccatgcccccggtgatgtggtcagttgcattctttacgtgaaaaaccctgtcaggatgccgccaaagtgcatgggcgatatttgtctccatgggccctgccactcgtgctgctcactggcagtgccctggaacacaggggggtatcccttccactgttcttgcttcgacatcaaccactttcccctgtcaaggcaatccnnnnnnnnnnagccctgccactcgtgctgctcgctggcagtgccctggaacacagggggatatcccttccactgttcttgcttcgaaatcaaccactttcccctgtcaaggcaatccacacgaaggctgggacatttggggaggttccaggcagcgcttttcccacccacgaagggccaggccttgcagcacccccaaaacactgccagctggagcagctaggccgaggcccaagccgtcaagctgatacccttgcaggtcgactgatctccaagccatgcatgcagactcggccctagcaggatgccaccacgaataaggcaccccaacggaaggccgggtgtgaatatgcgcatcccgaggcttagggcgtgacaagcagggacagcaactgcagcaatcttcaacgttttcgtgagcgggtcgtggcttacattggttgtcaaatgttaccatcccctcatcccttagcaaggaggatgcgcaggggagtgccgaacgcccccagatcaggctgcttcaagcatgttgatcgcgcgtgcgcaccggtagctcagcgctccccgatccatgtctccttcaaggggacactttccgcatccaggccggaaaatacggcacaataggttctcgccaagtacatctccgatctctgaggcttgccgccgtttgtcatcacctccagcacgatgttccgccgagccctgaccctgttcgggcaggggggtgggttctcgggccgtctgccacggcccactgggacgaggggttcccgcgcacgctcgagtggtaccaacaattctgggcctagttcagcccgcactggctccctcctgggcggcttgctagaggcggggctggcctctgggggcctgtccctgctgggagacttgctggcccagcacctcacctccccagccggcctgaaggtgcgtccggattgagatccaaggggaaggcaggtcatgcacaggcacgcctttcctgtccaggactcagcggccagctcct

SEQ ID NO: 29449 - DNA, 5014 bp, Chlorella protothecoides
  modified_base (205)..(214): a, c, t, g, unknown or other
  modified_base (1502)..(1511): a, c, t, g, unknown or other
gggggatgataggggaaataggctgaagccgtgagaagtgtaagaggcttgtgcactgtcgacatctacaggggagaaggaagtggtccctcgcgcgggttggtgccggacaccagctcgaatcagagcacagcctcgtgctctcgtgccaacacagaccttccccagcattattgtgcgctggccctcaggctctcccacactnnnnnnnnnnaagagaaaagtaagaggcttgtgcactgtcgacatttacaaggagaagtaagtggtccctcgcgtgggttgttgccggataccggctcgaatcagagcacagtctcgtgctctcgtgccaacacagaccctccccagcattaatgtgcgctggccctcaggctctcccacactcctcctcgggccttaatcacccacccttgctcctgtacccttcacagcctccgaggtgggggagctggcgcgccagatgtcggcggcgcaggtgagcgaggcgcttgaccgcggcaaggcgcccattgagagccacgtgtctgggtcgagttcggggctggggtcgccgccgcaccccgcggcggggaccagcggcgcccgcacccccgaccgctcgcgccgcacgctgtccaagggcgccagcctgatgaaggagcaggggcggttcaaggtttacgagggcgacgaggcgccgcccttcgccacgccccccgacggcgggcgccagaacggggcgcagtatctggacgactttgcgcgcgcacgcgggacgccgggcgacgccgccgccagcaccgaggcgcaggagctggagaaggccaagcgcaagggtcggttcagatacgtggaggaggacttcgaggcgcgggcgcgcacgccagggctcgcgcagtgagtgctcagaaaagggctgtgtgtgtgtggagggtaggggggaaatgattgggtgggacaggagatgacgcaaggcgcttgcaaaggaggggaggtgctggcctctttaatgctgcggggtgctgagtacggcagcgcagggacggcacatctcgtacagcggcgcaggcgggggtaccctggccgccaagggtgtgatacgcagacacgcacgtcccagagccatgctacctgaattccctgtgcacgtgcccctccatcaacactcccatcctcaaaatcccttcctgccctcttcatccactcccgcagcaagagcgccagcgtggcggcctccctgggagaaatgcgctccatgtcctccgtcagccccaccggccctcccgtgggcatcctgacgccccacctgcagcacctgctggagagcctcaccctgcagcaggagacgcttcgagagatggtgcgctgggttttggggcacgggggacattggcggcttggctgggggtggaggggctgacatagcaccaggccccctgcagtcaccgcgccccgctgcccgctcacccccccccctttctcgaactcgccgaacatcgccaggtggcgggcgtcagcgnnnnnnnnnnggggtttggggcacgggggacatgggcggctaggctgggggtggaggggctgacgtaggaccaggtcccctgcagataccgtgccccgctgcccgctcaaccacccccccccccttctcaaactcaccgaacatcgccaggtggcgggcgtcagcgacgcggagcgcggccgcatgggcgcgctgaacagcttcatcagcgagcggcagaccatggcgcgggcgccgcgggagtacgtggagcgcctgcgccaggaggtcctggagctgcgggaggagaatgcgcggctccgggaacggctgcggcagggcagcagcgaggggccctcccgcaacaccaccagcgagtcgcagggctgaagccccaggcctgccccggccgccctctgctcccaaacacgtaccccagctgagcagactggattaggataggcaccaccagccgctgcaatagatgtaatgcttgtacactagcgatcactccaggagggtgggcgcccatcatgcatgggcaagatgagttgccacaccgtcgccacatgttgccctgccgggctcgcgccggctgcacggagcctttccaagatccaccctcgtgcgcagttggttgccgcaggggctctgctggggtgagacaggcgaaagagggggggagagcaggcgaggagcgcagacaagaagcagtgggatgcgccgccctggccacaagctattcagccaccactcaagggtcgatgacgccggtgacgtcacggttcacagcagagacatcaacgtgcctgatgctacatggcctggtgtcccagacgtcctccagctcccatctgcacctgcctgtactgtggtgggcttgcagggtgatgtggcagccacagcacaggttggacgtcttgtgcaggtcacccacaaataccctgcacactctctggtactgcacacatgcaagaattctcacgatccgatctgaccacgctggagaaggtggtaacgacttcctgcctgtgagtgcgaccgtcaaacctcacattgaggccacagcgggccttgctctttccagcatgctcagtcatcccatgattcccctgaaggctctcgtcggccccgtaggctgatcgatgacatgccctgggtgtgctgtcagaatctgatgggaggttgctctgcacttcccatggagattatgccttctctgaggacagcagtgtttgagaatggaagcatccagacaaacatcatgctgtccacaggccaaagtctgaatagactcctgctggttcatagtttgtcccatggaatggccatgatcggcattggtaaggtgcccaaggagcccatcggcgttctcacgcttgaaaaaatcttgcagaactacaggacatggtccaggaaaacggaactgattgggtctggagggaggtgggttgacaggggtggccaccttagctcaaagcacaggatgggcagcttgatagagcagtcttgtagcggtcttgaccttagttggtgtacatttatggttgaagcgtggaacccccgtccacctagccatctcatcttggcctctaaccctattaaactttcaaaaacaataaacatttcagttaggcgccttgacgtggctctggaaatgacgaagatcgattccacgcgcagcaatctctaagctgaggcaggcgacgctgtccgctgtacccggctttggcaacatcgcgccatctgcattgatgacaactagcctggcgcgcacacgctgccacgtcccaccatgggggaatgcgccaggtccagacgccagcgtgagcccatgcacataccactgcctggcccaccacactgtcgagcacggagcaggctcgctggtgatattaaaatcgctccaacagtaaaagggctcgtctctgagccgcgtagatgtgtctcagaggtgacgcgtgcggatactaggaagtccagtggtcgatgggcagcagggaaaggccaggagcaagataaaagctcaccacatccatggatgacgcgtgcgaagtccagaggcgcagctggcatacagtctaacaccatggaggctagaacaattcacagcagctggctggcctttgcgcaggggtgctccatgcggccctgtccaaccccgtgcccaccctttcaatcaggacaatgtcagttctcaaccgcggctcacaagatgtgctgtccctgcagcaaccgatgctgctgccagcgccccaccctcctgccagaaaatcagcttgagaacgctgcattgcaacttcgtagattgagttaaccatgaggcagaattgccagagcccaaatcttgaggtgcgatgaagacagggacggccttgcataaattggtcagccttatcagtactctcggaaaatgcatggcgtccagcctttgggggggtgggatatgatgaccttgaatcaactcgctgacaccagtgtccatcagctcagtggacacctgcaagatgctgcagccactgcggtcgtcacttgcttgtgaaatagatcctcacctgcccttttgatcgaacatgtgccccactgcgccagcctgcagtatgagggatagagtaatcgtgcatgtggcgtgttgcagttcgcatgaacagacgcaagaggcaaagcttgcagtttcaggtgtgtcgctgcatatgtgtgcggagtgcagctggccagaccctcacccatgtcacacagcgaaccgttgtgtggacagacagtcattgggccatagactcacacatatgggatcggcacaaaccttctgccaccatcatctcaagcacaccttgagttcatgacctccgagaggcgaggtgcgcctgccagtagctgagcggacgccgcagcactgtctggcaaccaggacaccagcaggggggaggctgccttgtttcgcaatgctcatcccagccagagcgtttccctcccgacgctgcggttcactgcgtcgcggatgcttgcagagggaatgacctacaaccccggctgccaggctcgtcaccagccagccatccgctgggtctgtttggcgcatgtccggccaactcaccatccctgcaagtgcagcatgcagctcgagcgcacatcagtgacccctgcctcgccgtccctggcaatcagctagatcatggggtcaacagcccagcctggggcacgatgtggtcgcatgagcacacctcctggcaccaaaacctttgaaggagtgcaccattgaggaagtgtgtcattgcaatggtcctttgagcagcatgtgaggatctcaaagtctgtcgaggagcagggccacatacacctggtggcttcaacatagctccttccaggatatatgaacgatcccaagaagaccacagtggggcacggccgctgtgcagtcatcgccacaccgtcatgaggtcgccaatcgggacagggtccatcgcatccttcaaggccagtacaggcaggaggtgtgacgaggtgtaggagcaggtgtcagaacgccacttgctt

SEQ ID NO: 29450 - DNA, 114 bp, Chlorella protothecoides
gctcggacgccgggatcgcattcaagggcccctgcgaggcacacgccgcgccgcccacgacaggaggaaaccccaccagacccaccgcccgcccgacagaccttgccctccacg

SEQ ID NO: 29451 - DNA, 78 bp, Chlorella protothecoides
agcccttgagcctgcgttgtcgcggtgagcgctctctcagaactgccccatctcctgtggacggcgctctgccgggcc

SEQ ID NO: 29452 - DNA, 76 bp, Chlorella protothecoides
tatattttgaatcgttgcggctgctttgaggctacaaaactccacacagggaagcgtggctgcagacacaagcaca

SEQ ID NO: 29453 - DNA, 61 bp, Chlorella protothecoides
gcgttcgcatctcctactggccacgacgggtcctcccgaaggggcgagaatggcccccgcc

SEQ ID NO: 29454 - DNA, 106 bp, Chlorella protothecoides
ggcggagaggagcggaggagccatgcgagatcgacccccgcgtcctcgtgctgccggcatcacggccaaccaccatgcgcacccgtgcttcccccgaaagtgggag

SEQ ID NO: 29455 - DNA, 78 bp, Chlorella protothecoides
acctgtaatgataccgcttttcaatcttccggggggtggagggggggacgcaggccctgccggttgttgcccagggga

SEQ ID NO: 29456 - DNA, 105 bp, Chlorella protothecoides
gcagagaaagccctcctggagcatggtgagcagaatatctttgtgaagtgtactctgttgtcacgcttatgcacggtgggagtgccttgatatggtgcggctcca

SEQ ID NO: 29457 - DNA, 1141 bp, Chlorella protothecoides
  modified_base (486)..(666): a, c, t, g, unknown or other
gtgtagccttgactgtgggcaaagtgcagtgagtcagatcctcgcccacaccgacatgcagcccgacgcgccttggagacacacatcttggagctacatgaatcttcttgacctcgttcactcgatcttaccatgaattccatgacagttgaggtagagggtgcgcccgtcagcagctcagcagacgccgcggcacttcctggcatctgggatgccatcagatggagggatgctgaggccctgagcgcacagcccaccccaagcttgtcacttgccgatactgcagctcacgcctcgcagacactgatacttggaatgatccacaggcccagctccaatccagacgcaagccaggcttccgttgggtccactgggtgcaaggccagccaatgcaacggcggcaccgatgcaactctcatctatgcccatgaatgagtggctcgcccgttgcagccactggcaatcaggcttgctgtaggctggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgattcaacagcatcacccaattcccaccacgacggcatcactatgacctgcacacctgggatacttctccaagggtgatggcagcggtggcacagtagcactcattgggcaatcccagtgagtccagggaaaggcaccgtcagggcataggcattgctgcacctagcgccgcgctgcagagtccaccatgcgcggtgatcacacgacgcaagcggccatggtgtgcgcgcctgcagcatccctcagggcaataagcgtcgccaccagctgctcaatatcctcttgctggtcggtgtcaggtgctccagcacctgctcagaggcagtgggctcacatcaccctccggcaccacgcggggtgctcaatgcggccggtgcacagagcatgtacaagcatggtgaatcgaggtgagctcatgatagcagcagccacgatcctgctcgcgcaggaacgcgggttgcccacacaaag

SEQ ID NO: 29458 - DNA, 76 bp, Chlorella protothecoides
agcatgctggcctggttggccatggcccctgttgttccccggcattgtcctctccccttcaccatttcccctcttc

SEQ ID NO: 29459 - DNA, 75 bp, Chlorella protothecoides
ggatgcgccgaggtcagacgcgagcatgcacagtttgcctaccaatgcctgagccagcactccttcgtgcgaggg

SEQ ID NO: 29460 - DNA, 114 bp, Chlorella protothecoides
ggaccatgcagtatcacgcctcgcggtggagtgatgtggaggcggcggtacagttctggtcgtgccaggggcaagacgaccatctgtctcagagtgtgcagttgctccgagtac

SEQ ID NO: 29461 - DNA, 61 bp, Chlorella protothecoides
ggaacccttgtggacagtcccgaaccccactcatcatgcgctgggtaacattcagcacctt

SEQ ID NO: 29462 - DNA, 97 bp, Chlorella protothecoides
agcgggtcgaacccgtggtggaggtgagcaactgtggtttgccgctcagaagggggggggtgcccttggcattgggacggcaagggcatgaggtccg

SEQ ID NO: 29463 - DNA, 113 bp, Chlorella protothecoides
cgcccaaaagaccttgctgggtgctggcattccggtcacggtgagcaaaatgacttggggaaaaagggtgtcctgggcggtgatgcggcgcagggaggtgctgagggggaggg

SEQ ID NO: 29464 - DNA, 61 bp, Chlorella protothecoides
cgacatgcactatttatagcttccccgaggtggcgcttccctgccacctgaccgccacccc

SEQ ID NO: 29465 - DNA, 75 bp, Chlorella protothecoides
acgatggctgtgggattggggtgtcaaggaggccattgagggtccgtatggacgggtgacctggcaggcagagag

SEQ ID NO: 29466 - DNA, 132 bp, Chlorella protothecoides
gtcagcaccacgcagaagcaatgggtggcctctgcgtctcccacgggtcacccggccagggtctcccagagaaaggcttgctcacctgcctgcacctccctgtcctcgtttactcaacctgcaccaccgttt

SEQ ID NO: 29467 - DNA, 61 bp, Chlorella protothecoides
atcgtgcactgacgcatatgagccggcagcacatgtgctccctcccccgtccaccggcggg

SEQ ID NO: 29468 - DNA, 114 bp, Chlorella protothecoides
ccctgccttgtgcagcgcagcttctcgcaccgagggcaacgatgctggggttgcgaaaggttgggttgatggccagcagggaccccacgaggtcaacagcccactgggacaggc

SEQ ID NO: 29469 - DNA, 61 bp, Chlorella protothecoides
gacggccgcgttggtggcgttggccgcgccagggcggccgctgaggtcggtgcgggcgcgc

SEQ ID NO: 29470 - DNA, 77 bp, Chlorella protothecoides
ctacaagtacggcacccagtccctcatcgagcgtcatggcggtcgagtaaatgctggaagacgcaaaagcgcggctc

SEQ ID NO: 29471 - DNA, 67 bp, Chlorella protothecoides
gtccttgtttcgactgcttgaggtgtgtctttgtgcgaggaaaacggggggcggggtggtcgtgctc

SEQ ID NO: 29472 - DNA, 89 bp, Chlorella protothecoides
gagcagcttcccgataccttccttgacctgtaagtaggacaagtaggttgtggtgttgaccctcatgacatctatgaacatgtattgac

SEQ ID NO: 29473 - DNA, 73 bp, Chlorella protothecoides
ccgtgggccaggatgtcgaggagcggtcgaaagtcgacggcacgagcccttgaagcaggccctcctcgcagga

SEQ ID NO: 29474 - DNA, 79 bp, Chlorella protothecoides
ggacagcgccggtgccatcagcttcttcttcgaggcgggggcctttgattcccagggcgcccaggtcaagcccaaggag

SEQ ID NO: 29475 - DNA, 72 bp, Chlorella protothecoides
ccccacgtcgtggtcagcaaccgcacgccgttggacgtgtcgctgctgcactgcgcgggcctggtggagcgc

SEQ ID NO: 29476 - DNA, 604 bp, Chlorella protothecoides
  modified_base (224)..(295): a, c, t, g, unknown or other
agggacccacgcgccctcgcggcgaccggcgactcctcgccccgcgtcgacgctcccgcccagcgcccgacgccgggcgcccaggacccggcgccgcgcggccactccggcgggccagggatgctgcggctgacggactacgcgcctccccccccagagcccctcgtgccctggggcatggggcccctggtatcccggtggcagagggcgccgcccccgccctnnnnnnnnnnnnnnnnnnnnnnnnnnnnnnnnnnnnnnnnnnnnnnnnnnnnnnnnnnnnnnnnnnnnnnnncaaagacgcgccgggcgcagagcggcagcacggaaagggcacccgccgaggccctttccgatcgcgtggcggcggccgcggccgcggcagagtcgacgggcagccccgccccgcccagccccggccagagcgcacgcagcgtgtcgctgacgcagctggtgctggcccaggccgccggcgcggcgccggcaggcggggggcaagaacccgtcggcgcgacggcgccgagtgatgtcccaagggacccggccgcggccgcgccgccgccccggcccgaggctgacgacgaggcggggtggcaggggacgg

SEQ ID NO: 29477 - DNA, 79 bp, Chlorella protothecoides
accgtatcaatgacgaacagacggggtaatctgccctgtgcggtgcgcgttcacacccccgtgagccgggacagggtca

SEQ ID NO: 29478 - DNA, 161 bp, Chlorella protothecoides
tgcccagcccgggatgctgggcaagcagcatatgatggatgatgagagttggggactttccgcacgtgggcattccgcatattcctcaagacccgctcagcataataacagtactgcaggggatgggaaactgtgtgaggggttgacagcatcatcacgag

SEQ ID NO: 29479 - DNA, 61 bp, Chlorella protothecoides
gcaagaccccgtcacgcagttcctcccctggtacctgaccatttctccttcaggatgtcca

SEQ ID NO: 29480 - DNA, 133 bp, Chlorella protothecoides
gggatgaggatggcgatgagggactcagatgcaaaaggaagggggggcggggaagctgctaggcacctggctccagcctggggttcacgcatgactgagcgcggcactcccaccccattggcccgtggctcgg

SEQ ID NO: 29481 - DNA, 70 bp, Chlorella protothecoides
aaggaacagggcaagatttggaggtgatggtcgcaacatttgatcatcgtacttcgcgaacagcttcagg

SEQ ID NO: 29482 - DNA, 365 bp, Chlorella protothecoides
cggcgcggtgccgcggcgccgtggcgcggccggcccctctgacgaccccttcgcggacccgcggcgcgcgggcgacgccgcgcgcgtgcgcgccttcctggaggcccacgacccgcacctgctggccgtgggcgcagggcatcccgaggcgcgcggcctgcacgctgacctggcgggcgtgctggacagcgtgctggtgcacgcccccgggtcacgcctggcatcgggcctggccctggtctgggccgacgagcgcgtggcagcggcctgggagggcagcgcggcggcgcacgcggagctgccgaccgcggcgggggtggtgcgccgcgcgctggcgctcggccgctcgctgctggacccgctgg

SEQ ID NO: 29483 - DNA, 65 bp, Chlorella protothecoides
gtgtgtggtggtggggggtctgtgtgtgtggtggtggggattgtttgtcggggagcgccttggag

SEQ ID NO: 29484 - DNA, 174 bp, Chlorella protothecoides
gactgggtccgttgttagtccctgggacgcgcaggaggagcagtgtatgtgtatgaatggtaggattggcggaattgcgtggtcgacactcgataataaacgagagattgcgtgcaacttctgcaaataggcatgccactgcacacagatcagcaggcacagccacagccggtg

SEQ ID NO: 29485 - DNA, 61 bp, Chlorella protothecoides
ggtcctcctgcacgaccgctttgggccggagggcctgcgcatctggcgcctgctccgcgcc

SEQ ID NO: 29486 - DNA, 187 bp, Chlorella protothecoides
ccaggcgtggggctgagacgcgggagggcgttgtcgatgagccctggtcacgggcagggatcgcagtcccagtgtggggctccatctcttgctatagatgcctgcagcaggcggacttgttgccggggcggtcggctgcactgagtgcaggggctcaaatcagaatcccctcttgcctcctcgccat

SEQ ID NO: 29487 - DNA, 61 bp, Chlorella protothecoides
gctatgggcggaggggacgacctcttcctgtgtggtggaggggaccgcttcttgaggggcg

SEQ ID NO: 29488 - DNA, 94 bp, Chlorella protothecoides
gacataggcaggctcggcctcgccccgcccaccgcgcgggcctctggtagggtcgtcgtcccagcgccccgccgcaccgtgctgcgcccccggg

SEQ ID NO: 29489 - DNA, 61 bp, Chlorella protothecoides
gcatcttcttggccgtggcgctggacacccacaccgtcacctcgctcttcttgcggttctc

SEQ ID NO: 29490 - DNA, 206 bp, Chlorella protothecoides
gcggcaccaggggggtttgcctgtgtggtctagggagacggcttctcacgggtcggccagggtcccacctgtgccctgccccggccctcgctgcgccaatggtcgcttccagggtcctgcgccctggcatgccggcaggcccttttcctctcagtgcagctggggacctacatcttcacacacacacacacacacacacacatcct

SEQ ID NO: 29491 - DNA, 73 bp, Chlorella protothecoides
ggtatggcgtcgtagatacgaacgagttgcaattccgccttttactgaatcgcaccgcgtatcttcgacacaa

SEQ ID NO: 29492 - DNA, 113 bp, Chlorella protothecoides
cctcacgagcctcagccgcctgttgcaaggagacagcgttaggtgatggcttgcgatgcagtttgcttcccaggccaggaaactgggcttttctgggcgctctgcccatgctt

SEQ ID NO: 29493 - DNA, 157 bp, Chlorella protothecoides
ggcatgctctggtgggtgaggacacctccaccaagtgaccggcacccttacattctcatcgctgcccaggcccactgcaagcatacaaacccatctgaacgcaaagccacgttgcgcattcctctgacactccctgggtggccctgcggggcgagcg

SEQ ID NO: 29494 - DNA, 61 bp, Chlorella protothecoides
cacatgtacgtcaccctgaagacgggactgctgctgcttggcacatgcacctgtgttggtg

SEQ ID NO: 29495 - DNA, 61 bp, Chlorella protothecoides
gctcctgcaccgaccagcggtgcccacccctcccccgccgtgacacccaaagggcctcagg

SEQ ID NO: 29496 - DNA, 75 bp, Chlorella protothecoides
ccagcccggccctgacgtcctgtcgcatggagtggttcgagggagggaatccgtgttgtaatgcttggttgtaca

SEQ ID NO: 29497 - DNA, 79 bp, Chlorella protothecoides
cccacatcccggaaccgcagccttggcatccttacagtatttgatcggcagtgcagccgctcgcaaggctgacgcttgg

SEQ ID NO: 29498 - DNA, 833 bp, Chlorella protothecoides
tgtgtgagagaccaggcctccagtgcggcagttagagctctttgcattccagagctgctgtctgcgcggggattgggaacagaaggggtcagacaaactggaatgcaagacaacaaatggtatggggtccttggtgcagagctcaggcgtatgccaattcatcccaaaggtcagaaattggagacaggaaacctcatagagctacatcatcaatgctctgggcactaagaacaaggaggagtaatcaagacactggaaagcctcagaatgggctgcatccctcatcaacaagatcagaggatggaagcaggaaagctcctacagccaggtgtcatcataggtaaaagtaaaatggggggaaaacaatacttaaacagggagtctcagacacagctgcgcgattcatccatccccgaaggaatcagagagaggaagcaggaaagctccagcagcagaaagcgtcatcaaggacagaggaggcaaatgtgcatgcaagcataaggcagcgtgattcagatggatgtgtccctcacaggagggcaggcggaagcaggaaagctccatgatatccatggtgtcatcagcatcacactgttgtgttgtcgcaagcacgaaatcaaggaaacagacagatcgagactcagaagttgctgcacaaatccacacagatgattaaggtagcgggagcaagaaacatcccattgtgatatgctttcgtcacagtctcacgagtcgagatcattcaagggaaggaggccaatggagctcagacagaggtgccatcagacttcaaacacacgaatgtgcagaagaggtagagggcaggaaagccc

SEQ ID NO: 29499 - DNA, 61 bp, Chlorella protothecoides
tgcaggcgaggcgctggccatctgggccgacatgcagcgcctgggctgcaagcccacgggt

SEQ ID NO: 29500 - DNA, 123 bp, Chlorella protothecoides
ccaggctgacctggcccctgccacccccaacggccgcctgggcggcacgcagcacaacaagctggtgacgcctcctaccctgcgcggcgccaccacccccgcctcgccccaactgagcaccag

SEQ ID NO: 29501 - DNA, 141 bp, Chlorella protothecoides
gagtcgaattaatccaagggagtttcccccgtcggatgtcgggacacggtgccatggtgggcccgctgcaggccggaatcgtggtgcctttcgtcacacgtcaaccctccgccctgctgggactgcaaggtcaggagacgt

SEQ ID NO: 29502 - DNA, 97 bp, Chlorella protothecoides
atgaccctggtgcctcgtgggacactggatatcagggtgtggtagcagaggaggatattgcctaggaagcagagtcgccccgtactctgtgcagcac

SEQ ID NO: 29503 - DNA, 79 bp, Chlorella protothecoides
catgcaacacccctaccaagtgcacctgcgatgcccctcccccatgctgctcacccccctcacagcgcccccatgctgg

SEQ ID NO: 29504 - DNA, 61 bp, Chlorella protothecoides
aatatgcgaagggggggcgggtgaagggggtatttgttctgacatctgcaaaccaggaagt

SEQ ID NO: 29505 - DNA, 70 bp, Chlorella protothecoides
cgaggtgctccccgcggcccaggaggcccccaacaccccagatacctccccctggtggatgcagctgggc

SEQ ID NO: 29506 - DNA, 534 bp, Chlorella protothecoides
  modified_base (146)..(330): a, c, t, g, unknown or other
catcctggaggacctgtccaactccctgccgggcgatgggccctcccagcacccacgctcgcaggggcgtagcacacgcagggccgtacctgctgggatgagtggcggacagggtgggcgtgggagcgcagcaccgtccatgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagtatggatgctaggacgtgcaggctccgaagagggcatgagctcgcctcgtgctccacgatggggcactcgcatctggggcgctgagcagcaggccgggcgcaacacttccggaggcacggagtgctgtgaacggcatgtgcccctcttatgttggacgcccctcgccccaccgtcagtgctttctcccaggcacccagag

SEQ ID NO: 29507 - DNA, 67 bp, Chlorella protothecoides
cgccagcctgccagtcatggagggccttgttggcggaggggatgtgctgaacgctgggcaacccgta

SEQ ID NO: 29508 - DNA, 2373 bp, Chlorella protothecoides
  modified_base (175)..(240): a, c, t, g, unknown or other
catcggccgccggcttccccgccgccgccgcgtcgccgccgcggccggcgcccggccaggagggcatcgcctggcgctgcgccgccttcctggcgccggagggggcctactgctgccgcgccaactcgctgcaggcctacgcagaggtgaaccgcgacgtgctggcggggggggnnnnnnnnnnnnnnnnnnnnnnnnnnnnnnnnnnnnnnnnnnnnnnnnnnnnnnnnnnnnnnnnnncgcgaggcgcccaacgccaagtacgagaactttgtccattcctcagtccaggtgggcaaggcgtattggggaccgagggtgcgtgggtggagagtccagggcaagggcggctgggctgcaagcccgaaccctcccttgacccggtgctgatgaaggaggcgccagtgtcagcaccctctgcacgatgagaaactcccctcgacccccgccaagcagatggggtccaaggcggcagtcggggcggggtgcatgatcggcgaggacgtggtgctgggcgacaagtctacggtcaagcgctcagtcatcggtcccaactgcaggatcggcgcaggcgccaaggtgcggtagaggggtcgcgatggagggcagggcggcgatggaggacgttctgtgtgcgcaccaatctctgccttgaccgtcaggaggtgtgcgctgcgatcactgtgcgccccagctcctcaatacaagacggggccaggtccccccctggcaacctccaaccccccacccaaatgacctcaccgtgtccagatcataaacagcgtgctcatggcagacgtgacggtggaggatggggcgcacgtgcacggctccatcctgtgcaacagggcgggggtgggtgccggggccagcctgagggactgccaggtcagcccagagttcagggtgggcgagggcgccgacctgcgcggggaggtgctggcctccagcagatgaaacgaatcagacagtgtctcctgtattgttttcctgcctcgggcgcccctgccgagtgctgcagcgtgtgtaacagcggttgccgttggaggggggggcgcagggcaggtatcttacgattgccatcctttcctaagaaacgtccacgagcggaagcacctgcttgcgggaccccaggcacttctccagcagataccacggccagcgccatgggctgcattgatcacacttctgtcaggtcacctaatgacattgcctgataggctctgatccccccctgctggctctcgcaacttccttccaggccaggtccctgctggtgggatgaacttctacaacacgggcgggcgaccggccaccttcgatccctttgatgatccaagaggtttcaggtagcttgaggcgtccagggatccagctgcacaccgagcgggcatgggggtgtccggtcattccggggtgcgggaccagcccggggacagctgttgcctgctgtcccggagtgcacatggggcataccacgctgatccacgcactcaaacccccccacaggaagcgtccgaagagcatcttcgtccgacacagcggcaagctcagcgggctggccgtcctcttcctgaccgccacagtgatctacctgcactcccaccgccgtaccctgcacagccacctggctgccaaggactaccagctgaatgctattgtggaggagaaggaggccatatcccgcaccctgcgggaaaaggaccacaaagtgagcgtgaagacggtggagagcgagcacctgcggcgcaccatcgagcggctgcaggaggaggtgtccacccagagcacgcgagccctggaggccaccaggctggccgaggagaccacgcgcgcgtcggcggccaagatcaaggccctggaggagaggctgcaggccgacaccgcgcgctacacgtcccaggtggggctgggacgtggtttgcttttttttgggtgggggtgtcctggcagggattgggtcaccagcgaccaggccatggcagggcaaggcggctgtcatgcgtgatcgaggcgggagcggctgccgccccgcggctttgctgggtcctgcagcggaccccgctttggtccacggcggggatgggcgctcccctgtccgaggccgctgtgcgcccttgtgcggtcaaagtcggatcggcccggacgccactttgaaagccccacagcatcaggccccgctgtggcccaccatacatcctgctgcaccgacccaagcaccggttttcaaaattgcagggcggggagtgcaacgcccgcctcgccacggcgctgtccgagaaggcggccgccgacagccgggcaacgtatgcggagtcgctggcggccgcagccgaggggcgcgccacggccgccgaggcgcgcgcggccgcc

SEQ ID NO: 29509 - DNA, 141 bp, Chlorella protothecoides
cactcaattactcttctccaagcagcggggtaatgggtcctagtgcgggtattggccacattcctctccggctcagtgccgtggagtgatcatcagtagggcgtagtaagcaaacaacatgtgtctggaggagaggatagc

SEQ ID NO: 29510 - DNA, 69 bp, Chlorella protothecoides
cgccgtcttccggctgctgggccgaggaccgggtgcccacgtccaggcccgcgcggagccctgctggag

SEQ ID NO: 29511 - DNA, 164 bp, Chlorella protothecoides
atggacagccttggagggcaacaccatccccgttaagctcatgggaacacagctgcaggcaaggctcgtgtcgcttggctccgctctgtctggacctagcactcattcgagtggaggtacccatctggcaaaggtcggcttcgacaccaagatccgtctgttga

SEQ ID NO: 29512 - DNA, 65 bp, Chlorella protothecoides
aaggtgactgaccaggggccaatcagtccacaactccctgcagggcatcaacttggctgcaaact

SEQ ID NO: 29513 - DNA, 100 bp, Chlorella protothecoides
cctcgcccccatggtaggttggcgcgggggggggggaggaatggcccctttcctgtgtgtggcttggcactgtgcttgtctcgctggcgcctggttcact

SEQ ID NO: 29514 - DNA, 119 bp, Chlorella protothecoides
gcccaggcccagcatgaggaggtccagcccgctgaagaccttgcgcagggtaccttgcagcagggcctgtgcaaggggcgacaggagggggagcaggggtgagggtgtggggcctcagg

SEQ ID NO: 29515 - DNA, 82 bp, Chlorella protothecoides
cagcacaacaaggatacattcttccaacccgatgggtcacagaatgcatgcgactacacactgattgctcaccgtcgtggcc

SEQ ID NO: 29516 - DNA, 181 bp, Chlorella protothecoides
cgggacccatcctgccaggccagcaggtaaaggggaggggggcggagggaaagggggaaagcggggggttgaggtgtacatttgtgaggagcggacggagcagggtgtccgagaatatagaggccagacaggttctgttgcagggatggccggagtggtcgaactgaggggcgatgctgat

SEQ ID NO: 29517 - DNA, 61 bp, Chlorella protothecoides
ttgggccattatttcggcacatatatcacatcaaacaatccaattaaggtctgggccgtcg

SEQ ID NO: 29518 - DNA, 132 bp, Chlorella protothecoides
gagggggaggatgcggggccgaccgccgggaatggggaggacgcggggctgaccgctggagagggagaggatgcagggctggctgctggggatggggaggacgcggggctggccgccggggagggggaggac

SEQ ID NO: 29519 - DNA, 79 bp, Chlorella protothecoides
ggtttcggaccgccaggccggcgcgacccttttcagccccggacaatcgccccatgactccacaggagccccacaagta

SEQ ID NO: 29520 - DNA, 79 bp, Chlorella protothecoides
cgtcgctgccaccttgctgcgacacaagcaccaggggggagtgcgggagaggcgatgacctgacaccagccgatgcact

SEQ ID NO: 29521 - DNA, 83 bp, Chlorella protothecoides
gatgtggtcatccaaagcacagcggggggtcgaacacttcagacatgcacttaagagaggtagggcgccgccgcccccccccc

SEQ ID NO: 29522 - DNA, 73 bp, Chlorella protothecoides
gtgggagtcgatgatagtcattacagtctgataagaagttacaggggcgcaaacaaggtaccgatgcgacgct

SEQ ID NO: 29523 - DNA, 69 bp, Chlorella protothecoides
tgcagtgggacgaagtgccccagcaaaaaaacacttgagcaacatcagtatgttggctgctccgttgac

SEQ ID NO: 29524 - DNA, 80 bp, Chlorella protothecoides
cctttgtcctcctcagcactgctctgtttgaaaccctcgccaccatgagtgacgaagatcatgctgcgcgtgttctgatc

SEQ ID NO: 29525 - DNA, 91 bp, Chlorella protothecoides
caatactcttatgcccagacctgcttccagcaggcagcataacctgtcaaccctgggcacgtctgctgcttcagtgcactttaacagaacc

SEQ ID NO: 29526 - DNA, 128 bp, Chlorella protothecoides
gatggcgagaggagcccgaagaatgcagcgagccgcggcaggcaattatgaagtaggctataagtgcgttttggatccaatgccgcatcgccagcgctagcttcgggtcgcaccaggtgtgtatgagt

SEQ ID NO: 29527 - DNA, 120 bp, Chlorella protothecoides
ctcgccccttcttcccaagacctgcccggcaagcctgtgttcagagatttctgccgaccgtgcacggtcccagcgacacatagctggcccgggtgtggtagccatggaccaaatgctcct

SEQ ID NO: 29528 - DNA, 293 bp, Chlorella protothecoides
cttcgatatacatcccaattttctctctgccaacttggaaagcacatcgccctcagcggaactgggaaaaggagcgatttatgtgagccatttactactggaagtacttacaaaagctctaaataatgaatctcagactcgtaaaccgtctaccttgtcatgaacatcagctcgcaaaactctcatggtgcctggcaggaacttattgtagcattgctcggggtctaccctgaatctaccccaagatgcacacttttggatcgacagattgtatttgcacatcggatccgtgt

SEQ ID NO: 29529 - DNA, 77 bp, Chlorella protothecoides
caatttcggtcaccacagctatgcaccccgttgcccactctgtctataggtaccagcccgaccccacatatgctccg

SEQ ID NO: 29530 - DNA, 61 bp, Chlorella protothecoides
ccagagccatccagtgtccgcaggcagtaggtacaatcacatgacactcaaatggtgtagt

SEQ ID NO: 29531 - DNA, 66 bp, Chlorella protothecoides
ggacacagccctcgaggctgcctcactctcaatgtgtggcatgccccccttggcactcagaagctg

SEQ ID NO: 29532 - DNA, 72 bp, Chlorella protothecoides
acggcgcatcgtcccctgcaggaggcgacatctgcgccagggactgtcgcctggtcccttccccccgcccac

SEQ ID NO: 29533 - DNA, 389 bp, Chlorella protothecoides
  modified_base (134)..(286): a, c, t, g, unknown or other
cccaacccccttcccccttcccccccacacaaaccaccagacacccacccgaatcggtgagctcggagacccagggagggggggcgtcccctcccgccagcgtcagcttgatctccagcacggcgtgcgggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtgggcccgtcctccgggttctccttcatcatgcagatggtggtgtccaggttgacggagaccgaggggtcaaaggggatctgcgacggcggggtggcgag

SEQ ID NO: 29534 - DNA, 66 bp, Chlorella protothecoides
ggccgggcgccgccgacgccgcgcccaggtccgaactcgacggcgccaggtcagcaaatgacgacc

SEQ ID NO: 29535 - DNA, 76 bp, Chlorella protothecoides
tgtgattaacatgacatttcagtgctctagcatcctcgacgcggtgttgggaagcgcaatccagccgcgcatgcct

SEQ ID NO: 29536 - DNA, 61 bp, Chlorella protothecoides
tgtggcattggcatgttttgcaccggcaggtgaatggtatgctgagggggggtcacgaatg

SEQ ID NO: 29537 - DNA, 68 bp, Chlorella protothecoides
cgccagctggcggtggagacggggctgttccgagcacccgcccagccctacgacgtgccgcccacaga

SEQ ID NO: 29538 - DNA, 94 bp, Chlorella protothecoides
gcaaggcgaattccgccctgcagcagctgcgtatagccggcgggcaagcagcgacagagccgtaagtgcagcccgactcccaagtttggagagg

SEQ ID NO: 29539 - DNA, 110 bp, Chlorella protothecoides
gcgctggggaactacggcctggtgtcggccgctgcctcctacctcagggggggcggcggcgccggcgccaagggcgttccctccgccgacacggcattgtgaccccttcc

SEQ ID NO: 29540 - DNA, 79 bp, Chlorella protothecoides
cctcttcttcgacgcggcggaggatgagctgcgcagcgtgcgcagcggggagctgagcgtgcgccgctcggcctcgctg

SEQ ID NO: 29541 - DNA, 109 bp, Chlorella protothecoides
gtggggggtcagagaggaattgtcaaaaggtttacaacatcggcggctcagtcaccgcgcatgagccgaaactccttgaccttctgtcacactcattcccccaactgat

SEQ ID NO: 29542 - DNA, 67 bp, Chlorella protothecoides
aaatggagctgtgtgttctgtctggggactgggggtaaaggggactgctcaatactgtgtccagcgt

SEQ ID NO: 29543 - DNA, 81 bp, Chlorella protothecoides
ggatcgtcgttctttcccacgctttctaaaaccccccttggattggtgagctcataagatagagtcttgaggcaaacaccg

SEQ ID NO: 29544 - DNA, 75 bp, Chlorella protothecoides
caggcacatgccactcaggagcaaacaggggccaccccttgcaaacccgctgcacctggatctcaaaccatcgcc

SEQ ID NO: 29545 - DNA, 114 bp, Chlorella protothecoides
gtctacagatcctgctgggacggggaagacgccttccagggagtcacccgcatcaccgccaccaccatctctgggcatcctgcgagggagggttgataggcatttgcatgatgg

SEQ ID NO: 29546 - DNA, 77 bp, Chlorella protothecoides
gatggcttgatgatcgggttgggagcatctacaggatgcatgccggcctatggatatcacctcacctcacgttcctc

SEQ ID NO: 29547 - DNA, 129 bp, Chlorella protothecoides
agatcctggtacatgtgcatgcatgcaaagtcgatcgtctcatggtccacattcttgatgaagtcacatccatcctggagctggcctggattcagataggatgccttgacacctgcaaacagatgggta

SEQ ID NO: 29548 - DNA, 61 bp, Chlorella protothecoides
agctttggaggattccaatttggtaagctcaagaatagcgacttgtatggatcgtgtccct

SEQ ID NO: 29549 - DNA, 74 bp, Chlorella protothecoides
aatgatctcgggatctcgtccggaatgagtttcccgcctcaactatgaagtcatagttattgacaccttgagca

SEQ ID NO: 29550 - DNA, 287 bp, Chlorella protothecoides
ggccagcgtggagtgagcgaggcgcagtgcgttgtcgtaggttatggagggagggggcgcctgatcctgaaggtgggggggagggggggtcccgatggggagggagtggtgttgaataactgtacacaagaggattcaatttgtcaatgcggatgccacctgcactgcccccagggcccgttcctaagtgttcacttcccacacataccaacaacatgaagatagggttctgcaccacaaaccttaaggccatggaacaggcttacccctcccatgccctgctctga

SEQ ID NO: 29551 - DNA, 61 bp, Chlorella protothecoides
ggcaacctgcgggttggcctccgtcatgcggcgcagcatggggttgttgctcaccatgtcc

SEQ ID NO: 29552 - DNA, 115 bp, Chlorella protothecoides
gggaagagcaccgagcagacagggtctggcgccggtggatcccgcgaggagctcctggctcagcgtcgagcggagctgtgaccctcatcaggcggcagcacttccccatccacag

SEQ ID NO: 29553 - DNA, 65 bp, Chlorella protothecoides
agaggacgcagggctggctgccggcgagggagaggacatggggctggaggtggtggacggagagg

SEQ ID NO: 29554 - DNA, 121 bp, Chlorella protothecoides
gtcgacgagacacatgccgcgactgcggccgcaaacacccctcgcgccagacgttgtgtaagaacagaagattccacagacacatgcattgcggcaggggtcagagggcgcgcgtggcagg

SEQ ID NO: 29555 - DNA, 61 bp, Chlorella protothecoides
ttcatcctccgacctcccgagcatgccgggagcattctggtagaaaagcaaactccatgac

SEQ ID NO: 29556 - DNA, 113 bp, Chlorella protothecoides
catgcgggcggcacacgtctcagcggggggtttggaaccggtgggtgttgttgaggggacggggagttcccagccaccccgtcaactcgataacctgcgcgattcggtcgtcc

SEQ ID NO: 29557 - DNA, 76 bp, Chlorella protothecoides
gtttgaggtggtgatggctgtgacggcctgtgggaggggggtcatagtataagggaggcatgaggcgcatggctca

SEQ ID NO: 29558 - DNA, 280 bp, Chlorella protothecoides
caggtgtgccatggcaatgtacgagctccttccccatcgaggttatccgaaagagcattattaatatgcgttgtgagcctgtcctacattatcctgctccttaaattactctctcaccactcagcctgttcgaaaatatcaattttctgatctctacccaaaatggggaaccttaggctcttcatacatgcctgtgtcgctagtctgcttgtgaatcatgctcttgatcacagggagtcggaactcgcgctgatacaaccgaaggcgccattgtataaaa

SEQ ID NO: 29559 - DNA, 406 bp, Chlorella protothecoides
  modified_base (136)..(322): a, c, t, g, unknown or other
atctccctgtgtatgcaggcttgcaggaaatatggatgagacattacaccgcacttgccgacatggttttggtatctgtgtaggtgcacccttctccttgctccttctccttctgcaggtggattcggagacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaccaagcttgccaactcggtagattggataccaagatactcgcgtaaagagcaccagcctcagcactgcacccatgcaccc

SEQ ID NO: 29560 - DNA, 103 bp, Chlorella protothecoides
cgagcggtattccccgtatgttgaatgcgtaaccaagtaggatactgttggtgtgtgatgtgatgaggtcgccgtcctagatcgggcagggggacccggctgg

SEQ ID NO: 29561 - DNA, 61 bp, Chlorella protothecoides
ctcgcactcctcatcatactgggcggtggggatgtacacgcctgtggggaggcgaacgttg

SEQ ID NO: 29562 - DNA, 804 bp, Chlorella protothecoides
agcgcggcccccagcgccggcccgtcggcggcgtcctcggcccgcgccagcacgaggcggcgcagcgcgggcatgcgcgccagcacgtcacgcacgtcggcgcctcccagctccagcgcctcgcactcgcccaggtcgaggtgtgcgagatgcggcgcggccgccagctcggcgggcagcgtgcgcaggcgcgggttctggcgcaggcacagccactccaggcccgccaggtagggccccggggccagcccggccaggcggttgatgcccaggtccaggcggcgcagcgcgggcagcgcagccacaggtgcgggcacggcctccaggccgcaggcgcgcagctccaggaactccaggcggcgcagggcggagaactcgcggggcagggcgcggcccaggctggccgcgccggacaggtccaggcggcgcagggcggggaggtgcagacaccagctggcgggccagcgctcggccagggaggagggcagcgccagcgaggtcagcgcggggagctggccggggcgcagctccggcagctggctcagcaccatgggtagcaccagcgactccaggtgcctgagagagaagagggtgagggggtgggatgggggggttccaggaatgacaccacgtattgaaactggaggggtgcggtgctgtgcttcggatggagcttcatgagaggcggggatgcacaggagcctaccggcagaacttgcagcaccggcagaggctgagctgcccatcaccgtcctccccgcgtccctctcaaatctctgacccactgccatcgagggccccccc

SEQ ID NO: 29563 - DNA, 106 bp, Chlorella protothecoides
cgggaccgcatgccgccacggaggcgccggtggccttggtggtggggccggcggcggggaacaccacccctgcgcagggcaggcaaggaagggtgggtgagcaagg

SEQ ID NO: 29564 - DNA, 68 bp, Chlorella protothecoides
ggatggccactttatatggtgcaaccctacaccttgctttcgacacctgatgttggattcttgatccc

SEQ ID NO: 29565 - DNA, 62 bp, Chlorella protothecoides
tgcttgagtcacgcatgcacatccccccccaccccagttctcttcgggtgtcagccaccgca

SEQ ID NO: 29566 - DNA, 112 bp, Chlorella protothecoides
ccccagatggggaaagggagggaatccgaattttgaatgagtttgccaagggggagtgagcgcaccccgaccccaaacgctgagtgacccctcccacgcccacagacctacg

SEQ ID NO: 29567 - DNA, 61 bp, Chlorella protothecoides
gccgcgcgtcagcacgggactgatggtcggcccctccagcccgcccagcagcttggagccg

SEQ ID NO: 29568 - DNA, 76 bp, Chlorella protothecoides
ccgcgcgctgctggagcgcccgggcctgctcggcctcgtgcacgagctgctggagcgcctggacgcgcacctggtg

SEQ ID NO: 29569 - DNA, 73 bp, Chlorella protothecoides
cgccactgaccagtcacaacccgccgtgtcgatgttgcgtgacacctcctcgtcctgctcgccatcgtcgtcg

SEQ ID NO: 29570 - DNA, 194 bp, Chlorella protothecoides
ctgttgggatcaagaacatggggctgggctactttggtgcctggcccctggggcataagcacacagggattttctcctcttcatatactttgcggcgctctctggctccccaagtgcacttaccagccaccatgaatacccccttctcacccacctgacacaagccccccactctctttccatcccacctgcag

SEQ ID NO: 29571 - DNA, 61 bp, Chlorella protothecoides
acgaggcgcatgccgcgcacgtgatggcggggggggcggagacgcaccgccccctgagcct

SEQ ID NO: 29572 - DNA, 78 bp, Chlorella protothecoides
ggaagtagttgaaggcggggatggcgaagaagggctgcttcccggctgggacctcgcccttcctgtcaaagtaccagt

SEQ ID NO: 29573 - DNA, 116 bp, Chlorella protothecoides
gcctcaaggccggacagaaggcgtgcacagcagacaagaatggcaacattggtaccgggaataagggaaataacaattttggcgactacaacgacggcaacaacaacatcggtgag

SEQ ID NO: 29574 - DNA, 61 bp, Chlorella protothecoides
gggcggggcccccttccttgcggcgaggggtacaagtcgggggggcgcgttggggtgcagg

SEQ ID NO: 29575 - DNA, 73 bp, Chlorella protothecoides
cccccccccccccccccccccccccctaccaaaactgcagcatgagcgcgcgctcttccggctgcacaactcg

SEQ ID NO: 29576 - DNA, 61 bp, Chlorella protothecoides
catgatgtctccgtcctctacctccaactccgctgtggagaaggacaccttgccgaatcca

SEQ ID NO: 29577 - DNA, 117 bp, Chlorella protothecoides
tgccctggatgtgcttgaggcatgctcgtgtgcgctggtatgtgcatccaagatcccaggtccggctagaaactagcttccataggtcttgtcctctcttgaacccttcctcacttc

SEQ ID NO: 29578 - DNA, 61 bp, Chlorella protothecoides
cgcatactcgtggctggcctcgctgctgggggatgagtcatcctcggtgagggcggcggcg

SEQ ID NO: 29579 - DNA, 896 bp, Chlorella protothecoides
  modified_base (142)..(271): a, c, t, g, unknown or other
  modified_base (339)..(348): a, c, t, g, unknown or other
ggggatggctctgcccctcattgttggggggtatcaacatacagggcaaagagattgcgcggcttcgcaacactcatacccaccacataccttgtccggcaatcccgcacacaggccgaggcaggttgtgtcaggcgcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggccatcgacatcaaggaccttgcagacatcaggagtgtcgtttgcactgccactgacgaatacnnnnnnnnnnacttggagcggagtcgacgggggtggagactccttgttcatggcgactgtggaaaccaagtttgcagcaacctcagtcacctgctcctatcgagactcctacaactacgagatggggacattcaccacatacctcaaccctgctgcccgtacggcgactttcaaagagggcatcgacagcaaggacctttcagatatcagcagtgtcgtttgcactgccactgacgaatacaaaaacgtctctccagcgggaactctgacgggcagctttggctgatgccgatcatgtggtagtcacctggggcctggagatctacatgcagtaattcccatccctccgcaatgtgcctctcctaccccttgccaccctttactctcaatgtgtagcgatccgcttgaatgcacgtatgtagcacaacgtcatttcatgctagatttgcaataaagctcttgacagaagtgcatggcgagtgtattgcttcgagctggtacagtttttagtatctggttgctagagtctctgcatgccaatattaagtgtagtgctga

SEQ ID NO: 29580 - DNA, 215 bp, Chlorella protothecoides
tgcagtcacaaaggctcatgcagagcgccaacactgacggcttgcactttgacagtcacaccagtcgagtccgcggaggatgcgcacataattgctattaatttttgctacatccctacgaagactcacaggactggccccgagtctgtgtcccagccagcaatgaggagtgccactccaaagggtcggctctgtggggtcattgcaggaggaga

SEQ ID NO: 29581 - DNA, 77 bp, Chlorella protothecoides
ttgcgcgccttcctaagcctggagagggttgcgtcagggttgttttggcgtgcagggacccagagctgagcactctg

SEQ ID NO: 29582 - DNA, 61 bp, Chlorella protothecoides
tgttctgttcacgggaggatgctctccttcaccatgcgcctgccatgctggcgtgcggcgc

SEQ ID NO: 29583 - DNA, 76 bp, Chlorella protothecoides
gggtggacctacatgcagatggtatgggggacatggtgagcaccggagatgatacttgctcttctgctgcaggtgg

SEQ ID NO: 29584 - DNA, 97 bp, Chlorella protothecoides
ggtgtgggctgaggcctggttagccgactcacacacggccatgtaaagcataggaataagaatgtggaaagaggtgccctcacctgggaggtgagag

SEQ ID NO: 29585 - DNA, 61 bp, Chlorella protothecoides
gcctgaagggtgggacgcctcagctacctcgcactcacccttgccgccctcatcaaagcag

SEQ ID NO: 29586 - DNA, 157 bp, Chlorella protothecoides
ccacctttgacgggaatattctggctcgcttttgttagggtaattgagtagggtggaacatgtgtttgacatcctaaccttgttgcatctggggagcagaatgagtattcgttgaaggtctctggtctgtattggagtcatgtgtgaactggtcggg

SEQ ID NO: 29587 - DNA, 168 bp, Chlorella protothecoides
gttcaggtgcatgttgcacgggttgccctcataccacacgctggagatgcccacctaaagatcagggaagggaggggggttcagcgattctagtcgagttttggcaatgccagtcaggccgtatggcgacagccgagctggggtggggctctgagcaccggggagccg

SEQ ID NO: 29588 - DNA, 76 bp, Chlorella protothecoides
acaggctgctcgccgccaagggtgactctgtgctcgcaaatgagtttgtggcaaggagcgcccgtctgaagcatgg

SEQ ID NO: 29589 - DNA, 123 bp, Chlorella protothecoides
caggccgctcgcggccagaagtcgtctcacactggaatcacatatacgaaacacggccaggaactcgtgagacaccaatgctccaccacagaatccaaggctggtgagggtgaggacgccacg

SEQ ID NO: 29590 - DNA, 69 bp, Chlorella protothecoides
ccagtgagctttggtgaattcgcatcccacggccagggttcaaacgagacccagcactcccacctgaga

SEQ ID NO: 29591 - DNA, 61 bp, Chlorella protothecoides
gtgtgctggctcctgaacggcagcaaagagttgggggacaggtggccgcaccgtaccggca

SEQ ID NO: 29592 - DNA, 78 bp, Chlorella protothecoides
actcctcgaggagttagcctctggagtcccaatccgcgcgggattcaaaggagtaaaccccccacgacagatcgccga

SEQ ID NO: 29593 - DNA, 102 bp, Chlorella protothecoides
aagggagcttcctgtgcagtttgcacgtgcttgttcatgcgcgtgcaccttctctgctatggcccttcttcatgaacccccgagcccatgcatgctccccaa

SEQ ID NO: 29594 - DNA, 67 bp, Chlorella protothecoides
tccccctccttcccccagtccccctcctccccccagtcccctcctccaccaatacccctccaccccc

SEQ ID NO: 29595 - DNA, 101 bp, Chlorella protothecoides
cagttgtgagtgtggggaggcctgggtgaagggcttcaaagtagggttgaggctttaaaccaactcaaagtgcatgctgcttgggtggaaagagaaatatg

SEQ ID NO: 29596 - DNA, 125 bp, Chlorella protothecoides
aggcccatccagaccgcaggatgccaaacgggcctggggccgtggcagggtgcaccgggcccttgagagcatggcactgatacaacacacactacctcgactcactgggaggatgcgagcagggt

SEQ ID NO: 29597 - DNA, 76 bp, Chlorella protothecoides
gcagcaccgcctggatgtgagttatgttggtttgggggggttgatctcgtggaggaaaggacggcggtgggttgtg

SEQ ID NO: 29598 - DNA, 61 bp, Chlorella protothecoides
agtgtgtgcacacgcttcaaacagtggcggggacctggtgcgcgccagagttgcctcgtgg

SEQ ID NO: 29599 - DNA, 527 bp, Chlorella protothecoides
caggtcccctccgccccccaaggccaggtcgccaccaccacctaaagccaggtcgccaccaccacctcccattggattcaaaatcaacgtcaactacatggtgtgcgacactcggacctcgtcatccgtcatctgcacttcgagcgtaactacgactgccatcccccctttgctgacattgacaatttcattcaaatctgggtcgagcaggactctcaccctgacacctacaagcctcaccaccgtggacacatccaccttggcatcgaccacagccgagggcacggtaactgcagctgcgatcgaccccgacaccaaaaagacggtggcgtcgccttccgtggacatcgtggatgcacacctaccaccgccatcgccatcgccccctgctccacgcaggtctccgccgcctagtcccccgccgcgagcgttgccgccatctcccagatcatcccccccccctccacgtggtccaccgccccccttctctcccagaccaccacctccttcgcccccaagcccccccc

SEQ ID NO: 29600 - DNA, 160 bp, Chlorella protothecoides
aggaggaggattccgtgggggaggaggatgcagtgcagggatccaaggaagaggtgcaaggagctctttggggatgaaacgaggatctctggagctgcaccccagactgcgcaaggagaaaggctcctgtgcgccaacacgcaggaaatcgcagcaaggt

SEQ ID NO: 29601 - DNA, 148 bp, Chlorella protothecoides
catgtggattgtcgaggtcggcaaaaatcctccccgcaataccgccactgtggctgggctgatgcacaggatgtcaatatgtcgaacccacctggttccatacccatcaatattggggcacctcccttcccacctgtgctggagcgga

SEQ ID NO: 29602 - DNA, 75 bp, Chlorella protothecoides
aaagttgcgcttgcccctgttgccggatccaatgttgccactgctgtctgccgtgcaggctgtctgcccaggctt

SEQ ID NO: 29603 - DNA, 66 bp, Chlorella protothecoides
ttgaggactgttttgctgggagcgacaaccgggaatgatgcccagcagcggctgccaggccccgga

SEQ ID NO: 29604 - DNA, 77 bp, Chlorella protothecoides
tcgctccaatagcaccagggacgtgcctgtggcttgaagatggagtgaagaagtgcatcagggttgacgcttgcagg

SEQ ID NO: 29605 - DNA, 125 bp, Chlorella protothecoides
tgcagcagggtcaaggccaccgccgcatcccctggatctgtgggtacattttcgagtgcaggtcgcctgccgctggcttgccaggttggggaggggtgaaagacatggtgtcctgagcatgacga

SEQ ID NO: 29606 - DNA, 62 bp, Chlorella protothecoides
aacatgggattcgtacgcctcatgtgccgcggagtttcgggccagggcatccagcgccttgc

SEQ ID NO: 29607 - DNA, 62 bp, Chlorella protothecoides
actccccggatgtgccttcccccgcctccgcacaacccaagacgacaaaaaagcatgacccc

SEQ ID NO: 29608 - DNA, 62 bp, Chlorella protothecoides
ttgcctaccactgcctgagccagcactcctctgtgcgagggacacaccagctcgccttggaa

SEQ ID NO: 29609 - DNA, 167 bp, Chlorella protothecoides
cgcgaaggccatcctggcgcgcggcgtcgccgcgctgcctgaagcaggtatgtttggatactgcggaggcgtcagaggaggagcagggggtcgaaagagcccagagatgggggaggcgtagtctcacaatgtccacaggagagttggccaggcaaagaggacgtgcg

SEQ ID NO: 29610 - DNA, 73 bp, Chlorella protothecoides
tgggtcttgtcacgcatgtgtgggatgggactgggacgcagccactcggccggggggtgaaaggggattgtca

SEQ ID NO: 29611 - DNA, 126 bp, Chlorella protothecoides
cctctttgtcaaggacagcaaaggcaagagggggactttggggggcgctcctctttacataggagcttaaagtagccagatttcaatatttgcattcgaatgaatgctggagatggtctctgatgg

SEQ ID NO: 29612 - DNA, 109 bp, Chlorella protothecoides
cgcatggcagatgtgcccaagggctgggcccgcgcctgcgaggtattgccgagagaacaccaatccactgattcgcccccacacactcgactcagccccaccctgaccc

SEQ ID NO: 29613 - DNA, 101 bp, Chlorella protothecoides
aggctttgacgtcgcatgcacccttcagatagtgagcaggaccccctgcaatacctctgccgctccctcatcaaggcacctatttcttctcgacagccgcg

SEQ ID NO: 29614 - DNA, 71 bp, Chlorella protothecoides
ctatctccaccccaggccagccgcatagtaacttagataatacaagggtgggtttgcaagatgaggtgtcg

SEQ ID NO: 29615 - DNA, 109 bp, Chlorella protothecoides
tgggaacggcgagcaacaaggccttgatgacggctgctggaaagtgacggtgcatcgcaagcaccatgcgccagacgttttactgctcgctcatcacaggcccaaactc

SEQ ID NO: 29616 - DNA, 75 bp, Chlorella protothecoides
tgtgacgaatgtggtggagccaccatggctgcacaatcgcccgtggggctggagcatacaggcagagtcttgggt

SEQ ID NO: 29617 - DNA, 1076 bp, Chlorella protothecoides
  modified_base (532)..(541): a, c, t, g, unknown or other
cggagtcctcgccacgccgctcgacgctggcgcgcgcctttgctgcgtggcgcgagcgcgccgcggacgccacggtgcgccgcgtgacggcgggcctgggcattcgtccccgtccgccctcggtgcgcaccgtggaacgcagcgcacagagcgaggcggacgccgcggaggcccagatgcgcgcgcccgcgctgctgctcctgggcgtgcacaactcgctggtggacgcggaggcggcgggcctgcccgcctcggggccctgcgccatgaccctgcacgtgccctactggctgaacaaccgcaccggcgtggacctgttcacgcgcgaccgcgcctcggcccccgcgcagcgctggctcctgggcgcggcgctgccctgggaccacggcgaggtgttctccccaggtgggctgtattcttgtgtgtgtgtgtttgttgggggggagggaggaaagacggggtagggggggcgcatgcatggggctggtcgactgtgaaacgcgatggccgctgctccaccagcgtcggtgannnnnnnnnngtgtgtttgtttggggggagggaggaaagacgggggagggggggggcatgcatggggctggccgactgtgaaacccgatggccgactgtgaaacccgatggccgctgctccaccagcgtcggtgaagacctgtgcacactcccccgctgcctgctgtatgcacccagccccaaaatacacacccctgcacatcaggcacgagcatgacagagggcctggacgcagcggcggcgggggagggcctggagtctggcggctggctgggcgccggcggcagcgccggcacccactccaacgccggcaccacggcgccgggctccttcctgccctccgccgtgctggagttcaagctggtgctcatgaaccggcaggagagcctgcgcttcggcctggcgcacgtcccgcgccgccgctactcgccctccatccccgtcaagacggtcggcaacaagggcgcggtggagctgcgcggccctccctccgcgctgcgcgtgggaggcgcggcggcgccgccgccgcgccccggcgcgcgcgc

SEQ ID NO: 29618 - DNA, 449 bp, Chlorella protothecoides
  modified_base (159)..(333): a, c, t, g, unknown or other
ggggtggcccaagctcagcacccccgtcgtcaggccaccgactgccggcatgaggactcgccaggcgcaggccccaatggattggcggccgccgtccgcgtcgccgctggggtcgccctccccctgggcccccggcgtcaggtccttgaaagcgtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgactgggcctggagacaagaccgaaggaaattgcaggtctgcaaggcagcagacgctgcagacttgcgctgcatttgcttgagaacaaggtggggctgtgcagcgcgcagcgcag

SEQ ID NO: 29619 - DNA, 133 bp, Chlorella protothecoides
acactctggccaacaggtgacactggagggttagcgctatcactttgcgccacagcgccttacaagcttgtgtaaagactgtgtgccgacaccccgcaccctgcgccctccccttgcagccggacgttccaga

SEQ ID NO: 29620 - DNA, 73 bp, Chlorella protothecoides
gcgcaagcgcaccaatcagggcgcaccgctctgtacaaaagaaagagcacggcagatatcctgcgtcgctcag

SEQ ID NO: 29621 - DNA, 61 bp, Chlorella protothecoides
cgccgcggagcccgcgcaggtccgttcatcacccccccccgggtccctccccacaggcgca

SEQ ID NO: 29622 - DNA, 80 bp, Chlorella protothecoides
ggccccaacctggccctgttcttccccgaggacccgctgcacgtcaccagcgccgtcggctgccggctgtacaccagcga

SEQ ID NO: 29623 - DNA, 73 bp, Chlorella protothecoides
gacttcctgattgccaatgcggggacgcgacggagcattcaagtcatcgccgcctccctcccccaagcccggc

SEQ ID NO: 29624 - DNA, 72 bp, Chlorella protothecoides
tctcccacctgggcagagtgcgagggagtgtggtttttttgttggtgagggggtgggggatcagtttctgca

SEQ ID NO: 29625 - DNA, 61 bp, Chlorella protothecoides
tccaaccacaatcccttgcaaacaaaggccacccacctctcccccgatacgttccgccaca

SEQ ID NO: 29626 - DNA, 68 bp, Chlorella protothecoides
gggacccttgatgcatgttgcggctgcaactggtttccgctcaaggcatccttgacccaggttccctc

SEQ ID NO: 29627 - DNA, 61 bp, Chlorella protothecoides
catggtctgcagcacgctcttggggatggcgatgagctggggcaggaagttctcggccagc

SEQ ID NO: 29628 - DNA, 61 bp, Chlorella protothecoides
caaacacagctgacgcaaagagccctggaactgctggcgctgcccgatgatggcaggccca

SEQ ID NO: 29629 - DNA, 339 bp, Chlorella protothecoides
caggcgagatgaggggctgggtggtggggtgcttggactgaggttcgaccatcgctgtgaaaccttgcatgggcttggggtgcccatgccgtgcaacggcgggcagcgtcttctgctgggtgtctggatgggcagttgtcctcatgcgcgtggctgcgcgccctgcctgaccggcgaagccagttgaggccccactgccgaccccgctgccgacccactcacacatccacgctgcagggcccacatcctggagcagtatgcgaagcacttgaccccggaagagctggcagagctagccggcgggacgcccggactggcggggcgggacctgagggacgt

SEQ ID NO: 29630 - DNA, 90 bp, Chlorella protothecoides
gactggcccaggcgcccagccgggcaccatgagaaggaacgacggcgccattgtccatgctcaggcccgaaacccctccaactcccctcc

SEQ ID NO: 29631 - DNA, 73 bp, Chlorella protothecoides
agaaacccattccaaaccttcgccctgctttctcaatagctaaaattgcatgctgccacacacattttagaca

SEQ ID NO: 29632 - DNA, 93 bp, Chlorella protothecoides
ctggatgatgcatgttaggtattcctcattgaagaggcttttattgtggaatttgaaggggaggttcatcgcgacgggataggagcaggccta

SEQ ID NO: 29633 - DNA, 222 bp, Chlorella protothecoides
atatcatgtctgagctcaggcagtgcaggattgaggtcctgtatctgagaagggatcaggtgtgcccgggtgtgacccaacgtccatgccgggcatggctgaccagcaagggcgcaatacagatacatgtcgccatggaatgacccacattgcgacccaagtgacacaagtatcgcatataacactaattgctgtgctaaacatcagcaaatataattcgaa

SEQ ID NO: 29634 - DNA, 77 bp, Chlorella protothecoides
cgactccccaccccatccctgtccgccgcccacgtcactggcgcgctgctgtgacgccgggcccccacccatccact

SEQ ID NO: 29635 - DNA, 85 bp, Chlorella protothecoides
cccatgtcaaatgggttgctgcatgggggccgtggcagctgggtaatcagtgggcgcatgcgcgtccgggcagcacctgcatacc

SEQ ID NO: 29636 - DNA, 61 bp, Chlorella protothecoides
atggcatggcagtgttggccgcagcggcgggcacacctgatttggtggaagattggaacac

SEQ ID NO: 29637 - DNA, 78 bp, Chlorella protothecoides
acgacaactgtttcgcctggaacagccggttcgtcgccacctccaaattccagagtaagatccaacatcgctctgaca

SEQ ID NO: 29638 - DNA, 71 bp, Chlorella protothecoides
gggacgccttctttgggggcggcggggatgctttctcgggaggtggtggagacgccttcttggggggcggc

SEQ ID NO: 29639 - DNA, 76 bp, Chlorella protothecoides
gtggcacgctgagcgaggttttgcatcctacaataagcaccggcgagatgaggggggggggggggggggggggggg

SEQ ID NO: 29640 - DNA, 224 bp, Chlorella protothecoides
ggggggggcactcgcgtcttctcacagggggatcttgtgtgacaattccaggcccttgtgtgcgagtgtcatccttgccagcccagcacgatgagggccccatgagagttccctctctcatatccccacgtgccccccgcccctcaacacacacacacacactctagcaaactccccccccctccacctctccttcgaacaggtgtctgtgtccgggcaggcgc

SEQ ID NO: 29641 - DNA, 147 bp, Chlorella protothecoides
gcctcgaagccggacctggatggagagagccgggagtggaagtgagccatgcatggtgcggaccatttatcatggacactcactctgccatactctttcagcctactaaaggcacagtacccctcccaaaacacacacacacacaca

SEQ ID NO: 29642 - DNA, 151 bp, Chlorella protothecoides
cgtttgccaatgaagcacgtccgtgtccctttggagcatgcacctactcccacctccccttgtctaatccctgaacctccggccatgccctccagtccatgaatctcccttttggacctcactgcaggcatcgacacggagagctgggacc

SEQ ID NO: 29643 - DNA, 61 bp, Chlorella protothecoides
gatcgactccttccactgtgaaaggaggggtgtagaaggggaagggaggcctgagcatgaa

SEQ ID NO: 29644 - DNA, 110 bp, Chlorella protothecoides
cgtgagggaaacgccgttttccagtggcccagggtgcatggtatcctagatcaggcagccacactgctttcccacaaaaaagcagaccaatctcatgaccggtcagctga

SEQ ID NO: 29645 - DNA, 71 bp, Chlorella protothecoides
tgtgccctgtgcggtaggaaagagggggggaagggatctggttatcaagtgtgcaagtcagtccagggcat

SEQ ID NO: 29646 - DNA, 75 bp, Chlorella protothecoides
acccctggggaacagcgagcattgggagcactttgaggagctctttcctatggctcagatggagattcagctgcg

SEQ ID NO: 29647 - DNA, 80 bp, Chlorella protothecoides
cccagatgcacttcctcatagtaggaccctgcccccgttccctcaccaagtgttcatcccccctcgccccctcctcaccg

SEQ ID NO: 29648 - DNA, 162 bp, Chlorella protothecoides
ttgggagtggagtgaggggggagtggagtggggggggagtggagatcgatgaggtggtgaacataaggcagcagagtggaaggagtgcgggcgagatccgtcgggcgatctatagggcagccaccattgccgagcagccaccattgccaagcagccatgaat

SEQ ID NO: 29649 - DNA, 61 bp, Chlorella protothecoides
aaatttcgacacggtctgcgcaaggcattgcgtggagatcttcgcagtctgcgcacagggg

SEQ ID NO: 29650 - DNA, 136 bp, Chlorella protothecoides
gaggagtgctgacgaagggcaggaaccctcacgcgcactcgaacaccctgccagtgttcgacataggggtgcgtgcactgagcactattgacaggccaaccgcatggcctcttccagtccaagcctgctcacctca

SEQ ID NO: 29651 - DNA, 7222 bp, Chlorella protothecoides
  modified_base (550)..(559): a, c, t, g, unknown or other
  modified_base (2299)..(2308): a, c, t, g, unknown or other
  modified_base (2481)..(2490): a, c, t, g, unknown or other
  modified_base (2930)..(2939): a, c, t, g, unknown or other
  modified_base (4110)..(4119): a, c, t, g, unknown or other
  modified_base (4342)..(4351): a, c, t, g, unknown or other
  modified_base (5842)..(5851): a, c, t, g, unknown or other
  modified_base (6259)..(6268): a, c, t, g, unknown or other
  modified_base (6867)..(6876): a, c, t, g, unknown or other
cgggggcgtgcacggcatcgcgccgccaaacgcgcgccgtcaggtcctgggcgaccgcgggggcgggcgcgcgccagcggccttccagcgcggtggccgccagggatagcgcgggcacctccagcaccaggccccgctgctcaggggacagcgctggcgcgtcgtcgcgcatgccagggcggcgcacagacgagctgtcggcctcgtcatcggccgggccgccacgggggcgcgccgcggcgggtgccgccgccggcgcggagcacctggcgtcccagtacgccagccacaggcccagggtccagcaggggccggggctggccgtgccgtctgcaaaggacaggtcgtccgtctggacctggaagggttgagcggtgaagaggggaggaaggggggaggggtgaccgtgttgggactggtgctgtggtggatgcaccgctaggcacaggggcgcaccgaagagctctaccagaggtggcttgcacgcgaacagccgccagtcccaacagaacacaagccgcctagatcccgattctggccaggaagaccnnnnnnnnnnggagctcaaccagaggtggcttgcacgcgaacagcagccagtcccagcagaacactagcggcctagatcccgattctggccaggaagaccgagcagtgatgcaccgcagcccaccccttctccgccgacaaacaggacacccaatgagcacccctgtcagcacacctccatatctgctccaagctgtgagaccaggtccttgagaaaagtgtggggtgtgggcctggcagcatccttccctgcccgcaggactgtgggaacgctcaggtctagcgcagctggctcaccccaaccaccctccaactccacgatgctgccgggaggggacgggggcccgggatcgagcaccacggagcgccacttctccatgctggcagcggcttccaacgagctgtgggagggggggagggtacagctgggcgaagtgcacacgctctggctctcggtggaggggagacccgaggagggaacgggcatccagctactcgcgatgcggtgagcgaccatgccatggactagacgatgccatacctcctcacctttgtcgtaaggccttctgatggcggagcccaggcggtaggatcgcctccggccgcttctgcgcgcgcccccgccgagtaacttccgccactgcacagcgcctttctcgcaagcccctccgcccaatgacaatcataaaggtacgaagcagtctcttcgtttccagcatgcaagctctgacggagaggtcgctgtcggggggtggggaccccccggttctcgcctgacgattcatgctgccaagccgggcatctcctcccccagtgtgcccgggtggtttccgtacagtctccggcatggggcatctccttacattcattctcgacacaaaaatacatttactacactgcagccttgatcataccctctgcatgggggaaagagattgcttgcaggtgagggtgcctgtccgtgtatcgcataggaggcggcgacgcccccccacgccccacgcccccagccctgcactccatgcccccagcccctcactccacacacccagcccctcaccttgccgcgcaaagttaaagaggcctcccgcgtcgatgacagggcctgccgcgcccaggtccttcaggtcgtacgtcttcccggtttccaccaccttgagcacgttggcctccatgtccacctccacctcctgccccgtgaccaactcatcgcacaggcggcggtccgtctccaccgggtacagctcccccgtggcgacacagttgcggaagaagatgcgcgcaaaggtctgcgccagcacgaccttggcgccggcggcgccaagagccactggcgcgtgctcccgggaggagccgcacccgaaattctcaccgccgatgatgatggggtactccgtcttcatgctgtccaccgggacgtacctgtgcagaagtgtggtcgagggtgcttgtcagacagcagcgaggaggtgtgaggggtgtgcagggtctggcagcagggagagcatctcccatcccaactcaaagtctcacctctcagggtactcctgctctggcaggccgatcatggcgtagctgcccagcttctcgtactcggcaggctgccagggggcgcagggggagaagtcaggggtaaggtacaaggaacgggaaaagtacaagcacagtcccattggggcacacaatcagccatggcaatgtcgccccagcatgccaggaaccccaccttggacggcaccagggtcagatnnnnnnnnnntaattagccatggcagtgtcgccccagcatgccagggaccccaccttggacggcaccagggtcagatactccgcggggataatctggtcggtgtcaatgttctgtaggcaagtaggaagaggctttgagaggagccaaaggacagagcttcggccccccacctgcaacaccannnnnnnnnngagagggcttgggtggagccaaaggtcagagcttcggccccccacctgcaacaccagtccccaacacgtgtctcagctcacatctcgcgtaacgtagcatttgcccttcacgaagcgcgggcctccctgcaggtcaaccttggcctggaccttgactgcacatcgcctgccctgcgcgcggaatgcctgccgcgactggcgcagggcctgggagggtctactggtcgtgaatgtgacgcagccggccatggtgtcggcaaagacgcagtcgttcagactttcagctttcaactagcgagtatgtatgctccactggtgcatgtggtgctcgattggaccttcaatcgcggagtccagggatccatgcgtagacacccacgggcgcagtgctgtgaactgtagaaaccacgaacaccaaggccgccaagtctgtccctgcnnnnnnnnnnggtatgtatgctctgctggtccatgtggtgctcgattggaccttcaatcgcacagtccaggggtccatgcgtggacacccacgggcgcaatgctgtgaactgtagaaaccaggaacaccaaggccgccaagtctgtccctgccacgaaacgctcgtagcctggccatgccaaccctctttccttgcctggagccctcatcaggtgagactggtggtgtggtgaggccaaccgccctgcccgagcttggcgcggagcaccgccccaccccggaatctccctccctgcaggtcgatacatacacgatgccgggcggccagggataccgcgcctgcaccaggcacaccttccagcgcgggtacaggacaaagggattcatccctctgaccacctacctgcgcaactaccacgtcggcgactatgttgacatcaaagtgaacggcgccgtgcacaaggtgcgcgcgggggctgaggcgcgaatcctcgggagtatttttaagctgtcacggggacagtgggtgcccatgtatgcgagcagacgaggccagcgaggcgcgagagtgcgcatgtcggtgctcgccgtaccccagcccctgggtgcggcaatcccccccctcggggcagcagtcccacgtccccaccctcccaacctgctccacagggtatgccccacaagtactaccacggcaagaccggtgtggtctggaatgtgaccaagcgcgccgtgggcgtggagatcaacaagcaggtgaatgggcggtacatcaagaagcgcatccacgtgcgcatcgagcacgtcgccccctctcgctgcaaggaggacttcctgcgccgcgtcaagtccaacgacgaggcccggcgtcaggccaaggccgcgggggcgcccaagcccatcaccaagcgccagccggcgggtccccgtctggagggcttcaccctggagaacgtgagcatggagaccatcacccccatcccctacgatatcctcaaggagggcgtgctctaggcgttttcttggtcagaggtcggggagggcatggcgctcgtcatgccgctgcctcttgtgtaactcagtacatcgcgggcatagtagtggttggagcgaggcaggggacgggggcgggccatttgggaggtggtggggctgggttgcatgccacagctacggcaggnnnnnnnnnnaggcgcagtagtggttggagcgaggcaggggactgggggcaggccttttgggggggggggtgaggctgggttgcatgccacagctacggcagggagtgtagatacacgcaaggcgcgttcggataagagtggttttgatgctgcaccggctgggtcgggccgccttggtcgtgggatctttgctactcacttgacatgcacgccccttgcggctggtcagcgnnnnnnnnnntacgcaaggcgcgttcggataggagtggttttgatgctgcagcggctgggtcgggccgacttggtcgtgggatctttgctactcgcttggacatgcacgccccttgcggctgggcagcgctgccttcggcatcctgccatccgaacctgggccccctcccttgctacttctgtgacaccccctggcagtctgtctcggtgatgtctttgcatgggtaagcgtcatgggagggatgagtcacgtcaggcatgcggggccgacagcggctccttgatgaaggggtgccgcagcgcctctttgggcgtgatgcgtttgtcggggtccagtgccagcatgcggtccagcaggtccaccagctgcgccagcttcttgcggtcgggggactggccggccagcagcgctgccacgtcggccttcaccgtcgggttggggatcaggcgccgcgtctgcgcggcgcccagatttgtgttcgtcagcattggaggaaggggggctggaaaggcaaataccattgcagcagtctgaggggtggactggggtcgttcaggccaagccccaaccacaatccacaatgactcacgggtcgcttggtgacggggtcctcctccatgagcgtgaaggacatgttggcgtccgactcaaagtgcttgtaggcaaactccgccttgcgcagcatcttcttggggaagggccccttgacgtccatcatcagcttcagcatctcgttgttggtcttgccggggaacaggatgcgccccgtgaagagctcgaagatgacgcagcccaccccccacatgtccatggggtggtctgtgggtaacaatggtggaaccagtggtggaggtgggtacggcttcttagctgtgtgatagttctgagccgccagccacaggcaccacggtggtcatgtactagaacagcccgggaacgccacatacgatgcggtctcgaagcaacgggagcgacacacggcatcggggctctgcgccctggggcaccatcccgcgcatcggacccgagtccccctgggggcagttctcctgtcggccccctcgaatcaactcaagcggcaccccggcacacacaccgtaaggcaggcccaagatgacttcaggggctcggtagaagcgggagaccaaatagggcgtaatctcattgtccccagagaacatcgccgacccaaagtcgcacagcttgacctgtgtccgctttgcgttcaccctgttgtgggtgtgggaaaggaagggaatgagttggtcgttggagtggggacgaggcaccgatccccgacattcaggcgccttggccctcaccctgctgcccacagggcatcgacactgcaagcctgccgccgatgtgagacccagcagccacggagtagtgcaacacgtgcccattcccccgcaaagatgatacaaactgccctgccgtctcacaggatgttgtccggcttgatgtcggcatggagcacgccgcaggcctgcaggtggnnnnnnnnnngctgcaagcctgccaccgatgtgagacccagcagccacagagtagtgccacgcgtgcccacactcccgcaaagatgatacaaactgccctgccatctcacaggatgttgtccggcttgatgtcagcatggagcacgccgcaggcctgcaggtggtacagccccaccagcatctggtgggcatagaggcggaccgcccccaggctgagcccaatgcctcgcccgtaccgcttggtcagctcccgcaggttcatgtcctgaatgagtgtgagattgtgaggaaggaggggatgagacaatgtcggcgaggggatcgcgtgcggggtgagggtaggtgggtggcacacatccagctgaatctcctcatccctcccaccctatccgactccaggcaggacgtcaagcagcannnnnnnnnnccggcgaggggattgcgtgcggggtgagggtgggtgggtggcacacatccagctgaatcccctcatccctcccaccccatccgactccaggcaggacgtcaagcagcaccccccctgcagcccaaagcaacagatacaggcataaccactcaccagagactcgaacacgaggcagaggtggctgcggtagtcaaaggagccgagcagacgcacgcagtggcgcttgcccgccgggtctgcctccgccagcttgcgcaggatgaccttttccatctgacccgccttgtacatggtctcgttggagcggatcacctgggtttggggggtttggggggtcaaggggggggggcctggtgggtacaggggtaggatggatcacgaggaagggccgagacgcatcaggcgagggagcctgctggcattcagcatgcaacactgcaacaagaagccatgtctcgctccagcgaaacagatcccagcaccagcggctggttgcgggcagcatcaatcacctcccgtcagggtgaataacccagtgctcttcacaccaacaacccctgccaatcttcccctccccaaagagcacacacaccttgatnnnnnnnnnngcagcggctggttgcgggcatcatcaatcacctcccgtcagggtgaacaacccagtgctctacacaccaacaacccctgccaatctccccctccccaaagagcacacacaccttgatggccagctccggcggcggcgcgccgccctcgccctggcgcccggtcacgtcgcgcgcgcgcagcacggaggagaagacgccctggccgtgcgcggcgaagacctcgtaccccgggccgatcacctcgcccacctggaactggtagtacccctctgcgtcgtcaaagttgtccaccaggcccttgggcgccgcgccgccggccgcggccgaggcgccgccggcggccccg

SEQ ID NO: 29652 - DNA, 93 bp, Chlorella protothecoides
ctcccgcgccgaggacgactgaggaggaggagtgggggagcatggtctccctgacccgccctcgccagaccctgaacgacccacctccgctga

SEQ ID NO: 29653 - DNA, 61 bp, Chlorella protothecoides
acaccctcaccaagcgccactccctccccgccaagcacaccctcaccaagcgccactccct

SEQ ID NO: 29654 - DNA, 66 bp, Chlorella protothecoides
cacaccctcaccaagcgccactccctccccttcaagcacgcccccacccagtctcactccctcccc

SEQ ID NO: 29655 - DNA, 286 bp, Chlorella protothecoides
gaggaggggacttcaatggagggggaggagacacagtcgatgaagggggaggtatacgcttggtgggaggagggggagagggcttggtgggttgagggggggagggctgggtgggtggaggtggagaagagtccaatggagtgggtggtggtggtggtgggaatggtggtggtgtggcatgaggagatggagcgtaagcattaggggagggagctggagcgggcaagggccctgcccctggggagggaggaggtgtgcctgagggagagggagctggactgggtgg

SEQ ID NO: 29656 - DNA, 169 bp, Chlorella protothecoides
gtgggactggacggccgcctcgcccctgttcgggcctggcagcgcagcagcgtcatgcctggcagaggtaccggtggcagcgatcacgtttcgaagggttgcaggggcgggggaaaagccggggggccgtgctccctgatgcagctcctgggccgtcagctgcgagggt

SEQ ID NO: 29657 - DNA, 66 bp, Chlorella protothecoides
tgggcagggctcggagggtggggccaggcgatgcccgcaggtgtgccctctgtgcgtgacggccag

SEQ ID NO: 29658 - DNA, 70 bp, Chlorella protothecoides
cgaggtggcttttggagccagggccatgccatgtgcctctattcagtaacttcctgtcctctcttgggga

SEQ ID NO: 29659 - DNA, 89 bp, Chlorella protothecoides
ctgtgtgcctgggcagcaggaccggtgctgctattgccaaggaaagcaggacgcctgcttccctggactggggctctggaaattgacgg

SEQ ID NO: 29660 - DNA, 62 bp, Chlorella protothecoides
ggggcctcgggcagcatggggcctgctgcatgtgtgggtgccaagctcgctcccacccgaac

SEQ ID NO: 29661 - DNA, 67 bp, Chlorella protothecoides
catatccaaagcagcgctcaccattcgtacgcctagccccagcgcagctatgcaggcctgcctcagg

SEQ ID NO: 29662 - DNA, 71 bp, Chlorella protothecoides
tctatggcatgcagaaagcgggagttggcatagaggtatagcagatccattgcactttcaatggaaagcct

SEQ ID NO: 29663 - DNA, 123 bp, Chlorella protothecoides
ttcagctgtactgtggctgttgatgccaggacaggactacagcgaggccaaataaagctatggagaaagacaccttgtgcacaaacaatgtaaaatgtgtgcactgccggcaagcaggcaggg

SEQ ID NO: 29664 - DNA, 114 bp, Chlorella protothecoides
gatccggaccggctgcgaggctcgcctgcagcatgcggggagcaggagagggcgtgaggggtcacataagcactttttgggtaatcatacaaatgtgcagcttgtgtcgcacct

SEQ ID NO: 29665 - DNA, 61 bp, Chlorella protothecoides
tccagctgccccttgcttgccaacgccgcatgtttgaaggttcctcctgtcacctccaggg

SEQ ID NO: 29666 - DNA, 98 bp, Chlorella protothecoides
aggctccaccgatacatcaagagcagatggcattcccagccgagtaagagatcattcccttcacgacggcgatagatttcgggcatgcgaatctgcga

SEQ ID NO: 29667 - DNA, 107 bp, Chlorella protothecoides
gaggcaggagtagacggaaggggtggtgacaaaagagtatgaatttcgacgccgcacgtggatgagctacacccagatcgtcgtagaccgactccttgcctgtcatt

SEQ ID NO: 29668 - DNA, 68 bp, Chlorella protothecoides
gtggggtaagggaacagcagttgctgtgttagtgaacagggccatggtgcggttggtgatatccatgg

SEQ ID NO: 29669 - DNA, 5255 bp, Chlorella protothecoides
  modified_base (2470)..(2479): a, c, t, g, unknown or other
  modified_base (3007)..(3016): a, c, t, g, unknown or other
  modified_base (3265)..(3381): a, c, t, g, unknown or other
  modified_base (3552)..(3572): a, c, t, g, unknown or other
  modified_base (3855)..(3864): a, c, t, g, unknown or other
  modified_base (4431)..(4440): a, c, t, g, unknown or other
  modified_base (4917)..(4926): a, c, t, g, unknown or other
  modified_base (5148)..(5157): a, c, t, g, unknown or other
gggccggggggcgggcgaggcgtcgccccggccggcgccgccggcgccggcctgccagtcgggccagcccgcctccgcctcgccctcctcccccacctccagcgcaaactggtcgtcctcggagggcatgaagtcgaagccctcgccgctggcgccaggggtcagcgagagcggcccggcgggggcgtcccccggcagtgacaggcgcaggcccgggaagggggggggatggggcccttccatcgcgcctcccgcccccaagtcctcactcccggggccgctcccggcgtcggccgcgtaccccgacgcctcccgctccagggcctcggagaaggcggggctgctggcggcagcggagtcgggttcggagtccgggctcggctccagcgccttggcggtggggcgcgggatggacagcatgggcaggcccaggtctgctgcgctgggcgaggccagcccagcaaagggtgccgggccggacacgggggagcgaggcggcgaggccgccgccgcatacggcgagggggcgaggccgccgtatgcgtcgtccccggcgccgcccaggaagacggcgcggcggtcgggcgatagcgactggtcgaaggggtcgcgcaacgcctcaaaggccgaggccactcgctgcgggcccggggcgggcgagggtgcctcaacccccgcgccgtcatgctccagaggcctttctggaggcgtcgccgtcgccgcagcgggtggtgcaagcgagttgccggcggcgacggcagccgcgacagccgcggaggccaccgccgcagccaggaggcgggggtcgtcatcgccatcgctggccggcagaggtggcaaaggaaggcaatctgcagcggctggctctggcttcacgcccacatccgccgaccagaattcgcctggttgaggggcgagcaccggttgctccctcggagccttcacctctgcaaggatggcagacccggatacaggtccctcctcttttggtacgccgtcatctctggcagcagcagggggcctgccggcgtcctccgctctcacacccacaggtgggggcaggcccccacgcagtcctggcttggccggcccctcatcctgcatgcatggtcgggtacgggagcatctgggtatattccatacggtaagcggctcgaaaaagccacctgtcgaccctttgcccgcactcaccgactcctcagggggtgcacgcgaagccctaaagaaggaggagtagcccacacggacgagggccaccgccacgccgatggaagccaggcccaacagcctcagcattccgtcggggctgtagctgcgtcgagaggaggagcaggggtgcatgccgacgggtgcgtgcgcgagggagtgccctgaatgctcgggtctcgcacaggaccgtcccggccagctacccacctcgacatgtcagctttgcgcccgcatggctcaggatttgacgacctgctcgctggcgcaggccttgttcagaagctcggggcgatccgcgagcccgacggggaaggagggtttcggtccgacacacggagcgcaggatccctctgagcacccagacgactgatgggaagcgatgagtgaacgagcgtggcccgatgtgacgccctgcggcccccagtaccgctcagcggggggctggggggtgtgtgtccgtgatcgagggagatccccgcagcgggcgggagccacgtcggagctggacgaatgctggggccctcccgtacgaaaggcagccagggttctgcacatgcatgcgcagtactggccagatccatatgcgattaaggactgagatggtatccagatagccctggggtgattcaggctcgagccccatgccgaaacgcaagcacgagccagaggtggagcagcaggtggaggaggagcagcaggaggcggaagcggaggtagaggaggagaatggagcgggacaaggctcggagagcgttgagtcaggcagcagctccgacgacatggagggacctagcagtgcagaggaggagagcgaggatgacagcgatggggaggcctttgacagcgtcacagtcgactttgacttttcggagccacaggaagatgactttctgggtctcaaggtcctcctcaccaactacctggacggtgtcacctacgatggctccggcctggtggacctggttctgaagcatgtgcgctgtggagttgggtgtcatggtatttttactggcggggttgagatgttgggggccggggatgaggattgaggggagagccccagaagcgggagggagggcgataccctcctgggacggcaaagatgcgcatgatggcaatctgtcatttccgatcaacgctgcctgactgtcccagtgcgtgatctcagcggtcaggcatgagcttcaggccgggacagcaacatttttacccccacctttgtgacacctcgccccagagcaagctgggcaccgtcatcaannnnnnnnnntcgggacagcaacgattttacccccaccttcgtgacaccttgccccagagcaagctgggcaccgtcatcaagtgcgaggatgacgtcctgggggtcaccactgtccttcctttggcttctgtcgccgggaccaggtccctgtccgacctggggaagttcctgctggcgcgggtgggacccgagctcaaggacagagtgcagcaggtgcatggggtggaaggttgtggtgaggtgctttgtgagaggtgaggggttggacagtgggtgtgagtgggtttttggcctttgtggagcacccccccgctccagcgagcttgtgggtgccatcgacgaccgtttgtgagtcgcagacttgtaaacatctggcctcgaattggagatttggagttcctcctccttagttcaaggctagttcggggcgagtgctgcatgcaccgtcttacttccccaagccacacccaccctgtcccagtcgcttgctgacaaggcaacgggcttgctattaagcgaacggctcatcaactgccnnnnnnnnnnttgggggtcaccacagtccttcctctggcttctgtcgccggggccaggtccctgtccgacctagggaagttcctgctggcacgggtgggacccgagctcaaagacagagtgcagcaggtgcatggggtgcaaggttgtggtgaggtgctttgtgaggggtgaggggttggacagcgggtgtgagtggggtttttggcctttgtggagcaccccccgccccagcgagcttgtgggtgccatcgacgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttacttccccaagccacacccaccctgttccagtcgctcgctgacaaggcaatgggcctgctattaagcgaacggctcatcaactgcccgccggcagtggcaccgccactccagcaagccttgagagaggatttgcaggcccaccaggggaaggtaagcactgggcgnnnnnnnnnnnnnnnnnnnnnggtggggttgcgggttgatggatcggcgccgccctcgccgtcctgcgctcaatctctgcgtatcttgtggtcaaacagccgaggatgaaacatcttctactcttggcgagagcattccgggacagccggccggcagagcagcctgctgggaagaagcgagggaaaggcccatcatccagcaaggtgttcatgggagctctttatgatgagacgatgtggagttgggaaggggtgggaagccttatcattgtatttttatgccctggcaacctgcactcacatnnnnnnnnnnggggaagaagggagggaaaggctcatcatccagcaaggtgtgcatgggagctctttatgatgagacgatgtggagtttgggaagggttgggaagccttagcattgtgtttttatgccctggcaacctgcactcacatcccccattcacaacccctaccaccccaggctgagctcatcttcacgcagcccgaggcagagtgctgcttcaagcacgcggtctggacagcggagtttgcggcgagggagacgcaggagggccgcaacaagtcctgccgaccagtgcgcctcgtcctctgcataccctgcgctgccctgcacaggataggacaggacctggaggctctgcttggcagccctgcagagtgagctgtggtggtacaggaatgaatgcaaactacagattgggctcgaaaagggggggattgtctttatattgagattactatggctttcaagagcttgataggaggtgttgtcgagagtgcatttggtgaaggggtttggcgaggatgcctgtcacatgtaccaggttgtcagtcatcccaaggcacgcccacgagggcattnnnnnnnnnnaaatgcgacctacagattgggctcaaaaagggggtgattgtctttatattgagattactatggctttcaagagctgggtgggaggtgttgtcaagagtgcatttggtgaaggattttggcgaggatgcctattacatgtaccaggttgtcggtcatcccaaggcacgcccacgagggcatttctgggcaaggcaatcatttggatacccttggctttaccagcaagccaggggatggcagggtggcctcggggaggagggggctggggggaggttttcatgcagggcgagcatttgctcgagctagggataggttggacatagaagagagtgtcgtgatctcacccagtgtcaggcaggcgggctagagactgcgacaggacatgacagccttgagggcccctggatcatgagctggtgtaggaagtagtgggcacaggtgcaatacaaagtgtcaaagcttgatggtggcaagatnnnnnnnnnntgccccaggaccataagctggtgttggaagtagtgggcacaggtgcaatccaaagtgtcaaagcttgatggtggcaagattgaccaaaacagtcctcaacaaaagagaggccgatccacgcaatgataatgtccctgggtgcatgaccaaaaagggcaggtcattgggatgctagcacctacgacatcaaatactggtaaaagcttccgtccatgggcatcnnnnnnnnnncaaaagggcaggtcatcagggtgctagcaccaacgtcatcgagtactggtaaaagcttccgtccatgggcatcaatgcgtatggatgctgcagcgccc

SEQ ID NO: 29670 - DNA, 149 bp, Chlorella protothecoides
gaggaatcgcgcgccatgttcgaatcgtgctcgtcctacctgatgaggtggcctgaagtcacgggggggtacagcggtcagtatcgcgatgattgcaatcggctgcatcttttagaaagtacacatgctcctgcacctgcgcgatcgaa

SEQ ID NO: 29671 - DNA, 129 bp, Chlorella protothecoides
agccccgctgagagcacagcgatcgctttgcatgtgtccggacaccaaaccccatgccatcacatgtgcagctgtacctgcatggcatgtgccgaatcgcccagcagaaccactcggcccttgtaccac

SEQ ID NO: 29672 - DNA, 81 bp, Chlorella protothecoides
atgggacatcaagagcaccacgagtgtgattagctactcccaaaccagcacggcagcgcacagggagcgcgtagaagagag

SEQ ID NO: 29673 - DNA, 61 bp, Chlorella protothecoides
ctactgattatgacagatatatccaccacttttgctctcccatactccttcagacttcagt

SEQ ID NO: 29674 - DNA, 61 bp, Chlorella protothecoides
attaaagcagcagcaggaggcggacaagggggctagacgagaagctgaagccactaaagcc

SEQ ID NO: 29675 - DNA, 104 bp, Chlorella protothecoides
agaagccctgcacccacgcaggctgactgcgacccgagggtcggattctacgccctgcccaccctcgagtgagctttccgagccggggggttgtatgtcttgag

SEQ ID NO: 29676 - DNA, 72 bp, Chlorella protothecoides
acttccgcggaatctgcggtatgtggagttgcatgtcggcatgaatacaaaaggtaccgaatcgtgagctgt

SEQ ID NO: 29677 - DNA, 133 bp, Chlorella protothecoides
cgggtcatccagcaggtacacgtctgtgggtgggggggaaaggggagcggctcgatgaaaatcatgaggcccctagccatcttgtaccaagtgtttgcatgggaccccccaaccggcccagatgtgccgatcc

SEQ ID NO: 29678 - DNA, 61 bp, Chlorella protothecoides
gtcgttgatccaggtggaatctacggcagggacaaaagcaccttggccacgaactccctcc

SEQ ID NO: 29679 - DNA, 74 bp, Chlorella protothecoides
ccccgccatggcatcctagaggaccggaaaccacaactctgtatactgacatccatctctattctcccccaggg

SEQ ID NO: 29680 - DNA, 74 bp, Chlorella protothecoides
ctccagcagatacctgagtgtgtgatggaatggaaggggagtgggcttcagatcacgcagtccttgacatgcaa

SEQ ID NO: 29681 - DNA, 61 bp, Chlorella protothecoides
actgctggctgccgcgggaggtgaggggcgcgaagcccaccatgaagaagtggaggcgggg

SEQ ID NO: 29682 - DNA, 63 bp, Chlorella protothecoides
tacacggggtctatgcgtcttttgggcttgccgcactcttcttcgaggttctgttgggagcag

SEQ ID NO: 29683 - DNA, 61 bp, Chlorella protothecoides
gattctgtgccggatcacctcgccgcaggtcgagaacagctcctgcagcgtatagaatcag

SEQ ID NO: 29684 - DNA, 106 bp, Chlorella protothecoides
gggctggtgaggggagggatgcctgaggcactgtgcttaggaataatggaagggtctgcctccacccctagccacagaaatcaccgccaacatctccctttgcccc

SEQ ID NO: 29685 - DNA, 61 bp, Chlorella protothecoides
cgtaaacctcctgcaaccgtactcgcagcgcgtgctgtacaacggccaggagatggcgccc

SEQ ID NO: 29686 - DNA, 62 bp, Chlorella protothecoides
ctgctcccaaacccaccccaccttgcactgttggccttccctctctgcaggccgaggattgg

SEQ ID NO: 29687 - DNA, 61 bp, Chlorella protothecoides
gcgtccacctggtactcctctgcctttctatggaggcaggcctcgatggcctgtttcttcc

SEQ ID NO: 29688 - DNA, 61 bp, Chlorella protothecoides
agcaggcgatccagaagactccaagcacccacctgccatgttgcgatttgatgagaagatt

SEQ ID NO: 29689 - DNA, 71 bp, Chlorella protothecoides
agggctgggtggtggggatggtggtggaggactgggtggtcgggatggtggtggagggctgggtggtcggg

SEQ ID NO: 29690 - DNA, 71 bp, Chlorella protothecoides
gtcccaggagctggcgaaggaggggcagcccacctccgagccggcacccgagggcggcgagcccgccgccc

SEQ ID NO: 29691 - DNA, 73 bp, Chlorella protothecoides
acctctcggaacagtctatcccattcagtttcagctccatcacaaccgctatgagtagttgcaatgcagcttc

SEQ ID NO: 29692 - DNA, 133 bp, Chlorella protothecoides
ctgccccaggacacgggggcctcacccagcccaggcccgtccggcagcagcggggccggcgcggcgccctccagcttgccggaccacgcctgcggggccgcgtctcgggtgacccaggggttcccggcgagcg

SEQ ID NO: 29693 - DNA, 547 bp, Chlorella protothecoides
ccccccccccccccccccccccccgggcccttcccccatggacgagctcggcgccccctcccacctgcatgtctgacgtccagagggtgaggttgtcacgcaggagctgcatgatcagggtgctgtccttgtacgactcctcgcccagcgagtccagctccgcgatggcctcgtcaaaggcctgcttggccaggtggcaggcgcgctcgggggagttcaggatctcgtagtagaacacggagaagttgagggccaggcccaggcggatggggtgtgtgggcgggaggtccaccagcgcgatgtcctgcgcggccttgtaggccagcagcgtgtgctccgcggcctccttgcgctcgccgcccgtcttgaactcggccaggtaccggtggtagtcgcccttcatcttcaggtagaagaccttggactcgccagaggaggcggtggggatcaggtgctcgtccagcagggacaggatgctgctgcagatctcctgcagctccttctccacctgggcggcgggggagaggggggcgggggtggataggag

SEQ ID NO: 29694 - DNA, 70 bp, Chlorella protothecoides
gcatgatcgaggaggtgcaaagaacgtttgaaatcctagtaaatacttgtcagaaagatcattggccaca

SEQ ID NO: 29695 - DNA, 170 bp, Chlorella protothecoides
gatctgtactggggagttctcacttcaactcaaatttgaactcgcggaacccctcaagtgattgccgaaaacgaacccaaatggcttacgttcacttcacacacccaacatggcttgcaaacaatgcggaacgtaccaaagctatccgttctgtctgagtgtccatacac

SEQ ID NO: 29696 - DNA, 77 bp, Chlorella protothecoides
ggctgccgttgagcatcctgggctatggccgcccccacgcggaacctgtgccagtgtcctggccaagtccaagctca

SEQ ID NO: 29697 - DNA, 61 bp, Chlorella protothecoides
ggcagactgagtaccgagaggatcacccaagacctccccttgtcacggggatctctccccc

SEQ ID NO: 29698 - DNA, 61 bp, Chlorella protothecoides
tcctgagcctccgttacgcacactttggaggccaaattgcatacattcaaggtgcgactac

SEQ ID NO: 29699 - DNA, 170 bp, Chlorella protothecoides
gttcccatctcctggtccagctctcttcaccctgcttgctgtcttgcacaaagcctccacagcagaaatttcctgggcagccgtggtgtccagcgcacacttgactattctcgtgcaatgctgaccgatctgcaccgtgtgttcttcagggtcgggcagctgcagcgggt

SEQ ID NO: 29700 - DNA, 64 bp, Chlorella protothecoides
ttgcagcgatctgcatccccaagtatgaccccccccgccacgcaaagcccaccttcatcaacgc

SEQ ID NO: 29701 - DNA, 117 bp, Chlorella protothecoides
ggcgggggctccggctcctggcttgccacctggtaccatgactgtggagtgctccgcgatgcctcgccatccccctgacacgtcgcgcagcaccccccgcacaggcatctgttggta

SEQ ID NO: 29702 - DNA, 61 bp, Chlorella protothecoides
tgccagggctcgaactgggtgctgaaagggaccaagcctaccggccggacacctgtcccgg

SEQ ID NO: 29703 - DNA, 61 bp, Chlorella protothecoides
tcctgcccagaccgtgtggaggcccggctgggcaacggcaaagccactccacagcgctgat

SEQ ID NO: 29704 - DNA, 136 bp, Chlorella protothecoides
catcatctggcggcgtttgagatagtacggcgtggccacatgccccatctcaggcacatcccgcaccttgtacttggcatactgggcgaggatgtcgagcgctccgatggtgaggtgaaacttgccgctgtgggtg

SEQ ID NO: 29705 - DNA, 73 bp, Chlorella protothecoides
ccctgccatcctgagcggactagtgctgctgctcctaagatgtgccttcgcggtgagcctgggtgcacttgaa

SEQ ID NO: 29706 - DNA, 61 bp, Chlorella protothecoides
ggacatgaaccaccctttgggcgtctcatccacccggcagatgcccttcttccccaggtac

SEQ ID NO: 29707 - DNA, 61 bp, Chlorella protothecoides
gcacgcccaccagtacgtgcgggtgcgcaatggcgaggagaagctggtggacgtgtgggac

SEQ ID NO: 29708 - DNA, 77 bp, Chlorella protothecoides
ctggtggatgcagctgggccccacctggagcctgtgcgtcctgaccttggcctacctccaccactccaccacgggct

SEQ ID NO: 29709 - DNA, 74 bp, Chlorella protothecoides
caggcccaatgccacgggcgtgccagggcggggcatgcagtctctcccagcgggctccgacgacagcgctgtgg

SEQ ID NO: 29710 - DNA, 61 bp, Chlorella protothecoides
cgacgggtggtgccatggccacggaggaggccattctagccagcctcgaggcgcgtactgc

SEQ ID NO: 29711 - DNA, 71 bp, Chlorella protothecoides
gccgcagtttgagctcttctccctcatggtcttggatgaccatcatgtgacgcacaccgtgtccgtcgcca

SEQ ID NO: 29712 - DNA, 80 bp, Chlorella protothecoides
tttctgaggtgttaatgtcctgcatattaccagctcaagggacgagcgtcacaaagcagcatgatatctggtatgaggct

SEQ ID NO: 29713 - DNA, 61 bp, Chlorella protothecoides
ggctcgggcggggctggaggtgcagacgggtcgcggcacccggtggagcctggtggcccac

SEQ ID NO: 29714 - DNA, 70 bp, Chlorella protothecoides
ctggggagatgccaacaagggcaagggcaatcgctgcttcaataaaacaggggatcgcaagatcatcaac

SEQ ID NO: 29715 - DNA, 110 bp, Chlorella protothecoides
catgcagctggcgtaagcccagcacgggtttttgtggcatttgccagtgcatatctttgggggtgcgatactgattgccaccccaccaccagcatgtgcaacggccgcag

SEQ ID NO: 29716 - DNA, 510 bp, Chlorella protothecoides
  modified_base (245)..(398): a, c, t, g, unknown or other
tctacctgaagcccatgcgggcgtgagtgcctggtgactgggtggttcgggggagagtgtcctgtgtgcctgcgctggcagcacccagtgtgccacccgaagcagccattgcatgttgcaaaaatcagggtgcgtgccgagcggacccaccccccacatacacatcagcaaagcctgacatacacctgcgcaccacctgtgcagggtgtgcgcgctggccggggccagcgtcggctcctaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgacgccgcgcaaccgcgcgcacctgtcggagcccggggggggcgccccaggcgccgccggggctgaggccgaggaggagcctgccgtcgcggcacatgcctgagccaga

SEQ ID NO: 29717 - DNA, 532 bp, Chlorella protothecoides
  modified_base (154)..(292): a, c, t, g, unknown or other
gaacgagaagctggccaacctgaccgaggttagtggggcacgcgtgcaggagggtcatcggtggtgtgagggggaggggatctgtgtgcagcctcccgtcctaaaccttggtagcagcccaccggcttggtctttgctgccgtctgtccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggcctggttgcaactccaacgctggccgaaccgcgctgttcatgctgcgagcccgtcattcccctctcatgtgcacccgtgtgcgtgatgcagtgcttacaagacggcactcagtccagaaacatatttgggggcatcccatggcagcgaggcccctggctgcaaccctcggtgccgaggcatgggacctttcctcctgacgccactgtccgcctcaccccactccccaagcgccga

SEQ ID NO: 29718 - DNA, 61 bp, Chlorella protothecoides
ggagatgccgtggttgcagggggaggacggaccactggagcgccgggtctccacgacattc

SEQ ID NO: 29719 - DNA, 69 bp, Chlorella protothecoides
gtcgctcaatggaggatagcagctgctgggccacatgcactgttcagcatccccttacacctgcctgtt

SEQ ID NO: 29720 - DNA, 71 bp, Chlorella protothecoides
tcactcgaggcggacgaggagcgggccgctcggcactcaggctgtgttgttctgcgccgaggcctccactc

SEQ ID NO: 29721 - DNA, 61 bp, Chlorella protothecoides
gtaggtggccgttgctgtagccaggtcccctgccgcctcgtggacaaaggggctgatgaac

SEQ ID NO: 29722 - DNA, 67 bp, Chlorella protothecoides
tcccaataacgctccctccctgcaactgccagccattgccctgacgatgtacacactccacgcgcac

SEQ ID NO: 29723 - DNA, 61 bp, Chlorella protothecoides
acaccctgtggacagtagcagcgcacctgcaccgccgctgagcaccccaggcaacccggcc

SEQ ID NO: 29724 - DNA, 61 bp, Chlorella protothecoides
catgcgacatgcacgcagggccatcatcgtgttactgccccgcccgcatacgctcctctgc

SEQ ID NO: 29725 - DNA, 158 bp, Chlorella protothecoides
ctgccacctcttccagcagccctcatcggccagccactggatgctgaccccataagagcaacccagcacgcaagcagcgattcatggtccatgacaagtcatcgcatggagaagcctgccaggcaccccaccttggctgcaagcatgcccgtcatgcc

SEQ ID NO: 29726 - DNA, 61 bp, Chlorella protothecoides
tggacatcctgaaggagaaatggtcaggtatcaggggaggaactgcgtgacggggtcttgc

SEQ ID NO: 29727 - DNA, 102 bp, Chlorella protothecoides
gttcagcaggtcggtgtcggacaggttgtggaggatggagcctatcagaggatcgggcaggccgtccagaccctcccgcattatgcgggcgagagcccctga

SEQ ID NO: 29728 - DNA, 178 bp, Chlorella protothecoides
gcctgcgtgcggaaaggcaaggtgggcaaattaaggtgagcacgaagattgtggatgctggttggggctagatccggtggcgctgtgcgagctggtctggcactgaggaaccctaaaacggccctgagagctgtttgcaaaagacggataagtgcatcttggcgaaagtccaatcctg

SEQ ID NO: 29729 - DNA, 97 bp, Chlorella protothecoides
atggctgagtggcagtgccaagttggatgcaggactatgtgctcggagacaactgcaacctgcagccgaccagtcgtgcaccttgaggtgcgtctcc

SEQ ID NO: 29730 - DNA, 151 bp, Chlorella protothecoides
cggcctgcgagaccatgggcggcgccaccaccatctgctccgacaagaccgggacgctgaccgagaaccgcatgaccgtggtcgacggctggtttgcgggggccgccaccaagggcctgcccctgcttcaggatttgggatcaggggtggg

SEQ ID NO: 29731 - DNA, 104 bp, Chlorella protothecoides
aggaggtttttcttcgggaggacgggggggcgcattcttgggtgttgaagtggccgtggctgtgcggtccagcaaggacacctctgcttggactggagacggtg

SEQ ID NO: 29732 - DNA, 3956 bp, Chlorella protothecoides
  modified_base (1539)..(1548): a, c, t, g, unknown or other
  modified_base (2079)..(2088): a, c, t, g, unknown or other
  modified_base (3031)..(3040): a, c, t, g, unknown or other
  modified_base (3342)..(3351): a, c, t, g, unknown or other
gcccggggtcagcaggccctgcgacgccagtcccacctccgccagcgcgcaggcagccgccagccgcaccctctcgtccgggtccatcagccggtccacgcagtgctggggtgtggaagagagggaggggcggtgtgtggggggagtggagggagtgctggctaggtctggtaggcgcaaatcgcccggcaggcagccgaccgcagcgtggggcccccacgcccgacgaaggagcaggctcctctcgctgttagcatgtgagtgcagtatccaaatccttcatcgccgctccccactccctccgaggccccccccactccctccctctgcccacctgggtcacgcgcttggccaacccggcgtcgtccctccaggccgcggcgagggccggggtccgggcggccatggcccccctgatccccgcgctggtgtccgagtatcgggccagcaggcagtccagcaggcgggggcaggcggcctgggcccccgcccccaggctctcctcctgcaggaggagcaggcgggccgccacatcggtcgccgccccgcgccgcgcctcgtccgccgaggtggccagcacgtccgccagggtggggagcaggggtgtggtgatcctggggacgcggcagtgcacctgcatgtattatgtggagtgtgtttgggggaggggggggggcggcgggggaggaagtggaaaacggcgggagacacggggcgggagccgctgctgctgccagtggcaccacctgcactcgcggctgcccttcgccgtccctgtcaagcaccggattgactacgttcaaactctcctccaacacctcctggttaccaacacctccctcgagcttctgtacctggtacaggagctccatgcagtaagtcccaaacaccccggcctcggtgcgccctgccattgactctgccatttgatcctggatgctgggcgccagctgggccagcttgaggcccagcagctgcaccagcagccgccccgcggcgccgggtgcggggcgcagcaggggcttgagcagcgcctccagcaggcgcaggttgatgaggtcggcctggtcggcaaaggtgcacagcatgcccagcatgctggggaacacctgcgcctcgttggagtcgctgcggggtgaggggggaaaggggggcgtggagcttggatcgggtatgccgcgggccagagaaggaggggacttcaagcggcctgccctgaatcacatttcatcaacccccacttccccccccctgttctctgctacccacttgatgctggaaaggagggaactgatgaaggtgcagaggacctcgtcgcgctggacctcgggcaggtccaggtccaggtccatcgccagcacgcagcatttgaactggaaagcacgaggacgtcagagggtcttgaggtcataaccagggggctttcgtcccctcaggagcagcacaggcgatcgcttgcaaaatccaacatcacgccagtcttccttcttgcaagggatctagaaattgattcacgccctggccccccacctcgtgcannnnnnnnnngatccaacatcacgccagtcttctttcttgcaagggatccagaaatcgattcacgccctggccccccacctcgtgcagggtgtccaggaggagcaggtgcttggagaagaggggcgatgccgggtccgcaagcccaccgagcacttgactgaagaggaggaagacgcgctgcatgtggtttttggcaaggctctgagcgagggcggcagtgagtatgggagggtcaccgtcccagctgcagcttgcatcaagatcaccacccgcctgtccccaccttgagcgtcgcattgtcgtatgggcactctggggcgtgaagcttcagtaggtggcagaggcagcatgccgtgtagagctggacctcctgtggcggaggggatgagggtggggtgaatatgagaggctctatatcgaggcctgttctcaagtcatggtcacacctggtggactcaccgtgctcgagtgtctgaggagggcgtcggaggacagggcatggcaaaggcctgccgaggcggtacacaccgccgggtcggnnnnnnnnnntcatcgaggcctatactcaagtcatggtcacacctggaggacttaccgtgctcgagtgtctaaggagggcgtcggaggacagggcgtggcaaaggtctgccgaggcggtacacaccgccgggtcggcctgctgcgaggagctcaacgccatctccgcttgctgtgggacatacacggtgcgaatggttttcacgtatttttcgcactggttctggacgcgagcggcactcttttgagccaaatgcatgcccacaagctgcgttcatgagtcccggcgacaccttgagtgttttgaggatcacgtctttcgacttgtcgcgaatgtcgcataataattttccggcatcgcgcaaggtcacttgggagcgcgaggacgcgtcatccgaggcctcggtgggagctggggccactcgcttccgtgccatgttcgagggacttgaatttcaaagatctccgatgggcatactcgggacggccagtcgcgctataatgaatacattgggcaaggaagagtgtgtggacaggttataccaggggcgatggtcccagcggggaataccatcattccgagctctgtgataccattcctcgacagctttcccgcgttcgaaactatatggagatccgagaggaacgaacagagatatactgcatgtggaagactttgatggctttgattgcattgaatatatacgcaagtatccttcctgtgtgcagcacatgtagggaagtttcttcaataaaagcctctttgggggttggctcacgaggccttgcatgccgacttcccctgggaaatgatgaccatggcatagtccaaataagccttttcacatatcagttaccaagattcttatattttgcagtgtcttttgtaatatgctctgaacggggatcactaaaattgctcaattggagtgagagattgttttacaattagcannnnnnnnnntgggaaatgatgaccatggcatactccaaacaagccttttcacaaatcagttaccaagattcctgtattttgcagtgtctttttaaatatgctctgaacggggatcactaaaactgcttagttggagtgagagattgttttacaattagcactgcatccacaaggagatcccttgagatcgatcatcacacgctctagtttgcactgtgaggattaaaatgtggaaagtcactcagtcgagagtgcagaaagtgtgtccacagaggaggtttatgggttcagggttgcagctccccagaacnnnnnnnnnnatgcactgtgaggattaaatgtggaaatcactcagtcgagagtgcagaaagggtgtccacaggggaggtgtatgggttcagggttgcagctccccagaactggggcgccctgaccgagtatcgagcatcgcgacaacccggatttcatacaagagcacttcttgcattcgacaccgcagacggtgcaggacgacaataggcgtttgatatccgtcggagggaagtcgaggacagggtcaagccaattgacatggcctcgggaaggcgtcctctggcagaggacagagaggaggaggatgtggaggaagaggaggaggaggaggtgcggctggggagcctctggcttggcaatgaagtttcagaccgtgctatggtgccagtaaagtctgtctgtctcctcatccatgcacaggagcctgaggctgaagaggacgaggaagacgaggaggaggatggcctcgggcgccacaggagcgctgcgcggaagaggggcaaggccgcggccttcatcgatgatgtggcggatgaagacgacgaagaggtgattggggcgggatcgctggtgtgttctgtcgtggtggatattgtggggggtgggtgggtgg

SEQ ID NO: 29733 - DNA, 61 bp, Chlorella protothecoides
gggcgcgcgcctgggccactggtcgcaggcacccactcactcccaggggcccctgcctcgg

SEQ ID NO: 29734 - DNA, 156 bp, Chlorella protothecoides
gaggtggacgccctccaaggtgggttggggtgcggggtaagctgatgtcacagcagacatctggtttgcgggaaacaaggtggcatggccccggcccccgtccctctgcagccactctccagcgcaccttctcttcaggacgccgcatgactgcct

SEQ ID NO: 29735 - DNA, 66 bp, Chlorella protothecoides
ggcccctggtgggcgtgtgggggccggcagccagtcagccacactggtatgcaccgagcgttgaac

SEQ ID NO: 29736 - DNA, 119 bp, Chlorella protothecoides
cgtgagtgtgttgtggtcgacaacaaccacgcagcccttggcgctccagatagtagccagtgcggcgtcacctgatggacttttagctcagtggtgccatgctgagctcccattcccaa

SEQ ID NO: 29737 - DNA, 61 bp, Chlorella protothecoides
cagccgatcaaattcgaggcatgggctggatgtctttgcagtatgctgtatccttgaccgc

SEQ ID NO: 29738 - DNA, 61 bp, Chlorella protothecoides
agacacatcactgggtcaatgcaggatgttaaggcacagaatggtaatcgaacccacactc

SEQ ID NO: 29739 - DNA, 71 bp, Chlorella protothecoides
cagccgcctcgggaagggccacggacaacactttgtagcgtccttcaaggagctgcaagccatgtcctttg

SEQ ID NO: 29740 - DNA, 70 bp, Chlorella protothecoides
gacaaccgaggcatttgtctgatgaccgctgcttcatatgtccttgaatcaacgctagtgctgttttcat

SEQ ID NO: 29741 - DNA, 61 bp, Chlorella protothecoides
ataccatttgtactatgggacgacctctacttccgggcaaagttacgaggccggacgaggc

SEQ ID NO: 29742 - DNA, 221 bp, Chlorella protothecoides
actgcctgtcaagtgaaggagacttgctttgaatcggggtgggtgctaggggtgataaacatcctttttcctcaacagtcaagtgtctccagcccccactatgcatgggcaaccagtagctcgcattccccagggcctggaaacgcacctccttcagaccgctgctggtgtggtgctcctggcaccactcgttcattccctccagcacatccactggctgg

SEQ ID NO: 29743 - DNA, 135 bp, Chlorella protothecoides
ggagtgccaggtgccggggtgggtgggtgggggattgcgtttggatgagaagtcttgcatagcatctttggaaagtttggagtccctgcagagacaggataactaaaacacgcacagcatgcacctgtgccagcg

SEQ ID NO: 29744 - DNA, 78 bp, Chlorella protothecoides
ccccgtcctggctgaaccgagcccagctagcgggctgcatcctcaatccacccttgcgtgccgcctccccgcccccct

SEQ ID NO: 29745 - DNA, 70 bp, Chlorella protothecoides
tccttgtgcgccccaatgtcagtctccaagcacgacgtcgccgcggtcaactccctccgtcccccccccc

SEQ ID NO: 29746 - DNA, 61 bp, Chlorella protothecoides
gccgggatcgcaggcggcctgtcgggggcatgggtcaatttgtaaatccactggtgctcat

SEQ ID NO: 29747 - DNA, 61 bp, Chlorella protothecoides
cgtggtgggtagatgcgtgattcagaagggtggtttcaggatgaactgtccccaccccacc

SEQ ID NO: 29748 - DNA, 61 bp, Chlorella protothecoides
ggaccgcgccgagctggccctgcacgagactgggaacgtgggcgtggaggtggcggcggag

SEQ ID NO: 29749 - DNA, 61 bp, Chlorella protothecoides
tcgacttcctctggcccctgctcctagagtacccccgccgcggcatcggtatcgtggacgc

SEQ ID NO: 29750 - DNA, 61 bp, Chlorella protothecoides
ccttgcattcttgggagatggctggcttgggggggaacttcacctctcgcgcgttgagcat

SEQ ID NO: 29751 - DNA, 61 bp, Chlorella protothecoides
gtggatcctagacatgcaccgcgtggctggtgtatctgcgctgtgttccggatgtctatcg

SEQ ID NO: 29752 - DNA, 78 bp, Chlorella protothecoides
ccgcggtcccctcctccggcgtaaggatcattcatagtcctgcccctcccccgctttccactctcaccagaccaatgc

SEQ ID NO: 29753 - DNA, 61 bp, Chlorella protothecoides
gccagccggttgatggcccgctccctgccggcgtaggcctggtggcgcacctttcgaaacg

SEQ ID NO: 29754 - DNA, 80 bp, Chlorella protothecoides
ggctcgatggatgctggcacccagtgcttcgtccagcctagcgacgagatgagggtcgtgaccagccagctcaaatcgct

SEQ ID NO: 29755 - DNA, 97 bp, Chlorella protothecoides
atacaggttgctcattcatcgcgaatagtacagaatcaaggaagctatacgattatcatttttaaatgtcaataggtgtttgagcaaagatgcgctt

SEQ ID NO: 29756 - DNA, 166 bp, Chlorella protothecoides
ctcgctgcttctcagccaggacaaacacgctaaacccggaatctcaaatcgtagataggagaccctgtccagtgttttcgcgactcgagaatattcgatgacattccatgcacacattctccgtcaatcccgggggttggagggtgtacgggatctgattctccat

SEQ ID NO: 29757 - DNA, 104 bp, Chlorella protothecoides
tgcccacaccaatggcctcggtacgattgtaattatatacaagtgactgtgccagggagggattttgccctgcaccgagcgcaagtgggcgcacggctgcaggc

SEQ ID NO: 29758 - DNA, 69 bp, Chlorella protothecoides
cttactataccttcgaataccgttttctgccccccccgggtccgcgacggcaggactcacctgctcgcc

SEQ ID NO: 29759 - DNA, 75 bp, Chlorella protothecoides
tgcaccaggccgcgcgcgtccacctggaggatattaattttgtggggaaagggggggttggtgaatgaatgtgtg

SEQ ID NO: 29760 - DNA, 61 bp, Chlorella protothecoides
ctccttgccccacacgctggccacctccacgtggtccagcctcccggggtcaacccgcagg

SEQ ID NO: 29761 - DNA, 111 bp, Chlorella protothecoides
ccttggtgctgacatgaccgttgctggagtgtgtatgaaactcccgagctgcctttgcacggcagcctgaccactcttcatgtccccgaacgacagaaagaccatgcccct

SEQ ID NO: 29762 - DNA, 116 bp, Chlorella protothecoides
acaccagcgtcgaggcggtgtccctgcacttaccctcctatgtctcccagaccttgcaggacagcccgcgccgcaaccacccgccaccccacctcctcccgcagcacatccgggaa

SEQ ID NO: 29763 - DNA, 239 bp, Chlorella protothecoides
gtagccgggcaggtgcgtcttggagcagccaggggtgaatgcgcctgcgcagggtcggagtggatggccgggtgggatgagggggtgatgagggcggcgacgaggcaacgatcgagaagaaggcattgggcaggacaacgaggtcccctgcgggccgattttggtgcagcccacgcatatgagcgcaaaactttcattgacaccaccatcatcacccgctcccgtccactcgctcaccg

SEQ ID NO: 29764 - DNA, 79 bp, Chlorella protothecoides
cagggactggtccgcgaggagggcacggcaacatgccagctcgcgctcggtgacctccgctcgacgccgccacccatcc

SEQ ID NO: 29765 - DNA, 119 bp, Chlorella protothecoides
aagcttccattggaagaaatttatgcatttgcttggccaagtgattggtgataggcccccataggcacacatactcggccgtgccgtcccggcgtggcagcctgctgagcgtgcgaggc

SEQ ID NO: 29766 - DNA, 113 bp, Chlorella protothecoides
aagcgtgcatgcaggacggaccaatgctgagcttttcatgttatggttatgagtgagatggaatctatgcagtcggtttgagtaagtatttcatcaacatgcccatctcgcgt

SEQ ID NO: 29767 - DNA, 61 bp, Chlorella protothecoides
tgtcacaaggcctcccgcagaggtggccgtggtagccatggccgggagcaagcccacgtcc

SEQ ID NO: 29768 - DNA, 68 bp, Chlorella protothecoides
ggaactccgacacgagctgcggttgaggagaaggacgaggttgggggcgcacatgggtgcggggtgtt

SEQ ID NO: 29769 - DNA, 120 bp, Chlorella protothecoides
agcctgtatgcctgctgcgcctctgcatggcaaccctagatgcgtggtatgtgatcggctttcggctttccccggccccttaaacgctgcgcaccagctcctcatcgcccagtgtttgca

SEQ ID NO: 29770 - DNA, 131 bp, Chlorella protothecoides
gagaaattccgcaagtccatagcggtgctgcgagccaacgtctcccaagtgtcgcgtaccagctgcatgggtaggaaaattttagcggacagcttggtaccagcctaatgaacatataaggacggcatcta

SEQ ID NO: 29771 - DNA, 67 bp, Chlorella protothecoides
tcgcggaggaaagcaccggggggtgaaggggaaaatcagattctgggcgatgcacagagtggcaaag

SEQ ID NO: 29772 - DNA, 109 bp, Chlorella protothecoides
tgagtgagctgctggctgggagcggacgtgggaggaaggaaaccctgaggatgccgtggcacgagattcgaccccggtggcggggcaacccgcgtgcaaacggctgaaa

SEQ ID NO: 29773 - DNA, 111 bp, Chlorella protothecoides
agagcggggggtaagaatggcttttccatgcaggccatgtgcagggaagtgccgcgccccctcccctcctccccccttcctggcactcgcctgttttctggcttcggcaga

SEQ ID NO: 29774 - DNA, 66 bp, Chlorella protothecoides
tctcgtagacaaggcgacgatgcaagcggtattcaaaatagtcaagcatgcccaggtcctcgactg

SEQ ID NO: 29775 - DNA, 61 bp, Chlorella protothecoides
gcagactccgacaggacctcctgctccagattcttgaccgtctcagcagccttctggatct

SEQ ID NO: 29776 - DNA, 148 bp, Chlorella protothecoides
catgccggcagcatgagcgtggcttgagcgaagtgatgggaggccagaacctcttcaaagaggagcacatgcccaacatatactcattcaagggtttcaggccgttacaccctccaatgtggagctcgtccatctagcatgatgctgt

SEQ ID NO: 29777 - DNA, 118 bp, Chlorella protothecoides
tgttgccacctccagctgcatgtcgtacagtattaagaaaggaatatacccaagatatgcggtatcattattgctgacctgaagtgcatgagcagaggcatgccaggggagttatgcg

SEQ ID NO: 29778 - DNA, 77 bp, Chlorella protothecoides
tcgatttgcatctgccccttcactaatagcagcaactcaagtatcataattatgcggcatcaagtctgaaggattat

SEQ ID NO: 29779 - DNA, 69 bp, Chlorella protothecoides
ctcccgcaacctcactctgctttcagctgtgcagcctgcgcctccagagcagcccgctcccgctcctgg

SEQ ID NO: 29780 - DNA, 75 bp, Chlorella protothecoides
ggcgccggctgccttcccgctgaggggggccgcagcatcgcggagccgggggggtgaggccacgggggccgccgc

SEQ ID NO: 29781 - DNA, 163 bp, Chlorella protothecoides
agggggaggggtaccatgaagatagtgattttagcttttaagctggggagcaaggctccacatgcacatagtagggacaccccccgtacacacacacacacagaggcgcacttgaggaaattagtggcagcctttgggcactcgtccacgaagacatcgatga

SEQ ID NO: 29782 - DNA, 9085 bp, Chlorella protothecoides
  modified_base (1068)..(1077): a, c, t, g, unknown or other
  modified_base (1541)..(1550): a, c, t, g, unknown or other
  modified_base (1776)..(1785): a, c, t, g, unknown or other
  modified_base (2621)..(2630): a, c, t, g, unknown or other
  modified_base (2952)..(2961): a, c, t, g, unknown or other
  modified_base (3476)..(3485): a, c, t, g, unknown or other
  modified_base (5179)..(5188): a, c, t, g, unknown or other
  modified_base (5699)..(5708): a, c, t, g, unknown or other
  modified_base (5975)..(5984): a, c, t, g, unknown or other
  modified_base (6593)..(6602): a, c, t, g, unknown or other
  modified_base (6779)..(6788): a, c, t, g, unknown or other
  modified_base (6857)..(6866): a, c, t, g, unknown or other
  modified_base (8018)..(8027): a, c, t, g, unknown or other
  modified_base (8335)..(8344): a, c, t, g, unknown or other
  modified_base (8654)..(8663): a, c, t, g, unknown or other
ccacccaccctcctgcacgcgccgcgcctgcgccccggccgggtgctcctgatgaccggggacacctcctcgcggacctgggcggaggtctgggacgcgccgggccggctgcgagcccgcttcctgctggcggggccgccggccgccggcgaggaggcgggcgcgccgccgggcggccccgccaccgcctacctgtgcgaggcgcaggcctccgcgctggtgctgggacgtggcgggcgtggcgcctgcctccacgtcatcgacctcgcgtcgctgacgaggggctgcgtgctggagggccacgccaagaccctggggcccgtcaccgccctgtgtctggacgaggccggaggccggctggccaccggcgacgcgaggggccatgttcacctctggacctgaccttggagggtcccgtgctcgagccctgcacccttcaggcccaatctgtagatcacagtggagcaggcgcctgctgggcagctgatgcagggaggttggaggggccagcgatgcaggcagggcagcccattgcatgccagggggaagggggggagcagcaaagcgtggagctgcagggagccagggcccccggctcgaaagagaaatggcttacaagggaggacagcgccagtacacccagggtcagaggaccgagggcctctccagcgagctgaccagggcgccgggctgcgcggcaaacagctccgccagccgcctgcggccgtgcgcccctcggtcggtgatcagcttcagctccgccagggagatgagcttgatgttgaccagcctcacatccgtcagcggcatgttggggatgaaggcagggatgcctattgggtgtgtcatcgaggggaaggggggttttgggggcgaggaggttcctgtcgaagaagagcgggcggcgctgcgtccccggaaacacaaagcagcccttccagcctgctcctgcacgcgatgaacaggtgtcgcccacctaagggcgattccctgccccatgaccacccggccccaccctcgcagcgcacccatgctggggtcgtggaggccgagcagcgcccccacgcnnnnnnnnnngagggcgattccccgccccatgaccacccgaccccaccctcgcagcgcacccatgctgtggtcgtggaggccgagcagcgcccccacgcgccccgcgcggttgacgtgggccccgcgcgccgcctcaggcaccgcctcggccacgccctcggcctctgtggacagcagctccatgtcatcgatgatggagcggatggagccgtgccccgccgccagctggctcaccgtgaacagcaactggaactgccagctggccttcacgtccgcgggggaggtgcccagctccgaggcgggggtctcgatgaagaactccagggagtagccgttcacgttgccaccacctgtcatgagggggggagagcccgaagggcgggctacatcaagcgcctgccggtggaatcttagtggcagggcggatgctgttcaggatcaccaccgccatccacccgtcggcccacagcccnnnnnnnnnngagcgcctgccggtgggatctgagtggcagggcggatgctgttcaggatcatcaccgccatccacccgtcggcccacagcccgcagctcactctcttgcacgtcgtcaaaggggtccgacaggccgtcgctgaccaggaggacggagccgttggggcgatggatcagccggaagctttgctgaagggctggccacttgggacccgtggcagctgctgcagagaggnnnnnnnnnntcgagggtgcccagactgctccatagcttctccctggcggccgagctctgctctaccaggtcctccactgcaggaaagtcgtggttgagacatcaaccccagctccccttctcccatgggctagccccccgggggctccccgccctggtcacaggctagcactagtcccgggagcattctggggtcacaagggttcggcgagggagtgagggaaggggcatgcggagagtctccgcacctgatacgcccgaccgtgggttgaatagatttaggggctgcaagtactggtccccattgggctcattcccgttggtgcagcaccggaagaagctgacaaatcgattgacagctttcatctctggctggggttcatctgcgtgccatccagcgtgaatgccaaccctctggccctcgagtgccccggccacaagatcggtgaccaccgcgtgagggagctggtgcagtcaccctctactcgacacaatgatgccgcctctcaacgataatgtgcgtctggaagtagagttggcgcctctgtttgtcgccaagagtctttgacgaggcgttgaatctcttgcaggcatcacacgtggaggggtcgagatctccatgcgacgccacagtataaaaaggcaagtccacagtggatgcggcagtgtcccgtcggtgttgcagagcataaagcacttcaatccatagatacaaggaaatgaggcgcattgctctcatcggtctcttgaccttattggcaggagcctatgggcaggaagagaagcctgggtccgccgttgtcctgagtaaggctctctgtgagctcgcgactgatatgattctgnnnnnnnnnnacaggagcctatgggcaggaggagaagcctggatccgccgttgtcctgagtaaggccctctgtgagctcgcgactgatatgattctgctatacatttatcctggttgcccaattatcgcttctacgttacacttgcagcccccgagaactttgatcaagttgtgaatggtggcaagcacgtcctcgtcaagttctacgctccctggtgagctggcatacaattcgaccgttgatctacagttttaatcgggctaggggtagatcaggccgtgctgcgccctcgcatccccgtctcgaacttctccgccagcccttggtgctnnnnnnnnnnggaatcgggctagggggagatcaggccgtgctgcgccctcgcatctccctctcgaacttctccgccagcccttggtgctcgatcaccagatgtgcccatgtgcaggcatgggtaatggggcgagcctcagccactcaacaccactgttttatcatgcccatgttgatgtacctgtccataggtgcggtcactgcaagcgtctggcccccatctgggaggaactggctgacgcggctgctgcagacccccgcctcagaggacgggtcgtggttgccaaggtcgatgcggatgcacatcggtcacttggcgaccgctacggcatcaagggcttccccaccatcaagttctttggtagggggaaacccacagccgctcctgcagagtaagaaggtgtcgggtgggaaggcgggggcggcttctgtctagtgaagtcaatgacgcttaaattcaatgtcgtatcacctcaatgaggctaattttggggaagcagttttccagagggatgccgtcatggnnnnnnnnnngacgcttaacctcaatgttgtatcacctcaatggggctaattttgggaaagcagttttccagagggatgccgtcatgggcaccacccatcaaactcaatacgtggcgccatgctatcctgtgaccggcctccatgtgcccaggatcgaccaccacccctctcctgccctgtctctccctgcagctactctggtggacgcaccctggaggcgttttctaccttcctgactgagaaggtgcagtcggatgcccatgcccgtgtcgagttgctggacacctttgcctccaagttcttggggagtgccgatcaggccggactcctggcccagacagaggaggcggtgctgactctgacaggtggggaggctcgtttactgtggtgtagggcaagacctgcttgagtggaggtgtatgaggggttgttttgcaggagcacgatggaactcaccccagtggcatctgcatgctcatcaaccttcccctccccatgtcactgcaccgctgcaggtgaggctcaggccaacggtgccctgtacgtgcgctacatgaagaaggccatggagaagggcgcggcctgggtggacacggagctggctcgcctggagaaactgacctcgggagcaagcgcatccggtgccaaggtgcaagagcgctctgtgtggggaagggtgaggggattcgcctgtgatgcatggcggcgctcttgctgtgaagacggcgttcacatgctcgagacgcctcaaagtgaggatgagagggaagggctccgcctttgctcgagtctggattgacgagccgtggtgcgaatctcttctcacacatttcacttcacagctgaccgagattgggaagaagctcagcgtcctgtctgcgttcaacaaggagaagctcagctctgagtagggtgcaacattctccatgccgggcgcaagaagttcacaatttgtcgactggccctctgtggggatatactcttgatgattggctgtgatatctttggaaggcatgctacatgcccctccagggatcgagagttaatcacttagaatggggcaggcgtggcgtggtaaggtccggagtcaccaagacgatgcatattgcgcgcgatatgcgcatgggtgtgtgctcactcgacgcttgtgaccatgtccccactcgattcccacgtctccatccacgctgctccgcaattctgccgtcctcctctagaattttgttgtcgatctctgatccagctttacaaggcactgtcgctgccaacaagacgcgccgcgtcagcccccaccttcgtctcgcctcggcgagcctgagccgatgaaaggggacacaaacctggaggtgtccttcacggaccttcggttcaaggttcaactcaaggatggaagcacgctagaggtcctgaaggggatcagcggccaatgcagaccgggaagggtgctggccatcatgtgagcgagaggtttcgtggtgggtgtcagggcagaaggcaggcgcatggggcaagctactgaagggtaccagctcagtaatgattatttttacagttatagtatcctctgtgcctccatcaggggctcctccggcgcagggaagaccacactggtgggtgccggagtgggggaggggtccggtggttctaacaatcgcagtacgggcacccatcccagaaaccaccccatcatacccaccccttannnnnnnnnngctggtgggtgccggagtgggggagagggtcggtggttctatcaatcgcagtacgggcacccatctcagaaaccaccccatcatacccaccccttacaccgtggacccactttaatagctcgacatgctggccaacaacgtctacgggggcacccagacggggtcggtgtacgtgaatggagctccacgccagcgcgccgccttccagaggcagtcatgctatgtactgcaggtccggggtgtctcggccgacatgcgagggatgggacctttctgtgctccttgtgcccacggtttcttcgtggacttgccattgtggccttgtactccgacctgcgagggaacccccatccctcgcccccgctggtacagagggatgtcctgctttccagcagcacggttcgggaggccatcacgttgagcgcgctgctcaagctgccccaaaccatgacccgggaggagaagcaggcgcgcgtggatgagaccctggcagagctggtgagtgtgtggnnnnnnnnnnctgagcgcgctgctcaagctgccccaaactatgactcgggaggagaagcaagcgcgcgtggacgagaccctggcagagctggtgagtgtgtgggctgctgatgctcgaagatgatccttttgcacaagaggctgttgcgccggctgcctcctcacccttcctggccgctgattcaaatcctcagtgatccccttctattccggcctccccccctccacaccgacttcctcgcttcacccccaacacacaggagctggaggggtgtcnnnnnnnnnnggatgatgtacttgcacaagtggctgttgcgccggctgcctcctcacccttcctggccactgattcaaatcctcagtgatccccttcttttccggctcctcccctccacaccgacttcctcgctccaccccccaacacacaggagctggaggggtgtcagaacacgctcatcggcgacgacctgatcggcatcaagggcatcagcggtggccagaagcggcgcgtctcggttggcatcgagctggtgaaggagcccggcatcctcttcctggatgagcctacctcgggcctggactcggagatggccgtgtccctcatgacgctgttggtgcgcctggcgcgcaagggcaagacggtgagcgactggatgtggagagcttggttgcatggatgcaagtgtgtgaaggggaggtggggagggttgggcccagtagaatcagaccgcttttatgtaggcgtttcaaagggcgcagttggtgaagggtgatgtagagcgaaaaaatgcaagggctggccctgcccgcggcttgtaaagcgcgtttatattctcaggccatgatccgcggatgttagtgtgccaggctgctgacggtgcggcccctcatgtannnnnnnnnngaaatcagaccgctgttatgtaggcgtttcaaaggacgcagttggtgaagggggatgtagagcgaaacattgcgagggctggccctgcccgcggcttgtaaagcgcgtttgtattctcaggccatgatgcgtggatgttagtgtggcaggctgctgacggtgcggcccctcatgtannnnnnnnnnacccacgaaaccaccccgtgcactaaaccgcccccccccccaaaaaatctcctccatcctgcaggtggnnnnnnnnnncccccacaaaaccaccccgcgcactaaaccgccccctcccaaaaaatctcctccatcctgcaggtggtggtcaccatccaccagcccaactcgctgatcacgtccaaatttgacgacttcatgctcctcgccgatggccgcaccgtcttctccggcgcctggtcggacgccctgccattcttcggcgcggcggggtacccctgccccgcctacaccaacccctccgaccacttcctgagtgtgctgaaggaggagggggcgcgggataagctggtggcacagcacgaggccctggccgccaaggacctcgagacgggggatggcaatctcaccacgctgcccgaggcgctggcggtggaggggcgcagccgcagcatgctggagcaggaaggggcggcgcaggagtcccgccccgacgcccccttcatgaggcaggtggcgctgctgagtcagcgcatggcgcgcatgtgggtccgcaaccccgtcatgctcatgtccgagctggcgcagtacggcttccttgccgtgttcatgggtgagttggggttgagaggagtttaattggtgtgatgagcgtctgcgatcaagctgggggggctggcagcctctcgccacacggccaaggccatcaagtgctgcaccccatcagattttatgcctgatcagctgagacacctccccctcccttcaaaggcctcatgtacctgaggctgaaccactccacaactacgggcctgtccgaccggctggcctccctctggttcggcctggccatcctttccttcacaccctcctacaccgccgtcaccatctgggacaaggaccgcttgctgctccgccgcgagtcccagcagggcatgtactcggtgaggcagatgggcgcgggtgggagcggagggctgccgggcaaggcgggaccttggcacgggaggccagtccgtgcagaagcatgtgccagcccaagactcggaacctgtgccgccgacgacgcagatcccggcgtggttcctggcgaggacgctgaccgtgacccccatgcagattgcccaggtgtgggtcagggggttgtgaacgaggggtgctgcatcctgcaggtccttcaaatctggatgtctgatgtggaggaacctgcagctggaatgtttggggacnnnnnnnnnntcccatgcagattgcccaggtgcgggtcaggggggtgtgaacgagggggtgctgcatcctgcagggccttcaaatctggatgtctgatgtagaggaacctgcagctggaatgtttggggacaagctgccatgtgccaggactttctctactggactgtgtagtaaggagcgtcggccaattatttggaagccattgtcaaacctctccaccacccacgtcctcacacgcctacagaccacgctcttctgctgcatctcttactggatggtgagttgcagggtcgtggcctgggcaaacttgctgtcgnnnnnnnnnngcgtcctcacacgcccacagaccacgctcttctgctgcatctcctactggatggtgagttggagggtcgtggcctgggcaaacttgctgtcgcagggtgcaaatctggccagggtttccgtgtggccgactggggggttgacacacctgcaaaacagcttgagacattctccccaagcatccagttcctgctcccaggacttccctccccaccccgtgctgtttcaaagcgcccaacctgtgccgctccaaacatgccagcccactacccgccccgtcacattcccctgcgccagattgggtacattggnnnnnnnnnntctgcaaaacagcttgagacagtctccccaagcattcagtccctgctcccgggacgtccctccccaccccgtgctgtttcaaagcgcccaacatgtgccgctccaaacacgccagcccccactacccgccccatcccattcccctgcgccagattgggtacattggccgcccagggtccttcttcgtctacgtcctggtgtacaatctgttccagctggtcagcgagaccatcggcatgctgtgcgccatgctcacaaagaacagcacctacgccatcctggtgaggctgaagggtagggagggaaggagggccggactttcaccttccagcctgggtttgacactgttcgcctgatcctgtgtgcgggtgctcgcctctctattttacacgtatctacacgcaactagacacagctcgccc

SEQ ID NO: 29783 - DNA, 209 bp, Chlorella protothecoides
gcgtcgacaggaggcagcccctgcactctctcatcagccacccacattcgatgtgcattagaccactgacccttccaacccgcaccgcactgcatgcagggagggcgggggtgcagctcgtgcacgtgcggcgaggggagagtgtcggggaggtgctggtgcacccgggctacgacccggccaccatgatccagaggtggggcgtcggg

SEQ ID NO: 29784 - DNA, 79 bp, Chlorella protothecoides
ccttgccactggacagacgtcggcagatacgattccacggtgcaagacgcaggaaacattggtggcgtttgacaatttg

SEQ ID NO: 29785 - DNA, 61 bp, Chlorella protothecoides
ctttgagaaatgcagttgtcactcgagggaccggccggtggagaggtctggcaatgcaagg

SEQ ID NO: 29786 - DNA, 78 bp, Chlorella protothecoides
atttctgtgcatcctggcctgacactgctgtggaaagcttgccagacaattcacagttcatcctcctggacccccacc

SEQ ID NO: 29787 - DNA, 117 bp, Chlorella protothecoides
cacgaagcgtacagccggcaggtaagggatatcccttaatttgcaataataggtgcgaaggcacgccagcagacgcctgcttcggggtccttggccctcaccagagcataacaaatg

SEQ ID NO: 29788 - DNA, 72 bp, Chlorella protothecoides
ggccttgaccagcgctctgctgcgtgccgggccgatgctgagtgcgtttttttcgcctggcctagatggagg

SEQ ID NO: 29789 - DNA, 101 bp, Chlorella protothecoides
ggaagagggtggagaagagtcagctctgagtgccaaagaccaacccgaccggagcccatgcccaagctgctgcacccccacccagggtcctcaccatcctt

SEQ ID NO: 29790 - DNA, 167 bp, Chlorella protothecoides
cgtgcgcagcaggccccgcgcgtagtcgatacccttgggcttcctgcagcggtggtccgcacatgcattgagagtgagggacggaaggaggggtcccgaggataggcatgcgcagggcgtgctggcagcggcaggcggaggacaatgtgcggcaagcacccatgtgc

SEQ ID NO: 29791 - DNA, 80 bp, Chlorella protothecoides
cgagggagggcaggatgaggagtcccggttgacagaagaaagggacctggggggccgtgtgccagcatgacaccggcgcc

SEQ ID NO: 29792 - DNA, 62 bp, Chlorella protothecoides
ggggccgtgtgccagcatgacaccggcgccctaacttcgggctctgatatgggtgtccgcgc

SEQ ID NO: 29793 - DNA, 79 bp, Chlorella protothecoides
atcgttgaggaaggtgcttgcaagtgccctgggcaagggttcggcgccgtgctcactcggggcctctcggtggctcgcg

SEQ ID NO: 29794 - DNA, 110 bp, Chlorella protothecoides
gggcacccactgcacgagcaaggccacccagtcctcgaagagagactggtagcttcgggggccccacggcggggagttctgtccctggaaccaggagatcccggccttgc

SEQ ID NO: 29795 - DNA, 72 bp, Chlorella protothecoides
tatcgataggatccagtctccgtagctcagaagcggatcacagcgggggtcgccatgtcgtcgccaccgccc

SEQ ID NO: 29796 - DNA, 61 bp, Chlorella protothecoides
gagcgacggtgccctgcgagcacggtggggggggattgcatgaggtgctggggaggggcat

SEQ ID NO: 29797 - DNA, 149 bp, Chlorella protothecoides
cgcctagaatcgtgctgccagacagtaggggctgccatgcactatcaacaatcgtcatcctctctcaagactcgccctcggtctccagacccagccattgtacagcaaacactgccccccgggacgcactggatatcctgaggaagagg

SEQ ID NO: 29798 - DNA, 161 bp, Chlorella protothecoides
aaggtggtggcgacggtgggagacggtggtcgaggtgggatggtggtggatccagactcggtcacagtcgatgtatcaccacaacagatgcagcaaagaccaaaccacaagcaatgtgcatagcccagcaacacacctgacggcaagagacgcgctggggc

SEQ ID NO: 29799 - DNA, 115 bp, Chlorella protothecoides
ggtgggggtgggggggcggcggggcggtgtcatccggtcggttgagaaaaacatggtgggggccagggtcagaccgtcgtgggcaggtcgggcagacgagagcagcgcaaccagg

SEQ ID NO: 29800 - DNA, 61 bp, Chlorella protothecoides
ggcacatcctcgccctctcacctccacggtccaggctgctgagggagctggtggcagctca

SEQ ID NO: 29801 - DNA, 68 bp, Chlorella protothecoides
cgaggaggatgcccttcgaccctgcaaacatgacacgcctcccactgtcactgccagttgaggcccct

SEQ ID NO: 29802 - DNA, 61 bp, Chlorella protothecoides
cgtggacttcaactaccccgcccgccccgacgtccccgtgctgcacggcttcagcctggag

SEQ ID NO: 29803 - DNA, 77 bp, Chlorella protothecoides
ttggttggaaaggatggccattcgtgaggcaaaaccaccacaccaattccgactactaaacagcaatagttgttgtg

SEQ ID NO: 29804 - DNA, 217 bp, Chlorella protothecoides
ctgcacctgcttgacgaatggggagggtggcggtgggaaggatggttttgggaggggtggaggaaaacggggttggggggttggggggttgggtcgagccgccaccaggcacgtcccaccgagactgtgtctggccgaggacccctcatcgaagcaggctcagcgcgcgcgcccgaccaacaaccaacccccctcgccgcgcctgcaggaagccggc

SEQ ID NO: 29805 - DNA, 153 bp, Chlorella protothecoides
gggaagggggggggggggggctgagggctgggtgcatggggggtggtgggcgcatgccaggcaaaattccagggcggcgaccgagggaactggcagcgtccgtccctggactctggacaccggcagcatgccacttgggagcgtgcccatgac

SEQ ID NO: 29806 - DNA, 593 bp, Chlorella protothecoides
  modified_base (227)..(455): a, c, t, g, unknown or other
ctgacagaagctgcaccgcttgtgatcttcgcttggaaggtcgcgaccagctcccaggagcggcacgtcaaccgcagagcatgccgtgtttgatcccatctcgaaagggagagtgtcaagaggcgacagactgctccagcaggcagatgaaagccaggatgacctttacattgctgtgagtaccattttttggttgacatctaggcaagaatctaggcgagcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtaggtccggcctacccggggccctcgcatggccatccgacgaaaatttgcatctcattccttgcatcacatgcgtcggctcagtttgcgccagactaggcggttggcattgtcccgggatgaccgcactgggtct

SEQ ID NO: 29807 - DNA, 61 bp, Chlorella protothecoides
tacagtccagcctctgaattttgaatccccacctccacaacagtttgctgtgggcttatgc

SEQ ID NO: 29808 - DNA, 75 bp, Chlorella protothecoides
ggccccaggaccccagaatgcaggccccgctcgcctcattgcgttgacatttccgcttgcacacacacacacaca

SEQ ID NO: 29809 - DNA, 9481 bp, Chlorella protothecoides
  modified_base (502)..(511): a, c, t, g, unknown or other
  modified_base (1052)..(1061): a, c, t, g, unknown or other
  modified_base (5269)..(5278): a, c, t, g, unknown or other
  modified_base (6204)..(6213): a, c, t, g, unknown or other
  modified_base (6560)..(6569): a, c, t, g, unknown or other
  modified_base (7355)..(7364): a, c, t, g, unknown or other
  modified_base (8336)..(8345): a, c, t, g, unknown or other
gaggagcaggtggggcgagcgctcggccgggaagccgtggagcgattcaaggtgtcttgcagcaggcaggggcggccatgggcccagcaccgaccatgcaaccccggccccacccgcctgcaaggcagcacacccaccgtgggcgcgcgcagcagggcaccagcctcgctgggtggcactccgctgggtcccggccagtccagcacctctggttcgggcgggggtggggccaccgcagcttgccccagagcggggaactcctcggcgggcgcggggaccggggactgcaccaccagcttgcagtgtggcaggcccgaggcagccccgtcgtcctgcgtcagcgcaaagaggtgcacctccagcgcctgaggcgcggtggcgggggcgggcgcgggcacgccgctccccgcctgccacgccgaggaccctcccttgtccgggctctcctcccgtcgcagctcccgcgaccataccggctgcagcgtgcactcccgcctgagcnnnnnnnnnncggaccctccctggtccgggctctcctccagtcgcagcccccgcgaccacaccggctgcagcgtgcactcccgcctgagcctgcgtgccacctcctccacttcccggccggagaagggcgcgggcaggaccagctggcgcatgccatccagcgtggagagcttgagttgcggggcagcgtgcccgtggccctctggctgcattggcagctggcaccgagccccagtcaggctcaccgccccgcaccgccgccggtcccggttccacgtggcttcgaactcggccgcaagctcggcacgcaggcgcggcctgcaggggcccctggccccggcatcgtacgccctcagtcccgcctgtgcaggggcggggttgatgtcagaggaggaaacgatgctgattgtgatgatgatgatgatgaggttacggtgacggttcccagggaggggagcgaagctgccacgggagttgcgcggccttgatacgcgcagcgtcccccgcctctccagcgccgacccggacacaggggcggggcggagggggcnnnnnnnnnngcggggctggtgtcagaggagggcacgatgctgattgtgatgatgatgatgacgagagtacggtgacggttcccgggaggggagcgaagctgtcacgggagttgcgcagccttgatacgcgcagcgtcccccacctccccagcgccaacccggacacaggggcggggcggagggggccacaaacacacacaccagctcagccccctcaccatggaagctgcggagaaggcggcctcatccacgaggccctcgcccatctcgcgcaggaagagctcccgggcgcgtcgcgccgcccggccgcagtgtgcagcggagaactgggcggcgggatagtggcacgccgccagccactgcgccgcctggaccacgggcttcgggccgcgcccctccggcggctgggcgtccagcagggcctccagcagcgccgacaggccgtcgtgtgttgctggcccgggttcctgggagtccgacccgaggccctcggcacaggccgccacgacgtggcgcaggacgtcttcggccagcgcccgggggtcttcttccctgtctttgcggtccaatgccattgccaccctttccagggcaggcacgtgcagggcaggcaccgtgaggaccagggctggagctgcgcctggcgccctggcgccggcgggagtgcatgatccgaggcgcaggagcgacctggcggcctcggcgcagcgcagagtcccgcagacccgcagcgcgctccccagcgccgaggagtgggcgtcggagggcgtggcgcgacgcgtgtcacgtgctgctgctccctgctgctgcaggagcacgagtagggccgggcgcgtcgcgcctgggaccagctcggggaggctgggcgccagcgcgagcttggcgccctggagcacgcgcagcgtgctcagcaggcgcacgacccaggaggagccccgggcaacccacaccaggccctggcagcgcaggcacaggagcagcaggctgcactggcgggccgcctcctcgacccgcaccgcttccaggctgctggatgcgtcgtgatcggcgcgcagggggatgcagtaggcgtggacgttcttgctgtagtggtgggactccaggacgtggggcagcgtggcgctgggtgagggggggctgtctgccaggagacagaaggccgcctcgacatcttgggggtcatcgcctgggaggggccacgggtggagaacgtgtgtcgcagcggccgacatcgagtcatgctagcaatctaactacagtcagctatgtaagatcgtgtgtgcatcgccagactgacccgcgaatacgacgtggagagtcttcggaggcacaacgatggtcatggccgcctgctggtgggtccgcaggccgatcacagaccgcctgcactcccagccatgacccctatggtcgacatgtgactgcagatttgtgggtttgattgttcttgcacagtcagcgatgcgcatgggtgcatccctgtccttgaactcgacgccagctgctgcacagcaaatcgtcctggcctgtcggggcgggcgcgcgaaccgatgcaagggatctgggatgcatgcattcccagaggggtcccgagcgtgccatgcaacttcgccctcacatagagagtcaggtctgtcatagatccgaggtagcacagcggtgccccccgaacaacctccagggatctccgtgccaccccctccacccaccatgtccaagatcatcgacacgctcaacgcctacatcgagcgaggccagcccttctactcctttgagtttttcccacccaagaccgatgagggggtgcgaaacctgcaggagcgccagcgccggatggtgaaactgggccccgccttctgtgacatcacctggggagctgggggctccactgctgatgtcaccctggaggttgcaggggccatgcagcaggaggtgagtacttggaggcttgcatccgtttcccggggctgggtcggcccctgtgctggtggacgagacaggaccagggacagacctgatcaattgctgtgctgacaaggcctggaggctacctgccgctcacctgcagatcggcatgaacaccatgatgcacctgacctgcaccaacatgtcgatcgagaagctgcacgagagtctggagaaggtgtgattggtacacatgggtccagctgcccgctgtgttctagcgaggaggggtgtcgagccgctggcatgccctgctcccatcttctggtctcgcttctcatgtatctgagcccaatgcagatccaccagtgcctgattccaggcagtcacccacccagccatgccactcctggtctcctcctgcaggccaagtctatgggcattcgcaacatcctggccctgcgaggcgacccgcccaagggcgagacgagcttcactgctgtggatggcggttttgcatgtgccctcgacctcgtcaagtacatcaggtgcggagcaggggagtgctctgtgttgtgcagacatgcattttgtaaggggggaaggggaccgcctgtggctggctgctcatcacctgtggaaactctgggaactggcatcccttgcaaaccccaggtccagacacacaatctgcatcttgctccctggtgtcgcttggtctggcccctgcggtccatgccccggcctgcacccgcgcaccaaacgcgctgcgcttgcacccccccggtccaccctgccctcgtcagacccacctctcactcctccacaggcaggagtatggcgattactttggcatctgcgtgagcggttaccccgagacccaccccgacctcatcgtggacgatcccgtggccatggaggccaactaccggagcgacctggcctacctcaaggccaaggtggaggccggcgccgacttcatcatcacccagctcttctatgatgtcgactgcttcctcgccttcgtgcgtgactgccgcgtcgagggcatcgccgtgcccatcctgcctggcctcatgccgctcatgacctatggcggcttcaagcgcatgaccgccttctgcaagacgcgggtgcccgcccacatcgcggccaccgtggaggcgctgaaggacaacgacgaggcgatcaaggtgggtgggcgggtggagcgagctgcagtgaggaatgtggagtcgtgtttgagggaggggctctaaccccaccccatcacccccaacagctcccatgcgccccaccgcccgattcacctcccgcctctccaccgccctcctcacccgcacaggcctacggcatctccctcggcacgctcatggcgcagcggctgctggacgccggcgcgcccggcatccacatgtacaccctgaatctggagaagtcggcggtgggcatactgcagcacgtgggcctcgtcaaggtcgagcccgaggcggaggaggcggaggagccgcagcgcctggcggccaccgcttgaggaaaagggccacgccgtgcacgctgagctggccgaacctgcaggcccgggcccgcattttaggagcctggtcggcccccccttgcagcaccccttgccccttgttgccctggtgtcggtacttgagcatcggcgggcgcaggtgtcaggggaggggacagcgcgcgaggcggtgcaagggcgcgggtggaggtctgggaggaatggtgtgggcatgacaagggggagcgcagcggagggcctgcagggagcagcgcagcagtcgctcgcgcgtcggggggacgtacgtcatgcctctgggcggggccagtgcatgctctggagggggcacaaccaggcgcccccgcctccatccgcctctgtcagtcgtcgtagcccaggatgtgctgcttgaccagggctgaaaacccaaaggccttgaagcggtcctgccccgtcagcgcgcgcagcgtggcgtcggacaccacaaactgcttgttggcggggtcctgcaggccgtgctccttcacgtaggcccacatgtgcttggcgatggccgggcgcgaggcggtgccggcgcccacccaggccgccatggcgggggacaggcgcaggggcttggtgaagccgttgacccgcttctcgcccggcgtcgccgtgcggcctggatcggaccgcgccctgacgcgccgcggcgttgccttcgacgaacccgctcctgcgtcgtcgtcgtcgtcatcgtcgtcggaggcctccaccccgggcgcatcctctacgaagcagtgccggctgaggtgcnnnnnnnnnngcccgctcctgcgtcgtcgtcgtcgtcgtcgtcggaggcctccaccccgggtgcgtcctctacgaagcagtgccggctgaggtgcttgttcatcttgaacatgtccgtcgacttgccggggaagatggtggacagcgcgtcgtccagcaggatgcggcgccggtccttggggtcctgcaggtcgtgctccttgatgtaggcccacagccgcttcaccacctgcggccggggcaggctggtctcgcccaggaaggcctgcatggcgggggaaagcgcgcagcccagccccgcgccggagttgcgggccctcttactcctggcaggaaagcgccaggggtagggggaaagggggtgatcatgggtctgagagatagagggaagggaagaagggggctgggcccaaggcagtgggggcacacatcaggctgtggcaatgcagaaggaacgcacagtttccaaccaacgcctggggtgtgggtggtgcacagtgtcggagaggcgcggccgggagacgactgtgctgcatgctgcgactacctcggccgcccagcaaacccttaagaagccgccacccatgggctcaccgggcagtgggctcctcgtccgcttcgctccccgggggggccggctgtgatgacaggtacgcctccacctgcgatgagtcagggggtgggattatatggtcagcaggcttccgctggattcccacgcgcagcacccagccagcctctcgcagcgcatgggctcccgcagtgccagggttcctgccaccacccacttctgcacgcaggagggcctttttgctagagaggtccgtcgaaaattcctgctcgagtcttcgccgcagcatcttttctgcaaaggggatgctaaaggaaagcggtgagcgccccgaccatgccagtgatgacggtgcacccccacgnnnnnnnnnnatgaaggagtgcggtgagcgccccggccatgccagtgatgacggtgcacccccacgctcaagcgtctcgttcgcaaggactggcccacctgtggtggactgcaagtccacctcagtcagcagttcctggaggcggtatgtgatctcctcgtctgtggggagctgggacggggggacatccacctgcgtgccccccccatcctgagaggctttcggcatgctgccaggctcgtctggtgcgccagaagcatctgcaggggactccaaaggctccgaggagcattccacgtgtggctcaggcaccttcaccggcgtactcgagggctgcggtggctgagcatcggacannnnnnnnnngctccaaaggctccgaggagcattttacgtgtggctcaggcaccttcaccggcgtattcgagggctgcggtggctgagcatcggacacgcaagggggagcattggtctccccgggtgtcggtgaggatgcttgctcgtccggacttcgggcctcgacggcttccctctttacgccgctaggttcttgctgagattgggaaatgtatctttgggtcggagcctctgcatctacggccagtctctgagattcgttggcagcagtggtgggtgcagttgcctgggccacagcagattcccgtagtggtgagccatccatctcctgcatccacttattgacaggatttttgagaaggcaatggtaatcccatccgctacaactgtcccgggagcttaatcgtgttttatcgttcgggtacccgtgtctcgtggactgaatcccttgtcgcgcgcgagagatacccagggtcgaaggaggaatcacaccaccgaggtattgcattccgtcacgaggcttgttcgacattgaaatagctttcgtaagccttcaaactcatctctgctgtaaccaaacaacaaattgattctttgtctgtgcgcacgactgctgcgagaatccgaagtgctgcaggatcttgcgatggagagaagatcccttcggagtctgggagatgcatccgacatggcgaaccggaaatcatcacaataattccaaagaaaggttcttcagtagtcattgccgggccagagaatccagacgctcaccagcgcacttccggtgagggcgtnnnnnnnnnnattgagtagtcatcgccaggccagagtctccaggcgctcaccagcgcacttccggtgagggcgtggtgtgcccggtgcgccttctgtttttggtagatcggggcgtacgaaggcactccggcagcacaatctgcacatgatagtccaattgacaggttttggtgccatgcgcggggtttgtggctgtggcttggtggccttgattgtcgtgccctccaagttttctgccagtgggatgcacccatcctgggtcgggcctgttatccacccccttcatccccgatccggaaagcaggcgtccttcttacggcgaggaccgtcttgtggccactagcctggtgctgagtccctgcagggagccgcaccgggacatctgcagcagaaaccagataccgtgcgggtgctggcgacgggcacatcaagagtcgccaagagccaaattcgcttcctatagcgttgaaaaggtaattgaaggccatggctgatgaccgactgcatacttattgccccggcatggggccgtgccgcgattcgtgttgttagggccgggtcttccgctgataggtgtccgtctgagatggctgacattacccaacactttcacctgcaggcaaacgagcgcgcccctcggcgggatgccgctcctgtgtcccatctccacactgataccaccgtcctacttggacagtggcactggggaggccgaggtccgcgcttacaagctgggcaaacggcgatggtcttacaaccaggtagggacaggcgctggcgggcgagtattgctttcttgatggggttgtttccctgccggggatgcctttttgactgcggtggtaggggaaagatgctcccagctgaatgccaggatcgtgtgaacagggcatggactgcttgcatgattgggtcatatcctgcggcactcgcaatcttgggaactctgtaccccaccctccgggttccttacagctctcnnnnnnnnnntagggcatggactgcttgcatgattggggcgtatcctgcggcactcgcaaccttcgggactctgcaccccaccctccgggttccttacagctctctacaccagtgcatccccctgtcagagcatcccagacctgccctccacaggtggaggtgatcgtccgtgaagctgggggttcccgtgtcctgaccgtgaccaacgccaccaatcagggcaccgacaactttaacgaggagtaccgcgagtcggcggtgaactacctcctggagctgagcaaccagagcagggttgtgctccacggcttcctgtgctacgacgccggggaggggggcaccccgctcctcggcccgccgcacacgctctcgcccgaccagtggcaccagtggtgagcgggcatgctacaggatgggacatcgaagggatgggaagggagagtgcgcatgtcgtcgttctcaagcgcatcagggtgcactgtcgtggaaggtgggcggcccccggccccagctcttgcagcctgcccccagtcctgcctgggcatgcatgggattgtgggatcgcggcctggcgatgccaggaccctcccctgcggcctctatgccggaacacacacctttcccccttcccttcacccccttcccccacccctccacccaggtacctcgtccagcgctccgcctgctgcaagggctgcaccggccctgtcatccgcgtgatccagcgctttggcaagctgggcaagcgggcatggggcccgcaggagggctccccctcgcgcgcgcccgccgcgcgccccgcccacggcgcaggcaacctgaaggacccgcgcttcctgtacctgtcctttgacgaggcggggacgcacgtgggcgccaagaccttccgcctggtctgcgcgctctacgactccgacggctgccaggtgctggccaacgccgcctcgccgcccatccgcgtgctggccaacaacgacgtgcccaccggcgcggcccacctccgcctcgagctggaggtggacggctcctgggagggctggtcccccgcggggacgggcgagatcctgcgccccgcgccccgtcccctgggcctggccgtggacgctccggaggcctggcggggcggcgcggcggaggcgggccgc

SEQ ID NO: 29810 - DNA, 111 bp, Chlorella protothecoides
ctaccgccgcgaccgcgtccgcatcttccataataatgagggtagcgtggtccgcgtgccacgcctggggtgaggcacccctgcaggcctcgaccgatgatcctccccgca

SEQ ID NO: 29811 - DNA, 124 bp, Chlorella protothecoides
cagcaggcccgcccactgcgccgggctgggcgagtttggccaatgccgtggccgtggtacgagcggcacgatgcgcaggtgatcagatcccgtcgtggacggttggcgtcgtcagggctgcctc

SEQ ID NO: 29812 - DNA, 67 bp, Chlorella protothecoides
acacacacacacacacacacacacatacgcgttatgaacacaaaaccacatctgcaaccacaacact

SEQ ID NO: 29813 - DNA, 740 bp, Chlorella protothecoides
gctgtggcgccagccggcgcagacggagcgaatcacgcccacgcggtcctggcagttttttgtatgccgaaacgtctacacatcgtgtatcgatacaagcccatcatcagcccgcccagccattgcgaaagcaagcgtgggcgggttagaattgtcacatcggagaatcggtcgagactccatccgatgcaacgcaacactgatcggacccaggggcgacggatccagggagaatgttgccactccatccccgggtcgacatcgcgccgaggcccagtgtctctcatccaaagggttggtactgagacgacttgcttgtcaaatacaacaagtaagtcgtccgtccccaggcgaaggaagggcggcgcagtgatacatgctggcgtccagatcaaaccgctagaatcgacttcacaaaccaagcagagtcgtcaaacaccagggatcccagtaataggccctgccaggaaactgaacaacagattgcagtttgttggcaatcaactcatcagtcccaggcagcgccccctaccgaccccatcgacgacattgctctgatcagccgaccgtcgcagcagcaacctgtgcgcccgcaaatcactactcctcctctccttacaatgatgccagcccgggggaagcggagcagaaaccggcgggaggggtgagtgttctgatctgcggatgcgacctagcttccgcgcagcgcaagtcggcctgggaaggcgaatgttcaccgg

SEQ ID NO: 29814 - DNA, 10703 bp, Chlorella protothecoides
  modified_base (5242)..(5292): a, c, t, g, unknown or other
  modified_base (7939)..(8093): a, c, t, g, unknown or other
  modified_base (10077)..(10220): a, c, t, g, unknown or other
cctccccccccccccttcccccccagatgtgtatgacatgggccaggctccctccgtcaaggaggcccaggtggtggccgacgagatcttcagcgactttgtgtcgcaggaggtggacaaggtggagatcatctacaccaagttcgtgtcgctcatcgcctctggtgcgtccctgggggcatggcgcgacgcgcaggctctgcgcctggggggctgatcgaccggtgcggagccggcagacgccgccgcttccagtgtgcgcttgtacctttactctcctgcgccaacccctcacaccccctctccccctcatgcccctgcagagcctgtggtccagacgctgctcccgctgtcccccatcggcgaggtatgcgacgtggatggcaactgcgtggacgccgcggaggacgaggttttcaagctgaccacgcgggaggggcagctggtggtggagtctgagaagacggtgcgtaggcttgctgaggggtcggggggatgcatgggatcctaaattgggattcaggtttcccccctttgcctggaggaaacaggtgtggggttgggggccctatccaacgctccggctgattcttgctttcccaagaccatccgtatcaccattgccctcaaggaagctccaagcctcctcatgtccactcccctccagccccccaaccctcccctcctccccaaataaaccctcgcaggccaagacggaccctagcgactttgaggccggcctcatcttcgagcaggacccggtgcagatcgtggacgcgctgctgccgctgtacctcaactccacgctgctgcgcagcctgcaggaggccctggcctcggagctggcggcgcgcatgaatgccatgagctccgcctcggacaacgcggcggagctgcgcaaggggctcaaccaggtgtacaaccgcaagcgtcaggccaagatcacgaccgagctgagcgagatcgtggccggcgcgagctcggtgtgaggtggtcagaggctggcgtggggcctggttggctgcccctatggggaacttgggggcactgctgggcgagtgaatgctgctgagcagagacccaaatgggtctgcagccggccggctgcatgcgtgcacaggccaggccgtcggcagcctcccctgccgccccgccgagcccccgtcactggcttttgcatcgcctggtcccattctttcctgcactccatttccgtcctttgccttgcttgagaagatgcgtaacgtcaaggacttggtacaggtgcagggagaggcacaaatgtgtggcttgggggatagaatgccgaggctgggtagcgagcagcctgattgaagctgcagggaggctgaaatccagaacgctgctctggcggcagccagagcagccccgcctccccagccagtcacatgccggggtagagcctccagatgtcctccagcttgacgggctccagggtcacggggcaggcgcccgcctcgctgacgtggcggtgcacgcaggtgtagcagaaggcgtaccccgtcggcgccagcagggccgggttcttgcgctcgcttctacacagcgggcacagcgcggcgtcgtcgggcagctggatgccgccctcggcgggggccagcggcggcgggggcggcggcggcgccagcgcggccctctcccccagcgcctgctcgcccgaggtataccaccactccagcagctgcaggggcggggtggaatgggggacaaggaccgtgagggtcggggcaggagggagcgggcggggggagagggtccgtgcgcctggcgcgctcgaggaaagcgcgtcccgaccttgtctgcggcccggctcgccatgggttgtggggccgccacggcacccatccccaatctgtcagaaaatcgcgcaaggcacgcacccaccccgcgctccccaaagcccctcccctggacagcagcgccagaccttgaaggcaaagacggcgaggatgagcgcgttgtgagtgtggtccgccaccgcgtaccccgcacgcagggcggcgccgcgcgcgaggcgcagcggccaggcgagggaggcgccccgcgcggcgcgcgcggcgcggcgcgccgccagctcccgcccccgcgcggcctgggtgcgcggatccactcgagccacggcgaggcccagcaggtggaggcccggggcgtagtgcggggagcggcccagcaggtagagcagctggtagaggaagcgggagccctcgtgcaccgccaccacgcaggggtagaccctgaggaaggcgcgcagcgccagccggcgccagccgtcggcgaggccgtctgctcccctcgcggcgggagcgggaggagcctgcaggcccagggcctgcagcgagcgcagctgcggcgcgtggcgcccgtgcaggccgtccagcttggcgcgggcgtagggcaccagggtctgtggtgccggggggggacgcaggatggggggttgcggggggaggtactttggccggacagccacccatgagcggtggatttcgcagtccaccccccggatcatgtgtccccagcgtcagaacccgcgcgcgtgaaggagccagcacaccaggagcgccagcgtggagatgcgctgctgcggggacaggccgcccgccccctcctccgcgccgcgccgcgccgcagggacgcggcgcagcgcatacagtccctcggcgaaggaggcgtcggacgccctgagcgacccccggtgcagccaggcgctgatcaggaagaagagctcgtcctcgtggtccaggagccgcagcagcgagggccggcgctgggcatagacctgaggcgtgcgggcggggaggggcgggattcagcatcgaggtgtcgaggtgtcaggaggccagaccgtcgctccgcgctgcactgcacagccgggccgtctcacaccccatacgacgcaccgatagggagtatgttatggcagccttgaggctggggaggagtctgtcggcggccaccagctcaaaaaaggtggggcgagaggaggcctcacctcccaccgtcacgaagctcatgcagcctccgctcccctacctcgacccttcaggcggccagggctgccgataatgatttcatcgcagtatacatgggattacaatatcatccacccgtcactcgttgtccgtgcgaagcctgctcgtcccggaagtgcctcaattgcgagatttccgtgacgtggcagaactccgcatggcgcgatggtgatccgtcatggacggcacttgggatctatggcacctctcctgtcagcagtacatggcgacacatgctatacgctccaatacgagtaggaacatgaagactctcgcaccttgcaaaagtctgcagcccaggactgaggccggagcaccatgcctgggcaaaggatcccctcggcctccatgccccatgagatgcaggcagaaggggtgcggcagctggagatgcaagcccattgcatgtcatgcttcatcccctcgagatgtggatgctgtgcaggagggcatgagtcgctcggtcaatcaggtatgattgctccaaagctgtcgcaccctggggtgtgcaaccctctccaggctggaatcgtcagtccaatggccaaccttttcaccaacctgcccaaaccctgtccctggcagctgtgcacggatgccctgcgggctatgcttgccggggacgaaagggcggcggagcgagaggccgccaagtgccgtgatttggctgtacgagttgccggagcggggcggcagccgtctggtcaccaggtatcaggcatggggggcagggaacgatctcatcccatcggcgacccctgcactgcgtcctgcacagcctcggagctgctcaactttccctttccgtttccttccagtaccaacagacggttgcgtttctgagcgtgctggagcagatgctgcagcacaacatgcccagcacccacgccctggatgaacagcatgcgcgctccctcgaccgcctgctgaaccaggtggggctttcactatgtatttgttttccgggtggggttgagttgtctggtggccaagactcggcggtgctggagcagggcacgcattcggcacacccgctgaaggtgcatgctgggccctcatcgagatgccatgtacagcccccctctttgggttaggcgacacatcctacacacccggcgcagatctccggttcggagtggaaagtgggggatggtgaccaggctgcccaggagccgcagttcagcacctgggaggaggccctgggcgggggcccccacccaggcgccgccgggccgcggcgcgacccccctcctggtgcctcgaggtcacagccggggaggcacaccgccctgtacaacgacctgggcgtgaccggcggtgcgacccgcgccgacatccgggccgccttccggaagggggcgctgacctggcacccggatgtgaacgccgctccggaggcccccgctcgcttcgcccgcctcgcagaggcgtacggtgggctgggcgacgccgggcgcacgcctgctcggcttgcggtggagggtggggcgtgtttcgagggggacgtcgcccgtgccgcccacactgcccccgccctccgcacccaccgcagaggtgctgtacgacgaggagctgcgcaggagctatgaccgggagggaccgcggggcgtggaggccgcaggtgggtggctcggcccggcgcttctcgaggtcgtgtttacctttttggaaacgggcggcggcctctttgcctctcatccccacctccctcccaaacacacccacccacgctccttcccgctcggctgcgtgcagtgcggagcagagcgtcgggggccggcgtaggcaccggcgaggcccgcagggcctgggacgagttcaagcccttccggaaggagaaccggcggacccaggcccgcgccgcggcggggccccggtccgggtccgaggggagcccgcccacgccatcatcaggcgccatccctgtgggcagcgtggtgcagtacgccctcagccccgcagtcctcgcgctggaggaggggcacaggagctctggcatcggcctgttggtcggcaggaacatggacaggtcagcgcggacggcggcacactcattccatacatcatgctgggtggtggggttgggtggagggctttgcttctgtccaagcaccttggatgggccgggctcgggccaggcacgaggggctgggtgggcacacagcacatcccccccccccccccccccnnnnnnnnnnnnnnnnnnnnnnnnnnnnnnnnnnnnnnnnnnnnnnnnnnnagttccccgcgagtgcacaccaacacattcaccacgtgtggtccatcctcctgccctggctgtgcaggggggatgccagcaggctgccgccggagcggctgggtctgtgtgaggtggaggccttccgccagacggaggccggcagctcctgctggtgcccggacgatctggcctcgcccgccttctgccacctggacgacctgcgccccatccccgtcgccgcctacgacgcgcgcttcgatcggtggaccatcgaggaggtgctgccagacgggtgtgcagggccggacttgccagaggaaatcatcctgtgactgactgtggagaagggtgtgccggggcgactggttggctggcccatgtagcatggactgctgcgcttgatccaacgtcgaaatctcgcagccaagtccccaggcacagtgtggggagtgggtggcatggccggtgccggacggccctgggcacggcacagtgcacggcggctgatggggccgaggggtaaaggactcagtgggttggccccacaacaacttcgtgcctgttctctcggtgggtgtggctgtaagcccggcccgccccggccctgctgacccatgccaggaatcgaccaggggaagtgacagttggtgtgggaggcgagtccaggctggaatgacaccccatgccttgtggccggctcccttgtgcgatgaggtattgtgccaatgggaccccctgcagcacacacctgggctctcccagggtcagagtcggggaccagccttctgaagatgccttcgcgccatgcagccgggttcacttgccaaaagcgtctgccctgggaacgagcaggagcttgatttggaggagctatggtcagctcgcatccaaggtgcaacggacggggtgcttgaacttgataaacagactatcttgtgctaaagggggcaactgaagaggtgacatgcacgtaatgagcactctgcagggaggttcactggcttccagaacgcaagctttgggtgcaggcatgttcttaccaccgccacatattgacctccctccaaatctgtgtgacccgcgggaagtaatttggaccaatcttttcaaatctcagacttcaaggaacccagtttattatggtgaagacgggaaagtaccctctttcaagtggcactcactgctgatgtcttcggcgatgcaataccatctctgccactgtccggccttccggtcaagcccatggattttcgcggaagtgggatgtccggaaagcgaaactcacccagattgcgaggagtcctgctgcatggaatggcatgagcgacgctctcaaagtgtgccctttagtgataagccgttttctggcatgaagcagcacctgtcatgcactcagctgccttcttgtcaagccttttcaaatggatgctgcctcacaatgtatctctgctttccttatttgcaggatgccatgatagcttcatgtagcaaggacatgtcttggaagcagaattttggcagtaagattcttgaggaagaaatgcaggaatggggaaaagtgcatcactactcatctccatcccctgctgcgccccgggtgccagcgcacaggtatagaggtccccaaacagcacagatgtggggatgggttgttggttattcgactttgttgtgacttgcgacagccgcacaacccgccatccaatacctgccacccttctcctggtgttcacacgtaattcctgcagtggaggttctggtccggccacacataatacttcagatccagcaaaggaccatgagatgcctgagtctgccccagtttgcgaccccttggcgatatcagaggtgtgctgcctggctgcttgcaagggtgggccgtgttctggttggcattgcaactggggatccatgtctgatgtacacaagtccacatgcgtgcacacatattgctttgtcccctctctgatgcattgaaattcaccccttacagcccctgcaagcggcccagcagccaccagctccccatcgccaggcgatggcttgcgtgcaatcccatgtgactcagacagcggaagcaccaagtggtgtgctcaccaggtaggcagcaaagtcgatgggcacccaggctggaatgcatttgggatggtactgtctggatggaccaggtactaccatttgttgctgtgttcttggacattttcgatagttctgtccatttgaacaccctgcagatcagacaatcgtaacttcaaggagctggagatccagtaggctgcaagatcaatgcatgtttgtattcccaaatgatttgaggcatggcgcaggccagtttatgtgctcacagcttgcgggaatagagcaggccaggttgggcatggagtgtgcgacgagcagtgctcttgagcaccagaacattcgacgtccctgcatacatcaagtgctccccctcctagcaggtgtgcgtcattcgcaagagtccttggcgcctccaacaccactgtgtgccctgtgtccagtcgtccaccacgctgctcaatgcagctatgatatcagacctaccacagccaattcgattcatcttcttcctctccaaggcgtgcatccccatgtcctcttacaggttctttccacaatctgtgctcagttcatctgtatcccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgccctgctcctacatcaacttgcgacagcatgacaacttggtgctgggatggctggcgatgcctcaccatcacaccattgtaaagtttcttgaagtgcggacatagagtagcattgtggatgcctcttccgtactagtaggagatccgtcctctaccggtcaattccccagagttcatcccaaattcatcaaaaactcagccgaccaaaagtctcttcgtttgccaagtcttgttggcctggctggtatgggtctccattgcctgccactgtctcaatctcagcgctcccatacggaaggttgcggggtaactgacaagggcatttatctggatcacctggcaagcttgtgagaccagccctggacgatggtatgtggacgtccgcaggtccatgtggaagcatgccgtgcatcactgttcgacatcagtacctatagggtgctcaaatttggattccaacacatcccatgtgccgggggtggcgacacggcggtgagataacattcagttgtactctgtcttccgattcccgcgaaacacgagggtccttctcctgtcaatatgcaacaagaatagacatgtgcttaggttaaagccattgcaacgagacgacggcccagaagctagtctgtgagggcaaaatgactccggatggcgagaccagagcgcggagatgccgtgcatgatgtgtgatgttctcgcgcgctttccggcggggaccggggaggaggaggggtaacatcggtcatacggcgagtattcgacattcggccaggttatccacgccacgagactttaaaagcgctgaagtatactttaaagcgcgcaacggagctccagtaacaggatgagggtgtgctgggataagaaccaaccctccttcaccatgaccaagaaaatgtgggccgaattgtgagtgtgtgattgtctttgaagagcgctctttagctttagtagatactaaaaatatccacaatcttgtaaatgagcggttgacacgcaccggaccgtgcacgcggcttacccttctccgccttgtctgcccgcagttacgagttgttgatggagcaaccggacccctcccagaccagtggagtcgcagccgaagcttctggcgtcacaatgaaagacgtgggccatggcgtgagtgtccggtatctttactttcttagcagtacggcgagggattctgcctccaggagcctgattttcttttgggggggaatataaaaaggttacgtctcgtttcctgtatccacctccttgcagacttgttccggagcataccttgtacgtacatctcacgaacaggcatctcctgcgggcgaggccatgattaaggcctcgcccagcctgccatcccagactggcggactcgacgagcacactgaggtgaaggataggtgagtgggcaggagtgtgtatttgtaccaatgaatgcgaagccctcagctcagatgcaacgctgaggcggggtcgatatactctgaatttccttgttccagcgcgctctccatctcctaagaaagtgccccccccccttatgttcaattttcgcagtgccgattccgcttcatcctcaaagttttcatctgagacagagaatgctcatgggatggctgattcctcccttgccttcaggcacttggcgatgtccaaggtgcgcattccagctgcttgcagtagtttggcgtgttctggttggtgatgcaggctggggtccatgtctgatggtccctaaatttggtatgtggccgtacacatattgtgtcatcccctttctgatacatctagatctaatcttatgcagacacagcatccaacccagcagccaccagctccccatcaccagccgatggcttgcgtgccatcccatatgactcaggcagcagaagcaccaagtggcgtgctcaccaggtaggcaggaactgtgatgggtactcatggcgcaagtggtcgaggagggtactgggtgcattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggaagcaggattgaagtgcgtgggtattcccaaacgaattgaaggcatgacgcaggccagtgtttgtgctcagagcatgtgggtatagaacaggccaggaagggcatgaggtctacgctgagctatgctctgtggcacccaaatactcaacatccccacataatctgacgcttcccctccaaacaggtggccccctacagccggagtccttggcgcctccaacactggtgtgtgccgcgtgtccagtcgtctgccgcgctgctcgatgcagctgcgtcatcagacctatcactgcaagtctgatttatcttctcgtctcttaggcaagcttccccatgtgacacattcaggcccttctatccattctctgtacccaaacatctgcatcccaggccctttctttcccttatcagaggctttccgcaaagcattcgtatagaaactcgtgaccatcacctccaaaattctgccctgttcctt

SEQ ID NO: 29815 - DNA, 73 bp, Chlorella protothecoides
ggatgaggtgcacttcatgtaccagagggcgctgaaggctttgggaccacgggcccagcgcctgcccacttat

SEQ ID NO: 29816 - DNA, 78 bp, Chlorella protothecoides
ccctcccctccttctccctacagcgggacgtcgcgtcccacagggcacgtatcgtccagcagaagcagcggctggatg

SEQ ID NO: 29817 - DNA, 125 bp, Chlorella protothecoides
ccgtcacctttgttcccctcatggcgggtgcgtaggtgctgaaggggtcccggcctgcggctggctcgtgggcgtcctgggtgtcgggattgctggcacatcttggtggacttgtagccgagact

SEQ ID NO: 29818 - DNA, 1107 bp, Chlorella protothecoides
  modified_base (558)..(567): a, c, t, g, unknown or other
ggtggggggggcgctaggtgggcgaaggttggggggcatcgtgcagctcagttgtgcatagatcaggaggaggacaaatggcacgcgtcgtgggcgttcagcaccgcctgcaggggtgcatgacaggcctggagcccctgcagtgccccaaccctcctcggcccctctcctcacggtgccgcaggaatttgccggtgcaaatgttccagttgcccgccagcgccgacatgtacggctggaactccaccgcacggatgcgagtgttgacaaaccgcccccaggaggcccggccctgcacatggagtttgcttgtgagttgctgttctgtcagtctcatgtgatcaggtgaacgaaaaggggggggggggggcgatgaaagagggcggtgtggtcaaggcactcgcaccgacggggcctcgcccggttccgcccagaacagggtggcctgctgtacacgtgcccacgccccctcctcaccccccaaagacgaagtctcccgagaccacctcgagccgacagtcaccttttgtgagagcccggagtagcactggccagacnnnnnnnnnngcccctcctcaacccccaaagacaaagtctcccgagaccacctcgagccgacggtcaccttctgtgagagcccggagtagcactggccagacatgatcaggcccgcctccgccacagaccagacaaagtagtacttgaggcgggcggtgaagccagtgagcaagatgagagcgaccctgcggacagcgacatcgtcaaacatgagcaggaacagctttggagagagccgcggggaggggccacgccctattcagtagaaaccctttctcggagacaggctgtctgcaccgcccccttctcccctttgcaatgcttgcacctgtggcgcacggagattgtgttccaccaccgcgactccagcagcgtggcgttgaattcgcggcccagcacgctccacagcgtggcacaggcggcgcccctgaggaagcgcagcgcgcccgggagcagggaggactgcaggcggccgtgcgccgcctcgtcccagtcgccctgccgggggcatggtgggggtgggaggaggtcagcgggggggcggggtgg

SEQ ID NO: 29819 - DNA, 3605 bp, Chlorella protothecoides
  modified_base (2815)..(2824): a, c, t, g, unknown or other
caacttgtgtaggtctctacagcggtccacgtcgtaggggctagcacgcccccacaacacccccccggggcccaacgcctgtcaaggggaatagggcggcgcacaccaccgatggacgggcagtcgatcacaacgtcattttagttgcttcaagagcgtagaggagtcggcctgaggtacgtacgcgtgcgttgtgcataaaaagggggtctctggtgctgccgaaaggagggcaggagtgagatgggctcatgtaagaccgctgctcgggctgttgtggacgaacactcctttcaggattcaaatagtactgggtacgtgaggagtgttggttctgtcacgaatatactcctccccgggattgccctgtggggagactgaggcctgagactcgggcccaccgcccagcgcagagtgagcatggcttgggcgggacaagtcagtgtgtacacaagcactcatgtaacctgaaaccaaccccaaggattggcaagcatcgcgcaacttccatgaagacacttcagaagcttgccgccgaggcattcgaatccgtgaatgaggagttttgcgggagcggcaacaaagtcgagtgccgttcctgcaggcgaggaattgccacaaacacaacaaggcaaaagcaacgctttttgggtggagcaaacgtcgagcagcaagattccggaagcgctcttggtggcagtccagcgtgtcaagcagctcaacactccatgcaagcgcagccacaatccatgctctcgagcagtttggtggccgacacttcagaacctctaggaaccctcttcggcagaccagcattacggacgtcatgggtggccgggggtgcatgttgtgggggcgggctggcccccacaacggtggaccgctgtatatgacctgaagtaggaatgttacagacgagaccccgaatgcagtgtgatggtcgggtttcataggcgtcgcaaggaggcgtggactcgggggaacaggtggaaagtggggagatggcccggtcacccccaccacaattccctacgagcggcacgtcgagtgcaaagcacgccaaacagttcccagcttgagagtgggaatgctaggaggcagaggactgcttcagcgagcaaatgagggccaaggcgaccttgcacctgctgtgattcccatatctgtgagcgactagcttggtaaccaggcgggcagtacacgagaagggggttatctgaccccttgtaagggccaaggagggggaggcccctgggccacaggggaacaccgggcatgaccgatgtgtgccgagggcgttctatcgctctcgaactcgatactcttacgttcatatgatattaacaaaataaaaaatcgcctcttgcggttcgttcgcatctcctactggccacgacatgccctaccaaaggggcgacaatggaacccgccgaacgggggcctctcggattcccatcaggcagttcttcgcatttgcacatgttactgaaacatggggtttggcttgagtggcacctgactgggcgcttagtattgtcccggggtggccgatctgtgactcctggagccaggcccactgcggggccccaatagactgtgggaaagttcagcactgccaccatgcctggccatagcactgctcatccccgtcgctattgcaattgagcaaaaaaatagtaaagggacatatcccgtcaccgacaccatttcatggtatcaaggatcgaaggtggcccctcaaggtcttccatcaccagctgcgacattcgtatctgccagagctcattcccatagtaaggtcggttccatggacgtgcaatgtctccgtgagtccacggggttgacgtggtggagaaatggggtctcccaagtctgcatcctcctatacctgttacccacctcgaggtcggccgcaccaagacatgatgaacgggtgagtcgctcgtgtgggtgtggcagtgagttctggtctgcagtgtcgggtcgagagatgtttggggctggtcgtcaggcgggcatatgtgggcatgaggtaggtaggtcagcatcgtccatgtccctgctcgcagccaccagcctgtcgtccactccaccctgacgacaacccaccccctcccacgacagcatcgacgatcagcttccgtgggagcgaccttgaaggagctttcccgaaccttcggaaaaataagccatcgacatggcaaaggtgggtacggggtgcggggtggagtgattggcggatcagcgatacgcgtgcctccgcacgaccattcgatcatgcctctgacccacaaaatgtcctgcccatcccacagcggagaatgcgcgctttgtcacgctcgagggctgacttctacaatggagtccagggagcgacaccctgccatcaggagtgatcgacatggggagttatccagcagactgtggggtgtagttgggagggggaaccggcggtggtctgtggcgtgatcctggctgtcatgcagggcgggggaccgttgcattcggaccacctttgtggactcgcaaacgcaccgatacgagggtggctcagcagcagccctccccatctgatgcaggaaaatgacctgccaactcacgcaccccacaagtggctttcctggtgctcttcatatgatccgcaaacggccgttatagacggcctggaagctatggagcagccggtcccggatcgcacgcactgtgctcgacgtgatgggccggcgggggaagaaggaagtagaagaatcatggcatttcccagatgacagtgacgagtcgtgtacagcaagctccatctgaacccatcttccgnnnnnnnnnnatttcatgctctagggagcggtaacatggacgcttgggattgagaggtacctgccccgggctacgtgagcagatgacagtgacgcgtcacgcacagcaagctccatctgaacccatcttccgcactggaaagttcatccctggagaactgtattaacattgctgtggaggtccagtctcatggcctacccacgctcctgctataaactgcggggtgtgtgccgggatgtccaggtcctcatcagcggatgtatccccaacaccccggacagtagttatgacttggatctttcgaccctttcctggacggcctctcataacaaggagagctgcaacgggctgacagggacaatcttggtcactgcattcaccccgttcaagatggctggaggtcagggtgttgtgagggctggcaagccaccacaacacagggacgaacagcttcagtccatgtttgctccagtcccgggatagctgcaagtctcggtggagggtaacgactttaacccgttggaaagggtcacggtgcaatagaaacaatacttttcctttccgtagagatacttcgggactgctgaatacaaatgtaaacccgagccgttccaggtgaaggttggaacgtcattcatatacatgacaatggtgtctaggaagtaggaatccgcgctcacagtgaaattgacgtacctacggcttaaagcataagtggttaataagtttggggcaggaagagttattggaggtgggaagggtggggagggcggaggaggggaggagggggg

SEQ ID NO: 29820 - DNA, 64 bp, Chlorella protothecoides
gggcgccagccagcatgaggggcagacgggtcagacgagcctccgcaccaagaagaccggctgc

SEQ ID NO: 29821 - DNA, 61 bp, Chlorella protothecoides
ccaaccagggcctgggcttgctcaggcctgacgcctgccagtcgtgcacctgacattcaat

SEQ ID NO: 29822 - DNA, 108 bp, Chlorella protothecoides
cgcctgccagtcgtgcacctgacattcaatccaccccctccaggactcaaagccacccctccccaggcatcacccccgtccgcccaccttggccctgaaggcagtggg

SEQ ID NO: 29823 - DNA, 63 bp, Chlorella protothecoides
agcgatatccatccaccgggtccgtctgcaaattatgacctcacgtgcaaacctcacaccctg

SEQ ID NO: 29824 - DNA, 129 bp, Chlorella protothecoides
ttgacaagggattaaggcaattctggatggtgaaggtttgcatgacgtggggtggtgtcagcgaggctcctggatagatggagaggaagggaggagcaatcgaaatcagtgccctctgcggggctggga

SEQ ID NO: 29825 - DNA, 61 bp, Chlorella protothecoides
ggcgggcagcacgatggcctgccgccgggcataggtggcgtccagcgcccagacccaggcg

SEQ ID NO: 29826 - DNA, 64 bp, Chlorella protothecoides
ccaggcccagggccgctcagcgacgccgacagcggggcccccgggcaccgcacaggcgggcgcg

SEQ ID NO: 29827 - DNA, 69 bp, Chlorella protothecoides
gatggggcacaccagcaagtgggcaaggcagtggcaagcgcatggtggcatccagcagggtttccagag

SEQ ID NO: 29828 - DNA, 103 bp, Chlorella protothecoides
ctcccccttcctgcccgatcgcgcagctgcatgggccatgctcaggtcggccaagggcatcctggtgcccggcggctttggcgggcgcgggacggagggcaag

SEQ ID NO: 29829 - DNA, 89 bp, Chlorella protothecoides
tcccaggtcgcctcgtcgttcaggggaatgaggccgtcgtactctgcgccaaagtccacctggcggggggggggggggggggggggggg

SEQ ID NO: 29830 - DNA, 124 bp, Chlorella protothecoides
acgccgagtacagatggagcgcaggtgattagattgatgctagttgcatggtacacctgtcccttgcaggcctctgctccccgtggtccctcaccctcgcatgtgatcccccccatcacaacag

SEQ ID NO: 29831 - DNA, 73 bp, Chlorella protothecoides
gttcgattcccggcatcggcgacattttatattttgcttaaggtctgctgtgcaggctgccatgctgccatca

SEQ ID NO: 29832 - DNA, 68 bp, Chlorella protothecoides
ctgtcccttggcacacattcccgctgcccttgctattcacagacgcagtgctggtgctgctgctgcga

SEQ ID NO: 29833 - DNA, 61 bp, Chlorella protothecoides
ccagatccttctcccgctctacatcccctcaccaggctgcactggccagcaccttcccggt

SEQ ID NO: 29834 - DNA, 61 bp, Chlorella protothecoides
gcgcttcctcaccgccatgctggagatggagatcccgcaggaccgcgccgagctggccctg

SEQ ID NO: 29835 - DNA, 77 bp, Chlorella protothecoides
agacatttggttggggcgatggcccacactcgctgaagtgtgggggtacccagaacctgaatacactcgccaaggcc

SEQ ID NO: 29836 - DNA, 61 bp, Chlorella protothecoides
tgaagctccaacaccagcgtgatccttgcaaccctgcaagccaagactcactcgcgtcaga

SEQ ID NO: 29837 - DNA, 156 bp, Chlorella protothecoides
ggggacccctccagtggtggtaaacaaaaaacaccttgaccgctccagccgcatgcctgatgcgtcgagctgcttttgtacctttttgacgtcttcctggctgcaccgcttgtccagtcccagcgtcgtgtagcaagccgtgccatccacatcgtc

SEQ ID NO: 29838 - DNA, 69 bp, Chlorella protothecoides
ggcccaagggttcgagcgaacacaggaccccggccacttcgcgtgaccctgtcccggctcacgggggtg

SEQ ID NO: 29839 - DNA, 61 bp, Chlorella protothecoides
caacctcacccttaccgactggaagaggggagcgcactcgctcagcttgggaggtttgtag

SEQ ID NO: 29840 - DNA, 78 bp, Chlorella protothecoides
tgcggccttgatgcctgtgcaagttgggggccatgcatcgactcgggttgcactgactgtgagctggggttgcagcgg

SEQ ID NO: 29841 - DNA, 403 bp, Chlorella protothecoides
ccgggggggggcatgccagggcaggggagcggggaggcgcgccagggtagcacacaccctccatgaccgactgtgttggtgagcgcccatcaatcatccgctcgctcgaggttccaggcacttgccaccaccaccaccaacaacctcttggcatctgattcttccctgaacaaacacaaaaataccaaccacgcaggactcggcggacccatctgcggccgcggccgctgaggcggcagcctgggcgctgagcaacctgtgcgggtcggagggggcgcggcgcgcggtgtgcgccgaggcgggcgccatcctgggccccgtcgtggcggcgctgtccggcgggtcgccgggcgcacggcacgcggcggcgcgcctgctcaaggctctggtggcgggtgacacc

SEQ ID NO: 29842 - DNA, 62 bp, Chlorella protothecoides
gtgcccagccctccgccaaagccggcgccacggccggaggtcccgctggtacgtggcgggcc

SEQ ID NO: 29843 - DNA, 72 bp, Chlorella protothecoides
gccaggggctgccctcgccgaccagccccaagcccaatacagaggcagccgacgggtcctattccccgccca

SEQ ID NO: 29844 - DNA, 111 bp, Chlorella protothecoides
ggaaagagggttgctggcgtgccatacatgataactgtgcgacgtggagaccatgcccgggtagccctgcacaatacgttgtacattcaaccccatgtccacgcccgcgcc

SEQ ID NO: 29845 - DNA, 79 bp, Chlorella protothecoides
acggcagcggggcgtgcagacctgcgtcgcctggcggggaagggaccgggaggtccgtctccttcagcagccccaggtc

SEQ ID NO: 29846 - DNA, 126 bp, Chlorella protothecoides
tgaagcggagctgccggaggcctaggtcctgcagcaggggctggaagcgccgcaggcgcccaggatccagccccccgtgcccgcccgagggcgcctcccacagcggctgcaatgcatggtgcctgc

SEQ ID NO: 29847 - DNA, 115 bp, Chlorella protothecoides
ggaaagctccccttcctcaaggtacgtcgagcaagcctgtcgatctcatgcctcctggtcggctcttgtcaaggggttgaaattgatggacggtgaagtacattattggggatct

SEQ ID NO: 29848 - DNA, 79 bp, Chlorella protothecoides
cgtcttccaggtcatgagagaggccagcgaccgcacgtcgtcgatgtccacgtcggggtggaagcgcaggccgcccttg

SEQ ID NO: 29849 - DNA, 61 bp, Chlorella protothecoides
gtagggggtggggggaggcggcacgctggagggcggcgtcttggggctggggctggggctg

SEQ ID NO: 29850 - DNA, 107 bp, Chlorella protothecoides
gagctgtttgaccaagagtggctctggccagggctgcactcttcttgctaatcagacacgccatgcatgccaaaaaacatgcatgcatgcatgatcccatgccatat

SEQ ID NO: 29851 - DNA, 80 bp, Chlorella protothecoides
aaggtattctgcaaatttgagagaccacatttcgtgtcccgttttccaaccagatcatgccatgcttctgattacttgca

SEQ ID NO: 29852 - DNA, 78 bp, Chlorella protothecoides
gtcaaaccaagaccctgcactccctgcaccagtattgctttctctgctgacaactcttcgtcccgccacaccgtgcag

SEQ ID NO: 29853 - DNA, 112 bp, Chlorella protothecoides
ggcatgagtaggctggtctgcgtcctggggtccaagatacatgctatgataccaacacggctggtgttggacccgcatagggtaggatgtatcttgaaggcaatcaataggg

SEQ ID NO: 29854 - DNA, 242 bp, Chlorella protothecoides
ccgcctgctggccgacgtttgcctggtcaatggtgtccgtcagaggtcctatatgggtaagtggtggctctctggcacctagtgatagggttgcgctttgcagaaccaagttttgaagagtatcgtgcgagggtcaggccgtgcatgctgctgtgtctgcccaggagggttcaacaagctctgccctttggagggatgagcgtgtgcaatttgccgtccccatctcaaccatcatgccatac

SEQ ID NO: 29855 - DNA, 218 bp, Chlorella protothecoides
ggatggtgccctggtcgtggggagggggggattatggcatgaccagtcatggcgccatcaggtggcaggaactgggacacctcggggcagtcttcatttacggggccaactcccctgcaatccatatacttgccctcgaacaacaatgaatggcaactagcaacccttcttacaaccccccccccaccaaaaaacaaactttcctcctgccacgcgca

SEQ ID NO: 29856 - DNA, 61 bp, Chlorella protothecoides
gattccctgcaagcctgtgctggtggagggtggggaggcggcggacaccgcctttgttgcc

SEQ ID NO: 29857 - DNA, 88 bp, Chlorella protothecoides
gacctgatcactggtgaggaagtgggggggacgggggatgtggctgtctttgggtgtactggggtttgtggaggggtgccgaggccga

SEQ ID NO: 29858 - DNA, 189 bp, Chlorella protothecoides
tcggagggcatgagctgcagaagggtgcagcgtgacattttgaacccagggttgagatgggggtgatcgcccagagtgcagccatacggttggagtcatatctcaacaacccatcttccacaatgccacccctgtgcagctaaaatccaagctcgaaatagcagcaggtgtggatgcacgtgcgtctca

SEQ ID NO: 29859 - DNA, 77 bp, Chlorella protothecoides
ggggaggatgggcagtgcaccttgtggctgggagaggggcaagggattacatgaggggccgcaccgtcagcagcctg

SEQ ID NO: 29860 - DNA, 228 bp, Chlorella protothecoides
aaggtgcgcgcggggcgatgcggtttgcccatggggacgggaacagggattgccagcatggttggccgcatgcaggggtcggaagggcgtgggactgagaagcaacccacaatgtgtcccccccctgacccctgttgtgggcccccttgcaagagctgctcctgtcaaccccgcaccccacccctccgcccccccctcaatccaggggggttttaccaggacattccc

SEQ ID NO: 29861 - DNA, 71 bp, Chlorella protothecoides
ctggcggccccctttgtggggcccttcaccatcaccgccatgcgcggcactggggcggcgacgctggcgct

SEQ ID NO: 29862 - DNA, 126 bp, Chlorella protothecoides
atgcgacccttgcatgtgtctcgcatgtcaggaagctcgttggcggaggcttgttgagagaatcctggaggaactctctgagcacatgagggaggacgacaggggtggacagcacgcatgtcatgg

SEQ ID NO: 29863 - DNA, 66 bp, Chlorella protothecoides
ggcagccattctcctggtttcagtactaatccatcccatgctgcactgccctgcaggtaccagaac

SEQ ID NO: 29864 - DNA, 79 bp, Chlorella protothecoides
gtataccgaggtcgcttgtatgtccatcttacccccaccccccctctctcgctcctatccggacatgggaggccccgga

SEQ ID NO: 29865 - DNA, 63 bp, Chlorella protothecoides
aggatgtgctgctgccataccccgccaaatattatctgaacaaggcctgccctgcgtcgcgtc

SEQ ID NO: 29866 - DNA, 80 bp, Chlorella protothecoides
ttgcgcagtcagtgtgacggtgactgagctgcctgccaatggctatgacttcgagtacactaaatggtggtgacaaggac

SEQ ID NO: 29867 - DNA, 103 bp, Chlorella protothecoides
cccaccccccgcgccggcgctcctggcgcgcaggtcgctggaccgcgcccggagcgctggtgccagtggcccgttggagtggagtgagtcggtccccgtctcg

SEQ ID NO: 29868 - DNA, 79 bp, Chlorella protothecoides
tgcggccttgatgcctgtgcaagttggggggccgtgcgtcgactgggggtgcactgactgtgagctggggttgcagcgg

SEQ ID NO: 29869 - DNA, 148 bp, Chlorella protothecoides
gctgctgccattgtcaacgtgctcaaccaggccgcagcagcgggcctcaacaccgtccgcacctgggcccacaccacaaaccccaagcaacctttccaggtgagctggagtggtggtgccgcagattgtcagtctcagcgtttgtgtg

SEQ ID NO: 29870 - DNA, 62 bp, Chlorella protothecoides
ggggaggacgctaaggcctgcgggtgaggaagggaggccagggagggacgggagatgggtca

SEQ ID NO: 29871 - DNA, 61 bp, Chlorella protothecoides
ggcttcaggcgcagcaatggcgcgctgctcatgtatcctgccatgcgagagaacggctcca

SEQ ID NO: 29872 - DNA, 61 bp, Chlorella protothecoides
gcagggcgcagtacacgccccttgcgacaggacccctcgccgatgaccatctctgtaacac

SEQ ID NO: 29873 - DNA, 108 bp, Chlorella protothecoides
gtcgcgaggtgtgaccagcagggcccgggagatgtaagaagtgaggttaagctccctacacccactctggaacttccacatctcccgcagatcaagtgacgagccggc

SEQ ID NO: 29874 - DNA, 74 bp, Chlorella protothecoides
tggagtacatccgcgtcacgtgagtttggtgtcactggttgtaagtactaaattgcaagtgtccttggtcctcc

SEQ ID NO: 29875 - DNA, 90 bp, Chlorella protothecoides
gcacggccactgggcttcagacatgcagcattggtgttgcctccctctttgaaggtctcccctcgtctccgccatacacagggccagccg

SEQ ID NO: 29876 - DNA, 61 bp, Chlorella protothecoides
ctgcgccccatcctgcgcatcggcgagcgcacctcccccgccaaggggctggcggtgtgcg

SEQ ID NO: 29877 - DNA, 108 bp, Chlorella protothecoides
gtcctcggcaacagcgcgagatttgatctttaccgttccaaatttcagtatatatattcacagggtctgttgtgtgcgcgtccaccctgcactgggctggcaagcatg

SEQ ID NO: 29878 - DNA, 80 bp, Chlorella protothecoides
tggcgaccccgatacacggtcatacggtagattgttagtgtgactgagtggggacctgcctggttgggggactgatgtcg

SEQ ID NO: 29879 - DNA, 78 bp, Chlorella protothecoides
gggagttctcattctcgatgtggtcctggcgggagggggagtaagatggcaacgtggcagtgaaccgacgagtggcgg

SEQ ID NO: 29880 - DNA, 61 bp, Chlorella protothecoides
tgtgacccccggggggaccattgccttctttccctcccaccactatatggaggaggcggtg

SEQ ID NO: 29881 - DNA, 75 bp, Chlorella protothecoides
gttggatgtgagatcttgacattcaggttgctgattccaaggaaacctgatgttcgactgcctgggctacatctc

SEQ ID NO: 29882 - DNA, 61 bp, Chlorella protothecoides
gccggcgttgtagagcgtgaggtcggggcggccgaatccgtccagctccgccgcgctgggc

SEQ ID NO: 29883 - DNA, 79 bp, Chlorella protothecoides
ctccgacccccggcacggggacggtcgccagcaccaccacctgcgctccgtctccccaacccccgattcctgcacccgc

SEQ ID NO: 29884 - DNA, 61 bp, Chlorella protothecoides
ggcgtgcagcgcgtccagcgccgcgccccctcgccgcgcccccgcggcctccagggcgccg

SEQ ID NO: 29885 - DNA, 192 bp, Chlorella protothecoides
cagtgggcacacgccccgcccgggagtccggggcggggggatggatcggggttttgttgagagagaagccggtaaggggagcaggctgccctcgcaagggcgccaagctgctctcgccagggcaggcgcgtgctgggggggctgggggccggtggccaggccagcatgggcattcaaaacgagttcgcgggg

SEQ ID NO: 29886 - DNA, 85 bp, Chlorella protothecoides
cccccctttctacctgcatccgtgccctgcatccctctacgccgcccggcaccggtcttgaaacccaagcccctcaccgtactcg

SEQ ID NO: 29887 - DNA, 61 bp, Chlorella protothecoides
cccggcatgactacaattgtcggcgtgggccactggtcggcccaggaccgggggggcatca

SEQ ID NO: 29888 - DNA, 260 bp, Chlorella protothecoides
ggtacacctgccacatgcaccgcagtctccaacatctaaaatctgtatcatctttggcggccagcattatgcacttcaaccacaattgatatatctttcgtcctaagaagtagaactgcaccctctcccatttgcaaatgcatgtatattggcagtgtaccaggagattactttcctggccgtgccgattctccccaaacttcgtctgggcgcgaggtcacagggcgcgacgattgtgtcaagcgccccacgttctcgct

SEQ ID NO: 29889 - DNA, 76 bp, Chlorella protothecoides
ctcgtctactgcagggttgcgcttcagatacgaattgatacgatctactacctcattcctcgccccacatcatcct

SEQ ID NO: 29890 - DNA, 688 bp, Chlorella protothecoides
atcaaacgaacgtcgtcggtgtccagtgtggggggcccaagtctgaggcagcggtgggtcagtgcgcgatgtataaatgaagggttgcgcagcagttaagctgatcctgattgtctaggagaccgaatcgtcaagtagacaaactaaagccaccttaagactctgagagccctcgcagatgccttcgaagaaatctatgcttggctgtgtaatgtctaagaacaaaatctgcagtctctcgacctcgtaacagtacagtttgatgttatatggcaacctcgtgaagttcatcaacattaacgaagccgtatgcaagcagatagcaatcgacaattcatcatcatcgtatcatatggggtgatagatggcttcagaggtcgaaagatgcccttccacaccttgccaatggcaccagcaaaaggagtgcatgctgacaaggttcttgcgtcttcatcggaggagaagggcatcgagtgtattggatctcaggccacgcacataccgacgtaactcgaatgattaaactcagaatgttgccgcatgaagcccatgcagatgtcaatcaagagtcttcctttataagtcacctgcacaccttgatcttcacttcatcttcacaagtcgagcctcgaccacgtcaatagctatgggcatgccaaggcatactcacgtaagcggcccagagact

SEQ ID NO: 29891 - DNA, 61 bp, Chlorella protothecoides
tgggcaccccgaataacacaaatgacctccacccctacatgctgctcccagatcccaagca

SEQ ID NO: 29892 - DNA, 70 bp, Chlorella protothecoides
tggcagtcctcctgcccctctgaaggggccctttgcaatccccccctgtttccgctccagtgcccgcgcg

SEQ ID NO: 29893 - DNA, 77 bp, Chlorella protothecoides
gtgcgcggtgcactgcgtgctggagctcgcttttttggattagtttcatctacagactgctgtatcaatatgttgtc

SEQ ID NO: 29894 - DNA, 61 bp, Chlorella protothecoides
tcttttgtgttttatcactcagtttaatgtggcagggatactgcttgagtgaagcctcaga

SEQ ID NO: 29895 - DNA, 79 bp, Chlorella protothecoides
tcattcgctccacattgccgtggctccagataagcgtgcagccttcctcccgcagatattggctattgtgcacgccgcg

SEQ ID NO: 29896 - DNA, 80 bp, Chlorella protothecoides
tcatgtcccctatgccagccctgctgatcctcttggaacatgtccctgttccgcagggcaaggatgccatcccctggatc

SEQ ID NO: 29897 - DNA, 2382 bp, Chlorella protothecoides
  modified_base (741)..(750): a, c, t, g, unknown or other
  modified_base (912)..(921): a, c, t, g, unknown or other
  modified_base (1819)..(1970): a, c, t, g, unknown or other
  modified_base (2076)..(2275): a, c, t, g, unknown or other
ccctcccccccacccccacccggacatccccaccctcctgccccgcccaggcgcccgcatcgtgtacacctatgacgtctactgggacacgagcgacatcacctgggcctcgcgttgggacgcgtacctgcgcatgcccggcgggcgcgtgcactggttctccatcctcaactcgctcatggtggtggtggtcatgtcgtgcatcgtggccctgatcacgctgcgcaccatccgccgcgacctggcgcactacgaggccctgctggtggacggcggggcggccggccccggcgcgcccccgcccgaggcggaggagtcggggtggaagatggtgggcggcgacgtcttccgcgcgccccccgacactctgtccctggcggtgcaggtggggtcgggggtgcagatcctggccagcgcgggggtgaccctgctcttcgcctcgctgggcttcctgtcccccgccgcgcgtggctcgctgctcaccgccgcgctggccatgtacctcctgctctccgtcgcggcgggcgcggcggccgtctggctctggggcgtggccaaccgcacctatgagggctggcacaaggtgcgcgtgggtgggtggatgggagggggggtccccacgatgcggactgggtcgcgtggttgacgtcacaatgcactccctgaagcctccaccccacccccaccgcaacttatccccttccactctgcacaacccctccccaccaccctccccctttnnnnnnnnnntgagcaggtgtatcactgcaggggggcgcctgttcgagcacagagctctcttcacgtgtgcgccccctgggccggtcattggcgctgcagggagcatgacgcggtccttgccacaacaaacgttggtccgggcttcctcctcgcaccctccatcccacttgnnnnnnnnnnccccaactccccaaccccccaagtacacaggtgtgctggcgcgtggcctgcttcttccccggcgtgaccgtggcggtgctcaccgtgctcaacatgttcctgtggtacacggggtcggcgggcaccatccccctgggcttcttcttctccatcatcttcctttggctcctggtcagcatcccgctggcctacggcggcggtgcactggccgcgcgccgcgacatcgcgccctggccctcccgcaccaaccagatcccgcgccacatccccgccccgcactgggcctcccacccgctggtcctctttgtcgcggcaggcctgctcccctttggcaccatcttcgtggagctctactttgcaatgaccagcctgtggcagggctacttctactacatcttcggcttcctggccctggtcgcggcgctgaccctcatcattaccatcgaggtcagcatcgtctgcacctacgtccagctgtgcgccgaagactacctatggtggtggcgctcctaccaccgcggcggctccgtcgccgcctacgtcgccatctactccgtcggcttcctgttcaacaccttgcacaacctctccggcttcgtccccgtcgtcctctacctcgcctacaccgggctcatggcctggtgcatgttcctggcaagcggcaccatcggcttcctctcctcctacctcttcacctacaagatcttcgagtcggtgaaggccgactgagggctggaggagagggggagggggggaagtccaagtgggatggagggtgcgaggaggaagctcggaccaacgtttgttgtggcaaggagcgcgtcatgctccctgcagcgtcaatgaccggcccagggggcgcccacctgaagagagctctgtgctcgaacaggcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgtgccccaccaagcatgcgtcgtgtgtaagtgcagcgcagacccaaccagatatgggacagcctatctgacggtcgcgatgtgtgtacatgggcgctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcggttgggatgaatggggtttgctttactaattgaagcagaagacggggtccttcgagttgcagccgccgtcgtagtcgatctggaccatcatgcagccctt

SEQ ID NO: 29898 - DNA, 88 bp, Chlorella protothecoides
gtggcgggaagtgtcttttgagtccttggcgacagcataaatccacgcgacgggaccgcactcccacaaaatcttccagcctccaaaa

SEQ ID NO: 29899 - DNA, 72 bp, Chlorella protothecoides
ccccacccaggcccgacacgcccggcccctgccttcccgcacgcgtgcgctcctgcagagcccatgccccag

SEQ ID NO: 29900 - DNA, 83 bp, Chlorella protothecoides
cttgcgtgccacaccaccactcaactgcccgccggcggctgctcctatgcagcctcgcgcacatgatcctggctcactgcctc

SEQ ID NO: 29901 - DNA, 61 bp, Chlorella protothecoides
cgtgccctccaggaaacattccaatccatcactcctccatgcactgctctatgatcactcc

SEQ ID NO: 29902 - DNA, 76 bp, Chlorella protothecoides
gggatgggatgcagggcaatggctggatggggcctctcgcctcctctgatttttcaagtcccagacaatctggcct

SEQ ID NO: 29903 - DNA, 146 bp, Chlorella protothecoides
gcagcctggacttggcgtgggttctcctcccctcctgagactcacgcctccccctcctgccgtccatcacctgcagggacctgaagcccgccaacgtcctgttgaccacacaccgagtggaccgcaggggctacgtggccaaggtc

SEQ ID NO: 29904 - DNA, 61 bp, Chlorella protothecoides
agtgcagcctttcattccctccctcctccaacccccttgcaggagctaccacagcgtgcat

SEQ ID NO: 29905 - DNA, 410 bp, Chlorella protothecoides
  modified_base (138)..(297): a, c, t, g, unknown or other
ggcggccatgaagcggagagcctggagaggccactcctctttcaacacatcgtcatcactgcttggagggtaggcatctttcctgcttctcaagcggggtgcttgttgcgtcagacccccaggaggcgccagggaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgttgcctacacaagggctgtctgacttcaggacgtgccttgcctagagattctggcacatcgggacattgccatgcacagtgtcacaggacttaaagttcccgccatccg

SEQ ID NO: 29906 - DNA, 75 bp, Chlorella protothecoides
tcggcactagtaggccggggctgggctgcgatcctgaggtagtaacccgatcacttccgcggggagtgacaagaa

SEQ ID NO: 29907 - DNA, 79 bp, Chlorella protothecoides
acagtgcatatggagatccggaattcgttgctgttaattcaggggattgagcagcctgagcagatcctgccgatggcaa

SEQ ID NO: 29908 - DNA, 79 bp, Chlorella protothecoides
ttgccatcggcaggatctgctcaggctgcttaatccccttgatcaacaacaacgaattccggatctccatatgcactgt

SEQ ID NO: 29909 - DNA, 98 bp, Chlorella protothecoides
cggggctgctgatgcttcaggtgggtgtgcacacagttctaccggtgccatgaggaggctgaacagttcccccccccatatctcatcaggagcgggac

SEQ ID NO: 29910 - DNA, 61 bp, Chlorella protothecoides
aaaccgaggccgcccagctcgtcatggaggtgggttggggcgtggtgacccattaccctgg

SEQ ID NO: 29911 - DNA, 120 bp, Chlorella protothecoides
cgcctgggtggtgacccggggttgcggtgcggctcctgtcctgggtttcaagtctcaggccgtgtctcgatttcacccgagtgttctgatgagtgttttgctggggctggggttgaccag

SEQ ID NO: 29912 - DNA, 76 bp, Chlorella protothecoides
actcgagacctccagcccacccagtgagatgtttttctcgacaacgttccatgtgcatgacttgtacccttcctgc

SEQ ID NO: 29913 - DNA, 66 bp, Chlorella protothecoides
ccgtgcccggagtctgaagttccgaggctgcgcaccgccccagaagtagctttgcggcgtgcgggg

SEQ ID NO: 29914 - DNA, 245 bp, Chlorella protothecoides
tcatgtcgaggcacagcatcctgcgtgggaggaggttggtgaggtgattcgaggcgcgaagaggtcgcagcggtgctcgatgccgatgggtgcagcgatgcatgctttcttcgggatacggcgattccagcaggctatcactctgtgtgcttggagaagcccagcgccctgcgaccaaagcagacacaccctcctggcctacaacccggcactccatcctccacagcgtctctgtctcactgtac

SEQ ID NO: 29915 - DNA, 74 bp, Chlorella protothecoides
tccgcagggagggggagcctcggacatccatcgcacatgcgtccctggagcccttggcttccggcatgtcggta

SEQ ID NO: 29916 - DNA, 78 bp, Chlorella protothecoides
gacatcgaccgtggcatgcggctgggcaccaacgtgcctatggggccgctggccctggccgacttcatcggactggac

SEQ ID NO: 29917 - DNA, 76 bp, Chlorella protothecoides
atttagtgagatgtcagaggggggtgggtggaacgatggggttccaaaggtgtttgcggcatgcgcagcattgcag

SEQ ID NO: 29918 - DNA, 61 bp, Chlorella protothecoides
ccctcacctgacgcgattccaccagaagggcgaagccagtgggaagctggcagggatggtg

SEQ ID NO: 29919 - DNA, 61 bp, Chlorella protothecoides
aggtacaaggccaccctggccttcatttgcatgctgaagcagtctgccgcctcttgctccc

SEQ ID NO: 29920 - DNA, 61 bp, Chlorella protothecoides
tcgggtggcaggcttcctgtccggcacctcaacagaggggaacggagcccgtccctggagg

SEQ ID NO: 29921 - DNA, 62 bp, Chlorella protothecoides
tgggcggccctggacgggctgtgatggagtgttttttgtgcccggccggcgacagttctgga

SEQ ID NO: 29922 - DNA, 27375 bp, Chlorella protothecoides
  modified_base (618)..(627): a, c, t, g, unknown or other
  modified_base (2055)..(2064): a, c, t, g, unknown or other
  modified_base (2117)..(2126): a, c, t, g, unknown or other
  modified_base (2224)..(2233): a, c, t, g, unknown or other
  modified_base (2468)..(2477): a, c, t, g, unknown or other
  modified_base (3285)..(3294): a, c, t, g, unknown or other
  modified_base (3387)..(3403): a, c, t, g, unknown or other
  modified_base (3915)..(3924): a, c, t, g, unknown or other
  modified_base (4384)..(4393): a, c, t, g, unknown or other
  modified_base (5401)..(5410): a, c, t, g, unknown or other
  modified_base (5893)..(5902): a, c, t, g, unknown or other
  modified_base (6239)..(6248): a, c, t, g, unknown or other
  modified_base (6639)..(6648): a, c, t, g, unknown or other
  modified_base (7083)..(7092): a, c, t, g, unknown or other
  modified_base (7503)..(7512): a, c, t, g, unknown or other
  modified_base (8406)..(8415): a, c, t, g, unknown or other
  modified_base (9152)..(9161): a, c, t, g, unknown or other
  modified_base (10689)..(10698): a, c, t, g, unknown or other
  modified_base (12389)..(12398): a, c, t, g, unknown or other
  modified_base (12660)..(12669): a, c, t, g, unknown or other
  modified_base (14287)..(14296): a, c, t, g, unknown or other
  modified_base (15929)..(15938): a, c, t, g, unknown or other
  modified_base (16714)..(16723): a, c, t, g, unknown or other
  modified_base (17289)..(17298): a, c, t, g, unknown or other
  modified_base (17585)..(17594): a, c, t, g, unknown or other
  modified_base (17716)..(17725): a, c, t, g, unknown or other
  modified_base (17897)..(17906): a, c, t, g, unknown or other
  modified_base (18730)..(18739): a, c, t, g, unknown or other
  modified_base (20333)..(20342): a, c, t, g, unknown or other
  modified_base (25002)..(25094): a, c, t, g, unknown or other
  modified_base (25540)..(25549): a, c, t, g, unknown or other
  modified_base (26129)..(26138): a, c, t, g, unknown or other
ggcacgaggcggcgcccacgccgcgggacgcgcccggagcacaccaagcgccgggcccgcaggcggacaaggggcgcgccccgccggcccctgccctggccgccgcgacgtcgagcgacccgggggtcgctccccacccggcgccgcgcgacccgaccagcactgccccagcagccgacgcggcgctggacgcggagctgtcggcgctgatggctgcggaggatgagctggtcgccgcgcatcggcagcatatcgaggactccatggcccacgtgcgggaggagatggcgctgctgggcgagctggacggcggcggcgcggcgggggacgtggaggcctacgcggccgagctgacgggcctgctggccgagaaggcggcggcggtggcggcgctgcagctgcgtgtcacccagttccggcgcctggtgcagaccaccctggagcggcacgccagggctgggagtggcgccgggcagcagtgagggactccagtgtgtgtgtgtgtgtcggggaggggggtgtcctgtgccagcgagcccgaagcgaggaaaccgagaggcttcgacagcgcgggcacccgcaaccctgcccgtctccttcgactcccctggcccactnnnnnnnnnncgggggggggtgtcctgtgccagtgagcccgacgcaaggaaaccgagaggctccgacagcgcgggcacccgcaaccccgcccgtctccttcgactcccctggcccactcgctctgtagccttgccacccagacacacgattacacggcgcccagctccttcagactgctcatgaagtcggcgtacttttcgtccagtgagggcgggggtgcggcgctcgcgggcgcggcggtcttcacgggggccgtcaccgagcgggggaggaggccgaagcccgggccggggacggcgcggccgggggcgcctgcccggggccggggcgcggcggagggtcgatgtaccatgagcgtcgctgggaccatgctcgtgactgcggggcgggcggatgggtgtgggtggggcggtgatgccacagtctgcagggaccgcacacccagaccggcagagcagccaccacatgcagtcgtccagcaccctgaatgggtgcccgcccccctcccatcctccaccccacgacacctctcttgtcctggtgggccttgggcaggggcacgacagtggacttcccagagatgacagctgccgcggggcccttggcggactgggccaccgcgggcgggggaggccacggagcttgcgcctggtgcgaaatcgaggcccgcaccgcctgccccgcccagggcatccctccccccgcgggaggcggccccgggggcgggggcagaggggccccatgctgcaggtggtgaggcgggggcccgggcggaggggcgagggggggcggtccgggcggaggagggagcgggggccctcccgggggcagaggaggtggaccatttggtggcgacggcagtggaggggctggaaggggtggggcgcagacgtatcccggaggcggaccaggagggggcggcaggactgggaccccggggggaggtccaggtggcggcggcagcggagcacctgtcgatgcaaaggggggcgggggggagggtttcggggggcgaggctgaaggagttttgaagcggcgaagccactgctgtgacctgaggggtcgagcagggcctcagacgccatgagcattgcatagaagctccatgtcgcatctgcagggaccatcacctggggcaggacccgccggcaagggtggcagcgctgggactggcacggaaagaatggagggcgctgcgctgctgctgctcggggctgctggcgtattgtacctgcagagggggtgggtcatcacacaaatcctgcagtcttgcacacacgcttccatggtgcgaggccaatccgtcaagagcctgtccttgtcccgcaccccagtccatttcaccccagcacctaccgctgagctttgccggggggtgggagacccagcgggttcaaggtcgggtggtaatacacagaatcctcaggtcggtgcannnnnnnnnngaaccctgcagtcttgcacatgcgcttccatggtgcgaggccaatccgtcaannnnnnnnnntggtctctgatgcagccagggatgcctctccgggggccagtttgatgcaggccttctcctcctgcagtgagaggtagggtgaaaggcagtcatgaggnnnnnnnnnncggtctctgacgcagccagggatgcctctccgggcgccagtttgatgcaggccttttcctcctgcaatgagaggtagggtgaaaggcagtcatgaggaatggtagaagtcttcgactccagtgcgctatccatggcctctcccaggcagctgcagcacagggatccccccctacacttgagtgtcccagtcccaagtttttagcttcaatgctcaccatctgcctcttgatggcnnnnnnnnnntacacttgagtgccccagtcccaagtttttgggttcaatgctcaccatctgcctcttgatggcctgttcatatgctgattgcagcgctttcttcttcagccgcaacgtcggattggacttgccggcctgctccgctgcaatgacctccttcagctgctccttcagactctcaggatcatcccgcttggagtaggcatctcgctgcagtgacctctccttcttgttccgtgcaatttctttggccctctgtgttttcctgcaggttcggaggcggcacaggatgagatttgcaaggtctgcggagctctcctcctgctcgtcgcttgaccgtagtaattccttctccctcgtacctgaatgcatcagctggattcagctcccgtcccttccccttcttcaccatgcttgctactcaagctggcagggatatgtttggggatgtacgatccctacccaggactgtcagtgatgagtttcttcgggtccttgttcctctgcgccacctgttaccagggtcctgccataggggaacaactcaagccgttcgagagccctgaatgccaacagaaagaaacttcgagtagtcgaaaatatcatcagcacgctagtagaagagcggatcaggcacgagacatcaggctcagctggcgcgccctctctcggcgcgcactgtcgacaagcgcggttgatccgacgtcatatagcgcagggttattgacgacgctgttcaccatgctgcgcacgcctccacattcagtgctaacataaggtgccattaatcacgctgaaacgttcattctcgatcaannnnnnnnnnagacgacgctgttcaccatgctgtgtgcgccttcacattcagtgctaacataaggtgccatcaatcacgctgaaacgttcattctcgatcaannnnnnnnnnnnnnnnntcggacccaagggaagggggtgactcggagctgtgagccctgcaccatacccatcatgcctgatgtgaatgcgcgcatggatgctgaagcctccataagtgggcaggatgatggagaatcggtgtatgatgggctgcccttttaccaggtgagcacccagcagcagcagcaacagccgcacgcaggcagctcccgggcttgctgcctgatcagcctcaacattacactccgcccacagcacatgatggcaggagcactggctggcatcggggagcatgtcgtgatgtttccagtggacacgatcaagacacgcatgcaggccttggcccacccggggcagcaggtgaggctcaaccctggtgctcatggccccatttttgtctacgcagatctccattttgtcactgtctgcctcctgatcaggactgatgatttatcagggacgcgaacggctcgacgcacgatgcacctgaggctgtgttgatctggtccgatgccgcagcgggtgtgcnnnnnnnnnngggactgatgatttatcaaggacgcaaacggctcgacgcgcgatgcacctgaggctgtggtgatctggtccgatgccgcagcgggtgtgccttgcccacatcacattcttgccctgagcaaagcagtctcatgcctctgcatcccccgcctgcgcagctgcacctgtctgtcaggcacgcgatgcgggcggtgctgaggcgggaaggcgtggcggggctgtatcgtggagtcacagcaatggcccttggcgccggacccggccacgcgctctactttgccacatatgaaaaggccaagcatctgtatggcggcaaccggaagggccaccagctcgttgccacggcgggtgcaggtgggctttcggtggcgatggatgggacgagaggcgaggagagggagggtgaggactgctgccggggcgatggcagtgggtttgggtcattggagcagttgtttccnnnnnnnnnnggcaggtgggcttttggtggcgatggatgtgacgagaggcgaggagagggagggtgacgactgctgccggggctgtggcgctgggtttgggtcattggagcagttgtttcctcccattgtcagacatgggctggcccacccctgagttctgttgctttcccacgggggctgcgccgccccttgccaaccccaggctacccctggctgtcttccctcgtgttgggcacctgcccctcttcctgccgtccgtatggttgcctcggagcctcgtcgccctccctcccaaactccctccaggcgccaccgccacgatcgtgaacgacgcgtgcatgacaccgtgggacgtggtgaagcagcggatgcaggtgtcccacagcccttatcgcaacatctttcactgcgccaagtccacctaccgacacgagggcctgtcggccttttacagatcctactggaccacggtgggtgggtggttcagcagctgggacgcgttgccatggagccctgggctcggcgctgtggtggagattcagatcgcaacaccctgcatgggagccggtgcagcctggcaggggagtgatgatcgaccgaggatgtttggctcaggcagtgtgctgcaccctgccgtaagttcgtgcccagtgaggctatcaattccttcccatcccgctctttcctgggtgcagctggtcatgaatgtgccctacacggcccttcagttcatgctatatgaatccagtaagaagctgctggtgggcgagggcacggccgacgaggaggaagaaggcctgaaagtccaggtagcgagcctctggggggttgggagggggttgggggggtaaatggtatggcctgtgaggaggtgcaggggcgcgcatggacgaggtctgcccggcactcgcctgccatcctccccggcctcaatgcccgcagctgcaatcccccccggcctcaatgcgcgcagctgcaacccccccggcctcaatgcccgtagctgcaatccccccnnnnnnnnnngccccccggcctcaatgcccatagctgcaacccccccgcaacccatcattcgaccccccttcacacagttcgtcgccggggggatcgccgggggcaccgccgccgccgccactacgcctctggacgtggtcaagacccggctgcagctggaggggctgggcagcgccacacggtaccagaccatgtccgtgatcccggtcatgcggcgcatcgccgccgaggagggcgccgctgcgctgtggagtggctggcggccccgcgtgctcttcaacgcgccggccgcggccatctgctggggcgtgtacgagacatgcaagactttcctggcgggggatgacgtggcggaccaggcttgatgaaccgtgcagggggtcggctgacagcctgactcgcagtcccaagctggaaccacgccacgcccccagcgctgttgccgggaccgcaattccccgcctgtctgctccccaggggtgagcctgcacnnnnnnnnnntttgatgaactgtgcaggggttcagctgacagcgtgactcgcagtcccaagctggaaccacgccacgcacccagcgctgttggtgggaccgcaactcccccctgtctgctccccaggggtgagcctgcacctgtcacagctctgctgccgccgggacatgctgctctacaccttcacgggtgacctcctcgcgctcgtctcatctccctgctgaagaattttgggttcctcgctgtaacctgtgtcgacttcccacccaacgcctccctggtcaaaacagggcgtgcgactcccccttgcacacccagcccctccacttttgctctagggacagtgnnnnnnnnnntgggacatgctgctctacaccttcccggcgacctcctcttgctcgtctcatctccccgctgaagaattttgggttcctcgctgtaacctgtgtcgatttcccacccaacgcttccctggccaaaacagggcatgcgactcccacttgcacacctagcccctccacttttgctctagggacagtgggcagtgtgtctccatgaggaactggagaagcaaggggggaaatgtgcgacgaggagacgccaggctccgctcaagggttctcaggtccgggggattccttgcttgagaagccaggtgtgcctgggggtacaggagagcgtcagggtgtgtgggatctggctcacgttgcggatgcttgctttcatctcacgctgcccgcccagccnnnnnnnnnnggggatctggctcacattgcagatgtttgctttcatctcacgctgcccgcccagcctggcagcacgacgggcatgatcgtctactacctggcatccaacccgccttcacctggtggggcgcggcaggtggggaacacccagccccctccctccagcctcaccggctgcagcaggagcctgagcagaggcagggggggccttgggcgccggggtcttccttgggcggccccgtggccggcccgtggactttggggccaccgtcttcacgccctcctccagctgggtctccaccgcagctgccttggcgacggcctgctcaactgccgctctactctcctgcagctcctgtggcatgaattgggagtgggaaactggcacaatgccagatgcacagcaaaacttttgatgggcgggatggagactgtgcacgtttgnnnnnnnnnncgcctgctcgactgccgctctactctcctccagctcctgtggcataaaatgggagtgggaactggcacaatgccagatgcacagcaaaagtttcgatgggcgggatggagactgtgcacgtttggaaacaagaaagcgccagactcacgtgctggagcttgcggatgcattcgtgggcctcgacctgctgacgaatcgccgacttggcatcctgcgtggccagctgtgaagccaggggcagcacaagcgtagagagcgcgtgaggatttcattgtaatggggggaacgacatgcgacgtggcttgcaggctcagtggatgcccaggatgttgtgcttcctctcaagattggatgggagacacaacaactttgtgacccatcatgactgcggcaaggccccacgagaaactnnnnnnnnnngaggatgttgtgcctgctctcaagatcggatgggagacacaacaactgcgtgacccaacatgactgcggcaaggccccacgagaaactctcacggcagcctcagtcgcaccataaatctacctgcgtgtcttcctccagctgctcctggaccctcagcgcctccctgagtctgagttccgcctcgtgctgtgctgcctgtgtgggaagagacgatccatgagtgtggcatgcgtctaggaatcagtgccagctttgccagcaggctctcctggacacttcttgccggacaccagctccgagcccggcctcattactttgcccccgtctggctcctccccaatgaatctagggggctatgcatacctctgactcctccagctcggcacggagctccatgacctgagctgcgtggtcggccgcagacttgacctcaagccggtgtagcgtctgagtgggagggctttgggggctgagggaggccaggcgcggagcaccagagaggctctggtcaggctttcatgcatgccggcatgaatcgcccccacacaagagcatggtgcaccgccaggtgccgcaagacaagggcatggaacgctacgcctcatcgcctttcgccccgcacctgtgcatggtgcagcgcctgctcgacctcgactacacgctgactcagcgtctccacctcctcctgcgcatcctccaggtcgaagttggcgtcccgcagctgccccagcacctttgaggtgtcctgcgccgtgtcacatgctcgactgatgctcactccgtgtggagagggcagtgatagaaggttgtagtcgccccagacaagcaggcaggtggaggagataacaggccggaaagtgcacggtcagccgggagataccttatgaccaccnnnnnnnnnnaccccagacaagcaggcaggaggaggagatgacaggccggaaactgcgcggtcagccgggagataccttatgaccaccagtcgactcccctacttctttttaaaagcaccccgcagacctcctccaccacccaaccagcgcaccctcacggccgcggcgcgcgccttctccaggatctccgtcctctcccgctccgcccggagcaggcctttggaggcggcggcctcccggcgctccgctttgagggcggcctccagctccgccagccggcctttggccgcctccagtgccgcctgcaggtccgccacctgctgcgcacgctgcgccgcctcctcgccgagcgccgctgcccgctggtctgaggcccgcagccgggtctccaggtccgtcacccggtgcgcgttcgcacggcgcacgcgatgcaacatgcgcgccctcgcccctccctcggcctcgccccggtcctcaggcgtcagggccgtgtgggtctggagcctaggcgctgccctgcgggaaatgacgatggccaacacgtatccggccaggacgccaagacccagcggctgccagggcaagtccagggggccagcccgcgtgacgatgctgcggggcccagcgtgcattcgctgcaatgagggcgggtgggggtgctggatgggtatgcacacgaccgagcgggggcaggcggggcggggcgatgggcatggggacccctcctgagcacgtccctgtcgtgnnnnnnnnnngtgagggcgggtgggggtgctggaggggtatgcacacgaccgagcggggcaaggcggggcggggcgatgggcatgggacccctcctgagcacgtccctgtcgtgcacgaggagacctggtctgcccatcgcagaccctcaaaccttaccctttgccgcatgagacgatcggaatgctgcagatgtgtgcgatccataatcgagggcgtccagactgggtgctggacagcccggctggctccccgacagccccacgccggcccggcgatcatggcagtcgccatgccgcgccctgatctattgtgtggtattggagtaatgacaccacatatttactgccataaggtcaggagacatgcacgactgagtggccggggttgggctagaatggagtggggcttggtaagggcaggtagatggagatctagggggccgccttcccttcagcacgccttgccctcgtgcaagtcgggatggcctcaggcaaagggggcactgcacctgtacctctccgtgcataggcctgtccaattgagtttgcacatcccctggcactgtgtgggtaccccccagatagcagcagcaagtggcaaggctgcgatgaccgaacgtcgaacaacgaataccctctattgcttgcgctggatcgcccgcagcacggccgagaagtccaggtcacccgccccgtgattccgtgcggtcagatacaagtcgttggcggccgcggccaccggcaggtactgcccggcgtccgatcccagttccagcgccagcctgagatccttctgctggtgcttgagcgggaaggcggggtcgaagcgctctgccaccatgctgggtccctgtttgtggacaggaggaagggctgtgggttttcatggccggcgtgccaccgcgagagggtggagtcggcagccagaccctagaacctgccatgaacgcctgcatgatgcagcagatcgcccccatactagtatgcccagcaaaaccatcctcctcctgccttgagggctatcatgggggatgccagcgccgactggttgaggatggccagaaggtcctcctgcctcagccccgcctccttgctcagccccaggccctctgccagcgccgccatcatgcttccctgcggtaaagcgtcccggatctctcggaccatgccacgccattctgcagctaattcgggaacgcaggtggcccgcctgtgctgccatctttccccccccccttccctcgctgccgctccctaccatgatcatgttgaccaccagcttcatcttggccgccgaccctgtctccccgaggtacacggaggtcttgcccatggcctcaaacagcggcagagctgcatcatgcagcttcttgtcccctgcgcagtttgtgtggacattggtgggtcgtgtctcatgctctccaccagagcaagttggagaagcttcccagcagcgttgatgcaggcaaggactgcgtcaaccaacccccttgcgacacctctaagtcgcccaacacacctgccgtcatgaagatgnnnnnnnnnncaggagaagcttcccagcagcgctgatgcaggcaaggactgcgtcaaccaaaccccttgcgacacctctaaatcgcccaacacacctgccgtcatgaagatgagcgtgccctgctcagccggacccttggagcccgacaccggcgcctccaggaaggaggcgccggcgccgcggacggcctcgccaatcgtgcaggaggtgccgccgtcgacggtggaggcgtctatgtagcccttgccccgggacaaaccctccagcgctccctgcgaccctagcgcaacctccctggcggcgccgggatccgacagcatgctgattgtgatgtctgcggcggcggtcacttcggcagggctggccaggacctgcgtggccgagtgtcggtagagggaaaaggcaggctgatgggtgagctcaggggctaggaagcatggccttggtgcaccagccaagtggtccttcggcatccatggcaaaggtgccccaggctcgccaaagggcagaccagggcgccactgggaggcacaaaccggtgatacagcgtctcaggtcccacgaactcccaaaatctcccccttctgtcaatcaagcggttggcagggccagcattgtgactgcaccgcacatccacaatggacacaccttggctcccccagctgccaggtcatcacatgcatttggggagcggttccacacgaccaggtcataccccgctcgaatcaggttgagggcctgcaagggcatgaagtgggtccaggtgatcatgcaggcggcatggccagcaactgatcgtcctaggtttgggaatgcatctgactgtaccctgtggctgcctcgtcatggacgaggcccaggcctgcactccatgtcccctgctccacgtagtccctcccacgctcccgtccaccctaccatgggcctgcccatgatgcccagtcccaggaacccaatgcggacatcggcagcatcggcgcgctgcagtgcacacgtcgacagggatcgagagcggcagggcagggcccggcgggggatgggtcccaggcatggagcccgcaggcggagccccggtcggcacccggcctgcacacccacggtcatgagcgatcgacggcacaacacggcgagccagataggggtacaaggtcactgccgtgctaatggagcaatccacagttggttatcatgctcccatcaaggatgtggtcccaggtggtcgcaggagcaggcaacacccttggccattgcttgcgcgctggagcatcggatctccaggcatcgcccgactcttcaatgtgacatgtgtggagtgcagtgcttacaagcccaactcaagcaagctccaagcaatgaaagaaggggcctgtggctcattccactgcagccgggggatttcatacaaaaatgaggcggtgctctcaaggggggagggaaggatggagggggggaagtgggctcggcgtggcgtccacttcacctcccctcgttctacactgctatacacactgccggtgccagcaggtcatactagttttcgatctcgcggtgcgcctcacacttgcagctctccagttgggtcttctcggaggtgcaagagggtgagtgatgggcggtctggcgaccctctgaagggcgagagagggcgccgctgccggcagggaccactggcgagctgcttcgcggccctgcgccgtgannnnnnnnnncaatgggcggtctggcgaccctctgaagagcgagggagggggccgctgccggcagggaccaccggcgagctgcttcgcggccctgcgccgtgagcctgcggggcctcccggccgggtccgctgcctccagaggcgcggtgcctcgccaggcgctcgaggcgccggagggggcctcgccagcacccggcgcgctcccgcgcccgggcacgcgcggccggccgccccaccccgaccatcccaccgctacttgcgcgcggcggcnnnnnnnnnncgcacgctgcctccagaggcgcggtgcctctggaggcgctcgaggcgcaggaggaggcctcgccaggcacccggcgcgcttccgcgcccgggcacgcgcggccggccgacccaccccaaccatcccaccgctacttgcgcgcggcggcggcggccaggatggcctcctgtgtgctggccgccaggtcgaacatgcgctccagcgcctccatgttggccagggtctgcgacaccgcgcccgggtctgcgccgtcgcagcgcagcgcggtcatgggcccgtgcagcagcttgttcacgatggacttggtcaggtcctccaccgccttcttctgcttgttggtcatgccctcccccagccgcgccagcgtcttctccagctccagcgcgcggatggcttccgccttgctgcgcagcgccttgatggtgggcaccgtctccaggctgtcgcgccaggcctcgaacgcggcctgctcccccgtcagcagctcctccgcctccgccgcagcacgcgcgcgccccgcgctgttggccgccaccacctcgcgcaggtggtccacgttgaacacctccgccgcgtcgcgggcgggggtcaggtcgcccgccacgttgcgcggcaccgagatgtccacgaaccggcgcacgccgtccagcggcgccggaggcaggccctccaggagttcgcgccccaccagcacctcctccgacccggaggcggtgaacaccaggtcggcggcggccaccgcgtcgcgcagcgtgggcatgagtcccagctggaactccacatccgggaactcggcggccagggcctcggcgcgcgccagcgagcggttgagcagcgtcacgcggccgcagcccttggaggccaggtgcttgaccagcaggcgcgacatcttgcccgcgcccacgatgcacacacgcgcggcggggaggcccggggcgggcagcttgagcgccgccagctccgcggccgcgctggacaccgacaccgcgccggcggagatggaggtctcggtgcgcacgcgcttgcccgccgtcaccgcctgcttgaacaggccgttcaggtggcggccgaagccggggcaggcctggcccaccttgtacacctgcttcacctgggacaggatctggccctcccccagcaccaggctgtccagtccagcagagacgcggaggaggtgccccgtcgcgtcgcggtcgcgcaggaggaagaggtgcgggcgcaggtcggcaagggggacgccgctggcgcgggacagccagtcctccacctcgcgcacgccgcggtggaaggacaggcccaccaggtagatctccagccggttgcaggtggacagcactgctgcctcctcgatgtgggggtaggagcacagctccgcaatcgcgcgcggccactccgcctcgggcaccgcaagcttctcgcgcagctccacgggggcggagtggatggtcaggccgatggcgatgatgctggacttcttctccatggcatagcctggcggaggggaggggaggcggggagaggggtgcggaggtgtgtgggtatgcgtgccagagggggggcagccccgaccgggtggacggcaagcaaatcgagcctcgacgggtcggcccggggcccnnnnnnnnnngcagagggggagcagccccgaccgggtggtcggcaagcagatcgagcctcgacgggtcggcccggcgcccaatgctccgaaccaacaggcatgtgcacgctacgagggcgctaatgaacgacctccagccccgccccggtcccactcacggttcagccccttggtggccttcagcatctgcagggcgcgctgggaggactggaggtgcgacgccggcaggcttaccgagaactcagcgctagaccgcacattgcatgccctgctccgcccaggccgggcctggcgcagggcagtgaatgcctgcggacaggtccactgccccgacacgccacacagcatgtcgttgcgggactgcagccccaaacccgcagtctgcatgactgatgccatgcacgtgtctatggtggaataaggaaacctaaaacgcagccacgatgcagggagtggggttggggctcggggcattgtctgcctgtgagggtgtgatttgtgatcaggcctcggccggggtcaagcgccggaagattttgtcatggacccacaggattttcacgtcgcagattcgcatgcccgaaatctatcgcagtcgtgaagggaatgatctcccactcggctgggaattccatctgctcttgatgtatcggtggagcctttggaaccgtccgctctcgggttatgccttgcactgcttgtcgcggatgggtcttcaatgatcctacatccaagatttcttgcctcaggggggtgtccgcctccgccttctaccacagatcgtgtaggtgcttacatcaaaacgtataggtggcatgttcattgggcaacataaataatgggtcggctgcaggcgtgcaaggatcacggtacaaggggccagaccagctggcatctaaaaaaggtgggtagctcgatgggtttggggccagccatccccgcactcggggcggcggcagtgccgtagacctcccaccctcaagaggaggagaggaggggcgtgcggcagtcgtcggcggcgtgctctgccgcccggatgatgctgccggcgggcgcgccgcgcttcccctctgtggcacgctggcgccgggcggcgtcctcgccctctgcgcccgtgccgtgcgcacccagccagtacatggtgaggcagagcgccgccaccccctccagcaccagcgccagggtcagcaggcggtggtgggagcaggcgaagacgcagaggtcgtcgcgcagggccaccagcccctccggcagccaagaccaggctgcctggcgccggcaggagcaggcccccggcgcggcgtcgggggcctggcgcccgacgccgcgccgcagcccctccagctccctctcggcgtcgtccaggcgatgcgccgcccgcagcatcaggcggcgcgggagctgggcctccagccccaccttcctccccccggccacgcgctccgggtccgccaggcggcgcagcacgtccagcacctcgcgcaggagatccactgcgtggggtgagcgggatgagggggaaggggtctggaaggagccacgcttcggctatgcgattaggcaagcgctgatcagggagcggtggacgtgggacggtgggatgcagtgcactgcaaccgccaaggcccggctcaacactccnnnnnnnnnnccaggcgagcgctgatcagggagcggtggaggtgggacggtgggatgcagtgcaatgcaaccgccaaggcccggctcaacactccacaatccagcagactccatggcgtggccgaccaggacttcattaccccttgcaaggggcctcacttccgtccgtacccgtgatccacccacccaccccctcccaaacacacagacaaacacacctgtgccctgcatgcgaaggtcgatggcagagtatgccctcctgccatcctcggccccgcgctggccctccgtccgatcgtggtggcgcatcgcggcggccagggcggcccccaggccggaggggccagccagtctagtcccgggttccaggccccaaacgccagcggccgtctcggactcgccctgcagagctagtgccctgggcagcgacgtctccaggggcagggaggccaggatgtcggcgagctgctgggcgcccaggctgctctgggcgcaggcgcccaccaggggggccagggcctgaagggactgcacccccagcgccgacaccagaccgaccccggtctcgcactcggggctgcgggttttggggggtggaggggagggtgtgagggctgggttagagtgggattcctcctcctttgcatgggaggaacgaggtgcctgggcatgcaggatacacaccacacaaaccagtacccatcctgacctccgtgcaaccactccacataaattcgagcactcaccagagacatccgtggagctggtgggcctggaggagggagnnnnnnnnnncagagtgggattcctgctccttcgcatgggaggaaggaggtggctgggcatgcagaatgcacaccacacaaaccagtatccatccctgacctctgtgcaaccactccacatcagttcgagcactcaccagagacacccgtggagctggtgggcctggaggagggagcaacagcgctccaggccggcctccccttccatgagcctggagctgcaggcgtccagcacggccgaggaccgagcacagagtccggcgctgaccatggggaccagggccatgatcgcagcacatgtaaccaggtacggtctcgtttgcgccatgtcggacaacctctcacgggtgataggtcgagatcgcgcgtaagtgcctgcggtagatgcgagatcccgtgtcgggccgaagtgcacaaggcgaatcgcggcatcggtacatgtccagcgtacatttattgggtatggattgtgcatgttgggcgagactcaatgtgtccagcatgttcaagaaggagcagcatatcctacctaggccgagatgcagcctcggatcctacagatccaggacctcaagnnnnnnnnnnaattgcgcctgttgggcgcgactcaaagtgtccaacatgttcaagaaggagcagcatgtcctacctaagcagagatgcagacctcggatcctacagatccaggacctcaagctatcgaggactagagatctataactttgtaagaagatatcggtgttgttttcctctggtatgggagagacacaacactcacggcggcttactcgcaaacattgaagtgcgaacgtcagctattgcttacaaagaaagcgggaacttgcgaaaagttcccgggttgcattctaaannnnnnnnnncggcgcatatggcacccagattcgatgtacacaacttaaacagctgtatctacttcgacagggtcttcgtacttgttcgcccttggaccaaacctgagaagaagagcgacgcgctgttaccnnnnnnnnnncttgacttattacataagctggagcggcaacctacccaaactaaaatgttttcctcagatttcacacattactggaactatatataggtcagacttcttctgatgaatacactcgcaattattctgctggtggcaaaaggggcatgcagctgctgatcagagctgatatgtnnnnnnnnnnagtgtcctattacataagctgaagcggcaacctacccaaactaaaatgttctcctcagattcgaacattgctggaagtatatataggtcagacttctgctgataaatacactcgcactttttttgctggtggcaaaaggtgcatgcagctgctgatcagagctgatatgttggtgcatatggcacctagattcgatgtacacaactcaaatagctgtatctacgtcgacagggtcttcgtacttcttcgcccttggaccagacctgagaagaagagcgacgcgctgttaccattcccaggggccctgcgaagatgtgagcatttgcggccagggcgggattccagatgcgacggtgaaccattgagcagaggcactgagagttgggaggagcacctcctctctcacttgggccggccacccaatgcgtaccatgaatgttgctctgccttcctgtagtgaatatgggcagtttcacaattgcactgtgcgcagtccatgaccgaaaccacttgggcgtgcacccctcggtcgcttccaagacgggtgattacctgctgggaaccagtgtactgcccaatagtcctgcacaccaatgcttgctgaaagagaggcaaggacaaactgagaccaacctgcttcgggccagactgaacatccatcactcagatatccatgccaaagagaaaaatgatttagccattctcacgtgacactcgcaaatattcccagtgacaaggatatccatggctgcagatgtgagcactgatgtaaatcctattggcattctggacaccgattcactcctccgacacaaagattggcnnnnnnnnnntagtgacacgtatatccatggctgcagatgtgaacactgatgtaaaccctattggcattttggacgccgattcactcctccgacacaaagattggcgtgtgctaggtgtttattcctcgagttccagtcacgcatgatccattcctgatatcctcaaacagcaaataaacgttctttttggtttagaattctgtcaatataattgcagtctagaagtacaggtgtcgaccgaaccaccaccacagcacactgagcctccgccgctgagagcccgtgacagggaggctcgggaacttggctgagctgcaagaagtacttgatacatctagacgtctgactgcgctaccttcaggccccacccatcgagctgggatgtcgtgttcaaaagctgtcgtgaaggtggcctctgccctcaggaggcggtgcgagcttgcacacccctccgtcgccctcagcggcttgaccatgagcgatatgagggctggattgtcgcagaggcagcacagcagcagcctggcaaacattccggatgcccgagtaaaccccgacggtgtcagggccattgctcgcaacctgctgctggacacgcttcagatggtgagtacctggacccccatggcgctagcttggagtaagagccgaagcaatgattacagtccccagcttgaatgcacaaggggtgagggtggcagctggggtgctccctgtcctagtgccaaccgctcgatatctgtgccaaacattgaccgagacccttggtcacccacaaaacatatgcagatgaggaagttcgaggcctctggcatgagtcgggagcaggcagagggcttgactcagcacctcacccagatgctgtgtcaggatcgtgataagctggctgacctttatgtgaccaaggaagtgctgaagcgggtgcgcagcgggggtgtgaatgggactctgatcaccagtttaacgcttgctgcctgtgctgggtgccgcctcaagtctgtcaccctcacaacgcttgcacattgcagagcctgttagagcacgaggccaacatcgctggcttccgagcagagctgctcaagagccaggaattgcaggccgcctccttcacacgagacactgagcggttgcaggacggcctggagaagatccggtctgagatcaggtgagtgcctgcacctgtgcgaggctggcgggagaggaatctgcaagagccctgatcaaaggagttggatgcacctcctaaggacccatcgcatgtatctgtgcttcgcgagcgatccccttgctcaaaggaaagatccagttggtgagcattacctcttacatcccaatctccaccttgctgcctttgaaagaaattgctccatgtccaattccttcaggtatgaggttgacaagctgacggcaagtcaacgactggatcttaatcttgaaaagggcaggatccgggatgagctccagtccctccgagatatggccacagaaatggaaatcaaggtctgctgggcggttggctgtggttgcagtggatgggcaaggagaagaaaaggcttcaagggtttgtggctagggagaccagtgatctcccttcccccacggnnnnnnnnnngaggagaagaaaaggcttcaaggttttgtcgatggggagaccagtgatctcccttcccccacggtgaatacccccccgcccaaagtcttcactctgcatttgaaatgcaggtggataaggaagtcaactccttgaaggcggctatggagcaatccaagaacgataccgtaaagtatgtgctcggtctgatgctggccctgatgacggccgggctgggggcagcgcggctagttttacactgaccgccatgaacgcgtacgtcgtgacggagagaccaggccacatggcgatcgcacattggtttgcatggtacctcgcgtaatactcgcaaggctgaggaagaagagagacacagccgtgagataagcacgcaaacccgtggccgttagggcgccccagtaacacccgaaatagtcgcggctgcagcgcacatgtcgtgagccagaccctgcaaactcgatttaatgtatccatgtatccgatcaagtgtctcgaccaggttatggtggttgtattgtaccctgcatgatgtccacattcacggtttgtgtcggaacctgcttgccaggtcccgcgcaatgagacgacctgcagagagccggatcaaggaagggcccagagccttccaaacactataattggaagggcgagggccctgggttattgtccactatctcaccacgccatgcagagtcgagaggctctgaatgctgggaccagtggctcacccgaaggggcccagccccccctccgttatgccttccctagtgcccggggccccacgtcccacaaccgatcgagcgctttgataaaggatatggatgccctgaagcaacgtatggcaaccgccaaagctggaacgggggaggtggcagcggtgctctcctcggtcacctttcagccccgggcggcagccttcaccagtctgatccaggcaaccagcaaggccaaagccacggagaaggcgctagagcttttccagtgcatgcaggacatcttcggcatcccccctaacaccttctcttcctctgcgctgatctccgccctggccaagtccgggcagtgggagctggcggagttttacttccacgacctggtggcacgctcctccaacgacccccgcagccggcccaacaccgtgaccttctccgcgctattaaatggtgcggcaatgtgtgggagggggcgtcccgatcctccgcagctgccctggatgcccctggggaggggcgcctgccgcctgcctcgtcaggcttccctgccgtcgaggggttgcggctggtcgacgtgctgccttctgctcgctgggtctcaactcctcaatcgattgtcgatcacgagcggcggcgtgctgctcgatgccacggctgcccagtctccgattcccatcctgtgcagcatacgagaaagggggccagttcgagaaggcgctcaaagtcttccagcagcagctcgatgccaaggtcgacccagacctcatcacctttggcagcctggtctcggcctgcgaacgcgcaggtgcagcctcccggcggagcctggctggggatggggagggtgagcgccgcgcgtcgcctgcccccacgggcttgtcagccgtgcagtgctccaactccaaccccacccgacaccgccgccccgcacaggccagctggagacggcgatcgccatgctggacgtcatgcacaactttggcctgtccggcacgcagcagatgtacaacgcggtcatcgcggcggcgccggactggaactcggcgctcgaggtcttcctcggcatgcagtgcgccatggtgagcggcgtctgcggccacggcgtgagggacgtcgccccctgccggctgcatggtgttctccgaaggggcgcgtgcctcccctgctcctcacctgggaggcacagggcccccattgcagtcctttgctgacccacagcacctgcggcctgcccccggctgcgccccagggtcaccatgactcagcagtcaaacccccctcccccccccaggtggagccgaccgtccagaccctgaactccaccctgacccaggccgcggggtcgggaagcatgcagcccatcctggacgtgctgctggccgccgggcagtgccacgcctcgctgacggccagcacgctggcggcggtgcgccgcgcgacgaccgcgctgggcggcgaccgccagctggcgcatgtcctctcctcgctgccctcaggccttttcaagtgacgcccccgcagaccacccctcctccagccccctgctctctctctccctttcgctccgagatgcgcaaccctcaagaccctttttcaacgccagcacacagcttgatcccccccccccctcaaggccatgcatatgtgtgtttccgggtgccggttcctttgccccatacccccaggcccttcaccccttttccctccccaggaccttctttcattcgctaccccacccagtggggatttgccaaacaccaggcggcgagtgcccctttcccctgggctcatgccgtgcgttttccagaccctcttcaattctactgatcacgaacaagtcccttgtagacagctgcgcttggcagctggatactcaagctcttcattcattggttgcatttgttttttcccaatccctacccacactccgatttgctctctcccttccgtggcccatgcgccacctccagtaagccacgtctttgtccggtggagagggttaaaggcattggatgggaggatgggacggcgggagggggtggctgggtcgtcaaccggaggacggtgcgcaggagtgtctacagaggggtgggggggagtagcatcatcttccatcagcgaaggatcgcatcgctgcgcgaccccgggggtttgccacttgggctccccggcgcagccacggtgttcaaagggaaatgaccagggcgcatgggcattccgcactgattaatcttgtctgagccggctgtcgacgctcggccgaacctggagtgggtagactctgcgctttggagtggtattgccgggttgccagcagggcaacgagatcgaacgccctccccggccaacacacgcatcctcggtccggagggtacatggtgagactaccactccgagtttacgaagaagtcggcgacatggcgatggccagggcatccaccgggtgactctggagccggggctcctcagccagaagctgcgctggccctggaacccactccaacctcacggcaagccgtgtaaactcatactttgaggtaattacgcggccagacttcctttcgagcgcggctgtgcatggcacagcggtggcgcaaggccccgctggccttggtggtcctgctgagcattgtcgccctcgcgcagaatgccaccatcgccaacgatggtacggatgtataatggagaggattgggcctggcgctgcgctggctgggagggcgggcggcccggtcccgcatgagcacatgcctgcgccagggttttctctcagccccggcctgcccgtccccctctccacagccgcaacgctccaggagttcgctgcatcaatagagaactgggatgagttcagcacggcaaataattatgtctggaacagctccctccccacctgcgtctggaaaggcgtgacgtgctccttcgcaggccgaatccaagcactgtgagttcgtcgttggtggggctgggagggccagcattattctatccacacctcccaggctggcggttgtctccggcgcataccggggtctgtggagtgtgttgggggctcttcctcatatgagaactcccagccccgtcagctgggacgtgggcaccagctcctaggcgaccccatgatgccaggacagccctgcgttgggcctgccctggctccacaccatcatgggccccccttcccaccccccaccccccttgattagccctggatcctctgccgttcccacccacaggaccctgcaatgcagcgggtgcagtgtgcttgcggagggcaccgtgccggcctccctctcccagctggacgcgctggagaccctgaatctgcaattcaacgagttcacctcctccctgccggaggagtgggggacctcgggcgcattcccggtcatgcggaacatgtgcgcgaggcactcgttgtttgctgggggtagagtggggccgcgcaatggcccacaggaaatgaccattgcatcctgccatgcgcactggcacaccctgcaggggctaggcgtttgctgcggcatggcgacctacaggcggggatccacaccgtcgccgcaaccctgagcttgccgcaaccctttccccctttcctcctttgcttcaggttcctgagcaataacaacttcactggcacagtgccggagagctggggggccgagggggcgctgcctaacctccagctcctgcgcctggactccaacgccctcacgggctccttgccggcctggaacgcctcctccctgcccgcgctcctcgtcctgtgagtcgtggacgctggtgtcttatcctcaccagatcgcatgtgccatgtggagtccgggggaggggcacgccgcgtcgccctgcaataccacagctgggtgggtgcgcaccctcgtggccatcccttttccctgtggctgccgctcacccgcagatgcccccccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtccagatcctgagtctccagaacaaccggctgacggggacggtgccgtcgagctggcagtttgcggggctgcaggagctgtacctgcaggacaacgacctggaagggggcctgccctccgcctggggctccaatggtacctttgccagcctccagatcctcatgctggacgacaatgacctgggaggtgaggccacggcaggtgcatggcgttgctgggctgagtagaagaaggatcctgtgctctctggggcatggcgcgcggtcggcgtacgtcttggtgctgtgtcgtctcatgtttgtgctgaaagagatcatggttagcagagggaggatgcagcgcgcgagagcctgtcgcgaggtttcgatgccgcgctgtcttatgcagttgggccttcacaagtgcggcatgagtcccaacccatgccccgtcccgatgctgnnnnnnnnnnggttgctgcgctgagtagaacaaggatcctgtgctctctggggcatggcgcgcggtcggcgtacgtcttggtgctgtgtcgtctcatgtttgtgctgaaagagatcatggttagcagagggaggatgcagcgggcgagagcctgttgcgaggtttcgatgctgagctgtcttatgcagctgggccctcacaagtgcggcataagtcccaacccatgccccgtcccgatgctgcgtgcagggtcgctgcccatcagctggggcctggacgaggcgctgcccacgctgcgcacgctgtacgttggggaaggagggggaatgtgccgcggaagggggtgggggcccccgggcggcacagagggactctttctccctcacatactggctgccagggacgctcgtgctggggccgcatgccaccacttcagaagttcctcctgcgtcggctcctggccccaggtcctcgccccgtccgccctgcccacccactcacaacccccctccccgctcctccctaaggtcgctgagcaatgtgggcctgagcggcactctgccctcggagtggggcaccggcacgggccnnnnnnnnnncgccaccacttccgaagcccctcctgcgtcggctcctgcccccaggtcctcgtcccgtccgccctgcgcacccactcacaacccccccttcccgctcctccccaaggtcgctcagcaacgtgggcctgagcgggaccttgccctcggagtggggcaccggcacgggcctgaactcgctgacctcgctggcagtgcaaggcaacgcgctgtccggcttcgtgccctcctcctgggcgcagctctcgtcgctgcagcgcctggtcgtgcgccccggaaatgaggagctgtgcggcccgctgccgggtggctccgccttcgtggtctgctctgaggccggcgccaactgcacgcgcaggtctgggggccggcggggatgttgtgacaaagggggggtggggggtggggactgaacaggctagcagtgctgtggtatgacttgttcccgcctcatcagccctcagcgacctcccccctcccacaccccggtctcctcacactccatcgcagcgactcggccttcaccggctcgtactgcgcgggcctggaggccaccccgccgccgcccgcgtcccccgactcggggaccggcagcagcttcccagtggccgccgtggtggcacccatcgtggctgtgctggccctgggtgccgccgccgcgctgtgcctggtgctgcgccggcggcggcgccgtgccgccgccgtcgaggctgacgccaaggccgcgcaggtggcggccgaggcgcagcgcatggacctggccctgggcaccggcgggcacccgttcgacacgggggaggggcagcgtgcgtacacctcccccttcctctccggcatgccccccgggggcatgcagcacatggtgcgcaacacggggagcagcgccggcagcttccccggcgggtcccggggaggtgccctgcgcacgccgcactcctcggggtcggagggcgggcacacgcagggcacgcggtcgcaggcgccctcccagggcacagtgggggaggggacgctggccggggccagcttcggcgcggggtcgcagtccatgagcggcgaggcggtgggctccccgctccccaccctcatgtccaccatgggcagcaagaacccggactggcccacccacatttccggctccgagagctccaaggccctggactccggcatgctcttcagcgactgggagatcttccccaacggtgggttggtggggtgggtggagggggggtgggggtgg

SEQ ID NO: 29923 - DNA, 76 bp, Chlorella protothecoides
gattgagagtgctagctcatggtgatgcggagttgacacatgccctgtgaatggtatagtggctatcctggccggc

SEQ ID NO: 29924 - DNA, 99 bp, Chlorella protothecoides
cggccaccgttctcatcgctcacacgcccacgccctggcgagctccctccattttccgcccctctaccgctacagggtggacccagcatgtgccaaggc

SEQ ID NO: 29925 - DNA, 113 bp, Chlorella protothecoides
cgagcgcgccccaggttgtcgcgccctgagaccaggctagaatgacaagcagggagatagattacatgcggtcagatcgcttcggtagagggggccagaggggctgcaacaat

SEQ ID NO: 29926 - DNA, 61 bp, Chlorella protothecoides
ccgcagtgatgatcttgcgtggatgttctcatcatgtgtctattggaccatagttcctgtc

SEQ ID NO: 29927 - DNA, 134 bp, Chlorella protothecoides
gccggggcgcctgcaggaaagcgcggcgcggggttgccatcgggtgcgcaggggtcagcgcttgagggccgtgctgcaggcgtgtggcgagggcggagcgggggccccatccgccctgtcggaccaatcaggca

SEQ ID NO: 29928 - DNA, 80 bp, Chlorella protothecoides
agatacaatggttaccacaataaaacaagttcgcaccccagggtcaggtgctagacgaatgggagggtgcggtcgactcg

SEQ ID NO: 29929 - DNA, 94 bp, Chlorella protothecoides
ccccggcgattcctggaggagggacgccaggaggtgttggacgccacacacctgcttttgctgtggccatgctttgtagatgaagccgtgatgc

SEQ ID NO: 29930 - DNA, 61 bp, Chlorella protothecoides
catgctgtgatttgctgtggcggtcggcagtgtttcctgcccccacgatcctctgtaatgt

SEQ ID NO: 29931 - DNA, 395 bp, Chlorella protothecoides
  modified_base (105)..(311): a, c, t, g, unknown or other
gcctcggccgggctcgcggcgccggcctgcagcgcgcgcgcggctggccacagcgcgcagagcatggtgcggtcgccctcctcggcgccgccgtacttgctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccagcacgcggcccagcgccagccccgcggcgcccaggccgccgtccaggcgcagcccgccgtcgcgcagcgcgcgcagcg

SEQ ID NO: 29932 - DNA, 77 bp, Chlorella protothecoides
tcataacggtcgccattcctcacgcctggatcatgccattgacagcgagtgacacgatgcaggctgttaggcagttg

SEQ ID NO: 29933 - DNA, 258 bp, Chlorella protothecoides
aagccacaactcacgttggtcatcctttgacgcttcccttctttcattggtgcgccaggctcatgggaaaacagagactccctcatccgtgaaggttcccgcctcctttcgatgcgttgcatgaatgtataggacaggtacattttggcctccttgcacgttccagctagtcggcacatactttgggtattgagaagctagtagcagatgtcgtgatgcgtcagcaaaaccctcagcagtggatgcgctacctttcca

SEQ ID NO: 29934 - DNA, 61 bp, Chlorella protothecoides
ttgaatgctgtctccagtgtctgtggagggtgggacggtgtaagggttcgcaggcggcagc

SEQ ID NO: 29935 - DNA, 61 bp, Chlorella protothecoides
ggccatgcaggaggccgtgttggcggacacacagacagcctcttgggtcagcggcgggaca

SEQ ID NO: 29936 - DNA, 104 bp, Chlorella protothecoides
cctgccataacgtcactgtgctcctccggcacccaccggcacagattcggaggcactgcagcctggcagtaatctgctggtcaagctcgaaggagaaggtgagt

SEQ ID NO: 29937 - DNA, 115 bp, Chlorella protothecoides
cacgtttgaagatcaggtgtgtggaatccgctgggtgctgagaatggccattcctggtgtctagcgaccaggggggtggagttcgtgactgccatgggtgcggctgtgtataggt

SEQ ID NO: 29938 - DNA, 61 bp, Chlorella protothecoides
gagggctcaggagggctcaggggcggggggtgtagcatgcttcacactctgtgtgcgagcg

SEQ ID NO: 29939 - DNA, 72 bp, Chlorella protothecoides
tctgctgtcagggcaatcatactctgcgcggaatcaaccaaacaggacgtctgcgaatgttgcgaggcttgc

SEQ ID NO: 29940 - DNA, 149 bp, Chlorella protothecoides
attgtggattatgcagacgaccagacctataagcagagccagacgttgcaggcaagcagggctcgaggagattttgtctgctggtcggtcatggccccgcccttgtgccttgtgcccacccacccaatgcctgccactttcatctaccc

SEQ ID NO: 29941 - DNA, 61 bp, Chlorella protothecoides
cagcaggaccattgacaatggatgccgagggggccagccacatccgacaggatgtatgggt

SEQ ID NO: 29942 - DNA, 20870 bp, Chlorella protothecoides
  modified_base (159)..(325): a, c, t, g, unknown or other
  modified_base (420)..(429): a, c, t, g, unknown or other
  modified_base (1178)..(1187): a, c, t, g, unknown or other
  modified_base (1568)..(1636): a, c, t, g, unknown or other
  modified_base (1924)..(1933): a, c, t, g, unknown or other
  modified_base (2244)..(2253): a, c, t, g, unknown or other
  modified_base (2612)..(2621): a, c, t, g, unknown or other
  modified_base (2692)..(2775): a, c, t, g, unknown or other
  modified_base (3333)..(3342): a, c, t, g, unknown or other
  modified_base (3419)..(3428): a, c, t, g, unknown or other
  modified_base (3696)..(3705): a, c, t, g, unknown or other
  modified_base (4237)..(4246): a, c, t, g, unknown or other
  modified_base (4492)..(4501): a, c, t, g, unknown or other
  modified_base (5742)..(5751): a, c, t, g, unknown or other
  modified_base (6238)..(6247): a, c, t, g, unknown or other
  modified_base (6363)..(6372): a, c, t, g, unknown or other
  modified_base (6656)..(6665): a, c, t, g, unknown or other
  modified_base (7305)..(7442): a, c, t, g, unknown or other
  modified_base (7564)..(7573): a, c, t, g, unknown or other
  modified_base (8810)..(8819): a, c, t, g, unknown or other
  modified_base (9341)..(9350): a, c, t, g, unknown or other
  modified_base (9439)..(9515): a, c, t, g, unknown or other
  modified_base (9613)..(9622): a, c, t, g, unknown or other
  modified_base (10146)..(10155): a, c, t, g, unknown or other
  modified_base (10542)..(10551): a, c, t, g, unknown or other
  modified_base (10630)..(10689): a, c, t, g, unknown or other
  modified_base (10751)..(10760): a, c, t, g, unknown or other
  modified_base (11433)..(11442): a, c, t, g, unknown or other
  modified_base (12485)..(12494): a, c, t, g, unknown or other
  modified_base (13432)..(13441): a, c, t, g, unknown or other
  modified_base (13623)..(13632): a, c, t, g, unknown or other
  modified_base (14007)..(14016): a, c, t, g, unknown or other
  modified_base (14830)..(14839): a, c, t, g, unknown or other
  modified_base (14995)..(15004): a, c, t, g, unknown or other
  modified_base (15534)..(15543): a, c, t, g, unknown or other
  modified_base (16038)..(16047): a, c, t, g, unknown or other
  modified_base (16297)..(16306): a, c, t, g, unknown or other
  modified_base (16874)..(16883): a, c, t, g, unknown or other
  modified_base (17748)..(17757): a, c, t, g, unknown or other
  modified_base (18083)..(18092): a, c, t, g, unknown or other
  modified_base (18806)..(18815): a, c, t, g, unknown or other
  modified_base (18908)..(18917): a, c, t, g, unknown or other
  modified_base (20338)..(20347): a, c, t, g, unknown or other
  modified_base (20448)..(20698): a, c, t, g, unknown or other
gcgccgcgcggcgacgagggcggcggcgaggcccagggcccagccctctcgcccgccgacctggcgcccgaggccctggccgccgcctcgctggaggccgcggagcgcgtggtggaggcctgtcgcggccagctggccggcggcgccaggcgctcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgatctcgcgccgggcccgagcacgggcgtggaggagcctgcgagcccggatgccgccgttgccgccgcccagcgcagccgcggcggcgtgnnnnnnnnnngatctcgcggcgggcccgagcacgggcgcggaggagcctgcgagcccggatgccgccgccgccgccgcccagcgcagccgcggcggcgtggactggggctccgcgtccggccgccgcctgacgcgcctgatccagagctgcgtccagacgctgctgctgctccagcgcggcaccaccgcgcccgtgcccatggccgcgctggcggccgcgttggacgtggccatcgccggggtccggccccacgcgcccgccaacgaggggctgctgacggaggtgcggggggcgctgtccgcgctcaagtcccagatcctggcgcctggcgcgggcggggcggggtgacgccgcgctgccttttcgccgctggcccctcgcgccacgacatccgaccgaccagaccctccaggggatccccggctgaccccttcccctttggacgcacacccaccttgacccaacctgtcgctattcctgcaaccccaggaggggcgccttactcaggtccctgccccttctccaagtcacatcagccctcagcgccggctggcgatgaggggcaggggccatccaatcactacaccacccacacacactgacgcacatgtgatctgagctgcgcagcctgcggcggccattcaacttccccagttcccaagatgtgagtgtgtccccacgataccggtaacgaagatgttattgacagcggggtctaccaagggtcacaggcatgccgacggctgcactgcctgcannnnnnnnnncacaccacccacatacactgacgcacatgtgattcgagctgcgcagcctgcggcggccatgcaacttccctagtccccaagatgtgagtgtgtccccacggtaccggtaacgaagatgtaattgacagcggggtctaccaagggttacaggcatgccgacggctgcactgcctgcagagcttgctggtggaagactccaacccatcaggcggcttgctggaaggggaggaggttgccggtgagaaaatgctgcatgatgggcagccgagacaagacttccgcctggtacatcttgatcatgccggcgttgacctggggtgtggcgggggatgccaggcctgagggagggtgggtgggtgatgctgcggcgcctgctcaagnnnnnnnnnnnnnnnnnnnnnnnnnnnnnnnnnnnnnnnnnnnnnnnnnnnnnnnnnnnnnnnnnnnnngcaagctcatcccaaaccctcaacaaaacacccgccccaggcccaccctggtccaggagggcaagcctgagatgtcgttcagcatgggcgaggtctctgccaggtggcccttcttcacctgacagagggtggggcagacaggcacaccgtgtcagcacatgttccgtggcaggagatcccccccgcagcatccttgcggcatgaaagtggaggaatcgacaccccacaaacacaaggaggccctaggctgtgctaccgagcctcactgtgccctttccctggccaggnnnnnnnnnntagacgggcacaccgtgtcaacacatgttccgtggcaggagatcccctccgcagcatgcttgcggcatgaaagttgaggaatcgacaccgcacaaacgcaagcaggccctaggctgtgctcctgagcctcactgtgccctttccctggccaggagggcttgcctgcttcacaaaggccaccgcagacaggtacatgtactcctccttcccatcctgaagcaccgcagggttgtggatgctccccggtgtaatgtccccatggtccaccagctgcagaggaggggatgcgagaaagaggatcagggtccctnnnnnnnnnntatgctccccggtgtgatgtccccatggtccaccagctgtcgagagggggatgcgagaaagaggatcagggtccctggctctcacctgcagtttcacggcagtggtcgggtgcgaccagcacagcaggttgtttttggcaggcatgtcgcgcacccgagagcccctctccaggcatgcatcgggcaggaccggtgaggatggatatgactcctcactttgcctcgacatgggccccaccagagaatacacagagcagacatccctgtgcacacccctcaccgcacctgtgcggaaccccaaaggaaagggaggatttggtaatcgtccaggccccaaaccccatgcgacccggcgggcnnnnnnnnnnacctcctcactttgcctcgacatggcccctaccagggaacacacagagcagacatccctgtgcacaccccnnnnnnnnnnnnnnnnnnnnnnnnnnnnnnnnnnnnnnnnnnnnnnnnnnnnnnnnnnnnnnnnnnnnnnnnnnnnnnnnnnnncagaagaggaggccagcaaatgtcgtctcatgccctaaatcgtagagagcgatctggtgtccacttcagggtgctgtagaatggtgcgtcgtgacgttgtacacactgctgggcaaccaaaggccgctgaatgcacatctggtatcaggtgtctgaccggtgggctgccccacacattccctcacacctgtgccatagtctatgcgagtcgagtttccgaagctatcctgcaggtaggacaccagctcgggaagggcagcagcttgggcgcctgacaggaggggctctagaagctgcggcgcagctgagcgcatgccctccatccagtccctgcagaacagtggtggtcggggtgggaagtggtcgcactggcacaagacacgcaaccaaaccatacattaccaggtggccagttcactgccaacatgcgcatcatccctgcgtgcctgaacgcggggtttccatatcgcagggatcgctcagcgggggggtgggaatccacgaggcgctgtagagatcccagaatttccagcagggcttcgatcgcgggactcctcnnnnnnnnnnaaagctgtcctgcaggtaggacaccagctcgggaagagcagcagcctgggcgcctgacaggaggggctctagaagcnnnnnnnnnntagggatcgctcagctggggggtgggaatccacgaggcgctgtagggatctcagaacatccagcagggcttcgatcgcgggactcctctgtggtgaagcgagtacgcaggtgccgctgaagctgacagcattcaatggtggcagacgacgtcggtagttgtgagatgcctgcatcaaggacagagcccagcctgggacatcacaaagcatggagtggatggcttccctcctcaccctctgacttgatgtcagactgcgacccagtgcnnnnnnnnnncatggctcccctctctcacccgctgacttgatgtcagactgcgacccagtgccgcctgattgaggcacagcagaaaccccagaaagctggacatggattctgacttgaggaactgctccagagcatccagggacagtatttccttgcgagcagcaccccacgcgaggtcttctgctgattcgggtaatggttcggggaagcgggcgctcgccctgatgacaacgtccaggcgtcgggtctctgacttggaccaaggtgcatgtgtggtggacgactctttctgtcttgcagtctgagatcccggcacagccgctgtagcccacggcgcccgggtgggctccatgcaggatgaaggcaacgcccagccgacagagctactggtgtaggacaggatccatcggcatgctagattagtgacacctttatcaattcgatctctgaataatatctcaaacctgatcctgcagcacctgatgctctgcaagcgcagttactctgtctgtggaatgcggactgtgcgcgcgcgcatctnnnnnnnnnntctttgtcaattcgatctctaaataatatatcaaacctgatcctggagcacctgatgctctgcaagcacagttactctttccgtggaatgcggactgtgcgcgcgcgcatctccgacacgcattgaaaggagtcgcgataccaagcctgctttgtccccacctttttgtcttcacagcttattgctgccaactgagtgtattctcggtacattaaattactccagaatgagcagcgatcaccacannnnnnnnnnttgccttttggtcttcacagcttattgcggccaactgagtgtattctcggtacattacattactccagaatgagcagcgatcaccacatcggtgtggtgctggaccgagtggccgcggacctctggtttgtgtacaaccagcttacaccgggagcgttgacccgcgtcggtcccctgcttcgcgacatctactatgatcttgatgcgctttccattgccttgctcatctgcctggcggtcgcgaccctgtgtcacaccatctcgaccctcacccggaaccagagcgtggtacgaaggtgtcagcgagttctgcgagtgcatgcactcctcgtccagcctccaagagctcatcctggacccattatatgcattacaggtggacaagctgtggagcattctgcccgtggggtacacctggcacttcctgtggcgcagccacctgagggacttgcaggggcagttggtggtggacccccgcctcgttctgatcgccctgctcgtcaccgtctggggctccaggctgaccttcaatttttggcgcaagggtggctacgcacttcatgcggaagactataggtgggtgattggcatctgaggggtatgcctgcgtcgatggcctggaagctatgcgccgtgtgattgagaggggcatgggcaagcgcgtcatgagcggcactcgttgcccgtgcaccctatgtttacttgaatagaatgatcagagacccacactggcaacttctcctctcctctccagtcacacctcacacctctcccatcccgctcgcaggtgggaagttgtgcggcagggcggttccggcgtcccagtctccatcctccccctatttaacctgttctttgtgtccttttaccaaaacattctcctgctgctcatcactttgcctgtctacgccgcctggcggcatgcgggcactcccctcaaccgaatcgatgctttggcattcctcctctgctctggcttcctagcgctggagactgccgcggaccaccagatgtggaacttccaggtaactacttcccaggagtgcgtatcgcgtggagtccttgtaatgcttgatgggtcgcccctgcacatctcagcggggggtgctggggccggcaccacagccctcatcaacactgcggggcatccaaggctgggctctctcatccatgtccacacggcatgtcgttgcaggtagcaaagcatgctaaagcagcagctggcaagcgtctgacaggcnnnnnnnnnntggggggtgctggggccggcaccacagccatcatcaacactgcgtggcgtccaaggctgggccctctcatccatgtccacatggcatgtcgttgcaggtagcaaagcatgccaaagcagcagctggcaagcgtctgacaggcgactatggccggggcttcctgacctcggggttgtttgcttacagtcgtcaccccaacttttttgccggtgagaatgctgatggtcaggctgctgccttctgcacttcacgccatgtactgccgtcagcacctactaagttcacaccctactccctcttggttcctatcaatcccacagaacaagcattttgggcttccatctacctgtttggtgtggctgcctccggctcctggatccactggagcggactgggtgtgctgcagttgattgcactatttcatttcagcaccaacctgacagaggacataacagcacggaagtactccaagtgaggatgcaggttnnnnnnnnnntctgctgtcagcacctacgaaattcacaccctactccctcttggttcctaccaatcccacagaacaaggattttgggcatccatgtacctgtttggtgtggctgcctccggctccnnnnnnnnnnacggtcgaatgaatacaattggctccatttgctcatccaccatgcgccttgcctccctcaggtacaaggcataccaggcgtccacctcgcgactcgtcccctgggtcccggggaagcccaagtggcgctgagcaaggcatgaccagcaagatttttgaggagtgcgctgacgtgcagcaatggatgcacattgcacggtgcttgctgtgtcagcccgggggcacaagtgaaagccgcttgccaccaattttggtttgaatagcacccttgactcacaaggtgcnnnnnnnnnncgctgtgtcagcctgggggcacgagtgaaagccgcttgccaccaattttgctttgaatagcacccttgactcacaaggtgcccatctcatgacgacacgttgttgccccatgttgatcctgatagttgagttcttgagaattgtttgccggttgacggaggaaaatcttggattctcgcgcacgtggcccatcaggccatcagattacgcagcggttcccaagctgcgagggcaaacggctccccgtaggccccgaacatcccttcaaatattagttacatcaccacctatttgacaaagggaaggcagcatcgcttgaaccccagagcctcgttccccggggcgaaaaccgagacacgatgcacttcgccggtacgtacttccggaacctcccattggccattgcataaattttgggcaccgatatacgtctttaggattgcatatgcatgcatgaaggaccccgcgcatgcctcacgctttccctccccatgcacatgcccgcagtgagcggcaagggcgcggtggtggcgcgtccctgcccgcgccctgccttccatgccatcagtgcccccagctgccccggcctgagaaagagtttctcggcccgcccgactccctcccagacacggggcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacacggctcgtccaatcctcttaacccctcccccgccccgccccgtcccgccccccaaaatcgtactcccaggcgtctcccgacacgcgtgacacccccaccgtccctctgggcggcgagnnnnnnnnnnactgccttccatgccatcagtgtcccccgctgcaccggcctgaggaagagtttctcggcctgcccgactccctcccagacacggggccccctgcccctggcccgggtgggtgatggctggtcaggggcattcagtgctgcgtgcttggcattgttaccccgtccctgaccaccctgcgccattgccctcggtccgatgtcccacctctacacgtctggaggccatcacccgagccccttgagaacacggctcatccaatcctctcaacccctcccccgccccaccccgccccgcccccaaaatccgtacccccaggcatcccccgacacgcgcgacacccccaccgtccctctgggcggcgaggaggggtatgatgtgtacgtctatgaggcggagcctctggaggagggcgtggccaagcacacgctgtccgtgtttgtaggggacgaggcgggaatgatcaaccgcgtggcgggcgtgtttgcgcggcgcggcgccaacattgaatcgttggcggtggggctgacccaggacaaggcgctgttcaccatcgtggccacggggaccgaggccacagtggccaacctgtgcaagcagttggccaagctggtgaacgtgcggtatgtggaggacatcaccgcctccgagcacttccagcgcgagctgttcatcgccaaggtggcggcgccccccggcgccactcgcaccgagctgcagcaggtggccgaggtcttccgtgcccgcgtggtggacgtggcggagcgcacgctgacgctcagcgccacgggcgacccgggcaagatcgccgcgctgcagcgcgcgctgggccgcttcggcatcgtggagctggtgcgcacggggcgcatcgcgctcaagcgcggcgagaacctgttcactgggccgcaggtgtaccgcaagcgccccgccatcagtaacgccgacgccggcgagccggtaaatgtggaggcctccatggacggcgacgtctacacctcctccggctcagggtctgctgcccacgaaggtgtgtgatgaggggggagagcgatgtgtgtgagagggggtgtcgaggttcggcgggcagggtgggggaggggttggtgtctgaacggccctcccttccgccctcctttggcctcattcctcgggcaggcgcctggcgcgcaagccgcacacacccacacacacctctcactctcactctcccaaacaggtgtttggaacgtgcgcaacgtgnnnnnnnnnnaaatttggcgggcagggtggggggaggggttggtgtctgaacgaccctcccttccgccctcctttggcctcgttcctcaggcaggcgccagccgcacccacccacccacacctctcactctcgctctcgcaaacaggtgtttggaacgtgcgcaacgtgctggacgcgtactatgagaacgagggcagcgagtttgagccctacacgctgctgctggaggtgcaggaccggccaggcgtcctgaaccaggtgcgagcagggttgggaatggaacgtgggacacggcatgacaggttgtgggtcgggccgtctggctcgtgatgcaggagccggggctcactcaattcgaccggctgcctgccgcccgccggcccgcatgcgcggtcgagtgggcgggagtctgggcgcaagggagggttggtgcgtccggggcttggtgtccgcgccaggatcgtgcaggccgaacccgcacaccccaatctcacctcccatttcctccttcccacccccgccgccaggtgnnnnnnnnnnagtgacaggttgtggctcgggccgtccggcttgtgttgcaggtgccggggctcacttgattcgaccggctgcctgccgcccgccggccnnnnnnnnnnnnnnnnnnnnnnnnnnnnnnnnnnnnnnnnnnnnnnnnnnnnnnnnnnnnnnnnnnnnnnnnnnnnntgaggggtactcgcgcatcaccatggtcgtccccggcaatgccgcggggatcgagaagctgatgaagcaggtgcagaagctggtgtacgtcgaccgcnnnnnnnnnnacgggcgtggtggcgcggcgcgggtacaacgtgcagtcgctggcggtgggcaacagcgagcgagaggggtactcgcgcatcaccatggttgtccccggcaatgccacggggatcgagaagctgatgaaacaggtgcagaagctggtgtacgtcgaccgcgtgacaaacctgaatgccaacccctttgtcgcgcgggagctgatgctgatcaaggtgcgggcgaccgccgcgcagcgcggcgagctcctcaacctggcccagatcttccacggctcggtgctggacgtctccctcaccacgctgaccatcgaggtgacggggaaggaggacaagatgcgcgctctccagtccgtgttggagccctatggtgggtcgtggtgttggggctgagacaggggggggaggcggaggaaggggtcggtgcgaatgtcggccagccacctgttcgggaggcagtgccatgggaggggacccaggaaggatggcgtggccgtctcacattcatccagccactcccctcccannnnnnnnnntgggaggcagtgccatggcaggggtcccgggaagaatggcgtggccatctcacattcatccagccactcccctcccaccggcccctccccactcgcctcgctccccaggcatcctggaggtggcgcggacggggaggatatcgctcgtgcgcgattcgggcgtggacaccaagtacctctcctcggtggcggggaacaaggtcatgctctagaatagcgccgcagggcgctcgttgggagaaaggcacggcgcatgcatggccagcgccccccatgcccctcccatccccatgcatgcggtgggtcgccatgccagagacatgttacagaagagaaatgcagcgaattcatcactctttgggcaactgaaggcgggcacagcggggnnnnnnnnnnggcgccgcagggcgctcgttgggggaaaggcacggcgcgtgcatggctagcgccccccatgcccctcccatccccatgnnnnnnnnnnnnnnnnnnnnnnnnnnnnnnnnnnnnnnnnnnnnnnnnnnnnnnnnnnnncaaagatcccctctgaggacaggcagggatggtccgggggagagaaggtgttcgacaggggnnnnnnnnnnaaaagatcccctctgaggacaggcagggatcgtccgggggagagaaggtgttcgacaggggcaaaatatgtctgctcaggcgcagccggcagtgccaggccgaggtacgagtgcacctgcgacgtcagcattcccttcaaaagctcaggctcaggcagaggcctgctccttcttcttcagctgctcctctgcctcctccgtggccttgttggggtgctcagacatcttctcaatcagggcccgcatcttcaggatgtagaacatctccaggtagcgcttggcctcactgtgctccagattggagatgtacttcctgttgtaatacgtcaaggggggaggacaagaggaaagaggatgggttgttcggtgggctgagggctgggcagcgggcctgtccggctcaatccacatgccggagccctgctccagtacaaatccccaagttttgctcaccagaaggtgtagacctggttcagcgtcatgagacggttggcgtagatctcccaggtgtatctgcattgagagaggggggagggggggaggagggaaatggggggatgttgggtgtgggatatagggatgaggcggcctgccaccggtcacactctgaatgttccaaagcagagtcttgcaaacatcagccctccctccccttcttccctcaaaaaggccnnnnnnnnnntcaaggcagagtcttgcaagcatcagtcctccctccccttcttccctcaaaaaggccaagcctcacctggagaagatgcgctccagcccccccttgctgatgcggtcccactcgtccggcttcttggcggtggcctcgaagaaatcggcaatgacgttggcggaggcctcgccgtggaaggggtcgatgtggaacccagagcgacggtgcttgatgatctcggccggcccgccgcggttggtagcaaaggtgggcaggccgcaggtcatggcctcaatgaccgtcaggccaaaggcctcgtacagcgcgggctgcacgaaggcgccgcgccggtcggcgatgaagcggtacagctcgccattgcgcacccggttcttctgcgcgttgatccagcggaacttgccgtccacgcgccccgaattcatgatgtccagcatcttctggcactccaccgcctcctcgcggtccatggtcttggacgggtcggtgaccccgcccacgatgatcaggttgaccaggccctgcaggcgctcgctgccggcgtaccactccgccagcccggtcaggttcttgaccttgtccagccgggccatggagaagaggatgggcttgccggggtcggacagcgtgcccatcgcctccttgctgttggggctgaacagcagctcctccaggtcggcgtgcagggaggtcaggcggcgcgaggactcggagaaggggaagtagatgtccgagtcggcgccgggggagacgatgttgaacttgggcgagtagatgtcgatgccctgagaagggatttgagggaaggagaggatgaggggaggcagggggggggaatgggggggtctaatgcgatcgaggggactatggcggtgcacgctgtgtccatgcccattggtcatgccagcatgtgtgaggcaaggaaagaagggagtgaggtcacaggagcgggggcgcactgattccctgccccagtgccaaagaatgccccccacaattatataaacttaagttgcctcacattcacgacgcggtagaggtgnnnnnnnnnnggccaaggaatgccccccacaactagataaccttaaattgcctcacattcacgacgcggtagaggtgcggcatggtgaaggactggtacgattcgtactgcccaaccatctcatcatgcccagcaatctcctgtgagtgttgagcggacattggatgtgcggatcaggactacaggcaacattccaaacgattatttgggaggccgcaatgcatccctgttggtggtgagcagcccaaggcacacaggattcccctgctccccctgcaaggccaagacaaccctccgtcacctggtaggtggaggtgatgatgaagtccgaggtgttcatggcgataatgtcggctgtgaactgacaggagaagtggtacttcttatccatgctctcccagtagatgtctgtgtgaggaggttgaagagcgcgtatgagtactgcaatgggtcgctgagcctccgcatgatccgcagccagccacccctaataaactccgaatccctcctgcactccaccacttgcctgcatcttcgtacttggtcttctccagggcatgcgcgatggtgcactgggtgatgttcatgcgctggctcatcagggtcgccaccaggttcccatcgctgcacggtggtccacagaggggggccatgagtcggcgggcaggctgccagggccatcggatggagctgtaaaggcatgaaaatcatcccccccccaaaataacaaaatccctttgctggccgctcatggaaccgaccatgcggcctcccacatccttgcctgtagtttcctatgagcaggtctggcttccctcccagctccgccaggatctccttgctgctctcaatggtgaagcgctccaggtagggccagacgtcgaagcgtgagatccagtggtccaagacgcgactgagacgaaggagggagggagggagtggatgggnnnnnnnnnnagacaaatggttggacaaccttgcagagtgtggcagagtctgtggtcaaccatattgcaggctcacagagcgcagtcaggcatactctgctccgccagacctcacacaggggtaaggtgccctcctgcttggttcacaagtctccccacattctccacacaaaacacgctcacccctgggcnnnnnnnnnnccacacaggggtaagctgccctcctgcttggttcaccagtctccccacgctctccacacaaaacacgctcacccctgggcatccctgaacggcacacgcaggatgcggcagtactgggtccccgcgacaggctccaggcgctcgttgcagctcgtcccgtgcgagtctgggatgaggcgggtcaggatgacaatgtcggggtgtgcattctgtgacgggatggaagggaggaatgaaggtaaacgaacgagggggtgtcatctgggcggttgagaaatggctggagagtttccccaggctctggaatgcccgtgtcaccgtcctcagactcagggtctggagccctctttcctcccaacaagcgtctccctgagnnnnnnnnnntttgagaaatggctggagagtccccccagcctctgcaatgcccgtgtcactgtcctcagactcagggtctggagctctctttcctcccaacaagcgtctccctgagcggcactcggatcccccatccttccgaaaaggaaatcacaggtctctcccactcacctccagccccgcgagtgccaggcgcttgcccatctccgcctccagagctttgacctggtccaggatgtacaccacctgcccacccgtgtcgggcatgcccagcacgccctgctggccaaagtagccgtgcggggagaggatgaccaccttgaacatgatgggcaggcgggccaggaagcgctccagcgactcggcgtccggggcctggatgatgtccagcagcagctggaaggtctcgcgcactcgccccacggtgttgccccaaccgggcaggaagcccatctcctccaggtccaccgccgactccagcgcctcgtcatcctcgaagcggttcagcgcgcggtcggcgcggatgagcgcgctgcgcagcttctgcaccgagttcacgcggtggctgagcagcaggctctccccgccgtgcttgaagctgcgcaggaagccaaggagcagctggctcccctccgcgttctggttgggcgagaacatcttggccgacaggttcttattcaggaaggacacgccctgcccgatgtggctctgcagcgtgatcttcggtacgtgggaggagaagggcttcatgtccacttccagcacaaaggggtcatagccctcgatggctgcggaggaggggggggggggggggggggggggnnnnnnnnnngctgagggtatgacaatggtgcacgatcagccaccatgctcaaggtaaggggaagaaggggagagttcatgtctgcactcggttcagggtgcaaccccatccccttaggaagtagggccaggggggttggctttgcgctgcacaagcatgaacccnnnnnnnnnngaggtgaggcggggctgagggtatgaccatggtgcacgatcagccaccatgttcaagctaaggggaagaagaggagagttcatgtctgcacttggtccagggtgcaaccccatccctttaagaagtagggccagtggagttggctttgcgctgcacaagcatgaaccccagggtacgatgtgctgcgaaccactcattctcagcgcggcccctcccttcccttccccatggccaggctcactcatggtctcatcgcgcagctcaagaggcaccagtttctccttgaaagccaggtagtggctggccgtcatctcctgtggtcgaggcgaaaggaacccccgacagagggaggtcagaggattggcggtgctggaatttccagactccgactacgcgatgtgataatcagccatgcatatggccgatacaatgtctttgcaatggctaaagggtgccagggagatgcacggcaggcagacatacataaccccatctgaacacccggcccttgtctctactgacctccaccnnnnnnnnnntatacgctgtctttgcaatggctgaagggtggggggggagatgcacggcaggcagacatacagaaccccatctgaaaacccggcccttgtctctactgacctccaccgacatggtctcaacgttgaccctatcggggtaggtcgacacaggagaagggatgtgttaagaagtaaccatcatggcagaagaggcaagtatcacaccagaccttgcaggcgatccccaaacccaaaatgctccagcactcccaagcctcacctcaggaagtaccattcacccactccagggcgcagcgagaatgcgatccgaggagccaggatgacagcctgcggcattgtgggttggccgcatgcagtcaacagtacattgactcatacaaacagcaagcttcctgcatgatactcgaatcatgcgactttgctcggtgaatttggggttcattctccccgaacccaagtcaaatacccgcgcacctcctgcaggctcttcatcannnnnnnnnnatccattctccccgaacccaagtcttacacccgcgcacctcctgcaggctcttcatcaggataccaaactccgactttcgcaggctatggttctgggtctcctcgcaaaccctctccagttcatcgtggaacttgtggggaagcaggatgggcttgtccaaggcgcccttgtcgatacacctacaatcgacggaggcttccaggctaagcgcacgtcttgatcccgagcgatccggaacatgcgcgaacnnnnnnnnnngttgacgggggcctccaggctaagcgcacgtctcgatcccgagcgatccggaacatgcgcgaacatgtagctcacctcgtgaggagcacgaccagctcattgcgggaacttgcaatagcatttttgatcaggtccaggggaccatacgaggagaaggacacagatcgggagaggcgtggggtgagtgtgccacggggcgacgataagaacgaattctggggtgattccggaacgacccctcgcttggctgcggtggacgacgacatactgcggtgattcgtcaacgtttagggatcagtacggtgtctttcatgccgttaaccctggtcatggtgaagcgggagcgggggatcctgctatgtatggatctagcaagaagtcgcgaaacaccttgacctgcagaaccagcagcggcactggatgtgtgagcggctcagtccagtctcgccaaatcaggacgcttttcggcatgagggtatcatcaacaagtaattatattagctgatacagactctaggttacttttgcagaagacccggcagattgctccccatgcaatcagtcctcnnnnnnnnnntaacaagtacttatattagctgatacagactctaggtttcttttgcagaagacccgggcagattgctccccatgcaatcagtcctctcttctccactccattttccatgtgatgcgttatttaaagcattcttgcaacacacacacacacctctgggcccctcttccccgcgatagttcagaacaaacatgcagcagcccacgttttgggctccttgaaccttctaccgaaggaaaatgatggtactcaccttgccagtattgtgtcacacagaccataacgacattctctgactctcaggaggaccgcattaaccaaaacatacacgtctcgtaagagtccgggcattcgtatcctccatcctacacatttttctgcttgtcgtcttcccagtgacctctggcctgcagtgtacggcatccgatcctgcggttcggtgttggccgcatgaacttcttcatgccgcaccgcacccccatcttcgaatctatgctacccggttagccgacagacccatttgaatgagtctgattctcggaggctggcggggggtcgggtccctctgtcgcgggctcgagtgcagcggtacaatcaggtgagaaatccgtcatgaagcccatgggcgcgaatatcataggagccactacttgaatgtatctttgcgcacaggaggatcgcctgtgtccgacgatcgagtcaggctgcgcctgagaggtgaggtgtcctggtgcacacatgggcttgcgttgaatgtgagttgcccaggtccttgtaggagtgttcggtctcttttgccgtatacactacagtacacatggatgaaaatttcagttctttcatcctcacgacacattaactggcaggnnnnnnnnnnaggcttgcattgaatgtgagttccccaggcccttgtaggagtgttcggtctcttttgccgtaaacattacagtccacatgggtgaaaacttcagttttttcatcctcacgacacattaactggcagggtgcatcacagctgccaagccatcaacccagccaagcttgtcactacgggtgtgccagggttgccagtactggcttgagttggtggtgatcgatccctgtgtatgaaccgctcactgggtggatctcctgaccccaaaccccatcgagatgcagtcctgccatggaggggcgatgctggtgtgaggcaatttcggaggnnnnnnnnnncacgggtgtgccagggttgccagtaatggcttgagttggtggtgatctatccctgtgtatgaaccgctcaccggctggatctcctgaaccccaacccccaacgagatgcagtcctgccatggagaggcgatgctggtgtgaggcaatttcggaggaaactcagcctcgtagcagcctcccctactgacagcacaaactacagcttgtcccaggtgaccttggccatggtctctcgttgcctggggctgatgttatgcctcccctggcctgttctgcagtggggaaagtgaaaggcgcgcgcgcggacgtttcatgggtgaaattgcccgcaccagtttggcatcacgatgacgcaaaatgtcgagcccatgactgctgatcactgctgctcctgttttggaaattctagcttacaattcgcggacatgacggacatctcggcctggcatcctgtgagtcttcccattctagccctcaccccccgcggtcccgaccgctgaaggtgaacctcagcatccatgccccctcaatcctttgctgcaggtatctctgaccccaaagaagcagatcaatgtctcgataggaagcggttaccctcaggattggtcgggggacctcctggcattgggcgtcttcgagggtgatctcccgtccaaaggtgcgagccacgatggatgctgagattggacattgagtcggagtcggacgattttnnnnnnnnnngttggtgtagtagcattctatgctatgaatcgagcagcttgacatggagtgtatggacccttgggctgagactctggtaaagggttggctgcnnnnnnnnnntaaatcgtttgatgaacgtcagggcatacccttaccccttcggatgcagaggggagcttatccggatgcctggccaccctggatgcaagcctggatggcgccatcgaagatatcatccagacatatgagttcaagggcaaagaggtgagctcttggtgtagtagcattctatgctatgaattgagcagcttgacatggagcgtatggaccatcgggctgagactctggtaaagggttggctgcagcaagttggcccgaaatgcttccacctttccagggaagccagcaggcggtgcgcgtgggcggcaagatcaagaatgtggtgttgattgggctcggcaaggtggaggacgctgccctggaggccaagtggggcctgtccctgttccagacactgggtgctgcggccgctgccgctgccaagacgaccaaggccaggacccttgccctggcactcacgcagcttccccccgtagacgaggtacagaggcgcgcagaggtctctcagcgaataggttttcattcttgcttgcgctctgaggatcatgtgaggttgcctcactggtacaggcagaagctttgctttctgtgactcatcatgaatgcctgaagctgcgaagcccttcccgaaccccgccccccattcctccgcgccagggggaggcaagcggcaaggcagccaatggcctcctgcacgccatctacgagaccagccgcttcaaatccagcgagacgggccccaagctggagagcgcggagctgctcttcggtggaaaggacggcgcggcggctgtgcagcgggcgcaggcctttgtggcgggcgcgaccctcacgcgctacctggtcgaggcgccgccaaacgtgtgcacgcccgctcacctggcccaggctgcggaggagatcgccgagtcagcgcccgacgtctaccagctcaaggtgcctgtggggggctgtgcctggcagtaccggggtggcactgggaatgggccatggtgattggaccctcatcccatgaagatatgggtgtggctggctagcagcccacttccctttcttccccttccctgggggatctagccgctttctcagtacatgctagaaaatcgagtgctaagctgacaagattgctgccatcccggcgtgctgcaggtgctggagaaggccgactgcgaggcgctgaagatgggtctgtacctcggcgtggcagaggcctctgcccttccgcccaagttcatccacctgacctacaccggtgcaggtgggagctggggaagggagttcgaggggggggtgaggcagcatatcacttggttcattgattgtgcaacaggcaagcagcgactcgagtttgtgcaccgcactcatccacgcacctcacatgctcgcgcttctccacctcatcatctccgatgcctatgtcnnnnnnnnnncccctttcttccccttccccgggggatctagctgctttcctcagtacatgctagaaagtcgagtgccaaactgacaagattgctgccatcccggcgtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggggagatcaagaggcgggtcggcatcgtgggcaagggcctcacttttgacagcggaggtgggggacgtgtgaggctgggatggtgcgatggcttgccggggaagcagagacagtgtgaaagttttattcttcatgtaaccgagagcctggtcgttgtatggtgctcgt

SEQ ID NO: 29943 - DNA, 89 bp, Chlorella protothecoides
gctgccggcaggttgtgcctgggctcccgcacagcaccccaacctgtcgtggcaacatagggcggcgataggaatacccaaaagaatcc

SEQ ID NO: 29944 - DNA, 74 bp, Chlorella protothecoides
tggagtatatccgcgtcacgtgagtttggtatctctggttgtaggtactaaattgcaagtgtccttggtcctcc

SEQ ID NO: 29945 - DNA, 283 bp, Chlorella protothecoides
gggggggggggggtactggtgatggctggcgtcgacggatgtggatgctgcgcagatggcctgccactcctactgcacgtgaacgagcagggcgatctccggtgacccccacggccttctcatgcagccatccccttgtcgcagaaccttgatatgtgaacccactgctcccctcctcacgtcccccccttcccactcaaagcttcctaccccccccaaagaaaaattcatctcacgcacaagacaacctaaccaccgctctcaccggcccgttggagaagaa

SEQ ID NO: 29946 - DNA, 69 bp, Chlorella protothecoides
tgcacgcccagctcaccaccgaagaagatgatggcgggaaggaagagcagccggatgctggagctgatg

SEQ ID NO: 29947 - DNA, 2486 bp, Chlorella protothecoides
  modified_base (997)..(1006): a, c, t, g, unknown or other
  modified_base (1217)..(1226): a, c, t, g, unknown or other
  modified_base (1983)..(2026): a, c, t, g, unknown or other
gatcccccaccccaccccaccccaccccacccctccctcctcacgcacatgcgcaggggggcatcctgtctggcgacggcggcgacgaggtcaaggacatcctgctgctggatgtgtgcccgctgtcgctgggcatcgagacggtgggcggcgtgatgaccaagctcatcccgcgcaacacggtgatccccaccaagaagagccagaccttcaccacctaccaggaccagcagacgacggtgggcattcaggtgtacgagggagagcgcgcgatgaccaaggacaaccaccagctgggcaagttcgagctgaacggcatcccccccgcgccgcgcggccagccccagatagaggtgtcctttgagatcgacgccaacggcatcctcaacgtggccgcggtggagaaggggacgggcaagtcggagaagatcaccatcaccaacgacaaggggcggctgagccaggaggagatcgaccgcatggtggaggaggcggaggagtttgcggaggcggacaagaaggtcaaggcccggatcgacgcgcgcaactcgctggaggcgtacctgtactccaccaaggcggcgctggacgacaagctgaagggcaagctggacaaggccgacgccgacgcggtggcctccgcggtgggcgacgcgctggagtggctggaggacaatggcgaggcggaggcggaggagtacgaggacaagctcaagtcggtgcaggacgcggtggcgccggtcctggccaaggccaaggccgcggcaggggacgacgacgacgacctgggcgaccacgacgagctctgagcttcgtcgtgaggagggggacggccgggcgagcctgtgatcggatgggtcggcactgggccgacgagcctcgggcgctggcgagccctgctcgccctcttgtcggacggctgagggggtgccgagcaccgggccctggcctggccacccgtgggccgcggtgccaaggccatcgacgcaccccctgnnnnnnnnnngctgggccggcgagcctcgggcgctggccagccctgctcgccctcttgtcggacggatgagggggtgccgagcacggggtcctggcctggcccccttatgggctgcggtgccaaggccatcgacgcaccccctgcggggccatgcccgttgccggggcgccgctgtcgatccgatgcattcccccgcaccccttctcctggcaaagaccannnnnnnnnnattgcctgggcgccgctgtcgatccgatccatccccccgcaccccttctcctggcaaagaccaaaccccacacagcaccgcactgtactcattttgcgctccccattcccctgtttccacccgcgtgcttcaagcattcacaccacgtgaacaaggggggagaaccacatccagaaggggagggtgccgacggcaataaggggggctagctgggccgggcaggctgcaggcaggccgcaggcaggacgccgggcccggcatgtaattggggcaaaagtgcatcgggggaacaggagggagagaattggttggaggcgccccaggggaggactgcagtcttctcggcccctgggggagggcctgcctcgtttgaaaacaggactggcaacgctgaaatgaaaggaaaataatgggaggctgcgcggcggggcggggcggagggggcgccggcaaacggttggcaccctcgccacccgggcccggcggcgcggcgcctgtcagacaggtggacgcctggtggtcttggaagagaggggtggaggcgctacggtgcaaccccacccctggggagggcccgggggtgggggcgggggtgtcctgcgtccgtcgggcagggggagtgcgcacggcacagccaggggcaaagggcatactgggacaggattcttggtgtgcaacgagtggcatagccataatactggttcagtgggatacgcgacggggcccggggagggggggggggggggggggggggggnnnnnnnnnnnnnnnnnnnnnnnnnnnnnnnnnnnnnnnnnnnnaccgtgcgagggcagcattggagcgggggagagggacatggacacggcgggcgccagagggagagaactgcggcggcctcgtcctcgcacgaaataaaacagctttggtgatggagatggggattgcgggcagggcgccgaagagggggcgtggccgcgggggggtcagcacacgaagcgcgccttgccgcgcgacacctggttgcacaggctaagcagcgaggaggacttgcgcagggtcaggcccagggggccgccctccgccgccgcgctctccgcgatggccttgaggaagcccgggggcggcagcaccgcggcctccgaggtcgccgccaccggcaccaccgccggccccacctgcaccttgatgctgggcaggggggcggccctgtgcgccaggggggcgggggcggcggccggggtcgtggcggggggcgcgcggcgggcgtcgctgggcagc

SEQ ID NO: 29948 - DNA, 104 bp, Chlorella protothecoides
ctgtgggattgccagagtgcggccagtctggcaccctagagcgctcatgccctgtgctttccagcactacaggattgtccatcattccaccacgtcgtacgata

SEQ ID NO: 29949 - DNA, 71 bp, Chlorella protothecoides
caaaggacatggcttgcagctccttgaaggccaaaacaaaatgttgtccgtggcccttcccgaggcggctg

SEQ ID NO: 29950 - DNA, 483 bp, Chlorella protothecoides
cgcaactgtcgttggaccgcccaagcagcgttccgacttcgtactgctcaccttggtgaccacacactacccgccgcctccaccaccgtcttgagtggcaaaacttgatgcatgtgcaccaggcttcagtgtccgatccagaatgatttcctcgcccagaaggaattcgctcactgcgcaagccatggccacagccactcttccagaactccatctggtacagctccattggccagtggaacccccaacacctccacactgcctgcctcagtgcgtcagctctgcatttccaatggtaccaaccgtactgctctgcgcaattgcaggaagatggaactcaaagtgtccccttttatctccgatagagctccaggggccgccagattgcaaaaactgcgatgggcagtacatctcccgcagtcatgcatatcccggcagcgccactcatcttccataggcacccatgtcccagcccacccctgc

SEQ ID NO: 29951 - DNA, 122 bp, Chlorella protothecoides
tgtcgggcgggtggggtgggcgggatgccaccggcgctccagaggccccggtggcgacgggagatgggtccgtacccaagccagcgcaccagcttccctggcaaatgacgccccatggtcca

SEQ ID NO: 29952 - DNA, 74 bp, Chlorella protothecoides
aactgacctgttgagatggaatcccaactccaccccccagtgctcaagcaatgcggctgcatcagggtctggga

SEQ ID NO: 29953 - DNA, 127 bp, Chlorella protothecoides
ctacatcctggggggcctggtcggtcccgagtgggtcatcttcgccgccaactttgctgtcctgggacacatgtggtccgcctaccagatctttgcccaccccatgttcgacaccctggagtctcac

SEQ ID NO: 29954 - DNA, 67 bp, Chlorella protothecoides
gttagggttagggttagggtcagggttaggtttaggtttaggggttagggttagggttagggtttag

SEQ ID NO: 29955 - DNA, 78 bp, Chlorella protothecoides
agggctcaaacagtcccagagtgaagagacggtgacgaaaagggggacctcgacaggctacttactgcccagcgctcc

SEQ ID NO: 29956 - DNA, 155 bp, Chlorella protothecoides
ggatgacaaacggtggggagctggggtgtgggtgcgcgtggagggtgtgtgctgagtcagcaggcgctggtgtgggggcagcgaggctggcgacgccgctgccgccgcggggccagcgcaggcctgcgtcggggagggaggcccctgcacggcca

SEQ ID NO: 29957 - DNA, 61 bp, Chlorella protothecoides
ccccctttgcctgcagcagtgcactaaccaacgctgccagcacatgattcccatgaaacca

SEQ ID NO: 29958 - DNA, 62 bp, Chlorella protothecoides
aagcccgtccgttatgtgcttctcacctccaacacatgtccctgcatggtgcccagttcgat

SEQ ID NO: 29959 - DNA, 67 bp, Chlorella protothecoides
ttgttatcaagagcgcccgtgttgcaatggcgaaggcgaataccgtgcaccactgaaataggtgaaa

SEQ ID NO: 29960 - DNA, 329 bp, Chlorella protothecoides
gaaggtcgaggagcaggtagcctgggcggagacatgggcagcaaatttagacactgcagaaattataggacctattaccatccatgatctcctcaacactcaccgccaaggccccttcactccacaagagcgcaagtgtggcggccagcaccaagtggccaacagccttcggcaccttccgggaagtcatcgccctgtgcgattccagggcgagcatgcacccagattcgtgataaattgggattccaagaaggggattgatgtgttcgctcctttgataaaccttggtacgcgtttataaagagcttgatgcacgttctgcctggtcg

SEQ ID NO: 29961 - DNA, 113 bp, Chlorella protothecoides
caatggggccggcgcaggcgccgccccctccgcactgcatggcttgtcaggcattaaggtgaggggtcccggcttttgccttcgaacatgctgcgcgatgtacctgtacctat

SEQ ID NO: 29962 - DNA, 1913 bp, Chlorella protothecoides
  modified_base (910)..(971): a, c, t, g, unknown or other
gggggggggagctgggggttggcacatgcaagcatcctggcagcagggacagggcgcaggccaggggctctttagagagactgcgtgggtgccgggctgcgggcagcaggcgggaagttgccatgcagctgcggcacctgctcccgccccagcgtggctcgggattgcgagtgtgttgcatggggtggggcagagcatactgcagggggctgagcatcggtgcggggccctcctgcctcgacaaatcgaccttcctggacaccctccgtctccactctcccagctggcggaggcgatgctggactcggtgggccagggctgggcgtcccgcgccttcttctcggacgacgggtccaccgcggtcgaggtggcgctgaagatggccttccggaagttcctggcagaccggggggccacggactgggaggtggacgacggccccgagctgggggtgaggagtggtccgtgggagctagcggggggtgtccaggggcggacgccttgcacaggcccggcagctgtgcacccaaggcttccctgccggggtcactctgccccgggcccgcccgatgggcgcctggacagcgttgggtcccggtgtcggatgggtctgtccacctcccacacgcgcgatgaccccgcaccccggcccctcggccctgtccgcagcccttgacctcacctcgctggcccacctctgacccccgccctccctcaccccaacctcactcactcgcaggtgctgggcctgcagggcgcctaccacggcgacacgctgggcgccatggactgcgtggcgccctcgcccttcaacggccgccgccagacgccctggtacgcgggccgcggcctgttcctggacccgcccaccctggcgttgcggggcggtgcctgggtgggcgcgggcctnnnnnnnnnnnnnnnnnnnnnnnnnnnnnnnnnnnnnnnnnnnnnnnnnnnnnnnnnnnnnnccgacctggcggcggtgttcgcgccgcggcccgaggcagtggccgcccaccgcgccgcgatcgccgcggcgctggacgcgcacgacgccgcggcgggcgcacgtctcgccgcacgccccgcgccgccggcgctggcagcctgcctgctggagccggtggtgcaggggtcggggggcatgcgcctggtggaccccgccttccagcgcgccctggcggcggaggcccgcgcccgcggcatccccctcgtcctggacgaagtgttcacgggactgtggcggctgggcgcgccgtcgggggcggccctgctgggcctcgaccccgacgtggcctgctatggcaagctgctgacggggggcctggtcccgctggccctcaccctggcctctgagcccgtgttcgaggccttcaaaggtcgggcagtggggtggatggacgcgagggtggggtcgtgggggtggcgagggcgaggcctggaccccgcagcccaggagtgtgtggtctgtgaagtggaggcaggggggggcggggggacgcctggccgcagggaccccgtgccgcgcaggactctcatctgacgtgcctcccctccggctcgatggcattgaaacctttggtgcgatgtgtgcaggccccctgccgcgccaccgccccctttccaccgttgagggggttccccatgaccccggcttccctggtgccagattcccccccccctgtgtggagccccgatggacccaccccaccaccaccacaaccaccccctctcctgacctactccacaggggagagcaagctggacgcgctgctgcacggccactcttacaccgcccacccgaccggctgcgcggcggcgctggcggcgctggcggcatacgcgagccccgccctgaaccccaatgcgggcgcgctggcgggggccgcggcgcggcgcctgccgctgac

SEQ ID NO: 29963 - DNA, 73 bp, Chlorella protothecoides
ctcggcgtgcaaggtgcccatatctcccatgccaaaggctgctaggtccagcatgccagtgggctccactgtg

SEQ ID NO: 29964 - DNA, 61 bp, Chlorella protothecoides
caaggccaagaccgccaaagtgtacatcgaacatctttacaaagttcagagtcagcaccac

SEQ ID NO: 29965 - DNA, 90 bp, Chlorella protothecoides
ggaaaggtgcacccagtgccatgcttgcggctgtcccatggccaagattcgaatctcacggggggcctcgtccgccggttcggcacaggt

SEQ ID NO: 29966 - DNA, 61 bp, Chlorella protothecoides
gttcaaggggatgaggagcgggttgccgcacagcgcatccaggccggagtagggcgaccaa

SEQ ID NO: 29967 - DNA, 77 bp, Chlorella protothecoides
catcccacctactagcaggggatggataccggggtgagttcggccgaggggtaattaggcaaggtgacccagccgac

SEQ ID NO: 29968 - DNA, 77 bp, Chlorella protothecoides
ctttgtgtgccccggcaaccacagtccagcgggcggcccccaatgcagcgcgacctattcgattggaggcggtgctc

SEQ ID NO: 29969 - DNA, 80 bp, Chlorella protothecoides
gcacttggaggtgctgaagcagagatgggttgcggcagggcgcccgcagcagccagactgggacgctctgctttcaggac

SEQ ID NO: 29970 - DNA, 61 bp, Chlorella protothecoides
gtccagggtcctgagtgtggaggaggaaggtaccaagtgtattttggcatttgtaatgatg

SEQ ID NO: 29971 - DNA, 61 bp, Chlorella protothecoides
gccagccccacgtcggtgcggccgtcggggtggaagacgcgcaggcgctcgtcggtgtcca

SEQ ID NO: 29972 - DNA, 118 bp, Chlorella protothecoides
ccctcagctccttgggggtgaaggacgcctactgggcatgggtggacgatcgcgagatgagctcgggaggaatgggtactgggtgggggagtacgccggcccggggtgatctggcaac

SEQ ID NO: 29973 - DNA, 61 bp, Chlorella protothecoides
ttctcccgttgctgctctccctgctgctcccggatgctcgctcctcctgaactgctcaagc

SEQ ID NO: 29974 - DNA, 68 bp, Chlorella protothecoides
cattgttgtggtgcctctgaatctggactatctttatataccgttgaaatgagcctgtcagattacaa

SEQ ID NO: 29975 - DNA, 70 bp, Chlorella protothecoides
catggcccctgagggcatgtgcagggcgcacagcccgctcggcgcaccttgagggcatccaggtacctca

SEQ ID NO: 29976 - DNA, 64 bp, Chlorella protothecoides
ggctcacagcgtgcatggcatgggggattattgtacagtgcggcatttaagaagtgatgttacc

SEQ ID NO: 29977 - DNA, 70 bp, Chlorella protothecoides
ccacaccggctggaagcgcctgcgggggggtcgttttgcatttggtccggcgggatggagggcaggcaat

SEQ ID NO: 29978 - DNA, 64 bp, Chlorella protothecoides
actccctgcatccacccgccccccgcactcatcctcctcgactccactcccctcatcctgagct

SEQ ID NO: 29979 - DNA, 75 bp, Chlorella protothecoides
cctcttgggccgggagcgttgagggcctgcgcatttggttttgggggggaaggggggaggagtggcccacacgct

SEQ ID NO: 29980 - DNA, 136 bp, Chlorella protothecoides
ggaggttggtcatcctgtgccagggattggcacttggtggctcagttttgagacaatcccagaatcagcctgtgcagagccacagcttgcgcactggacgccaggcgcgtcgtcaccatgctcatgccaaccctcc

SEQ ID NO: 29981 - DNA, 61 bp, Chlorella protothecoides
cttggtcttgatgtataggagtgagtgggcaagtgacagattggaagcccacatgcgggga

SEQ ID NO: 29982 - DNA, 111 bp, Chlorella protothecoides
ggcttcgtgtgcaccggctggggaaagtgccaaaggagtcacagcttggaggagagggtgacgagtggagaggggaaaggaaaaggcatccgcgatggaagcccagccagc

SEQ ID NO: 29983 - DNA, 61 bp, Chlorella protothecoides
tatcatgttattccatgctaatgtattcagagcggatgcctgctttgaacactctaattta

SEQ ID NO: 29984 - DNA, 61 bp, Chlorella protothecoides
cgtcctgtgaacctatcccgtcacgatgggtcggcagactacaatgtgtcagtgccccagg

SEQ ID NO: 29985 - DNA, 7105 bp, Chlorella protothecoides
tgggagggggaagggtgggagggggaagggtgggaggggtaagggtgggaggggttgggcgccgggccctcagcgttcagcaggccagcaccaaccgccggagttcaccgaccaccagagcccttctccgccagcatttgcagagtccatgcgaccacggctcaccggcagtaagcctcagatgttccagagcccagcaagtatagcgtgccgagatatctgggagggagtgaagggtgagtggtgcggtcagcaaggtcaattcagagctaagagttcagacttggcccagcatccgatcgctaacgtgtaggccatacagttccatccatagatacattgcaggtacacaggaaatcagtggaaccgggctcatgccatgcaacccccttgctcggaaagctcactcgagggtgggcaaggcgtagaatccgaccctcgggtcgcagtcagcctgcgtgggtgtggcgctgttcctttgcttcaatgccgagagatatatgtcagctaaaattccatgaagctctgcttctcacgcgaggcaagaccttgacgtcccacctgtgcctcccgcacgctagcgccagcgagaagcacgccaaggaggatgaccctccaacatcccatggctggcaacgcacagcaaattacaaaaatgtaaccctgtacaatccctccaaggatgtgcagactgatggaggacagcagttcgagatttacgtggcaggcctccgtgggaaccacaccgcactccgggccgggccgcgcgctccggtcgccggaaacgccactggtgcattctctgttttgaaattcttcatcatcgctgacgtcggccagtatgccatttgataagttatgcaaggtcctggggtctcgtgtcgtgaacacattagcccgcccctggaaccccgtcccatgctgcagatggcgatgcagtactagcttcggtgcgtgccctcacatcttcacaccaagggttggatggaatcgctgttttgcacactcacaccctctttcccccggactgtggctcgttacatccaggtatcggccgctgcgagctccagctgcacctggcatggcgcacgccgtaggttcgagcacccctctcccaccagcggcgctaccctgcctccaccccggcgccgcgcgccagcaggcactgcagctccgcctcaacgtgcatcagcacgggcagcacccccctctccatctggcctgatgccagcgcggcctgcgccagggtggcactgagtccctgcacctggacctccagggccgccctcgccgcgctttcctccagcaggcgctgctgcgcgtcggagcggggggaggccggacttgcacctgcggaccatgccgcgctctcctccagcaggtccttgagccgcgcggcgtgctccagcccggccagcgcctgccgctcccactccgcggcggtgcgctgcgacgcctgcagcgcctgtcgtggggcgagaggcgtggtgtgttgtcatgggcccaggccggcggcgcccgccccgattccagccaaactcacagacaagggagacccgggccgatttgtgccaggccccgcccggttcacacagggctctgcgcagtggtctcgcaccgccccagtctctcacaggtgcctgtcacctgaccagctcaccgcgccaagccccgacacccccaacggccccccacctcggccagtgcggcgttgagcgactgcagcctctccacctccgcggcctgggtgtccagcgccgagatcagccggtcccgccccgccttcagggccgccacccgctcctgcaggcccactatcttgctgggcgccactgcggccgggctctgggcagtgacgcggccttcggcacgtccatcaccctcccctccacgctgaccctccagggaggcgaggtcctcctccaggtccagagcatgccgctgctcgttcaggagacgggccgccagctcatcccgagcagcctggagtgtggaattttgttgcagaggttggtggatcgagcaggggcagaattgtgtgggaagaggggccaccaaccggcagcagcttcgtcttggggcaggctgggggcactacatctcgctctgaataacgcatcatactcccgcaggcatgatcatgacctccctcttggccacgatgcccctcctcccgacaccctgaatgcacgtctatcacctggagtcggagctgagcttgtttgctcgactcggcctgcagctccgcctcccgcctagcccgctgttccgccgcaagctgctgccgtagtgattcgagttcgtctgccagcgtgagatcggccaatctgaaggcgcaggctgcacccccagagaaggaagggtgcccgcctcgtagctcggtgcacgtctagcttagctgagagctgatctaattttcagcaacttgcatgagtttatttacatcggtcgattcttagctgtgatggttgcccatcagcatgcctgattacctgatgcatccattgcatctgtcgggggggggggagcgcggatccaaccgggcattgatcagccgaagctgaggagatgctgcccccgtgcccgtggttccgcacacttcccaatttttaaggaggtactgtgcttaaagcaaatccaccgttaacaactgatcctgctatcagcatttattacttctgtgaaatattctggcctcgagtcggcgcattgctctgttttaagtacccaccctttcggtcgtactctccacccgaggagggaaacacttcgtccatccaccttgaataaagcaacagataaccatgcagctttctgccccccgagcacaattctaccggggcaaggccttccaatctgtcgccccaggccgcaccatccctcctcgcgtccgtcgccaagtacccatcaagcccactgccaagattcctggggtggagcaggcgacagccgccctgaagacttaccgcgcggtctctaacctgccatcttgggtcacgacggtggcattcaccgctttccaggtgctgcccaagatcacccacaaccctctcccctttgtgcctgactccagccttctcttcaacctgctggcttggtacacgttgttgtacgcagggacgtccctcttcaatcgcaaggtgcccgcaggggtgggagtgcggaggagggcatgttcatgtgttcatgccaggacggtgtggaagggcaagaacaccccagatacccgcggatctcctaccctgcccatcccttccctccaccctcagttggagtttgatggcgtgggcacggtcatcgggccggcctacctggcagtgcaggcgatggggggcctggggtccttcctctccccactcaatgtggccacagctctctttggcgtcttcctgtcctacaggctgccggtgagaacgcgtgagcgggcagctttgccggcacaaggcagctgaaagcgcgtttgcccagctgttgttgcacacgtgggaggatcctccgtgacctgccggcacgcacgcttgctgttgcttggacatgaactccggactcatccatgtcccatccttcattcttttcgtcatcacagggtcccaccctgctctggctgcccaccctcgcgtttgccatctactccggcttcggcttccactgggccgtggcggcctttgccgggggagctgggtggcagctggtgcaggggctgcgcgagggcaagctgcccctccagcaaatagccttcctgggggtggcgggcctggccttcgtcaccaacctggtcccgcagtttgccctgtttgtgtttggcgggcagattctggcctctgccgtggggaagtgagagactgggccttgcctccgcatgctcagagcttgccatgtctccccctgatggtgggattcggttctaccgctgcactccacaggaaactggtctgcatgcatttcagtgccctctgcaaactttaatgatttgggcagataatggtgcggctcagggcctcacacaggacccagtcgaccgctggtctcgtgcagctgggctgcagtgccgccctcaacaccagggccaagcccctcaaatccggggggagcagcgcccaggggcggcgtaggagagccggctctggctgccgcaccggcagtggccggggcgatgatgatgcggtacctgcgccgtagctcgtccaggttgtcctgtgtgaagggaggaggagctcctagaggttgatggcagccctggcggcgatcttggaccttgcattgcctgctcagggtcaccccgtccccagcccggtgcctccagtgccaatcaacaaccccccacacacacctccaggtgcttctcgtagggaatgcacatgaggtctgcggcctgggcgcccgcctgcagcgcccacggcaggtaggtcctgttcagctcggctctctgctcggcgggcaggcgcagctcccccgccaccaccgcgagcgccgtcatgggcaggccggtctgcgatggttgatgtcgcacagcatgacaattttgcgcgccactccggggagggttggccggatggcaagtctccgagcatgctccgactctctgacatgcgccccgtctggcgcagctgcgacctctacgagcccttccctctatcgacaccccacccgcaccgcccctcacctgcaggaactccaccgccttgagtgccacctccccctgcacgttggtgtggcagccaaagaggacgtgccagaagtcgtgcacctcccgcgcccgtgtgacgatgtaggccagctcggcgtcggccacgaagcgcacgggcggccgctcgtcggccgagaagccgcgcgtgcccatgaaggcggcgtaggccccaccaaaggtgtcgggcggcagggccgccgcgcgccgcaacagcgcatcggtcacgcgtggcctctccgccaggatgtcggcgccgcgggggtccagggtcatgcgtcggcgcagcgcggccagcgcggggccggcgctggtctcgcccacggcggccaccaggtcggcgcgccggggggaggccagcgcgccaagcgcgctgagcaccgtcagtgcgccctgctgcaggccggtcaggggcacgtgggtggggtaggccgcggcaggactgaagatgagggcggttggggtggggttgtgaggacttgatggagccggcccagctgaggcccacgaacatgcgctggaggaccacacaggggagggggtcccaacccaccgccgtgcctctcaccgagcgaagagcaggcgttggaggacactcattacgccttgctacgtctcaagccgcatccgatgtccaggcacctccgtgatgggcggtggaacagctcgctgcccagcagtgcgccggaagaggagcctggtgtccgtcctgctgtgcgtaagctcgaggtgcggcaccgagtagagatcgaatggtgccgatggttcaaaatgaacaaatcagtcgtccgacgagctcatgcatggcgaggatgtggtgttgtttgggaccacacagggagagggtttcctggggagaagtccgctccatgcacagcatcccatggtggacctttcaaacccgtcccacctgctcaccctccccaaccccgaccttccccacaaccaggaaggaaggttacagcgcgcatgcagcgatgtatattatggcatggagtttcagtatggagtatgtgcaagacctcaaaacatacatgtgatgctcggatcgcttcaagcatgcaacgaagggattccatgccttgcggatgcaggccggctgtggctggggagggggggttcaccaaggcgtgtggggaggctggggacggaaggggggcggggtctgggtgtgtacgcggtactcgatggaaaaagctgtcgtgggggcatgcctgcatgccatattcgtaccaaggcatggtgcgaccaccaagcaccgtaaaacggttcctgctactgtgcaaacgggctcgcgttcgtcatgctaccctgagggtgcagcgacttcagcggcgaccgcgggctcgcgcggccgggcgccggcgccccgacgccccccgccccctcccccgcctcggcgtccagggaccgcccctcgcccacgccctcaaaggagctgcggagggaggcgtcccccctggacccgcgcacgcccccggcagcgctggacaggagcgaaaaggaggggcgcgtgctgctggtggtggggcgcgcaccctcctcgtagctgccgcgctgcatggtggacccggtgcgcatgccggagtcgcggccctcgccctgcgcctgcaggtgcatgccggcggcgctcagcgagtggctcagcttggagtagccggagggcgcaaactcctgctccagctcctgtgggaggggggtgcgagcgggccgggagtgatcagagcagagggaagggaggggggtccgactcggcctcaccgggccgcgagcttctcaaggccgtcccccattccaccctccaacccacactccaccctccaacccccaacccccacccacccacctgcaggatggcgtcgaagctggggcgtgcgcccggcagctggctgaggcagctctcgcagacccgggccaggaaggggtcgcccgtggcgggcgggggcagggtcttgccctggaaccccaccgcgcccaccacctggacggggagcagcccctcccagggctgctgccccgtcagcatctcccacagcaccacgccgtagctgtacacgtccgcgccctccgcgtagggctcggagcgcaggacctcgggcgccatccactcgggcgtgcccgagggcgcgcccggggtcacgtgcgcgtgcaccttgaggcgggccaggccgaagtcggcgatcttcacgcgccacttgtcgtccagcaggatgttgggcgacttgaggtccaggtgcagcagcggctgggggcgggagtgcaggctggccatgccgcgcgccacctgcaccgccacggtgcgcaccaggcgcagggggagcgggccctcggcgctggcccgcatcaccttgaacaggctgccccgcgccatgtacctgtgtcaatgtatttttttgttgtgggggggggggatgaggatgg

SEQ ID NO: 29986 - DNA, 135 bp, Chlorella protothecoides
acttccgagcgatggcgacagcctgtgggtttggcgcaaaggtgcgttgatactcaggtgcaatggggggtggctcacccagacgagcgtcctcccagcgttcaacccagcgtccggacaacacacgcgcgcacc

SEQ ID NO: 29987 - DNA, 61 bp, Chlorella protothecoides
caaggcttgggaggtgggtggagagctcattgtacagtcttggctccatcgttacctgcgc

SEQ ID NO: 29988 - DNA, 110 bp, Chlorella protothecoides
ccgggaagaccgggatacggggcacgcgggattgagaggcggtgctggccgcaccagcgctctggtgcatttgctctcgattcacctgccaccgaatccccgacaggtca

SEQ ID NO: 29989 - DNA, 79 bp, Chlorella protothecoides
ggaaatgcagcaggcccgcccctggctccaggaccccacatactttaagaggtgtctggccgggcgcggagattcgggt

SEQ ID NO: 29990 - DNA, 144 bp, Chlorella protothecoides
atgtgtttgtactgtgtttcttcttgtgattgtgcttcctcaccgctttgattactggagatgacggccaagaaagtgctgacgaatatactctgatagtaaaacttcttgccttgacagttacaaaaccatctctgcgcgcat

SEQ ID NO: 29991 - DNA, 5548 bp, Chlorella protothecoides
  modified_base (3348)..(3357): a, c, t, g, unknown or other
  modified_base (5056)..(5065): a, c, t, g, unknown or other
acctgcagcgctcgaccaatcccgccgcggcctgcgcggcggcggcgcgcaccgccgacgcgtcgtccgcctgtgccgcgcggacgcagcgctccgccagctcggcgtcggcgggccacagggcggcacccagcgtgcagagcgccgcccgcacctcaggcgcggccaccggtggtgggtttgtggcgcccagatgcagcgcaggggctcgacggaccagggtcaacaccgcttgggtgcgctgcgcgtcccgagcggccacgtcggccagcaggcggagcatctgggcggcggcctgggcggtggcgccgctggcctcgcgcaggtgcggcgcaaacgctgcaagcagcgactcgagggcagaggcagtggggccgagggccccgccctctcgcgccgcgaggccgcgcagtgtgatcagggcgtccagctgctgggcgggtgctgaggtcgcggcgaggcgcagcagagcggccgtggcggcggggatggcggggcaggggaagggcacgccggcggtgtggcacaccaccgcggccaggcaggcgagcagagccggcaggtcttgagcagtggggggggggcagtgagccgcgagaggacggcctgtaggtattgggcgggtgggtgttagactgcggtctggtcacgccgcagccaatccctaagagttctggtcctctgacaccacaccctcctcctgccttcctgatctaaccccaaacctcgagagtctcgctggccagctcgggcgggaggcgcgagtacgggctgcccaccgccagcgtgcccagcgccctcagcgtgccggcacgcacgcgggcctggctttctgagcaaagggcggccagcagctgggagtggaggcgtgtcaccaggtggcccatccgctcagacagtgggatgaagctgggggggggattaagagggtgacctggggatcaggagttgctcagaatggttggggcccgctgcaatgttggcacaccatgtgttgacgcctgcagcccttgcccatgccggggacaggtacggacgctgccctcctctccacccatcgacacacctcgccgtcctgcctcccggtgccacctcggccagccccaagtacgcagcctgcgcgacgccctgcagcaaggtggcgatgctggcggccgcggcgaggcggactcggggcgaggcgtcgtgtgccagcgcgctgaccacggacggagtctggcaggggagatcgggggcggccggggggcggatgtgaattctggagaccgcaccaggtggcagagcatgcaagcgctgggaggcagcatgcccatcatcaagcaggagaggagttcctgcatgcaacaggcgtgggatctgcagccgcctggctgctcggcgacgagtgccctgttggggatcagccaaagatgactacccacacagtgactgccgggccgacccacatcccacctgctggttcccggggacgctgctgccccgcaggagcgcgggccagtgctggtggaaggagcgcgggtcgaccttcaccgccgcctggaggcagaccagcgccgcacgcttgatcccggcgggcgtccccgccagcccctccccctcgctgtcgctggttgcggaagacatcctgctgttactactgagtttctgtgtgacaggccttggggaggagctggcagccagggctgctttgaggggggcgcccgtggactccagcagccctgcgttcgctgggtccagcagctccagcgctgcgccgctcagcaggcttgcagtgctggagctcaggctggccccggggcgggtcaggcacgtctgcagcagctccagcaccgctgacagagcgggtccgaggcagccatcgtccgggccggcggctcggcaggctgccaccaaggccgcggcgcatgcatcttggcaagacacggcgtcgccagagctgccatggtctgtcgacgacgagcatttcagattatcggcagccacgaggaggagcagcagctctcggcacccgccctggcctcctgtccttgtagacgactcgcatggggcccttagcaggacggcatcatagatgcctctcctcaacttgtgcttcgctggactgctggccaggaagggccgggcctgggctaccactgcggcagccccagtccaagtgctgagggggcactccgccggatactcgagcagactggacacaagcgcatcggcgtcttgctccgatatggtttcattgggggagatgcgagcgagctggtgcgcaacgccattcagatccctacgatggggggtggggggttgactggccttattcaaggcgcattcctgaggggcgaggcgtcgccttgtttattctgcgcagataattgcacatacgcttacccaggggcattaagtttgcgtctgacgtcccggatcacgtcgcgagctatgtggtgtggttgcacagccgggctcctccaccatccctccgccatgccgccaccataccgcgatagcgggagtgacccagttgtctctgtgatatttaatcgcacatgtataatcagagcttcttgaaactgcactgccagatcaatcggttgcgttgcgagatccacctggcatgatcattcgggcgggggactcgatggaaagtgagcagatcctacacgtccattatgcatgtgggccccgcttgtacacatcaaccggcagggtgcttgcaagcattgcatgtgaatattggcatgcgccgtccgactggtgcatttggtggacaggggactttcataacgaagcacagccagttgtccggcctgtgacgggcaggcacatcttccgcaccagcttcgaccttccggattgctgcctcaagagcctgcatgaccaccgtaatgcgaccgaacctttgcactgcaacccgacatgacgtggtgggagtcgtcgccgcgagtgccggattccagcctcgccgcttccgccaccagttcagacccttcctccctggctctgggccgtgcggcacacgagccatgggaaggtgcagggctctgcagagcagcgagcccacaaatgcacagaactctggggaggagggggcttcctcacgttcatcagaccgcataaggtccaccattagcggcttggacgagctgctgggggtggaggaccagaaggcagcctccaaggaccaggtgggaggtgctgctgccgggaggcaggctttttgtcaagtgacatgaatgctctgatgggtccagctggccctgttatcatatcaccccacgactggtcggcgtcacccaacatggcactgggccgaggattccaggtgtaccaggtcatacaattccctcgtcgccgtannnnnnnnnnttcatatcaccccatgagtggtcggcgtcacccagcatggcactgggccgaggattccaggtgcaccaggtcatacaattccctcgtcgccgtacggaccgcaggacgtcatgccggccatcgaagtgtctgcatccaagcaggttctggagaagatcggggccgctgacgcggcccggtcaaaggctcaggatgaaggcgccgtggcgtcccagatcgaggacaccctggcgcgcgtcatcgagcaggcgcgcaagctcgcggagtcggaggacttccaggacaaggagaagaaggaggcggggggccaggacctgcagcgccaggttgagaagctgctgaactccctcatccggtccaagaacggcattgacaaggacgattataggtcggtgcgaggcctgaggggttgacgggccagaacgtgtgggtgggagtccggtctgagtgtgtgacactgggaggacagcccgcctgctcgtgccttcaagaaacaggacacaagcagcagccgctgccggaatcgctgcggcatggcgctgttgcacaacggtccacactctaccctcccatgcatcagtgacatcaagtccaaggtctttgggcccgacaccttctgggtcaccgacgtcctgcccagcagcggactggagggcggcgtcatgttccgcggcaacctcaggggaaagcgggaaaaggtggtggctgaggtcatgcagcgcctgcacgacgcatacggtgcgctacgtggggcgggtgtgcgcgatgaggccggggcctgggtggctgcaggatgtttgacgccttggtatgcaagagcctcgcagtctgcatcgtcctccagctgcgtcagatcctctcgagccccctctccccatcgtgcctgtcctgttgactttccctgtaggaggaaagtacgtcttgagggtgatcctggatgtggaggcggccttcaaggccgacgaggacaagagcgaccgcagcctggactcctttgtcgccttcgaggtcctgcccgctgctgccgcggtgcccccgccccccgccacctggcagcgatgggtgggagtgctgctggtggctctgacagctgcatccaccctcagcttcgggctcgcctcctccctcctcttcctacccaaggtgagagggggtatgcttgcaagaaatggccctcaatctctggcttcaaaccaggccatggatccaagatgggtctgtgcgtacccgccaacatgcacatgtggagggctgaagctcttgctctgcaccctccctgtgccgcaggagaccctggccttcctggccaacccctccagcatcagcggggatgcgctgccgccgggcctggaagggttcgacccccaggccttcctgacggcggccgtgtctgtgggggcgctgagtctcattccacaggtgcgggacttgtggggccatgattccacggtgcagcagtagtctctcgagactggcttgcatgcccagcctgattctctagatcttccgaggtctggaaccatgcccccctccttcctcgccgctgtaggttgcacacgatgcaggacactccctggtggcccgtctgcgtggcatccagctgaaggcaccgtgcgtggaggccaggctgtctgttgcgggcctttttttctttattggggggggtgtttatgggcacacttgcacttgaagtcctgannnnnnnnnncttttttattgggggggggggggttatgggcacacttgcacttgaagtcctgaggtcacgctcgcgcatggcatactcccaggggtggcggcgctccttgcttgtcacagcacacctttccctctttcctccgaccctcgccagtctcctggtgccgagcaccgcgctgggcacctttgggagcatccggcagctggcgtccctggtccggagccgcactgacctcttcgacctggcggcggcagggctgctgggtgggggggggacggccctggcgctcatgattgcaggcctgcaggcctctcacggcggagccgtcgccgaggcaagcgtttgcaggggctgtgcggagtagggcgggtgggggcccttgctgtgctcaaatgcagggggctggcaccttccaggagggacattggggccggggacggaatggatgttgtcggggagcaagccgtttctccgtgccccctccaccccccc

SEQ ID NO: 29992 - DNA, 61 bp, Chlorella protothecoides
gttgttgatagatagatccagagcaattcctatccctctcgccagcatcctcgtactgcaa

SEQ ID NO: 29993 - DNA, 121 bp, Chlorella protothecoides
gacggcttcaggctcgacatcaagggtgcgcagcggttggccgatggcgcagatgttttttgctgccgcgcatgaaggttctgcattcgtacctttgacgacagcttggacgaggccgtgc

SEQ ID NO: 29994 - DNA, 61 bp, Chlorella protothecoides
atccagggcccaggcggagtcccccgcatggtacccccccggtcctgggccgaccagttgc

SEQ ID NO: 29995 - DNA, 508 bp, Chlorella protothecoides
  modified_base (140)..(149): a, c, t, g, unknown or other
  modified_base (417)..(426): a, c, t, g, unknown or other
tcgctggcgcagttggttgcctctaatggcaatccgaggggattgggggtgggtggaaaggaagggaaagcatggggtccaccagaagttgccggacgaagtgcatccacaaaaaagcacttgagcaacatcaggatgtnnnnnnnnnngggaggaaaggaagggaaagcatggggtccacctaaagttgcgggacgaagtgcattcacaaaaaagcgcttgagcaacatcaggatgttgaccgccccgttgacgtcgcggttgacaacgttgaccttgcaggccttgttgacgcaccgcttcgtgtcccacagttccgtccacgacaccccgcatcactcctactgtaccaaaccccctcctaaaacccccccttttcccgcaggtgcccgacccacaagacagctagcaccgagnnnnnnnnnngcaactgtaccaaaccccctcctgaaactcccccttttcccgcagctgcccgacccacaagacagctagcaccgaggtgctg

SEQ ID NO: 29996 - DNA, 61 bp, Chlorella protothecoides
aatgtgcagcgagttcggcagcgtgatcgcagtcaagggacggattggggagaagaaaaac

SEQ ID NO: 29997 - DNA, 147 bp, Chlorella protothecoides
gacttgttgaggaaggtgggcagtggcgtgcatgtgacgtgtgggagccctctacaccactccgtcgagctcggctggggcctgctcgatcgtggcagttgagcttatcatccccttcccaccattggcgctagaaatatttgcttc

SEQ ID NO: 29998 - DNA, 327 bp, Chlorella protothecoides
aggctgcctggaatgtacatgctatgcaatgttgcggcgtcagaaagagtgcggcaggctcatcgacaggttgtgatctagaggggttgcatggtaaattcatgctggcaagcctttggatgctccccgatggacacacaccctgcagctcaattacgcattaccgtcgggcgctaaaagggctgattgatgctcgctcaagatgctagtgtactcatgagccccttcgcctgccacatgactccccataggcccgcacagcacagcacgcgcgccgcgtaccagcctggcgcccgaggctcaaaatttgcagcgacagacttaaca

SEQ ID NO: 29999 - DNA, 71 bp, Chlorella protothecoides
atcccacacagccgctgttgcacacccgcagcatcgccaagcagttattgaggtgggcggcaccaaactgt

SEQ ID NO: 30000 - DNA, 7028 bp, Chlorella protothecoides
  modified_base (2059)..(2068): a, c, t, g, unknown or other
  modified_base (2351)..(2360): a, c, t, g, unknown or other
  modified_base (4623)..(4632): a, c, t, g, unknown or other
  modified_base (5676)..(5685): a, c, t, g, unknown or other
  modified_base (6112)..(6121): a, c, t, g, unknown or other
  modified_base (6530)..(6539): a, c, t, g, unknown or other
tccgccgccgggcgcgccggccgccgcggcgccggcggtgttgcccagcaggcccgcggcggaggcgccggtgcccgccgcgttgctgaactcggccaccacctcgtcatgacgtagttccaggaggaccacgcgcctggttgcaggggggggtggggaagcggtggacgggggaggatgtcaggggattgaggcaatggtggggcttggcacagtgggttgagggcatgttggtggtccagacaggggaagggcagcgtgacaacggcgaccaggaagaaggtgggtagcgatggatcatgcagagaggtgcgtcaaaactgcacacacggtgcagcaagtcacagggtggaaatcatgacaggaaggtgaattgtgcaagggctactatcagataacaccagactggatcaggcgccgtcagcgaaacccccgcgaggctctctgtgcgccccccatgaaactccgcgtggcagggggatattcacccgcggagagatcaatgagggcggtggcatgggcatgcaggtgggaccaagggtgtgggtggggggcgcacttcatcgcaggatggcacacacctcccacaaactccacccaacaaaggggagagtgcctcgctcacccatctgccaagcccaagccgaccacatcgagcgcggggctgggagccagcacgcggatgccggaccccaggcccctgaactcgtgcagcagggtccccgtggagaagttccacagctggaggcggccctccgcggaccccaccaccaccttgttcaggtaggtgtcggggtgggcgagagtggatggggtgaagccgggcccgagctccagggtctggaggggggcggcccgctcccccagggtccaggcacgcagggtgccgtcggtggaaagggtgagcagcgtgctgcccaggacctgcatggccacgaccgacccggtgtggcccctgtagaccccggtgacatgcacgcgtctggtctccacgatgtcgcccccctccaacgcagccagggtcacgtccccggcgcaggccagggcagtgatcgatcgaggaagctgggaggggagtgggtgggggtgtggcttgtgtcagtgatgattgtggcaaccgttcttttgagcaggttgtgaatcctaacactggacccagcaaaaaacgagtcctgccccatggcctgcggtctctcggggcgaccacctccaaccccgcacacctggggaccgatgagtactaccgtgagcttggcagtgttgtatatctgcggagcaatggtggtgggaggggcctttgaggtggggacgagggcatgccagacggaggcgcaatccctgaatggacacaacggttccttgcacactttatacctcactgtacgccatcaacgtacctgccatgcattgccgacgctcacggttgcgtacgtttcccgaccgcgccgctggactgcaaaggggacatcgtcgacgatgtgcccgattgcccggaagggttcgaagagggccattgcgccgtatgtgagagggctaaatcatcttgaaagaatgacaggtgcatgcgaattggtggggcgatggccatatgtgtacgcagccagcagccggctgctgggtttcaggtggaaagggtcgcgcaaggggtttaggggcctaggcataggtgtacggtgcatcagagggaagacacgagtgtgattggatcctgtccggggaaaaatgttgcaaccgatacaatcagatcggaaccttgccttctggactgctccgtggtgcctgcatgttgctgtacatgttccagtgccaccaatatacaagcttgtaaggcaaagacccaagtctgagggggcaacgatgacccataccacagccgacggtgcaactttgcaaagtgctggtacctctgtggacacggaaattttatgagcatgacgtgtgaagtgcataagtcatgcagcctttgctaccataacgattgtaggaaactgtcccccccacaatgttggccacagtcccaatgagaattcattgcgcacaagttcatcttttattgctnnnnnnnnnnaatgagcatgacgtgtgaagtgcatagtcatgcagcctttgctaccataagggttgtaggaaactgtgccccccacaatgttggccacagtcccaatcagagtcattgcgcacaagttcatcttttattgctggtgggaaatatgcaggcctgtcaagctcctcgtttgatatggcgaccctgtgcagtgttcacaatccatctgtatacagccattgtgtgcaaaattgtcagctgcaccatgcccacgccccctgcaacctcggatccacatgcccatagnnnnnnnnnngatccatctgtatacaggtattgtgtgcaagattgtcagctgcagcatgcccacgctccctgcaacctcggatccacatgcccatagattcacaaacagtacaaaatgtgcaggagttcccagagtggagtgggacaggtgcctcctgtccttgttgaacatggtactgcccgccccgggtcccggctagggttcctccaaaccccctctcggcaggaacacattcttctgtggtacaggcccactccgaatccaatgtgtagacaatctcgacacatttttgctttgataccaagaccgcgattgtccattgacagagcccgtgagggccacgagagtcgcagccagcgatgccgcaaccactccgccccttcggcctggagcggtacctggcaccccgggagttcaaatgcatacatccaatctgtgtgagcgacaccgagacctggaagttgtcggagctgctggaacatgctgacgcggacacccttgctcggtgggtgggttccggggggggggggcgcccggcgtgggtcgagggctgttccccgctgaatgaccatggtaagatcaggagtctgacaccctgaagcctccctccacgacaccttgcggcaggtggaatgacctggggctgggctacaccaccacccagggcctggaggtgctgcgggaggagattgccgcccgccacttcaccaagacgggaaaggacgacatgctcctggacgcccctggcgatgccatgtacgtcgccatgcgggccctgctcaggcccggggaccacgtcatctgcaccttccccgggtaccaatcgctatacgagacggcgctgagcatcggctgcgaggtcacccactgggaggcgcaggagacgtgcgtatgagggaagggcgcagctgaaagggtcttgggcgggtggggcctttggcgtttgggggtcctggtgagggagcccaatccgtgcctgctgctccgaaagttgggcgcttgccctgcccgacaacttgccctgtgcctgccaaccctgtcccaggcctgccatgcgcagatgccgcacccctccctccacccctgcccgcccctcgcctcctctacgcttgcagggcggagggtgtccccgtgtttgaccccgcctccctgctcaccctggtccgccccgccacgcgcatgatcaccgtcaacttcccgcacaaccccaccggcttcctgccgagccacgaggagtgggcacgggtggtggccgccgcgagcggcgtcggcgcctacctcttcgccgacgagatgtatcgggggctggaggcggaggcggcggaccgcctggtccccgccgccgacgcttacgagcgcggcatcagcctgggcgggctcagcaagtcggtgggcctgccgggcctgcgcatcggctggctggcctgccgggacccggagggtgaggcgctatcttggtggtgtgggaggggacttgggccgggtacggtctggacctgcagacctgccgtcgccagggctgggaagcagagccttcccctctcccgtccaggactcaaacaggcgccgtgcacgcacaccctcgcatcctccacccccgcaccccccgtccagtgatcaagcgcgcgctggaggtcaaggacttcaccaccatctgctccagcgcgccctccgagatcctggcgctcgcggcgctccggcgctgggacctgctcatgcaccgtcagctgggcatcctgcgtaccaacgcggccgcgctgtgccgcttcggcgagcgctgggcgcgcctgctcggggtgtacgccacgcgcggcgggaccatcgccttccccaaggtcctggtgccggggttgtcggtggacgcgctggccgacgggctgctggaggaggagggggcgctgatcatgccggggtcggtgtacgaggcgccgcagcacgcccagcgcctccgcctgggttttggcagggccaacttcccggagggcttggcggcgttcgacaggtacctggaacgccactacggcgagtatgccgtggtgtcggaatgaacagtgtctaagatggcatcgtcagacgtgtgagaaagtgcaaggacgctgtgctccagcgtgggtggatgaccggcaagtaaggcttcacagatccttgcgcgccaagcgagttggacctgccgccgcgcgaatgcgctcgtgcagtgtgcgaggagggaggctacacggcagtgcatcacaaaatgccatcggagaaccaggcaaacgagctgtgcactccnnnnnnnnnntgaggagggaggctacacggcagtgcctcacagaatgccattggagaaccaggcaaacgagctgtgcactccaggaaggcaccagctgcactcgataaggacatctcaaacaggcttgcctgcctgccctccatggcatctcactcttccaggttgatggcattgccgaatttggcatacagggtcttcttcagcgctgccatttgcttcaggagcgaggccctctcatcggacaaggcggcacactggctcgtgccctcgttggcagctgggcggggaggggatgaaagtgtgcttgcttacccagtgtctagatatgaccccttctcgcaccacccgggcgatcgtgccgagagccggagccagcagccccccgccccacctgcacccctgcaccactttgcccctcgagacccaccctcttgcagccgggcctctgcgacctctttttcgagatgaaagaagcattcccccacaaggtaaggcacttcctcgtcctcggccagcatcagctcgttctccgcttcctcgatgtcctccgctgcagcctggtggggggtattggtgccgggtggaccgaccgtgtctggcaaggtcggggtacctgccagaaccggttcgctacccatggttgaaccaaacaacagtgcctaccttcagagctttgagcttcgcattgatctcgtggaccttggtgttcagtcggctgaagtgattgatgttctcctggtccgctaatgtaacatccatggagcgccgaggtagaaagaatcaatactggatgtgttgattctgtgtttccctgccaatttaggcgtgcgagccgttgcgtggagattgtacaaactcctccgtctgcagggactgcagaactatggaggttgatctcacaaagcaatgatccgcggccacaaaggagtatgaagtattgtgagtgtaacagtggacccaaaggatgtactcaatctttcaatgaacgcaatgccttggtaccgggcaccgtcaaaagtcaagcggagaagacttccatcctttccagctggnnnnnnnnnnaagcgcaatgccttggtgccgggcaccatcaaaagtcaaggcggagaagacttccatcctttccagctggtctgattcgtggctcaagtgcacccggattggcacccctctcgcgaccacatccgactccgaaatccggccaaaacagcttctcgttgttctggggcggctttctgccatgcaaccaaaaataatgacggactgagtttcgagagccttctcgcaccgcccctgctcgaccacccgccctggtcagggcgggactcggtggctatggtggagaagtgctcccccggcaaacgccgggcgcccgacaaggatggcaatgcggcagcagatgcagccagggtctcgcctgttgagcatgagctactcgacctggccatcatgtggttccgtcgggacctgcgcctggcggacaatcctnnnnnnnnnngttcacctgttgagaatgagctactggacctggccatcatgtggtttcgtcgggacctgcgcctggcggacaatcctgccctcgcagccacggcccgcatggccaagagagtggtgcgtgggcgcgggacccggcacgccgggccctgcctcgcacttggcgcacccaggcgggatattgttgcccggtcgattgcactgctccgcgaagcctgcgccccgttacgccctggtcaaaaggccccctcctgggcctgtcctccacggggaagctgcctgacgcagggggccctccatcgggctgcacgctgtagccaccctcaccaatatccatccgcccacccctcgctccctcccccctaccctcctgtagctcccggtgtacatatggtcccccgaggaggagggcnnnnnnnnnngcgcagggggccttccatcgggctgtatgctgtagccacccttaccaataaccatccgcccacccctcgctccctccccccaccctcctgtagctccctgtgtacatatggtcccccgaggaggagggccagtttcagccgggcacctcctcacgctggtggctggccgccagcctggcaacactggccgccgacctggccgcgctgggctcccgcctgctcctcctccgcgcctccgactccggcgccgcgctgtgtgagctgtgccgcgacaccggggcccgcgccgtggccttcaaccacctctacgaccccgtgtccatgtgtcgggacgccgaggcacgcgccgcgctggccgccttgggtgtggcctgccacccgctccccgctgacctcctgtgccagccctgggaggtgctgcgcgccgacggccggcccttctccgactttgccagcttctgggaggcgcaccgccgctgcctgtacccg

SEQ ID NO: 30001 - DNA, 63 bp, Chlorella protothecoides
gccccgtcgcaaggtggggacgatccacgcaagccgcgccggccatgccaccgaagaccatgg

SEQ ID NO: 30002 - DNA, 75 bp, Chlorella protothecoides
caggaggcccccaaggaggaggaggaggaggagaaaaaggagaactgaggctgtttccaaaacgacgagtggagg

SEQ ID NO: 30003 - DNA, 159 bp, Chlorella protothecoides
cgttggcgtaccagaggtggtctgcgcaggtgggttgcatgatggtcgatttgagagcctggaaccgcaggcagggaaagggcgcacaggggagcatgcacctcagggccatgattcatgcaagatcctggcgaggcagggagggccacagaacaatgt

SEQ ID NO: 30004 - DNA, 76 bp, Chlorella protothecoides
tgcgctgagcaagccgtccatcgaggaggcatgcgatgagctgctaaaggagggtcaggtgcgaatcagggtgcag

SEQ ID NO: 30005 - DNA, 80 bp, Chlorella protothecoides
gtccaccgccgaggcaagtgcacatgggagagggatgggagttgagggttcggggctccatctgagggtccgtcatacgt

SEQ ID NO: 30006 - DNA, 638 bp, Chlorella protothecoides
  modified_base (203)..(426): a, c, t, g, unknown or other
cgggcgccgggctgggcggcgggcgccgggttgagaatgggattcagggggtggtgcggagcacctgcggccgagaagttgcttccttgtgcccggtcagggtatggaagagccatctgcgcctggacttgggggcaccagacgcatgcaccgccttggggttgctggcctagcgagcctctggcccgtctcaactgcccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagcctgccctgctgtgggtgggtgtgaggctgtcaggcaaagaggatgggcagcccacacgatgcattgttgcgcgtggcggctacggaaaaggggtgttacggcaacgatgcagcatctctgcgcccggcagagtgtcagcatggaacagaccccagccgcgctcccatgcctgcaggaaattactcggcatatgtggcccagaaacgc

SEQ ID NO: 30007 - DNA, 61 bp, Chlorella protothecoides
agggcaacaagggcagacggaatcatgcaggccagccatgagtgcatgcaagtgcaggagg

SEQ ID NO: 30008 - DNA, 61 bp, Chlorella protothecoides
gcgacgaccgggcttgggcgggcattgcacacccgtcatgcgcatggatgaacagtaggtt

SEQ ID NO: 30009 - DNA, 78 bp, Chlorella protothecoides
ggtcctccccgtcaccagcatcggcagcgcagaggtgaggggggagcggggcgattgggtggggtgggggctccctgc

SEQ ID NO: 30010 - DNA, 130 bp, Chlorella protothecoides
gtccagtcgcacacataacgacggattggaacagggcaccccgtgacacccacccaccaaaagcatgccatcatctacaatcccacgggcctcaccggaagggggaaagacgtgcgctgcgtcccccgcc

SEQ ID NO: 30011 - DNA, 127 bp, Chlorella protothecoides
ggcgttctaggtgcaatatgtacggcataaggtttctaatcactataggcaaggcaatcgtgtcctggtgctcttctcagcatctgtcgcaacctggcgattatttgcagttcccgcgctcttgtca

SEQ ID NO: 30012 - DNA, 61 bp, Chlorella protothecoides
gagagtgtccacccgatagtcgatgtttttccccagagaacactgctgctacggaagatgc

SEQ ID NO: 30013 - DNA, 112 bp, Chlorella protothecoides
ctcatgctcatgcagcagctccttgacagcatagatgaaggccaggacgggacccttgttgtcgctcacaccccgaccatataggtggccatcgatggaggagagctcaaag

SEQ ID NO: 30014 - DNA, 74 bp, Chlorella protothecoides
ctgggactggtcaatcccaacagtctcattcctctggggtatatggggatcagatggtggatgagtatcatcat

SEQ ID NO: 30015 - DNA, 78 bp, Chlorella protothecoides
caccccttctagcgcgacaaactgcacactgtcttccgtacttagaaccccttagcccgcgacgtagcgctgctcttc

SEQ ID NO: 30016 - DNA, 66 bp, Chlorella protothecoides
tgcctgtgtcagtgtgtggattgttgattgactcatcaccttggtgtgggtgagtagcattggagt

SEQ ID NO: 30017 - DNA, 69 bp, Chlorella protothecoides
tactggcacagcgcgccgctacccttcccgaatgcttggactttgagcgaaacccagagttatactata

SEQ ID NO: 30018 - DNA, 143 bp, Chlorella protothecoides
acgcacgcaccgcagcaggttctgggccgcctgtggctgcacgctctgcagcacagcctcactgggcctcgcctcgcccggcggggccgggcagcgctccgtgggatcgcctccgggctgcggggccgcagggtgcgccgccg

SEQ ID NO: 30019 - DNA, 130 bp, Chlorella protothecoides
gcggaatgctccgaggaatttatgacacggaaaggccatggggctccatggggggctgcccatgggcactgtttagggacaggttctgagcttgcaagggggtctcactgcacgcccgcccagcgcgcca

SEQ ID NO: 30020 - DNA, 170 bp, Chlorella protothecoides
cagggtatgactacaacaggtatggtcttgaagaagatgggatgcatcatgttggcagagcggtgccctcagcatggcatcccagtaaaacctcacacaagcagccaccaatcccctgatgcacaggtgcatgagactcgcactggtgcacgacatcgctgagagtgagt

SEQ ID NO: 30021 - DNA, 251 bp, Chlorella protothecoides
agcgaggaaagttgacaaactttgtgaaaagcacatgcactgcacttgtttatcgtatcaacggattgcacgccctcaaacctctgcttctgttcttgagcacaaagcacgaatggctggcaaacgacagagtcattttccctgaagttcaaattactgcagctgtggagggtcatcacaaatgattagtgtcttgaaagtacaccagaggaatactgccacgttgtaaagattgtgggtcgaagtttcac

SEQ ID NO: 30022 - DNA, 69 bp, Chlorella protothecoides
atccgccctcaccttgagcagctccctgcgggcgatggcctggagctggcggtaggcggcgacgggtga

SEQ ID NO: 30023 - DNA, 118 bp, Chlorella protothecoides
gaccccacgcgttggagagaagccctgcaaccccatctttgccagctcttcttcaagccttcctggccatcacgcacaggtggcgacttagaagtccgctccattcaagggtatggaa

SEQ ID NO: 30024 - DNA, 73 bp, Chlorella protothecoides
agccggagcgtacgctgacggagcagccggagtgtacgcggtggatgcggaggcgtacagcgtcgatgcggag

SEQ ID NO: 30025 - DNA, 113 bp, Chlorella protothecoides
ggtgtcgttgaaggaggcgaagatgtgggcaacgccccacaccagctcgccctccctgcgaattggtagaatgaggtgaaggagtgatgaccaggggagcatcgcattggcgt

SEQ ID NO: 30026 - DNA, 61 bp, Chlorella protothecoides
gtgaggagcctgatggatgtcacgggcgggtgcaccggtctcgaacgggcggggatgcagc

SEQ ID NO: 30027 - DNA, 63 bp, Chlorella protothecoides
ttgagacaccagggacttgagactggatgtagccatgacggagcagacagcaccctctccaag

SEQ ID NO: 30028 - DNA, 78 bp, Chlorella protothecoides
taagagaggaagcttgggtgcacgggcatatcatggatagatggtaccacatgcggcaagacatcccaaactccttgc

SEQ ID NO: 30029 - DNA, 148 bp, Chlorella protothecoides
ggtgtgggagtacagtgcggactgtgtgggggagagcatgcgaaaaagtgcagtacgaatgcaaggggccatgggtcacgatgtcaagtcaagggtttgcatggcgctgcatggcggagcgccgattatcagttgggcagctccgttg

SEQ ID NO: 30030 - DNA, 61 bp, Chlorella protothecoides
gagggcggcaaaggagttcatgatcaggttaacccacagcagctgcagcacgttcagggcc

SEQ ID NO: 30031 - DNA, 61 bp, Chlorella protothecoides
gccggtcagctcccagacgccgcgctgcagggccaccagctctgattttggcggcatgctg

SEQ ID NO: 30032 - DNA, 149 bp, Chlorella protothecoides
tgggagacacaacattgaaggtcagaagctgacggatcagcttgtgcctttgatcaccatacgggaccttgagggttgtggggaagggggatattccgaaagctggagtcgagcgcgcgttgcatgtgtggggataacatgagttgaag

SEQ ID NO: 30033 - DNA, 76 bp, Chlorella protothecoides
cgtctgcgcccaggccggggtccgacccccccgcccctccgcgcgagccaccagcgccgtcacggcggtggggaag

SEQ ID NO: 30034 - DNA, 203 bp, Chlorella protothecoides
gtctggtcctgggtcttaggccggtgagcttggactattcttgagggctggagtagggagggcagagaatcgggcagatgggtctgttggacccaagtcgtggactggagggtgccattgatcctaagcagggctgatcggcagacagtacacctgctgggtagctcacggtgtgcatcatgccatgaggtactgccaatata

SEQ ID NO: 30035 - DNA, 93 bp, Chlorella protothecoides
cccccccccccccccccccccccgcgcaggcatgagctactccttttcgtcggtggacctcgcccacctggcgttcccttccatcatgaagat

SEQ ID NO: 30036 - DNA, 74 bp, Chlorella protothecoides
catgcgcgcccttcaccctcctctccagcccctcccctctcccgacctcggagttgagcgtgacgctggtgaag

SEQ ID NO: 30037 - DNA, 92 bp, Chlorella protothecoides
gagaggtcctgtcagtgaaagagaatggaagggtcatgcgacatccgtccctgctctgcaatacccagcatgctggccagcaagcacgagct

SEQ ID NO: 30038 - DNA, 75 bp, Chlorella protothecoides
gatagggggttggtgagagttggtggggtcagggttgcatgagcgctgcacccaggcacctggcggtgcatcgct

SEQ ID NO: 30039 - DNA, 110 bp, Chlorella protothecoides
catgccatatgtacatatacatatgtcgcattcacacgcgttattcatggtatggcggttccgaatgtgcatgaggggtacagcgatggtcacatcgcccatgccctgct

SEQ ID NO: 30040 - DNA, 80 bp, Chlorella protothecoides
cagtctgctgttccacggaaaggtccaatgttttccccctgcctatctgggtccccaacaaggtctcccctcctactccc

SEQ ID NO: 30041 - DNA, 201 bp, Chlorella protothecoides
cttggggatcacagggccatgctccaatcataactctcactccgttgagaatcgggcgaggatgagtgctcgctcatgcacaaggtatgcgttgtcagccgctgccccttgtcgtgatcgatggcagatcgcaaggcactcggcaccccacccaacacctcctcgtccacacacccagcagggggcagtcccgccacgccg

SEQ ID NO: 30042 - DNA, 64 bp, Chlorella protothecoides
ccgtatggcatactgaatatctggtaattcgcgtctggatccttggctggtactggcctgccca

SEQ ID NO: 30043 - DNA, 71 bp, Chlorella protothecoides
tgcccagtcgggtgggggcactccagtggtgtgggcaagtgtgcgtcctgcccggcggcccatccaggcgc

SEQ ID NO: 30044 - DNA, 71 bp, Chlorella protothecoides
gtgaatgataaggggggttgatgaacatgacacatccaagcggtgcaagccctcgagtgctcacgttcatt

SEQ ID NO: 30045 - DNA, 5943 bp, Chlorella protothecoides
  modified_base (151)..(160): a, c, t, g, unknown or other
  modified_base (1524)..(1533): a, c, t, g, unknown or other
ctctggcggtggaggaagagcggtggggctggtgcgtatggtacagatcgtctttcctgtgggagctccggccgccaggctgccgccgcctctgcctgaattcaaagactcctttacccccctcccacacaccatccacataaaccaacgnnnnnnnnnntccgcatcagctgtatgtctccggtccgcgtgcgcttgacgccgatgccctctggcggtggaggaagagcggtggggctagtgcgtatggtacagatcgtcttttctgtgggagttccggccgccaggctgccgccgactctgcctgaaattcaaagactcctttacccgcctcccacacaccatccacataaaccaacgatccttgcctgcaggcggtgcgtatcctgcggacctaccccgcgggccgcttggtggtgctggcctacctcctcttcgtgcacgtcatgatgtacctgctgctgcaccgcctccagcgccgcgcgttcgagggcggcggccggacgggcctcagcgtggccgccctgcgcgcccaccgcgacgagatcgggacctaggcgctggacgccatgcgaccccggtgccttgaagcctcgtgtgccttttcggatggctcttggcgaccttcacatctgcttgagctcactgagcacgacacagcctggccccacacgatctgcacatgcccaatcacgggctgcctgttacactcacgcattgcggtcaacagccttgcacacagactgcaaggcagaagatcatcgtacacgcctgttccccattgcaatcaggcggcgggcaccgagttgtatgcctcccccggcttcagcgtctcgtacacctggcggctgaccagccaccgcccaggctcggcctcctgcagttccatgcacacgcggtatgtcctccgcacatcgcccgtgtgatcacctgttgtggcgtggaaagggggaggaggtgacaggggcccccgcgtttggcggtcgtgccaggctggaccatcaccaagcaaatgggcaggcaggagggaatccatccagcactgggtgccaaatcttcccgtcatgctcatcccccgggaccccctcaccgccccgccacccttcccccacacgctcatgctcaccggctttgaagggctggactcgctccaccgcctccaccttccaggtgttggccaccccctcccggaccacgattgcgcccagccactcccgccactcgccgcgcccggcagccacctgggccatgccgccgtaccccggccccccaaggtagtccaggtactcctgcttcccgcactccaccccctcatgcttgtagaagaagtcgtccgacagaaactgtgcccgtggaggcgtatgtgcgtgtgaagtgtgggtgggaaggctggagggtgtcatgtccatgaccatgtagtgcccggtgcctgggcaaaaggtgttgcaggggcatgcaagcacgtcgcgggatgagaggaaccctttcacccgactcgatacagatggctcccgacactctggnnnnnnnnnntcaggggcatccaagcgcggcgcgggatgcgagcaaccctttcacccaactcgatacagatggctcccgacactctggacacgtcagggatcctctggtgccccaccatcccagtccgccctgcccctcacctctcccagccgcgcgaccgtatcggtcgggggctggggggcgatcccgcagaacagctcggcggcggcggtggtcatgcccaccaccgcacgccggacggccacgcccgcggggcgcggctcggcgtgcttgacgaactcaaagtgctccagggcctggaagatgccgccagggccgtcctccgaggcctggcaggacggtgtgccaggggcggatgggtgagggtggagtacggcgggcgggcgatgcagtgcatgcactggaggccgtggaaactggctgcctgggtccctgcccgaggtgccccacgctccccgagggtaccacgccacgcgccgcgcagacagtgtgcggcccctgggccccctcgaacgacagccggggaccccgcccggcacgcagcgcaccctcccccggcaccaacacctggaagagggtgctcgatgcatgggcgtcgcaccaggccctgagctccgggtgggcgttagccaccatgcacccatgcacgccggcaacggcaaacagctcgatgtcgttgccggagtcccccgccaccagcacgccatcgcgcggccgcccagcgcccccgtccatctgccgcattcgggggatgcaaatgagtgcatggggtttgggggtggggcgcggggctgtcggagccgggtgcggggcggcggtgaggagtggctggggtcccattggaccatgccaggaggcaggcgtgggttacaacccagcgcacgggtactggcaccagggactgagggagcgtcattcgccgcaggctgtagtgctcactttccctccctacataatctactctcctccctttccaccagtccaccgccccgcacctcctctaggaggaaagccagggccttgcccttgctggcggctgccgggaggaggtcgaggtcgacgcctgcagagtagatgacgttcacctccagccctgcctgcttcagcttggcagtgagctcctggaccaccgcatccgagccggaggacaccttgaagctgattttgtgcggccgctgctcgctggcatcctgtgttgggtgatgtaagctgtgatgatcattcagatgtgagaggatggggaccgcatccaaggtttagcaacatatgatccatgtgactcatcgccaatgcccattacctaacccggcatggcaccagtcctgcgtgcacctgaagagtaagggcaggctcggcctgtgcaatctccagagttttctcgcggtcccatcccctgtccaggaaatcagaccacggcttgtgcggcacacctgaaagggcagggctggcatgttgtcgagggtgcgacatgctgtgggaggctgatgccacggctgcattggaatagtgacagtggaacccacccagagcaaatgagagagagtggaaatgcccgacgtcccaggccttatatctcaccctggaacaggatctcggtgccaacagagcacaccaggatgtcagggaccagaagagggacctcggcctgattggacaagcagaggcatgagggtgtggtggagtgtgagggcggagtgaatccagcttcataggttgcactgacagcatggctctccaaccccctttccttcccccaccccaaggccatctcaccgccagctcctcatacagatggggggatctgcccgtggagtacacgagcagggagtcatgggagagatccgtattccaaacatggttcaggcggaggagcttgtcgtgcgtgtgatcgttgtgatcgacctgaggggccaaggtaccgggatggggattggcaaccgggttaagccagatgcccacatcggaattcatgagacaccccgcacgctcgcctcatcacacggggcaaaccgtaccacattcgcagcaacatctcaccatagtccagtccagatcagagacaagggcgaatctgacctccctgtccaggggaccctgctgggtagttttagagggctgcatgatggcaatagcgatgcctctatcgcctctgtctgacgtgcgaattctcctgtggacagttaaatgatgaggtgttgtacacaatcagggactctcatcaagacatggggcatcttggatggaaggagctgctgcgcaggggtcaccatgctgcgcgtgatggcgggaaccatcaccttctcaaggccacgcgggggcaacgaactctcggctctgttgctggtggggccccatccgtgcctctagagcctcgaacagcgaagtgcccgggcgatgctaggttgaattacgtctaagaaatcaaagccggtgccctctcctctctccgcgcctgcctttcaaaggtcacagctgacacgttagcgatggcagcacccagccaagccagcactctggtcaacaggggaggccgcagtgggggcgagggcgcatctgcacctaggtccacacccacggccactgcctcgagggcgaggcgcgcctcaagtaaggactgtcggcctgaccagggagggtgatcagctggtgcactgtgtgaccaggccggctgaggtaacccgtaatggaccgctggaatgaggaggtgtggtttaggctagtatagggctaaaagtatcccctcctgcgctgtgcagcccgtggcagtgctgccaagggtggctacttctacaccgacgacagctcagcgatcaagctctcaccggtgcgcatcacggcagtgcgcacatttggagggtagccattgtgttgccacgtgcctttaatgggtgtctgtatcgattacggcatgtgtctgagagcttctccaccatcatctttcagaccgcagtgattggtgctgccgtaagcttcatcatcttcgtcttcattctgcacatcttcggcaaggtattagtaggggtgtggtcatcatggccttgatgcctgtatgtgatagccataggcatgcgacgtgatgctggagctgtatctcaaccactgatggtgcaagactgaccctccctccacccacaccgattcctgaatcctgtgcagctgcgcggctgaggctctgacttcattggaccttgagacttacactagtgagagccctttttcaaggttcctatgctcgtttcgcctcattctggtttcctgacaacctgggctggcacggcccttcaggcatgcgtgcttatttctttgctgctttcaaacctttaagaatgaggaagagaaccctgggatcgctggtggatgtcagtcacaggtatcgtggaggcagtcctcaccaatactccatgctcgccacggaaactcatctcggcgttcctgcacagcagcatgcggagcatcccggcgcaatctcctgcattgctcatgcaccggctctctgcccaagtcatgggcgcgatggactcgcaggatagatatttatttgttccagagaacatggcttcttgctggccaagctgccgagtcggcgaggggcaaggacgatgcccccccgcccctcccatgcccagctgcattgtcgctgcaggtgggccttgagatcgcgcgcagagcatggtctcccttgggtaccatgcaaagtttgacgcgcgccatgtgcttcaatctcagcccccagctcgatcggtgaggcaggtcgggatgaggggccccagacggcctggctgtcacccagctgcgcagcgtcggcagcaggcctcggaggtgcacactacgcctgacaccctgggattgatgggcatttctaatgtgctttggagacctcaaatgcccatcgcaccttgcactgttgcaggtgcctagggtcccaggcagctgcagagcaggcctggcgagtggggcactacaggtctcgagtgtgattgcgcgccagcctctgcggcagcaccaatggtaggtcctggacagacatgcagggcatgtgctccctcatgcatgcgcgtgcctgcagcccgactcttggcagggcagggaggggcaggagtctgccgtgctggactcacccagaaggccggacgcctccctccttcgcgcacagggccggtgcccagctccccggaggccagcggcgcagacggcataccagccccccacggacccgcgtgctgtgcgcgctgggcctgcgcagcctgcgggcgccgccggccctgctctcgcgcgacgcgcggctggtcctgctgggcggcctggccgcgaccctggtctggtttgcgctttcgttcctgggcacgctgccctcggtccgtgccgcgctccggcgcttcgtctggtggcgcggcgcggcgcgcgccgcgccgcgcctcg

SEQ ID NO: 30046 - DNA, 119 bp, Chlorella protothecoides
gcgaccgcacctcctcgcctgtggaggggggcggtgggggcgggggcgctgctcggcctttgccagcggggctgcggagcaccgcgcccagcccctccctgcccgccatctggcgcgtt

SEQ ID NO: 30047 - DNA, 80 bp, Chlorella protothecoides
cagccccgttctcccagctcccatgctcgtgctcctgccccgcactccatcctcccatgctcaccgcggggtcgatggcg

SEQ ID NO: 30048 - DNA, 282 bp, Chlorella protothecoides
tcaatgcttgaatggaaagatgtacataataatgctttctgactttgggaagctatctagacatgactcgtcaccgttgccgtcctcattggaggtgtacacctccctgcaagcaataaagagcagttcagttaagtgggcaattaattgaggttcaggtatgacaagaaccagtgctgtgaagacagggcggtaggggcatgccgtcataaatccatagcatttccgtctgtttcagttctccctgcctcggaccctgacatgctagtgagtgcgcccatc

SEQ ID NO: 30049 - DNA, 111 bp, Chlorella protothecoides
ttcttgcagcataggccgcagcatgaggctctttacaaactgtcttaaaattcacttgcccagttgtacacaccttccagtcagcctctcggaaatatgtactcctatgta

SEQ ID NO: 30050 - DNA, 79 bp, Chlorella protothecoides
ggaacagggcggggagtcgcgctagtatggtgggtgggtggatcagtgttgccggcacgcagtcgacagtacgggatgg

SEQ ID NO: 30051 - DNA, 174 bp, Chlorella protothecoides
aggggcgccatgccgctcgctgggacggctatgatcagctggacctctgcggtttggtgaggggaggcgccgtcgggtagcaattcgctttgaaaccccccaaatcctgccgactacacgtcccatgcccggtgcgggcgggatcaaagtcagtggttggcctgcatcgcaccg

SEQ ID NO: 30052 - DNA, 61 bp, Chlorella protothecoides
ggatggcgctgggcgtgttgctcttaatatatgcagagctggcaggttgccagcatcaatc

SEQ ID NO: 30053 - DNA, 97 bp, Chlorella protothecoides
attccatcccggaggcaccccgacccaaacctctatcgctcaccaggaggtgacttcttccttgggcacgccgcgctgatccgccagcacgtctgca

SEQ ID NO: 30054 - DNA, 1466 bp, Chlorella protothecoides
ctaaacctaaacctaaccctaaccctaagcgacagctgcagggcctgcagattggagggtgcaaagatcagcttggggatgttgagtctggcagagactggaacttcctgcagccagaccaggaatcatgacgcctccaagcccctagcgcttacatcaccaaggtgcacccttccaaacacgcacagtctcccagagctctccgtcacccgcactgtcttccgcggcatcaacgactgccagcgacccgcctagaagcatccgcgccattgcatgcagcgcttggcgcagcggggggatcctgcgtagcgcttgcagtagagaccagctccaagatgcacacaggtagctcaggcccctcgcctccatctaggcaagacgacaaatacgcactcagtgtcggccggcacacagcagagagctggccaatgccgcgctggcatatgagcccctcagccacccgcaagcacgcagcgcactcatcgctgtggcagcaggtccacgcgcagcaagctctgagcggaggcgggtggtagaggctgccgtggtcagctccggcaacacgtcgctatcagcaatgatgggtgccagtgcaacacgcttgcgctgccagatctcatcgttggggatgcgccgaggtcagacgcgagcatgcattgtttgcctaccactgcctgagccagcactcctccgttcgagggacacaccagctcgctttggaatggtcgcagcaccagcaccagcactgcgcctgtgtatggtgagggcaggggggatgtgtgtcaggggagaggcttgcaaacactgggcgatgaggagctggtgcacagcattgaagggcctgggggaaagccaaaagccgatcacacaccatgcatcgagggatatcctgcagatgcgcagcaggcatgcaggctgatagaacacaggccacagcgatcctccgcctcagtgctggccatcgttctgggtgacgccattcacctctgctcaccctgcggccccactgtcatcaagtcaacctcaatcccccgatcgcacctcaccaagcattgtgctagggcgatgccgctgctgcagtgggtcacgtcctcctgctacaaggccagctgaagaccggtgtgtcactgtcgtacgccatgttagacaaagccgtgcctgatttgcgcagtgccagtgcacaggacccagccactgcaatctgctcgtgcttgtgggactgacattcgtccccacgctgccccacagacacaccactgcaagggcctgaacggcggcaaagaggaggagggtctcagcactgggtattgagcatgccgggggcaggcaagaaacgcaaggctcgcggtccaaggagtgtagccttgactgtgggcaaagtgcagtaagtcagatcctcgcccataccgacaggcggcctgacacagaccgccgatgcgccttggagacacacatcttggagctac

SEQ ID NO: 30055 - DNA, 61 bp, Chlorella protothecoides
cctgtaactgtatgcctgccacatggtgttccatggcttcttgaaggggatgggaggggga

SEQ ID NO: 30056 - DNA, 114 bp, Chlorella protothecoides
gcgcgccactcctcgccggggaacggcaccgacgggcaccactcgccagcggtcaacggtgccaatggtcgccccgcctccccgaccgactcgtcgctggccttcatgaagggt

SEQ ID NO: 30057 - DNA, 78 bp, Chlorella protothecoides
ggtctcggtggtcttggagtagttggtgtcgctgccagtgagaccggtggttccggtggttccagcagtgccggtggt

SEQ ID NO: 30058 - DNA, 61 bp, Chlorella protothecoides
tgcgatgcgattacatttgtaatggatgatttaaatagaacaggaggtgagatgctaccca

SEQ ID NO: 30059 - DNA, 62 bp, Chlorella protothecoides
gatcaggtttgtcaccagcaaatgctgccaatacgtaggtgcatgtgacgtcttgatgcacg

SEQ ID NO: 30060 - DNA, 80 bp, Chlorella protothecoides
ctttgcgtgaccccgcaacctcaccctacaactccccacaatctaactcaatgcagctgctccccctggcacccactccc

SEQ ID NO: 30061 - DNA, 61 bp, Chlorella protothecoides
atctatgcctaagcggagccagtggcagagcaagagggcagtgcacgcacgtcacgtctcc

SEQ ID NO: 30062 - DNA, 68 bp, Chlorella protothecoides
caaggcagggataagtttggccgtctacacaagtgtgaccgaccacttggccttccagcaaaaccacc

SEQ ID NO: 30063 - DNA, 61 bp, Chlorella protothecoides
cgtgcctttgatgggattggcattgaagtcgtcaatcccagtctgcagggtggccttcatc

SEQ ID NO: 30064 - DNA, 112 bp, Chlorella protothecoides
aagccagcagggcggaacagtaacagcgccgcggggtgcgggatgtcgccgcccgctaaaacccctgtattactagctttgatcgtgctgctgcttacaagatgcgcctttg

SEQ ID NO: 30065 - DNA, 122 bp, Chlorella protothecoides
ctcggtgctgctggaagctgttctgcgtaatttgaagtaagggtggtcgcagcaatggcctccaaggcctccttcatgcgcaggacgtccgcgaacccggtcggcctcaccaggtaggagtc

SEQ ID NO: 30066 - DNA, 68 bp, Chlorella protothecoides
tttgcggcaacatcactgatacctacttcaaatgtggccggggcgtcatgggcatcgctggagtccat

SEQ ID NO: 30067 - DNA, 102 bp, Chlorella protothecoides
ctgcgagggcaaaggggggagagagtgaatgtacgcaccataaattggaatggatgcgctaatctaaccattgagggggacgcggcacatcacatggggcct

SEQ ID NO: 30068 - DNA, 61 bp, Chlorella protothecoides
gggaatgcgccttggcagagatgcgcagccaacatcttgcctctcagcacaggtgcgcggc

SEQ ID NO: 30069 - DNA, 61 bp, Chlorella protothecoides
cctgcctcaggacgtgcactcgcatcatgcaccttgcagccgctatatggggatgtaatgc

SEQ ID NO: 30070 - DNA, 61 bp, Chlorella protothecoides
tgtatcgatagaattggctgcatgcgggcgattcagctgtatgtgcccaaccaggtcgtcg

SEQ ID NO: 30071 - DNA, 61 bp, Chlorella protothecoides
tcgatgaaaaacaatgacacaggcacgcattcatcatgatgctgcactgcgttctttgccc

SEQ ID NO: 30072 - DNA, 147 bp, Chlorella protothecoides
ccacccatctcacaggaagatgtgcagggcgaccgtgtgcaaaacgaggaggggcggcatgatgacgttcctccaccgccgccacacccccggccagactgagggcagcagcagggtagctcccagcacagcaaagttgcagactgg

SEQ ID NO: 30073 - DNA, 143 bp, Chlorella protothecoides
tggtgaggtggacgggctcgtgggcgcccaaggatcaacgatcagccgggaggaagcgtgacggcgcggcgccgcagtggccgtgcccggctcccgtctggctcccagcgtctgtacaccccaccgccactcacgtgccaggc

SEQ ID NO: 30074 - DNA, 77 bp, Chlorella protothecoides
tgtcaggcgggatgcgccctgacccacccaaagccgctcccccaagcccggcagcagcactcacagttgcggtagca

SEQ ID NO: 30075 - DNA, 75 bp, Chlorella protothecoides
cggggatgccacgtgggtggggctctggcggcacgggaggctgatacttggacttgcaaagggaggatcacatct

SEQ ID NO: 30076 - DNA, 75 bp, Chlorella protothecoides
tgcatgcccgaatcctgaatatccatccattaaccctgcttccgagagcaccgtcatcatccctgcagaaaccac

SEQ ID NO: 30077 - DNA, 61 bp, Chlorella protothecoides
ggggtccgcctccgggtcctggcgcagggcgcaggtcaggagggccaccagggccacatcg

SEQ ID NO: 30078 - DNA, 73 bp, Chlorella protothecoides
catgacccagaactcctcaccctcccctcttcccttccctctttccaatcgctcaggctggcttgcaacacgc

SEQ ID NO: 30079 - DNA, 108 bp, Chlorella protothecoides
accacaatgcaggacagcttggtcacacaaaccagcccctccaatgcctctgctgattggaaagaggggcacaccaccatctcacaggctcaggatggccagcccatc

SEQ ID NO: 30080 - DNA, 3097 bp, Chlorella protothecoides
  modified_base (329)..(386): a, c, t, g, unknown or other
ccggcgtggcacgcggcgcacgctgcagttcggcgaccccgagcccaagcgccccaggctcgcctcccccgtccgcccgcccgacgcacggacgctggaggcgctggcggccgggacggtgcgcgtcacgcgccgcctggagctggcgctggcggcccgggacggcgggcgtggtgcgacgggggatgtccaagccggcgaggcggtggaggggggcgagcgggccgggacctgggagggcggcgtgggagcgccgtactccacggccgaccccggcggcgaggcccccgcgccgagcgcaggccagacgacggtgagcctggcgaggnnnnnnnnnnnnnnnnnnnnnnnnnnnnnnnnnnnnnnnnnnnnnnnnnnnnnnnnnncagcagcctgcctcgacgcaggaggggggccgtgccggcgatgcagattccagcggcatcgcctcgacggtgggggtgggggagcggccggggggcgccggggtcccggaggtctccagcgccgccagagatcgggacggcgggggccgaggagcggaggaagggagcgccagcgccgccgcggctggaccggcgggcggcgatggcacagtggccgtacgtggcgacgccgatgtgcgcaaggccggcgctgctgcaggagccccggcgggacaggtgcctgtggatgcgaggggcggcgcgggaccaggcaatgctgccgtgccagaagcggcccacaccactggagtccagtccggggaggccggcgcgacggccgcaggcgagacgagtgggggggggtccctgaggagtgggagaggcagtcacgccagggaagaaacgctgcagcagcgcttgatcgacaccctcccttccgtgccctgtgcagggcgtgccgacctcccgccccgcatcgaggcgctgctggcgccagaggcctggcagcacgtccgcatcctgtgtgagtgcgaggagcggcaagggcagggtgctaaggcggcatgcgccccagtgcctgagcgcgcgagcggctgttctttgcgctggctggggcaagcttggatggccatgttacgacccgcgaatgcaggctgactgagttacctccaccaccatcttctcaaacacacacacacacacgttcatcaaccactcatgtgcagctgccagggtcaaggcagagtctcgggaggtgctggtggagtgcagctgggcgcagccgcgccgcgtgcggcaccgcatccccacccacgtcctgcaggagcggccgcactgcctgaggacgctggtccagtactacgagcaggtcgcgtgggagaggatggagaagaagcggggccagggctgtaaggagggcaccagggcgccggagcccgacccggccgaggccgagcccgctcgagattcataacgctgtgctaaggtccccggcaactgccaggcctgtgtccccgcacgtgtgttcagatgggtttcggtgcgcaggactgtacaggggaagcggggagaggcagcgggaagggagtgtggggtgcagcagagggagcggtgcaatggtggtcaggcaacagcctcagcggtcactgcagccgcctcggcggtcacggcagcagcctctcgtcgcagcgcggcagcggcctgggactcctgggccggcacgggcccgtccaccgctctccactccttcttgaggaggccggagatgcgcaggggccgctcgtcgctgacctgtccattccagctcagcactccaaaggccttgccatgcgctccgtcctgggaggagtagggaccatgttggattgatataatcaccacttgacctcgacggatccatacatagcgtggaatggtgcacccgccacagcgaccgaacctgcgacagctttatgctggtgatagagtagtgtgtgccctccttccaggtcgtcctcgccagcttggagcccactccatgatgaggaagtttactcaacacctcgaaccctgatgtgaatagggcggtgatgtaaactacacgcataggcatcggaggggttcctactgtccgtgcagtccaaacccactcaccattcctcgcgagcccggctagggacgcccgcattgccaacaccaaggcctatctatagacaaacaatttcttttggagtactccttcagcaacccagactcccagtcctcagttagtcctgagctcggtgtgcgagatgtaccgtgctgccagtgctgaggagggagcagagctttggtcattctttccagccccgtgcgccaaatgccgccattccctcgcaaagccgtggcaggcacctgcgccaccctctttctccttctagtggagtggcaagggcacagctagcacgatgacgacccgtaagtgggcgaggaaggcgcagctgggattctcggtgtcgtgcacgggccggctgctgtggctgaaggcctcctctgcgcccggcagggcctttgttggatgcgctgtcgcggcttttagtatcttgatagtttcctcaaacggcctgggagggtgtctccaccctccttggctgtgcccgccccacccacactccctcctccgaccccatcccgcgccgtgcagacttgaagaagaaccggaagaagaggggccacgtcagtgccggtcatggccgcgtcggcaagcataggaagcatcctggcggtcgcggtaacgctggtggtcagcaccaccatcgcatcatgatggacaagtaccatcccgggtacttcggcaaggtgagctggccgccggggtgggtcggcttccttgccctgcccttgcctgggcactggcgatggctcatgtcgtgatgtcaggacctttactgtgaagcaagcgtgctgggttgctgtttgggtggggaaaggcatagaggtgctggatgccattccttggcatgcattgctcctcggggcagatgaaagtggccaggcggggatagtttttgcagcctcgccaatggtggaacaaatgcatgcctcttgtccacacacacacactgcgtgcccgccccttattccattgttcccccaccgtctggtaacacttgctctcttcaccaccccccccccccccccaggttggcatgcgg

SEQ ID NO: 30081 - DNA, 1920 bp, Chlorella protothecoides
  modified_base (1441)..(1450): a, c, t, g, unknown or other
ctcgccgcccgcgtccgccgcggccagctcgggcgcggcgtagcgcaacggcgcggcgacctcggcgcggccccccgcggacgcccaccccgtgttgccggccagcttccagcgcccctggcgcccaaagaagcccaggtcgcgcgggtggagcgtgccgtacaccccgccccgcgcgtgcaggtgcgccagcgcgcccgctgcgtcggagacgagcaccaggcactgcgcgggcggggggcgggggcaggccgccagcagccccgccagcgtgaagtcggggcggggggtgaccaccagggggggaaggtcctcctcgtcgccgtcctgtgtcgttgagggcgggcgggtggttgtggggtgaccgtgtgtgcggagcgggggggggatgcaaccggctggagcatcagaactggagcggatctggcggcgcaacctagaaccctcgtgagcggcaaccctcctgctcagatcgataccttccacaccctcttcccccccactgcgtcccaaaccagggagaaggtacctggtgggcgaggagaggggggatgtggagtgggtccaggcccagctggtgcagcgcaacctcgtgccggtattccgccatctgcgggccgtggagttgatttggaagagggcattgtggggaaagggtgacggagtaaggactgcaaccactgccccacacgcccacagctttgctggcagggactctgccaggccggtcccaccacacagctcgcggtccctcaccctggcgaagaacttgaaggccacaggctcgccggtctcgcagtcctccccaaacctgggcggcggatggggcggcaggggaggcagggtcggatgcagctgggaccgacactcccggcgaatcctaaaggaaccacaccacctgtgactcgcccacgcagtgtgccgggtccccagaacgcacgccgaggagcccctgcccccctctcaagccctcctcccccacctggtgaggcaggtctcggtgacgctgctgcccggggtcaccagccagcggcccaggaaggtgcggccgacggacaggtgctcggtgcggtccgccaggatgcgggtgaggaaggaggcctccccgcccccgctccacagccgctcggcgcgcaggacgcggaccacgggcaggcctgccagcggcacctcccccgcggcgggggggctgcctggcggcccctcgatgtcgtcgtcgctgtcgctgtcggcctcgcccgggtccagccccgccggcagcgtgcgctcgtactcgctggtcctcctttccgtctgggaggcttctctggacggcgcggcgggagacctagcgtccagggacgcggcatcgaggcatccggcggccagagactcgacgccagcagaaccgatgccgtgaggtcctgtgcccagggacaccacggccagggatccggcgccnnnnnnnnnnggacctcgcgcccagggacgcggcatcgagggatccggcggccagagacccgacgcctgcagaaccgatgccgtgaggccctgtgctcagggacaccacggccagggatccggcgcccagggaggaggccgcggttggcgagatggtagagatgagcgagacgggtccccactcctccgacccccgcgtcgtggtgcggggggagagctgcgggatggtcttgggcgtgagccccccgttgacgctggcggagggggggtggtccttggcgctggaccggtcgcctgcggccgactcctgggcggccagcgcggcggcgctcctcctccgcctgcgtcggcggaggagccagagcgccagcaggccccccaggagcagcgcgcccaggccggcgcccagcaccgcccaggcccaggcgggcgtgccgctgccggccacggcgggcggcgggggtggcgagggggcaaggg

SEQ ID NO: 30082 - DNA, 80 bp, Chlorella protothecoides
ggatgctcgaaacacatgaccatgagcctaggccgcccggcacgccctctcacgccacacacatgcccgtgtgcctccca

SEQ ID NO: 30083 - DNA, 69 bp, Chlorella protothecoides
aatattctcttggctccgctttggtgtacaacaacatgaataccctgaaggaggtggtgccgctggttc

SEQ ID NO: 30084 - DNA, 61 bp, Chlorella protothecoides
caccattcatggcggtgagccgatcggctggcgcgtgacgatagatcggttgaaacccgtc

SEQ ID NO: 30085 - DNA, 9484 bp, Chlorella protothecoides
  modified_base (982)..(991): a, c, t, g, unknown or other
  modified_base (1774)..(1783): a, c, t, g, unknown or other
  modified_base (2466)..(2475): a, c, t, g, unknown or other
  modified_base (3023)..(3032): a, c, t, g, unknown or other
  modified_base (3483)..(3492): a, c, t, g, unknown or other
  modified_base (3587)..(3596): a, c, t, g, unknown or other
  modified_base (3870)..(3879): a, c, t, g, unknown or other
  modified_base (3943)..(3952): a, c, t, g, unknown or other
  modified_base (4137)..(4259): a, c, t, g, unknown or other
  modified_base (4352)..(4594): a, c, t, g, unknown or other
  modified_base (4812)..(4821): a, c, t, g, unknown or other
  modified_base (5118)..(5199): a, c, t, g, unknown or other
  modified_base (6430)..(6439): a, c, t, g, unknown or other
  modified_base (7215)..(7224): a, c, t, g, unknown or other
  modified_base (8437)..(8446): a, c, t, g, unknown or other
  modified_base (8864)..(8873): a, c, t, g, unknown or other
tgccgcgccctgcgccccgggcccctctccacgctggcgcgatggcggctggtgggcggcgtgctgctgggccgcgacccgcgcggctcggcgctgggcctaggcgcggtggcgggcgtggtggcgctgcgcacgctgctccaggaccgcatcgccaacctgaacggcgaggcggtgcaccacgtgctgcgccaggatgtgcgcagcttcctctggctcctgggcgtcagcgcggcgcagggctgcgcctcggccgtgctggcgcccagcctgcgccacatcgccgacctgctggcgctgagctggcgcgcgcgcctgacgcgcgcggcctctgaccgctacctcgcccctggggcgacggggtacaccgcggtgcagctggcggggctgggcgatgtggaccagcgcctgacgcgcgatgtggagcggctgagccgcgacctggccgccctcatccccaccctggtcaagcccgtgctggacatcacctggttctccgcccgcctctgggccatgacggggcgccgcggcgcggccatcctgtacctctacgccgcgctggggtacggcacgctgcgcctactgactccggactttggcgcgctgctccgccgcgagtacgagctggagggcgggttccgaggcgcgcactcgcgcctgcgcacacacgccgagagtgtggccttctttggcggtggcgcgcgcgagggcggcgccgtcgtggcgcgcttcgacgccatgaccgcccacctgcgcgggctgatcgcgcagcgctgggcctacggcaccgccgacgagttcttctccaagcagctgccgcacaatgtcacctgggtgctcaccctcctctacagcctggaccagcaaggtgggttcatttgtgtggggggggtgggggtggagggcggtgggcactcaaagggagtgagatgtggtgaagtgtgcaccgtagcatgcatcactgtggggcggcgggctccgnnnnnnnnnnatggaccaacaaggtgggttcatgtgtgtgtgggggctggggatggagggcggtgggcactcaaagggagtgcgatgtggtgaagtgtgcaccgtggcatgcatcactgtggggcggcgggctccggctcctcgaaagaaggacgcgcgactctagggcttcatcacaggctggcaagggccgtatctaccacccctacatcccaccccccaaactccgttgctcctgcaggcgacctcagcgacgatatggtgcagggacacctggtgcaccaaatcaggtacctggcctccgtggtcacctcctccttttccgcctttggcgacctgttggccatgcccaggaagtttgctgagatctccggcggcatcgcgcgtgtcagcgagatgttccaggtgctggacgctgcctcgcgcttcgacagccgcgccgcgctggccgagctggagggcgcactgccggacagcatcgagttccggaacgccgacatcctcacgccgggcgggcggatgctggcgcgggacctctccttccgtgtgaccccgggccacccgctcctggtcacagggccaaacggcgtgggtaagaccagcctgttccgcatcctgagcgggctctggccgctggctgcaggggccatgcaccggccgggggctgcgggggcgggcctggactcctccgtaagcacataagagggggggtggggcgtgcgcaaaggtgattcactggtgcattgctgggaacaggcattcgaacgtgccatgcccaccggctgtcaatggnnnnnnnnnngaatggggggtggggcatgcacgaaggtgattcactagtgcattgctgggaacaggcatttgaacgtgccatgcccaccggctgtcaatggtatcaatgtgctcagggacgctgtttgagcttccgtttcacgcaaatcagtctgtttcctgaaccccaccacccccctacaaaccctctgctcctccaggacatctactacgtgccgcagcggccatacaccaccatcggcacgctccgcgaccagatcatctacccgctaaccgcccgccaggcgtaccagaggtattccatcaccgacagctcggagggtgagtgggctgggggtctgcatggagggtgagccatgcaggtcgctccatacacatgactctgaagggtgtacgtagtgcagagctgacctgtcaagttcgttttctacctttacagatgccgcgcagcagctggatgctgagctggatgacctgatgggggtggtgcacctcaagtacctcgtcagccgcgagggtggatgggacgcttcccgggagtggggcgagaccctctctctaggtaagcgggggcagagggggattgtcaagcgctcttcgacgcctccggctcatgtcgatcgcaacccaattccattgcaaacctactccatcgtacctttcccaaacaggcgagcagcagcgggtgggcannnnnnnnnncacgcctgcgactcacgtcgatcgcgacccaactccattgcaaccccactccatcgtactttccccaaacaggcgagcagcagcgggtgggcatggcccgcctgttcttccacaagccgcgcttcggcatcctggacgagtgcaccaacgccacgagtgtggacgtggaggagtcgctgtaccagcacgccaccagcctgggcatcaccctcatcaccatctcccagcgcacggcgctggtgaagtaccacgagcacgagctgcggctcctggacggccagggcggctgggagctgcgcaagctcagggcctgatgcgtgccgggcgcgtaagcctggactcagctgccagtttgctcacgtgcatggacttgctgcaggtgttctgcttttccctctgttccttgtatctttgtgtgcctctgactccagtctgttgtccttatcaaggcctatctcaacatcagaagtaggagccagaggtctgtggctgcatgttctgcaggtcttgaggatcaactcctcgaggagttagcctctggagtcccnnnnnnnnnngggagctagaggtctgtgactgcatgttctggaagtcttgaggagtgactcctcgaggagttagcctctggagtcccaatccgcgcgggattcaaaggagtaaaccccccacgacagatcgccgaccccccccagactattcatacacatctaagattctcaaatcaggtgcaaacaatgcacggtgtgcccccgctattcgaacccatcgagggccccttcaccctggccaacataggggccgccaagacaacggtccgcagtacctactataaaagcccgtgacgcaggcaaccattcccacggagcgcgtgcatgacgtcctgcgaggcgggggccgcacgttcaggacgtccctccatccgggcgcccacctcgcaaaccaggttcgaattcaaatgaactccgacgaatggcccatgtgatgagcatgcagccggtccctttcccnnnnnnnnnntgagggccccttcaccatggccaacataggggccgccaagacaacagtccgcagtacctactacaaaagcccgtgacgcaggcaaccattcccannnnnnnnnngtcccggaaggcccaagtggctgaagagaaggggggcgccagccagcatgaggggcagacgggtcagacgagcctccgcaccaagaagaccggctgccagcaaaaatttacgatcaagcagctgaggcaagactccaagaagagcattgtcttctaccctgacatcaggcattcgggccacagtgacaccactatccagtgtctgcgtctgtcccagtgggctattgacctcgtggagtccctgctggccatcaacccaacctttcgcaacccnnnnnnnnnnacctgacatcaggcattcgggccacagcgacgacactatccagtgtctgcgtctgtcccagtgnnnnnnnnnntgcacgttcaggacgtccctccacccgggcgcccaccccgcaaaccaggttcgaattcaaatcacctccgacgaatggcctatgagatgaccatgcagccgacctttacttcctgcactccgtaccagctcttcaacaaacacacgagactgattgtcagtcaagtactacaggtgcgcccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagatgagcctccgctccaagacgaccggctgtcagcaaaaattcacgatcaagcaattgcggcaagactccaagaagagcattgtcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcccctggcgcccctgccgccgcggcccctggccccgcgcacattgcggagctcctgagacaaatctgcacactgctcgtccaggcacttgttcaccgcggccctcctctccttcttttaaagctttttctcgacgcttggcccttcgattctccagcatcctccctcgagcggcctcatcgaccgcgacatcctgtgtcccaagagggtaggctnnnnnnnnnnaactacttgatcaccaacaaggagatcgcctgagttgcagagcagggtgctcggtgccaatcacctgcaccttggtgccctccagtctcccactcctcgaacttgaagaggagatataggtaagcccagccaacgtggacacggtcgacggtctgttggcactgcacttccttccgggcacgcaaacaagccctgatggctgccttttccccagcggataagcgactgctatccatgccaatggtctaaattacctacggtgaatgggtgggtgggtgggtggggtccatgtggacnnnnnnnnnnnnnnnnnnnnnnnnnnnnnnnnnnnnnnnnnnnnnnnnnnnnnnnnnnnnnnnnnnnnnnnnnnnnnnnnnngaggagtggtcagaggacattgaacatccatcctcaataagtcaatggcgtcaatgtccagggaaacttcaaacgtccccatccacaggcatcttgcagacgctgttcaccatcagatgtcccttccctaaaacacatgggagataccaggactgacatcctccattctctgagaattccacttttgattacttggcagctccaggcccgtcaatgctcggacatcgccgtggagcttcagcagctcccacagcgtcgtcagggtgaccgtgatgtggccgacctggacgccctgacggccggaaatcaatgcgaagagcctcgtcaccagccgtcgcagttggggggtgatgtcgccaccggcagcggctgcagtggcggtgccgccgccggcgatcgtgctgctgacccctggacctccgcctccgccagcgcctccgccagcagcagcgccagtgcctgtattggcgccgccattagcaccagtgcctcggccagcgctagcatctccgccgacgccgcctcatcccctggcgcccctgccgccgcggctcctggccccgcgcacattgcggagctcctgagacacatctgcacactgctcgcccaggcatttattcaccccggccctcctctcctttcttcaaagctttttctcgccgcttggcccttcgattctccatcatcctcccttgagcggcctgatcgactgcgacatcctgtgtcccaagagggtaggctcggacttaggtgctagggaatacagaccgcagaccgctgccaacaccccacccccaccccaccccaccctgatcaggaccactgcaatccagcaccagtctcctcatcgaacagtatccacggtaagcttggggttctcacattgccatggcgcgtctgggatccgacgtaggcggggctcggcgaaggatgggcttgtgctcgtgcttgctccgcaggactctctgctgtgggacgagagggctacgaatagctatataaacgaccgagctcttgcttaacaataaagggtgtcacaaagccgcaacccagaaagataaggctacgactccattcacgacattccgtgctcactcagtacgttcacaatgtcgagtcaggattcaaagaacttctccgtggtcgctacaatgccagctcttcgtcgaacgtcctgtgatgatgaaaagggagctcggtcgttgatggaacgatggacgccgtgttgacnnnnnnnnnngcaatgccagctcttcgtcgaacgtcctgtgctgataaaaagggagctcgggcgttgatggaacgatggacgccgtgttgacagtcttatgagcaggtttggcgctattcagactggagcgatggtccccaagggcgagattttcgagaccattcctcttttccacgccccatccggggcgattctctgcagcaggcctcgctagaacactccatgcaccgcaccgaaggtcacaacccgtctcttgccctgtggatgttgatttcgagatgaaggtactcaacagtctggcgacagacatcttggcgaggcgtccagcggcgtttgggtgcacgaggctccgtgcgtgccctctggcattcagagccgcggcgccccgtgcagcaggcgcgcctcgtctcaatgtccaaaggaatgccactagggataattcagtggatgatggtacgttggtcgaccgaaggctggccatgggcccctgagcagcttcgcatccccagcgtcggggctgtattacgttgagcacagtgctttaatccgtcatcccaacctcccttggcacagatgtggacgactgctccaccaacgtaaatgcgttctgcagtatagacgagactggggcccgccgactgacacagctcagtcttggagagaaggagcaaatgttcctggaggccctgtcggtgagacatcagctttacttggggtttgcttccatgcatgatgctccgtgactgcgtgattgtaagtacaggttcgaggtcttggcaaactcnnnnnnnnnngatgttcctggaggccctgtcggtgagacattagctttacttggggtttgcttccttgcatgatgctccgtgactgcgtgattctaagtacaggttcgaggtcttggcaaactctgttctgcagctgactgtgccccacactcgtacccgcccagtcattctactttgagggcaagcccaagctcagcgaccaggagtttgatctgctgaaggaggagctcctctggaacggcagcaaggttgccgtgctgaggtgagcaggcttggactggaagaggctatgcggttggcctgtcaatagtgctcgatgcacgcacccctatgtcgaacaccggcagggtgttcgagtgcgcgcgagggttcctgcccttcgtcagcactcctctcacgcccgcaacgcatccttatcgcctctctctcattccgccatgcagctccgacgagatccgcttcatcgaggcccagaaggcgtaccgctcgggcaagcccctcctgtcggacgatgagttcgacgcgctgcgcggccgcctgcgccgcaacgccagcctggtgaccgcccagggcccacgctgcagcctgcgcagccaggccatgtacagcgacgcggaggtggcctacggccgcatgctggccctcaacgtgcccgccaccctggccgtgctggttagcgtttttctcctggacgacctcaccggcttcaagctgaccgggctgctggagctgcccgcgccctggggcatcatcctgacctgggccgtggctctgcccagcatctacctggtggtggacaagatcaccagcatcgccttcaaggacgcgctagtgctagtcgcaccttgccccaactgcggcaccacgaccaccacctactttggggacatcctgacggtgcccgggaaccgcaagcagaacgatgtgcagtgccgggagtgcaaatccaacatcaccttcaacgctgagaagagacaggtgggtgggtgtgggggagtagagggggttctgtgtgtgtgtgtgtgtggttgtgggggttctgtgtgtgtggtgggggggattgtttgtcggggagcgccttagagaaagctggtgccgagtcttaccgaacggcaggaaatgcggccaggtgttgggtgtgtgcacatcggttgtgtcctgctttggtatctcccaagtctgcactccaaccgctcccctattctacaccatccacatcctnnnnnnnnnncgtgtcctgctttggtatctctcaagtctgcactacaatcgctcccctattctacaccatccacatcctacgtcgcaggcggtggtgacaaacctgccctcgtcgggtgatggcaaggacagcaagtcgggtgggcccaagaagccatcagacagacccgttccggccaaggcctgagcacacaccataccctcactttgtattcaagcggcactgacacacctggaggaccatgcaaggaccaggcatgcaggcatgcatgctacgggtgttggcagtgccgatttcttttttaatgtcttgacagcatgtgaacaaggagagaagcttgaagaggcagccaagaggttgttcagagcaggaagggtgcagcaaatattagatggatttgctttggtgggctgcagaaccgctggannnnnnnnnnattcaaagcaggaagggtgcagcaaatgttagatggttttgctttggtgggctgcagaaccgctggatcacagggatccatggcagggtgcacagtgaggagtacaaggcttgccatgcgacaggcggacggaaaggtagtaggcgccaggggtatcagcgccggggcactgcttcaacgaagcaaataggcgaacccatcaccacccctgcccaaaccttccgcctcacgtcgccggcctgcctgcgatcctctcgcgcaggcgcaggctgttccccaccacggcgatggagctgaaggccatgaagcccgcggcgagggagggcgagatggcgaggcccaggctgggcagcgccgccccggcagcgaggggcacgcccaccgcgttgtagcccaccgcccagcccaggttctggcggatggtgcgcagcgcggcgcggcccgcgtccagcgcggagcacacctggtccagcccctcgccgaccagcaccacgcccgcggcgcccgccgcggcgtcggtgccccccgccatggccatgccgacgtcggcggtcgccagcgcaggcgcgtcgttcacgccatcgccgaccatggccaccaccgcgccggcg

SEQ ID NO: 30086 - DNA, 61 bp, Chlorella protothecoides
acaatcgtgcacgagtcacgggaacagcacaccgccactgtcatcttgctgcatgggctca

SEQ ID NO: 30087 - DNA, 119 bp, Chlorella protothecoides
gcagagagctgactggggtgcagaaccggggcggagagctggcagggcagggcggcataaggcaagacctaacaacactggatgattcacaggccctgtgcatccttaagaccctgtgc

SEQ ID NO: 30088 - DNA, 153 bp, Chlorella protothecoides
tgcagctggtgggcggggacaaaggtgggcaggggttgggcccatcaggtaggagggggggccaccctgccatactcaatatggagggcagggactgctggggccagatgcacgtgttgcactgccggatgggatgagtggggggatccctct

SEQ ID NO: 30089 - DNA, 99 bp, Chlorella protothecoides
cacaggcgcatacataaaacatggctcgaaggggcacacaccatcgcttgtcggcgactgtggggaacagcattgcctgtactcccgtgcatggacgca

SEQ ID NO: 30090 - DNA, 80 bp, Chlorella protothecoides
gttgtaatcagaccctcccaccacacgcccactcccaccacacgcccactccctcacaggatgcttcctcggactgaatg

SEQ ID NO: 30091 - DNA, 72 bp, Chlorella protothecoides
aagggagcggaggtggggtgggattcgagcactgagtgtccggtgtgggtcgtgcaaagctgcacaacagat

SEQ ID NO: 30092 - DNA, 65 bp, Chlorella protothecoides
ggcacaaaatagtgccagaagcttctcttccttgcacactccaacacctgcctctagaggtacat

SEQ ID NO: 30093 - DNA, 64 bp, Chlorella protothecoides
agcagcccgccatcatggcatcggcggtgctgacccccctggtcacccgactgctccggagttt

SEQ ID NO: 30094 - DNA, 61 bp, Chlorella protothecoides
ccccctggtcacccgactgctccggagttttattcgcagctcggcggagagccggggctcc

SEQ ID NO: 30095 - DNA, 74 bp, Chlorella protothecoides
tgactgtaccgtgtgcgcgtgtgaacgacatgaagaccgccactgcgtagcggccagcttgcccgattccctcc

SEQ ID NO: 30096 - DNA, 64 bp, Chlorella protothecoides
cacctgccccaccctgtccctccccgaagctcacctcaacaaagttcttggtgtcgttggccat

SEQ ID NO: 30097 - DNA, 77 bp, Chlorella protothecoides
cagggtcctcgtgctgcatgctttgctccagcgcatccaattcattccagtgatcgacacagagtgcagacacctct

SEQ ID NO: 30098 - DNA, 71 bp, Chlorella protothecoides
ggcccgctcttgcgtcgccggtggctgcagacgggcctctgcttgggtccgggtggcgctggggtggaggg

SEQ ID NO: 30099 - DNA, 96 bp, Chlorella protothecoides
cagattggagcttttctgctgttgcagcctcagaatctttccacatgcaatcgttgtgattaattccactcatgacacatataagagcgggtgcat

SEQ ID NO: 30100 - DNA, 61 bp, Chlorella protothecoides
acccagggggcactgccgctgcgtaatcagtccagactcaagccactgtgatggtgatgtg

SEQ ID NO: 30101 - DNA, 75 bp, Chlorella protothecoides
gccagacgttggtgtgcgcctgtcgaggggggttgtggttttttcgcgggggtggaagtcatctaaaggtgatgg

SEQ ID NO: 30102 - DNA, 75 bp, Chlorella protothecoides
caggtcgctggggtacaacgccatccagatcatggccatccaggagcacgcctactacggctcctttggctacca

SEQ ID NO: 30103 - DNA, 76 bp, Chlorella protothecoides
tcccgcatccttgtactgggttgggaccgctttgtcggctagctcgtttgaatgccgccaatgaagcgaagagcgg

SEQ ID NO: 30104 - DNA, 74 bp, Chlorella protothecoides
acatgggcacgtcatcaccagacgtggggatagggggcccagggacccaccttggagaaccctgggttggtacc

SEQ ID NO: 30105 - DNA, 67 bp, Chlorella protothecoides
aaacacatcggtgggaaggcctcacatcgaagcttaccgtgcaacaccgccggcggcctccccgccc

SEQ ID NO: 30106 - DNA, 431 bp, Chlorella protothecoides
  modified_base (147)..(349): a, c, t, g, unknown or other
ggcaggggtggctcagctcaaggtgcctgtcacctgctcatgcctgtatggctcccgacacacgtaatccttctcaatccatccctcacatccctctcgtgcctcctcccacactatagggagccaaagtgcgtgccaaagccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtcgcccccggggcatacccagtggctcccccggagcaaacgtatccctacctgtcttcatgccctgccctgcatcagca

SEQ ID NO: 30107 - DNA, 179 bp, Chlorella protothecoides
gacttggtgcacccttgatgacggaagcctcgtgcaagctgtctgggtgtgcgcgtcgtgcgcatgctgcagggcacccagcaccccacagagagcagggccatcgcccgaaggtccacgcccacctgcgctcccgcccagctgcagcaatgtctggggcaggggcagcactccccagg

SEQ ID NO: 30108 - DNA, 76 bp, Chlorella protothecoides
gggtgggtgccgcacccacgctggcgccacagctggcgttattaccatcgccgccactcccgtcgccggcgctctg

SEQ ID NO: 30109 - DNA, 72 bp, Chlorella protothecoides
ccttgcgcaggcagcaatgtgggtcaccgctgtggcagtcggcgcctgccatggatctggtggccattgttg

SEQ ID NO: 30110 - DNA, 115 bp, Chlorella protothecoides
gcctgcgtcgctgccagcacggccggctggctccctggatcccttcccccgaaatgcctgacccctcccctgctccagccccgcgtgggtggttgccgctgtacagagggcaaga

SEQ ID NO: 30111 - DNA, 98 bp, Chlorella protothecoides
ccggatctgtggatggcacacagaatgaagcattgggttcacgaggttaaaaagtctaccgtgcagggcagcccactgccgacctcccctacgcccga

SEQ ID NO: 30112 - DNA, 124 bp, Chlorella protothecoides
accgggaacaaggggaagaacaactttggcaactataacgagggtaacaacaacattggtgagcaggcccgggaaagcgatggggtggtcctggggttctgagtgttgcacaagatgggtggag

SEQ ID NO: 30113 - DNA, 3533 bp, Chlorella protothecoides
  modified_base (481)..(490): a, c, t, g, unknown or other
  modified_base (755)..(764): a, c, t, g, unknown or other
  modified_base (1166)..(1175): a, c, t, g, unknown or other
  modified_base (1977)..(1986): a, c, t, g, unknown or other
  modified_base (2071)..(2080): a, c, t, g, unknown or other
  modified_base (3354)..(3363): a, c, t, g, unknown or other
cccccccccccccccccccccccccccggaaacccttgccacaggccgtccagctggaggtggaatgcctggtcggcctcacctggaggctgggcccttacttttctaccaccaccgcccgtatttagggctgtgacaaacggcgcctcgcggggggttatggctcccccttgcacccaccccgatgaaggaatactctagaacgaaaccacagctttcttcccttcaagcccctccctctgtgtactccatcaacagctcgacccagcctgctctctcttttgcgctggactgtgcgctcacctgggggtccttttccctttcagagcaggaaagtgctccctcatgaaccataatgtccggcagaaatgcacggacgccctacagacctcttccaagacatttttccactgttggctttacccccgtcccagctttgccacccattttgccaggtactctgcctcaccgatgtctcacnnnnnnnnnnttttttcccctgttggcttaccccccatcccagctttgccacccctttcgccaggtactctgcctcaccgatgtctcacacctcggttggtcgtccctttgccaagctgctgactcaggctcctatactatttactttttgtttgcagaacttctttcaggaatgccagggttttgggcaggttgcgccccctctcagcactgcgaccgtccattggaaactccagctggcactgccagagcttcaccaacactcgtgctgcacnnnnnnnnnnagaactgcgaccgtccattggaaaatccagctggcacagccagagcttcaccaacactcgtgctgcaccgtctttcaggtcacctgcaatgccattcatcctattaaaacatgcatgtgctcagcttttagtgaatttcatttgttccaggcccgtgtaatataataaatctgaatggaccacacagaactcccacccagcatgcacagcatgtcaagattccaaatcaccgggcgcagtccacatcgccggtgacggggcggggaacgctgttcatgtgccacactggcccctcatgtagactatcatgtgcgtacgagggcatggaggatcaatagcgttacgcgctcagacacaggatgctgagcccggtgcgccccgctccgcgacgaccagcatggnnnnnnnnnnacgtaacgcgctcggacacaggatgctgagccctgtgcgccccgctccgcgacgaccagcatggtttgtggaagatgacatggcatcggggcgtccggcctcggcatcaacaaggtgagaagcccggaagtcatgcgttgcagatagtatggccagaactgcgtcaaatgagccaccaaatggtgtcccataatcccaccgcagaccccaagcacggccagccaacacacagtctctgttcctggtcgagaccccaaagcttggagtaccaggcccttccacgggcataacggtccaacacgacagcagaaagccaacaacccccgcacttccccgtcagcctactgcgttcgacctgagggtgctggctgccagagaccggctggctgactcggtgtgctccctgtgcgggatggaaggcgcattgcgtctgactgttaggttataccacgattgttacgattctgggctgccgtctcctattccttctgccaagcaccatgcattcaggtttgtcgtttccaaccctgaaccctactccaggctgatgcatcggtcatttcccggaatctgctgacagggcgccctggtgttcctgttgcagcgcatgtcctgtgcacagagactcagcagcctaaggccgatgcccaagcaaaagttgttggggcagtccaacccatcaggcagaggcatggtgcatcctcgtctgcagagcagacgctatcaatggctcccacaagtactagctcattccaagcaccttcaggggtgactgaggacaggctacgtcagctagtgaggnnnnnnnnnnagccctggcgttcctattgctgcgcattttctgtgcacagagactcagcagcccaaggccgatgcccaagcaaaagttgttgggnnnnnnnnnngctctttctcaacttcatctcatgaggatcagattggtgtttggacgccaggcctcagtcaatctgtcttgtgcttcctcttcaccaaaccagcgtcacacaattaaggcacgcccacacttgcccctgttattccagggaagagtgtactgctgctgtgcaggcggtgcttgccgacgtgcgtgaggagtatgaacaacaactctctgcattgagggccgatgtctctcgactcggtgccatcgtgaggaagagcagggtagcttcagcaagcactgccccagttccgcactcgaggctacagctctgtagtcgacttggggagccagagaggactaacacgagcccactaagactggcatccggtgatagtgctcaagcctctgctgctgtgcctggtactcccatcaccagcctgggctttggtagtcccattcgccccttggtgagccgcacatgagaacatcatgaatattacatatattcaatggacggggagctgaccatcataggcctgtgtaatcttgacgtgtgctgtggctctgatatttcgaatcgactctgtgtcttgtaagttaagaaatgtcctgccgggcaccaacagagagcgcgcttgcgcttcgtcgtcgtcatcgaatgcattttctcatgagcattcagaccaccagtgaacgccagacatcgccctgctcgcctaatggcggccaccaccgactctcttccggcagtccgacagggcaagcgcaagcttctgctgccgcccgcgcagcgacgacagcactctggagctgtccccagttccgttgaccccgtggaagctgcatgcagaagtggcgaggccgtcgcgtctccagtgtctaaccccccctccgctccaggaggagatgtctggggcgacgacgactccgacctgggggccatcttcacagacacgcaggcagcactgcacatacttgccagccagttcatccggcagcacgacgtgaggctggagtggagaagggttcctacttagtgtgcactgcggctggaagatcttctgcccagccctcctcctctggtggccagcaggctggtcccccttttgaagatcgaccatccctttgccacagagccatgcccctcccttctccatggtgacacaactgtacaccctgctcccggaccggacgaagacggacacggagctggatgcgctgaggtgagagtgggcgcattctgaggcaaacccctctttgcatttgtggtgtgactggctcggtggtggatggcannnnnnnnnnctgccacagagccatgccccccccttctccctggtgacacaactgtacaccctgctccccgaccggacgaagacggacaaggagctggatgcactgaggtgagagcgggcgcatgctgaggcaaccccctctttgcattcgtggtgtgactggctcggtggtggatggca

SEQ ID NO: 30114 - DNA, 5719 bp, Chlorella protothecoides
  modified_base (609)..(618): a, c, t, g, unknown or other
  modified_base (797)..(806): a, c, t, g, unknown or other
  modified_base (1185)..(1194): a, c, t, g, unknown or other
  modified_base (2272)..(2412): a, c, t, g, unknown or other
  modified_base (3315)..(3324): a, c, t, g, unknown or other
  modified_base (3698)..(3707): a, c, t, g, unknown or other
  modified_base (4252)..(4261): a, c, t, g, unknown or other
  modified_base (5571)..(5632): a, c, t, g, unknown or other
cttcgtgagatgtggtcatttgtttggtctcgtagacggcacggctgtcgcgtgaaaatcatatctttcccagtgttctccacgtgtacagtcctgtgcatcccatgtttcagccattcagggtaaggcagtcctcattcgacttgaccatactttaatactctctatgtggtcaagactccataaattgcaccctgtctctgcgtctcatgcaggaaccctgccaaggtcatttctgcccactccatcacccaaagggttgcgaaagcactgcagatggcaagcatcgcttttctcttaccaatacacatggaggagtgacggaggggggctaggaggatcagtgttggcttgtccgatttatggctcggtggccgccgatgggacctgtggatgcagctcctgtggcgcctggaacgggtgtacctcaacatggagatgagcaagagcactccatgcaggggttgctgtggtggctgcctcaccggcaggcacaatatttgtacaaataagaaggtgaaaggaggcgccggagcattgcccccgggtaaagggaggctcggctggtgagtgtgcagggaatcaagagtgacatcattgccctagccnnnnnnnnnncaagaaggtaaaaggaggcgccggagcattgccccacggttaagggaggcttggctggtgagtgtgcaaggaatcaagagtgacatcattgccctagccatcctcatggagggcggggctgcaagaatgctccgacacacagggaacattagctgccacttgtggcatatgcccctgtnnnnnnnnnnttgcaaggatgctccgacagacagggaacgttagctgccacttgtggcatatgcccctgtctttcattcctctttctcccttgttattggttttcaccctgcgtttgttccatcttcatggggtggcataagctggtagggtgtcgcgatccctcttctccaagcatggaaagtgttgtttgacaaactggcaatctgacaagaactgatccctcctctgttgtctcttcataaccatacagtgtgatgatttacagccgtaaactgtcgatcagcgaaaatcaaagatcgttgggaaaagcatcacccgctccacatggggggcgggcagcgtaaaaacccaacaggtcctccaggtccttccatccacagggtccannnnnnnnnnatgttgtttggcgcagtgataatctgtcaagaattgatccatcctctgttgtctcctctaaaacaatacggtgtgataatttacagccgttaactgtcgatcagcgaaaatcaaagttcgttgggaaaagcatcacccgctccccatggggcgcgggcagcgtaaaaacccaacagctcctccaggtccttccatccacagggtccaccagcgactccacagggtcgcgcggggcgacatcaggtctgggtcaggttccagtacggcaccaccgagtggcaatgcaacttggtggtactctgaagccacacatacacatagagatacaggggctcgagtaagacagcagcacaaaaaatgcgacgaatgtcgcataggggagtgacatcatgtctcgaatactggggggaagggtggtcaaacaaggacagtgatggagcgaccgcagggccaaaagagggacaaagatgatggaacacagcggtcactgccagcggcacaatcggagggaggtggtgggggagagagacaaggtgcgtgggtggtgctgcccgagggcaaccgggtctccacaagggggggtagggggtaacgactccgaagagggtgggcattggccaggcaatttaaacacgcccgaacggccatgccttctcagcggttggagtgctgaaggggaggctaagcaaatatccaagagagagaaatagtatgcggatcctgcccggcagaaaggaacgttccactgatggggggcaagggggtggcgtcatcccagtatgggggatgtgccagaggggcagggggagcgcacggtgaggaaggtggctcacagcacgagctgccgacgcaggccgtccagcatgaggaggcttgccgtgggcagaggcagtgcctcaggcatggggctgttggtgaatcctgggccggcataccgtgccaggagaagtggggaagcggtgggctggggggtggcagcagcggtatgctcggcacgcttccggggcggcgagcggttgctactgcgggcagcgactgcggtcagcggcgccctgctggcagtggcagctggagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttcataagaaaaggtgcattcgtacgcatcccatcacccggctcgccgcaagcgtgtgagagtttgcagcacaggtgcggacactcaccgctgcaaggtggcaaactgagcgttgtcagcctgggatgggctgaagaatggtacgagctcgcgttcctgcattgagatgttgttggatgctcaggataccctgttgaaacagagcgatgacaatgcgcaggatccctagtagctactgcctgaatctcaccttgagggctgtcgtaggggtcggggtccgctggcaagcagcagtcaaagcgtccacgaggtggtcggcatcacccttgaaccggccctatatcatacgagaatagacgtccagagtgagaccgggagcttccgggaaccggggtctgtaacaaccaccctccgcgtgacccacgcctacctgtcgaggcatgtgtcgcgcgacagcagatggagacggcatgactgctactgaagtcattgcgacagagttaaacaagatattatgacagcgggaagctcagggcctcagagcgacgtcgacggaaccacggaggtcttgccgagagggcgcgtcttgcttgcaccacgagtaacggtgcgttatgaagtaagcagagtcttatcgcggctgtcggggaaatcttccggacacggagacatactatactagggaaaatagggcgaacccaggaatcccacgtccacagatacgccctcctctggggccctgccggggacaatttggctgcgcttcgcgccagattccatttcccttggcctacgtggctctcgcccgaacacagggagggggccctgtaggccgaccgacacccctgctgggcatcgccgagcagaaattaggtgtatgatcaaatctgatcactccaannnnnnnnnnagggcattgccgagcaggaactaggtgtatgatcaaatctgatcactccaagcagtccccagcattcgcactcgccgtgggcccggcacattcgggcaccctcgcggtgcagaccatactcgcaggtgcttcatcccccactgcctctcattcgtccactcaattgtggcacatattttgtattgacgtttgggggaaaggtaacagtccgagaggcctgctcggccccttccatggccgcgctgacgggggctcagtaggatcccaggggggggggcccatcctcccacgccctgcgatgctccgcgccctgcgccgcctggcgctggcccaggcccaggctggggctgggacctggtcgccctcgctccccnnnnnnnnnnccccatcctctcacgccctgcgatgctgcgcgccctgcgccgcctggcgcaggcccaggcccaggccggggctgggacctggtcgccctcgctccccgccctgccccgctcgctcctcccagccagggcccccttcggcagcgccgccgccaagaccgccgccaccccgccctgggcgcgcctgccggaccgcgcctcggagtgggcgctgtcgcgcctgcgccccaactacgaccggctgctgggcgtgcggtacggcccgcgcttcacgctcatcaacgccgtgggcgtgacgcagccgcgctgggcgcgcgcgatgtccctgctcctcgccgaggcgctcacccgcggcgacccacacgtcgcctggtgcttctcgtcgcccatcacacaggtgtgtgttttggtcgggtggacgggtgggggcgggggggtgagggggacggacggggcatctggccgacctctggctcatccccactcctgtcccatgcatcatcttccccagccaccgaaccagaccagctaacaagcatcatcccccnnnnnnnnnnccaggtgtgtgttttggtcgggtcgacgggggggaaagggggggaaaagggggggaaaaggggatggacggggcatctggccgacctctggctcatctctacaactgtcccatgcattaccttccccagccaccaaaccagaccagctaacaagcatcatccccccccctcccaactcagtctgaggcggcgtacctggcggcggcggagcgtgcggacgccgaggcggcggtggcggcggcccacttctggcgctcggtcctgcggcgcctgggcatggcggcgcgcctcctctggctcctcctcatcttcctgcccgtggccgccaccagccccttcgccggccgccccggcccgcgccgccggcgctggctggcgcgcgtgcggcgcgcgctggagcgcggcggccccgccttcatcaagtggggccagtgggcggccacgcgccgcgacctcttccccccggacctcgccgccgagctggcgctgctgcacacgcaggcccccgcccacgcgccgtcggtgacggccgcggcggtggccgccgcctttggcttcggcgtgggcgacctcttctactccttcgaggacgcgcccgtggcctcggggtccatcggccagatccaccgcgcgcagctgtcggccctgggcgcgcggctgacgggcatggcggagggcacggtggtggcggtcaaggtgcgccaccccgcggtcagccaggccatcgagcgcgacttcgcgctcatgtccgccgcggcgcgcgcgctgggcgcgctgccctggctcgcgcacctgcgcctggaggagagcctgcgccagttcgccgcgccgctgcgcgagcaggtggacctggggcgcgaggccatgcacctgcacgccttcaactacaacttccggcgaatgcgcgaggtcagcttccccgtgcccctctacccgctggtcaccccgggcgtgctggtggagacctacgaggaggggcggcacatcggcgagtacgtcgcgcgcggcgccggcgcgcccttcaactcctccctcgccgtcatcggcgcgcgcgccatgctgcacatgatgctggtcgactccttcatccacgccgacctgcaccccggcaacatcctggtccggctggagacgccgggggggcgcgccgtggcgcgtgccatcgacgccgcgcgctccttgctcaaggagacgggggtgagaggggtgggtgggagtgggaggagaggggggctggtatgcaggcttgtgtttgaggaggtgtgcaggcggctgggtgcatgggcgcatgcccggagccgatgagccgnnnnnnnnnnnnnnnnnnnnnnnnnnnnnnnnnnnnnnnnnnnnnnnnnnnnnnnnnnnnnngccgaccccaggttcagcacaggacgcttgagaaccgatcctctgcaccagaatatgtccacctacagcaattgcctctcccccccc

SEQ ID NO: 30115 - DNA, 130 bp, Chlorella protothecoides
aagcagcaggttgcacaatcattatcgatgtaattacattaattcgtgtcagtgcgaatttgcgatggaccccagatgcaagagtgataacgacagagggttcgtattgaacaaggagcatcagcgagtc

SEQ ID NO: 30116 - DNA, 188 bp, Chlorella protothecoides
aggcaagtgagctgacaccactctgatggtgaggaggtaaggacatgatgcaatggcttcccagtttggttgttgtgagcagtttaggcagtcagcaagaatcttcagatctgggcactaaagacaatatccccctgttcaatactgctgcgcaacaccccctccccctgccagccccgtttgcgcac

SEQ ID NO: 30117 - DNA, 61 bp, Chlorella protothecoides
tctgcgaggcggccttgcggaagaggcgccaccccgacgcttccggagactcctgagccac

SEQ ID NO: 30118 - DNA, 72 bp, Chlorella protothecoides
cggctggggtggggagcaggccgtgtgacgaccagctcatatgacagttcggttcactgaccgaggtggccc

SEQ ID NO: 30119 - DNA, 70 bp, Chlorella protothecoides
acattaggtggcaggtggagcctgagctctgcctgaactcaagtgagaacctgtgttgacctgatcaagc

SEQ ID NO: 30120 - DNA, 61 bp, Chlorella protothecoides
gcaatggttgattgtggatatatcggtgaactgaatgtgatgctggagtttgaggtagctg

SEQ ID NO: 30121 - DNA, 102 bp, Chlorella protothecoides
tgggtgcccggacccctggtctgcagcccggagtctctggccgaggcgcttggacccttggtctgaaggccagagtccccagccctggcgcccgagtccctg

SEQ ID NO: 30122 - DNA, 76 bp, Chlorella protothecoides
tctccagcaactccacctggtcctgcatggacagcaggggaatatggtggggtgaagaggctgcagcaatcctgca

SEQ ID NO: 30123 - DNA, 127 bp, Chlorella protothecoides
gcggagacgtgcacgggagcccctgctccggtgctgaaccctgccacgaggaccggagccgccgctgccgcggcggccgaggtgcgcgtgggaccctgctccgacgcgggagtgtcctcctccagta

SEQ ID NO: 30124 - DNA, 62 bp, Chlorella protothecoides
gcgatctgggactcctggagcgtacctctgattctctactgtaacctgaatgtattgacaca

SEQ ID NO: 30125 - DNA, 130 bp, Chlorella protothecoides
ggggcgcgcccggcgccaggtttgtgtgtggtggggggggaggttgtcaggctggaccgtatgcagtgggctaggtcatcctgcgcttccagccctgtgcggctgggggcacggcacagagagggacctg

SEQ ID NO: 30126 - DNA, 80 bp, Chlorella protothecoides
gctggaagagctcgatgtgaggcaggggcgacggagccgcggcaaggttacctgcctccggctttcatggagtagcatcc

SEQ ID NO: 30127 - DNA, 80 bp, Chlorella protothecoides
tcctcggctcccggggggccgcctgctctccgttgttcagatgggatgggtgatgtttcgatgctgacatcgagcatgcc

SEQ ID NO: 30128 - DNA, 78 bp, Chlorella protothecoides
attctgcgcgctctgtctgaggggtggcgacgggaggtacaatgggaagggggggcaaatcacaacagttcagctcag

SEQ ID NO: 30129 - DNA, 99 bp, Chlorella protothecoides
tcccccgaagcaccccctctctgaccctcacaacatgcaaacagacgtagaaactgccccccacacgataccaccaagcagggcaaggatgactgcgtg

SEQ ID NO: 30130 - DNA, 61 bp, Chlorella protothecoides
gatgacaccgatctctgcaccccgtgacgataccttttaacaagcatgctttcctggcgaa

SEQ ID NO: 30131 - DNA, 121 bp, Chlorella protothecoides
cctcggtggggctgacgtcagctgggagcggccgtacggggtccctattgtggtgagggcgctctgaccgccgcagtgtctgccgtgcgccttacatctatgggcctacatcgggttggta

SEQ ID NO: 30132 - DNA, 76 bp, Chlorella protothecoides
gttggcaggggacagtgtgacacgccggttcagattgggtgcatgtgcaagccggtactggggtgaggggcatgga

SEQ ID NO: 30133 - DNA, 65 bp, Chlorella protothecoides
gcgcaagcccggtgggggtgggggtggggggaaaggaagacgatacagggggtccaccaaaagct

SEQ ID NO: 30134 - DNA, 16123 bp, Chlorella protothecoides
  modified_base (2411)..(2482): a, c, t, g, unknown or other
  modified_base (4986)..(4995): a, c, t, g, unknown or other
  modified_base (5614)..(5623): a, c, t, g, unknown or other
  modified_base (6015)..(6024): a, c, t, g, unknown or other
  modified_base (7111)..(7120): a, c, t, g, unknown or other
  modified_base (7653)..(7662): a, c, t, g, unknown or other
  modified_base (7727)..(7736): a, c, t, g, unknown or other
  modified_base (8516)..(8525): a, c, t, g, unknown or other
  modified_base (8951)..(8960): a, c, t, g, unknown or other
  modified_base (9688)..(9697): a, c, t, g, unknown or other
  modified_base (10316)..(10325): a, c, t, g, unknown or other
  modified_base (10500)..(10509): a, c, t, g, unknown or other
  modified_base (11775)..(11784): a, c, t, g, unknown or other
  modified_base (12982)..(12991): a, c, t, g, unknown or other
  modified_base (14500)..(14509): a, c, t, g, unknown or other
  modified_base (15012)..(15021): a, c, t, g, unknown or other
  modified_base (15722)..(15731): a, c, t, g, unknown or other
gcgtctccgcacccgggcccgccgtccaatccagcaggccggggggcgcggccagcgcgtggcgcagcaccgcggcgtgcgcgtccgcgcggggccaggcggcgccgccgagcaggacgtccacggggaaggcgccgccgccggacaggccgtgccagaaggacaccagggcaagcaggccggcggggctggggggcgggggcagggcgccggcctgcagcgcctgggcgacgcccagcagcgacagggagggggccgcggcgtgcagggccgaccccagggcctcggcgtcccaggtggaggggctggcggtgagcaggcccgccacctccgccaccgcccggtcggtgggtggggggagcctggccagcagggcgggggcgtccgccccgggcccagactcctccagcaagcccgccaggctcacgccctcagccgaggctgctgccatcgcggccagggcctgcagcggggtgcctcgctgtgtcgttctgcggtgggttgatcggcgagagcttggggggaaggggcgtgcgcaggccccttttacaacatgaggcgcaccctgacgctgagaacatgaccagtcgtggtctacggcgcttgctgcagggccttgcaggcacgcacctgatgctcgcactcgaacgggagcaggatgtcagcgagtgcctctccaaggcactccaccggtgcctttcagctggatgagcagatcatcccaccatcgcgacaatctctggttcatttgcattgtcggatggaccatcgatgcctcgatcgtcttgcacactcaaccccgggcctcgctcccagttggagcgagatggcaccccgggctcgaacattggctgccccttgcccttgcgccatgcatgccagcaactcgtccacctgacgcccccacctccctctcgccccatccttcaatccctttagcgcgcccacatctggtctgtggccaaagcaggctgcaggcagtccgtttcttgtgtgtggcagccgtggtgtagccggtgcccgaggttgtgatggtgagtcttggaaggagagggcgagcatcccatgagcggcagcggcgtgccactctttctggaacatgcaagggtggcactgggagaggcgttccgctctcaaagctgtcccagtgggagccgcagggatcgctcgcctctcatccctcccccactttggccgcgatcgcaggctctgcccgggcagaccacccccgacggtgtgccagccttcaagctggtgctggttggagacggcggcacaggtgcgtgggctcagtttgaattcagctgcccggcagtggagtttaagatcacaccgcccattccccccgccacaccccagggaagaccaccttcgtcaagcgccacttgaccggagagttcgagaagaagtatgagcgtgagtgactggcttggcgctgggtatgctggggaatgaagaggatgggcatgctggtgtggtgttcatgggagaagcttctgcggatgatcactcacaagtccttcgtcggcactgacctgatcgccacagcaccactgtctgcattggtattggattgtggagtgcactgctacccagcctgccctgcatctggactggtaaccacccctgcgccagatgtgtgtccatgggcccactcacccctcggctccacaactcacgcccctcacaagcccaccatctcacctcccctgcagcgaccatcggcgtggaggtgcaccccctggacttcaccaccaaccgcggcaagctgcgcttcttctgctgggacacggccgggcaggagaagtttggcggcttgcgtgatggctactacatccacggccagtgtgcgatcatcatgtttgacgtcacctcccgcctgacctacaagaacgtgcccacctggcaccgcgacctgtgccgcgtctgcgagaacatccccatcgtcctctgcggcaacaaggtggacgtgaagaaccggcaggtcaagcccaagcaggtcaccttccaccgcaagaagaacctgcagtaccatgagatcagcgccaagtccaactacaactacgagaagcccttcctgtacctggcccgcaagctggtgggggaccccaacctgcactttgtggagcaggtggcgctggcgccccccgaggtccagatcgacctgcagcagcagcaggagtacgagcggcagctgaccgaggccgccaacatgccgctgccagacgcagacgacgacgacatgtgaggatgttggttgttggcttggggtatgcgctggggtaggggtgtcggtcaagtgggcttggtaaggatcaggctggaagtgctgccatcatggcacccccggactgttgcgatgagggaacacctggcacccttccatgggatgtctggccgggttaattttnnnnnnnnnnnnnnnnnnnnnnnnnnnnnnnnnnnnnnnnnnnnnnnnnnnnnnnnnnnnnnnnnnnnnnnncccatccccaactcctcctccccctttggctgttactgcagtgcggagtgatgagctgcccaggccaccctgcttgccaagcttgcaggatattccccggctctgtctgcagtgtgttgccccaggtctggattaagaaacagcatggctggccatggcgattgcaactcaggcggcagagtggggggttgggcatcgaagggaccccatcagagaggagggcgaggaggggtaggcaaggatgactgcgctgccatgctgggctgccgcgccccaagctgccgatgcctccagctcggcgccgagaggaggcagcacacttgccgaagccaaatgcacgccaccagatcttaatgctgttcctatgagcttggcacctctgccccggccaggtcaggcctccatcttcttccgtgccagcaccgcatggaaggggtcgtgcatgccgccgcccaaggcaccggccgccgtccagaacttgcccaggagggaggggtcctcgggcacagagacgcgattgatcacctctggctgctcgtaccccggacaggcaccaaagtactgcttcaccagctggatctgggagggggtgggtgcagggacaagagcgatcgacagggctgggcctccgcgcggcctggccatccatacgacactcccctccaaagcgcaaagcagtgacaggctcagagggcaatccacacagctccctcccctgccacttcaagtatcccctcaccctgctgtagtccgtgccgtccctccaagcggcaattgcctgggaacaggaggtaggagcgcatggtgctgctgaaacttgggtggaaaggtatcgcaatggcgacggtgctttacctgttgaatctctcttccaccctgccttctcacagctcacagcagcatgttatgagaccaaaccactcccttatgaccccccattcccagtcatggacgcactcccaacaacaaagcacaactgaccttggtgaagaacatgcggttgctgaaggaaacgatgaacacaccccctggcttcagcacacgcagtacctccccaaacacccgctccggctgctggaggtactgcacgctgacagtgcacagcacggcatcaagggagttgtctgccagcgcccagcccgtcggatccacattcaggttccggaggaagaaggagtccaggcgggggttgcgcgacagctgcatggagataaacaaggctggcacttttacttattctctcgttgacctccctaggaagctccagaggcgaggcggctttgtcaacataatttctttgacaaatcacaatagtcctccactgaaacctctcctcacctcttctgcattcatgccgtggcccaccaccttggcgtaggtcacttctggggggaggtggctcacccagctgctcatgagatccagcatcgtgccccctgggggaagcctctcccggtacagctgtgtgagctgggctctgaacccgtcatcgacatgttgcacaatctttgggctgtcgtagaacatcgtgtcatcgctggggtccatcttctgccgctgggaaccggtgaggacctcacgagtggccacccgcatggccatggcgttgcctcgacggcgagatcctgacgaggtaagaagtgtcctgcaatgattcaatgtcgccccctgaaaattttgcggcgtgcatggacatgcacgagtggtgaggaatgctgttgtcattggtcagcaacctgggccgagtcgacccttgtattgatcgagattacactcgatgcaatgtaaggagagttgtagtagaatgagggagcccaggaggcatgcatgaggttttcatcgtggtatgcgcaccagtgacggtcatgcgcccattcgtccacgtggtggatcactggcgtcgacaggttgtgccactcccgagagcgagaatatcccaggcttgaagaagaccgtcggggcaacggtgcttatgcacagcatgccttgtccttgcgcttcgatcccattcagatggacagcgatgcctagctgggcattccttgtctcgggctaggtctcctagtggcacggtgtctgcaaatcggtgagcaccggctccattcctgcaccttttcgtggataaattctgagacacatgacaccgtgggccattgtagcttcattgtgctcgatgtgcatgtcaaaggagtggacctagttgggtgtatcagggaagcaacatcatggatcttgaaggcgcctcaatcccaaaatcactcaatgcccgaggcatcaggatgtaccgccaaccccccttgcagcactccaaaacagctgcttcagccgccatgccttgctgctgcgacatggtgcggcagagtgccgctgcagtggctcgggtgggcactcacgtgcagatcagcaagccaggtgcgtcgccggagtgacacgccggcaggcactcactctgcctccgtgggaactcagatgagaagcatgatgggcagaggctgctttgtctnnnnnnnnnnaccggcaggcactcactctgcctccgtgggagctcgatgggaagcatgatgggcagaggctgctttgtcttgactttgcatgggggtttgagcagtgccagtgttgcatagactgtgctgaaccgcagcgggccaccacgcccatttcccacccttctccaccacactgcagccatcgcggcggtagcagcttccatcagagcctcccacgcagccagactggtgggccccgccgcctgggacacgagggtgcacttccgggacacacttcgccctgagctcacactgcggtactgcctggtactggacgcccttaatttttgcttctggcctgagccggggctggaatacgagcacctggccacaggcctcaaggtgcctgcggagcgcaggcttggcggtatgtgtgtgtgttgcttgtggggcgacaggaacaagacctgtccacaacccactttgatgtgcgaggacgtcgcaccactctatctacccaacacgcccccacgccacccccgggccactttcctcattgctgcacttccccctctccccccagcacaggcttgtgtggaggcggacccccaggtcctgtctgatgacagcctggccggcgccacgnnnnnnnnnnccctgtccacagtccactttcatgtgcgaggacatcacaccactttatcaacccaacaagcccctacgccacccccaggccactttcctcactgctgcactcccctcttcccccagcacaggcctgtgtggaggcggacccccaggtgctgtctgatgacagcctggccggcgccacgcccgccatggtgcagcggctgtttgggcgagagtgccctgtacccctggccgacgagcgcgcgcgctttctggcggaggtgggtcacatggagggactgtgctgttgcaaccggcctcccagagtgcccttggacctgaccatgttgggacggtgatgctgtgctctcctcgcgtaaaaccaccctgcgtgcctggtgatccatcacaagttcnnnnnnnnnnatgatgctgcgccctcctcgcgtaaaaccatcctgcgtgcctggtgatccatcacaagttccctcagcccttgccctccacacgtcgccagatccccaagggtctgaggcggcatggtggccaggtgaccggtctggtggcagccgcgcagcagtcggccgcagccctggtggacctcgtggttgaggccttccccgggttccgggatcaagcggtgtaccggtgcgtcccggggccgaagtctgtgctgcaagggtcctgaggagagggcgttgcttcccggcccagcctgcaccccagcgctgcgggaggcaccattccgccggctctccactccctgcactcctgcccaccaaacaacctcgctccccccccggcccctcccccaggggccggcaggtcttcttctacaaacgcgcccagatcttcgtggcggacgtctggggcgcgtttgggggcgccggcccgggcgccttccacgacgtgcagcgcctgaccatgtttgccgactatcgcgtgccggcccagctgcgtaccatgggcatcctgcactacgccaccgccttggccgaggccgtggatgctgggagggagctgcccgcagggggcgaggcggaggtggagatcagggcggcgactgtggaggctgtggagctcatgcggggggcgctggcgcccagcctgccgggcatcacgagcgtcacgctggattggtggctgtgggaggcgggggaggctgggaaggacgcccagagccctcaccatcacacactggttccctactactgaatgaagctgggtggatgagtgctgacagtctgttttatcccaagacgtaacacagtgtgaaccattattaatacaatagcgctgacagtccagcctcagcacatggtcatgggggcatgcaacgggtatggaagggggtatgacttggatgggaaggtgaagttgccaaggagacatcagctgggagcaaaagaggtatgcgagattgtctctcacatacgcctcttcatactcgaggagcgacgcctctgccgggtccagggccttctgcaagcccctagagcgtaggagcaggcannnnnnnnnntatacgcctcttcatactcgaggagcggcgcctctgccgggttcagggcttcctgcaagcccctagagcgtaggagcaggcaccgcaggggcagcggtgctgctagccgttgcgccgccagccttccccttgcccaagaaggaggagacgtagcccttgagggtctcggggctcagctgagtgcccaggtatttgctggccagctgggagagcttgccgtagtcgctctccttgccaggctccagctccctgccttcctccttcttgaacaggcccaacagcttctccactagggtgtgagctccaaacccaccgccgtgccctccagcaccggcctcactgcagggatgcattggaatgtcaggtcagcggctgtgtaagaatatggctgtgccagtaacacattgagattctgagaacgaacaaaagatcgctcattacacacacgtgtgctggagcacatcttaccaaggcggtgtaggatgcagctatctgcaatgacgacctgacgcaatcctctcccaaaacaaccnnnnnnnnnngggctccagctctctgccctcctccttcttgaaaaggcccaacagcttctccactagggtgtgannnnnnnnnngatcgctcattacacacgcgtgtgcaggagcacatctgaccaaggcggtgtaggatgcagctatcagcaatgatgacctgacgcaatcctctcccaaaacaacctgccctatctccaaaagcaaccacctgacccaccctgttgtcccagcaggcttgtccaagaaatccttggcggcgaccttagccttgtccaggtacccggcgatgccagccttgggggcaccgccctcctcaacggggtgcttgtccaggtagctccgggccgcatccttggccttctcgatgtagctggaagcaccggcggccggctggccggtctgcccggtagcggccttcccctcgagacctccaggagtcgcatgggtggggatggcgccctcggccgacgctacggatgcatggccctgctggttggggtcgatggggccaggcttcttattcaggtagccctccgccaggttggtcagcttgtcgcggaaccccccgcctccgctcgccgtggtgccaggctcgccatggacgccctcggcaccctgctcgccagtgccaaggtactttcctgccaggccctttagagactatggaagggagaaaaggaataaggttgggtattcaccgtcggacatcgggcagtgtactggtcatacgaacgcgtcactcacgtccatgccgatcttagaagatgtactcttgtcacccacgttggatcgctggatgatagtagaggcctctgatggttgttatgtcgcaaagctgatgcagggggagcgggccagannnnnnnnnngtgttggatcgctggatgaaagtcgaggcgtttgatggttgttatgttgcaaagctgatgcagggggagcgggccagagggtgtccctgggtttccgatcttcgtcgatcgacccagcaggaagctgtgatgaatctggtcctcccaggggtttccccctcgccataggcaatgggtgatccccacatagctgattctttcgccgtagcattccgtgtatattgttgcgacctttatcgtgtcaaaatgctgtcgcatatgctgcgcatggaggcctctgtgacacaggcctcgacggcgaggcggacattcttgcgctgtctttcgacggtggggagccatgtaaccttattgatgggcaataaatcggggaatctgctacgtcttatcgcttggcacaaattgtgaacttttctccatgttgannnnnnnnnngaaatcagggaaatctgctacgtcttatcgcttagcacaaattgtgaacttttctccatgttgattagggcagtcatgcagatcgccttgctcatgcatccctccaatcactgcaactcccatgccaggcgccccccgaggagagcctcatggacaaggtcaagaacaccgtgaagaaggcggtcggtcagggagacgcaacctacaatgatgcagagcaatccgcaaaggatacgctggaatctgagcttaaggatggagagaccagccccacccagggtggcatgcaggctgacaacttggagtcaaccaacacggggcacgagtcttggaggtatcagaatgccgacaaggacgccaaaacctaaggatgcatagtgggcggcagcagcggcctcctgggaacactcttggtttgttcacatatttttggcctttcagaaaccattgcttggccacctcaatgcaatggagtctcatgagtgagcgctgtgctgagagtccatacattccagcggaacacccatttaaaaggagatacacatggatgtcctggatggtgcgcgtccccacccgacgagaaccaactggctggcctcccaagacatggacaatcatgcacaaggagatgaatggatgatatccaggtgttttatctcaattgacaggatagtgtctcaaagtgcatgctgctgcccgggcctgagactcggtggtgtctcatggtnnnnnnnnnnaaaaaaggagatacacatggatgtcctacaatggtgtgcgtccccaccagacgagagccaactggctggcctcccaagacatggacaatcatgcacaagcagatgaatggatgatgtccaggtgtgtcatcgcaattgacaggatagtgtctaaaagtgcatgttgctgctcgggcctgagactcggtggtgtctcatggtcgcgggttccttcaacccagggccaccgaagcacgggtacccaagagtcccgcttatggtaccatcatccagcagaggagaccgagcaacatgtcgggacatcctgcaaatgtcgcttgcactcgacaagtaacatatgcttccatagtcaccctcttgcactcaccatgttgggaacagcagtgccatccttggtgcgctgcgcgcctgcaggctcgaccttcacagcgtcccgacggcacccacggaccgcgcacctgcgatgccttcatgcagcccctcgatcgtcccagctgagaaccccaggaaggcccagctgggcgttgagcgccgaggaggtgagcgtgtgcatctaaggatgtgctgggagtgacctgccatgcacccccgccccagcctcccccgtggaacctctccnnnnnnnnnnactggatatgctgggagtgacctgccatgcacctccgccccagcctcccccgtggaacctctccggccccctcccaacacctcccttctactctcccagggtgacggcgcctccccctcgaccgccacgatggaccccccctccgccacggacgcagagggcctgctggccgagnnnnnnnnnncccccctcccaacccctcccttcttctctctcagggtgacggcgcctccccctccaccgccacgatggaccccccctctgccacggacgcagagggcctgctggccgaggcgcgggaggtggcctccacgcgccaggtcaccgacgccttcgcggccaccttccccgagcggctggagtaccaccttcgcgccgcgagcgagggcggccccgcgggcgcggacgccgcgctgagcgcgctgcgcgaccagcacctgcgcctggccgccgactacgacaacttccggaagcgcagcgccgcggagcgggacagcgcgcgcaccgctgcccggggcgacaccgtgctggagctcttggcggtggtggacagcttcgagcaggccgcggcggcgctgagccccgccacggatggcgagcgcaaggtggtggccgcctacgacgccgtgtaccgccagctggtggccgccttccggcggctgggcgtggaggcggtgccgggggagggcgagcccttcgaccctgcggtgcacgaggccatcatgcgcgagcctgcgcccgcgggcgtgccggacggcaccgtcgtccaggagttccgcaagggcttccggctgggcgacaagctgctgcgggcgggcatggtcaaggtagcctttgccgaggacgagcccacgcagggtggggaggaggaggcctgagggtcccatgggctgttgatgaatgacattatgatgtttggtacacacctcgggttgcccgccaaacccatgcgaggcagaagggtcagcaagctgggcgtgccgtcgtgggcacgtggcgggtgggtgggttaagaaacacaagacatcaggccccgggcggcgccgggtcaccaagacccggacccggtggcgcaggtcatgcggggagccgagggcgaaaggggcgcaggatcctcccgtgcgctgatcgcgcgtgccagccaggggtggagcgcagcggggtgtgtgccacgcagcgcctcggcgcctggctatgcccctgtgcgcatgggtgagtgcgtgccggggatgctcgatcagggcgggagtcgcggcaaggcagtgcatgcaaagggctttcgcctcgattcacgacctgatgttgggcatctgcatgactcgaaccgacacatgggtgattgtcttttgctggttatgggcaatggaacacaccccaggcccccccagccatggtggaggatcagggaaaggacggcacagagggatccccccactcatcccatccggcnnnnnnnnnnttcggggtgggtgggtgggtcaagaaacacaacacatcaggcccaggacggcgccgggtcaccaagacccggacccggaggcgcaggtcatgcaaggagccgagggcgaagggggcgcaggatcctcccgtgcgctgattgcgcgtgccagccaggggtggagcgcagggggtggtgtgccacgcagcgattcggcgcccggctatgcccctgtgcgcatgggagtgtgcgtgccggggatgctcgatcagggcgagagtcgcggcaaggcagtgcatgcaaagggctttcgcctcgattcacgacctgatgttgagcatctgcatgacccgaaccgacatatgggtgattgtctttttctggatatgggcactggaacacacccctggtcccccccagccatggtggaggatcaagggaaggactgcagagagggatccccccactcatcccatccggcagtgcaacacgtgcatctggccccagcagtccctgccctacatattgagtgtggcagggtggccacccctcctaccggatggccccaaccccggcccacctttgtccccgcccaccagctgcaggcgtgcgtcccagggacgggtaaaatcctgccccccacacacgtcctccagcccctcgccggcgtaggagaggaggggtgacacctccacaccctccccgcagccaacgcggccgcccgcgcgccgcacccagccggcgtgcagcgccagcaccgcttcgcgcgccgtctccgggcagtcgctccccgcgcccggcccgttcttcaccggcgcaaactgggcggcgcggcccacctccaccagccgcacgccctccgccaggccaaaggtgtcaaagatgaagagctccagcttgacccccgggcgcgtgcccccgcccaggcaggggaccgccttgcgcgccacgtggaagcgcggggcggcctccagcgcgtccgttgcgcgcgccagccaggccagggagaagaagtgcaggcaggcgttggaccaggcgtagcgcagcgcgcccgtggccgggttgcgtgctgctgcgcgcgcctcgctcagctcgctgtactccagaaccgcgaggcggccgccgcgccgcgccaacacgcccacgcgctcccccggcgtcgccttctgcagcacgcggcagcccaggtcggctcgggccgccaggcacgcgcccaccnnnnnnnnnncgcgccgcgccagcacgcccacgcgctcccccggcgccgccttctgcagcacgcggcagcccagttcggctcgggccgccaggcacgcgcccacccaggcagggtccaggggggcggccagcgcgttgtccacgggccagacgtccagcgccgccacgccgcgcgccgccatgtccgccagggcgccagagcgccgcagcgcggcgtacaccccgccgttgccgtcggggctcagcgccagccggccgggggcggcgaggatggcctcgcccgaaggtgtcagcgccggcagctcgccctggcgagacgagggggtcctcaaatctgattggcgcaggtgagagaggtcgccggccgtgcagaagcctcctggccccatggagaacatacagattcagaccacagccacgaccctccgcccatggcagcttcaacacgactcactacatcaccctcaccaccttgacccctatggaactgggccccctgcgtacctgctggaagaagaacacctgctcggcatccagcccaaaccaggcgtgcgcctggaagaaggcccgggtctccacatccgtggcggggctgggcattatgtaccagggtatgcatggtcgaggcgcgctttcctcccgctgggccagctgctgcagccgcagcaggcgctcagcgtgcagctgaaacagggacttgcgggaaggcaggccgatgtcatagcagcccttgggcgcggggctacccagacgggtgccctggccgccggcgaggaggaggccagcaaccctgcccccggcgatggctgccagacccagcgcccgccacttcccacgctgctcctcggtagtgtcctgcgatgagagagaaaggggaaagagaggggcaattgacaattatcctgggcggctagctcaagcatcaggtgccgcatgccctgctggagtggccactgcccatgtgtggctggttttatgggcgagactctgcattacaatacaagtacacaccctgatgcacctgggcccctgcccagtccaaaggtcctcaggacaacaccgcctcatttatacatgatcccacgacttcccacctgaatggtttggacgccgtcgatgggctccacgccctcctcagaatcctccgtcatggccatgctggcctggaatatgcgctgcacgcgggcaaaatcgacggcctccagctgtacctggaaagccgttcgtacctctccatcgagggtgagcaggtggtcccagaggtggccctgtccagcagtcctcagggctgcctccagcccgcccattgcgcagctgtcaggagaatttttgggagtgaggcacagatacacatcctcttgcgagtgttcaaggtagaaagaatcaggcttccagtttatataaacagatgacgtttgctggccacggagcttgcatgagctgtccagcatcggtgagaggagcgcacctgttcaagggcaccccaagggcacctccgtacccacgaatccaaggtctnnnnnnnnnntttcatataagcagatgacgtttgctggccacggagctcgcatgagctgtccagcatcggtcagaggagcgcacatgttcaagggcaccccaacggcacctccgtacccacgaatccaaggtctatcgtctgcagcaggctattcctcgctaccacatctcaaattcatgcacaaaacatgtcgttcctgggtgtaggtaacctcaacaatgttgagaaggctgggagtcctgcgatcggtgctacacctcgtcttccggttgccgggaaaggaaagaaaacctgaatcccaccctgcgcagcgaaaccgcgcgcacccacgtttggaatcgtggcgcaacgccaagatggttattgaatttcgagggtcgagaccgtgtgcgcggatgggccgtgtcacaggcctccactgagtgcggcaccgagcgcccgagcacgaagggcacaaggttcagacactgttcccaactcgcaccccgacactggcagcctccccattccgnnnnnnnnnntcgagcacgaagggcgcaaggttcacacactgttcccaacccccaccccgacactggcagcctccccattccgaagactgccagtcggaagacggaaagaggtaacttttcgcaagcggcgcatgcgcgcagcccgacaacggccttgtgtgagtgatcaacctgccgagatgctaccgtacgactcagttcgcccctgaagtccgagccacctcttctggtacgtgcatattcctgatgctggctattttggtggtacgccccatgcgtccatgcagcgctcgctctgcacctcgcatggcaaggcccaccctcgctgcaaggcgcgcgggaaccctgagctcgtggctttcacccatcgcaggccatggctggcgcggagccctccctggcccgccagcgcgagccgctggtggtagcaggttcagaggtggtgggtcgcagcctggccatctggtcggcccagctcatggagtggcccaaggctgtgattaccgggcacgaccccgccacggggcggcatgccatcaagtaccggggcagggcagggcccgagacgaccgagacctgggtcaatctggctcgcacccggttccagtgggtgggcaagcctccccccggcgcagcccccaacccgtcggccaagagcgcgccccccgacgaggccctcgtgggctgcagggtcaaggtcttctggccgnnnnnnnnnnaaagagtgcgccccctgacgaggcccttgtgggctgcagggtcaaggtcttctggccgggcatggccaaatggtacctcggaaaggtgaggggtggacagagagggtggagcagagacactgcatccactccaccccgtccatcctgcctctgggtctgtgtgtttgcccttccctgcgccggattcccacctctgcagcttcttcccctcccgaacccctccgccccccaacgcccctccctcaggtcgtggggtttgacgccaagacccggcagcacagcatcaagtatcgggacggcgatgcgcagcacctcaccctgcggcacgaggcggtgcagtatgtggacgtgccctcccccgccgcggggccctccccgcccaagtccgccag

SEQ ID NO: 30135 - DNA, 74 bp, Chlorella protothecoides
gacccctgccgatctcgtcgccttgcagtcaatgatcgacgatggtgtcatcctgcttccgtaccctctccaaa

SEQ ID NO: 30136 - DNA, 72 bp, Chlorella protothecoides
ccgtgcgccacacagggcgatatttcctccgaccaccagcatgccccgcccagtctcacctgaccaggtccc

SEQ ID NO: 30137 - DNA, 1565 bp, Chlorella protothecoides
  modified_base (471)..(480): a, c, t, g, unknown or other
  modified_base (1092)..(1101): a, c, t, g, unknown or other
cacccacccacccgacacaggacggggagcactaccacttcacgacacgggccgcgttcgaggccggcatcgcgcgcggcgacttcctggagcacgcccacgtgcacggcaacatctacggcacctccgtccagtcggtgcgcgatgtggccgacgccggtctgtgctgcgtgctggacatcgacgtgcagggggcgcggcaggtccgcgcggcggggctccccgccctcttcgtcttcattgcgccgcccggcctgaccgagctggaggcgcgcctgcgcgggcggggcaccgacagcgaggagcagatacgcacgcgcctggccaccgcggcagtggagttggagaggtgggcgactgattgggggttgtgaggcggtgggtgtgtctcaggagggcaggcgcataacaaaagagtacggctgccatagacggcgctcgtcttgcgcgggcgaagcccgatgcaagccnnnnnnnnnngttgggggttgtgaggcggagtgtgtgtctcaggagggcaggcgcacacaaaggagtgtggctgccatagacggcgcttgtcttgcgcgggcgaagcccgatgcaagccctgcgctggactgacggcccagctgattgcctgccggcgccggcggcgcggtgtccgccacggctgccgcctgtctcccgaggcccaccgaccaacagacccctcgatttccctcatgtgttcacatctcgcagccggggggaggaggggctgtacgactacatcctggtgaacgatgacctggagcgggcctacgccagcctggcggcggtgggcgagcgggccctcgcgggcgcggcgccggcgaccccgggggaggccagcgccgccttccgcacggcgcaggggtcggacgtgcaggaggggcctggccggcagccgcacgagtcgacgtcgggactccgtggtgtggaactggcgacgatagaggggcccggcgctgcgggggacgcggcgataccgatgcctgccggtgctgaggatgtggcgaccgcgacgccgcccgcagcaagccctgcctcccttttggtgtcctccgctcccgggagcattctcatggtccnnnnnnnnnnaaccgcgacgccgcccgcagcaagccccgcctcccttgcggtgccctccgctcccgggagcattctcatggtcctgcacgccggagccccgctgggcgccgagctgtgctgtcagttggcggccgcgggcgcgcgcgttgtcgccgtggcgggcgacgccccgcccctgctggccctgcaggagcgggtgcagggcctgggcgccgccgccgagcacgcgttcctccccgtcgtagcggacctggagcgcgaaggcgaggtgctggcgctgccccgcatcgtggcggagcgctggggcggggacgctgcggtgagcgcgctggtggtgtgcccgccggatgaaccgccgacggaagagaccaggctcctcgtggaggcgccggcccaggccgcggccgcggcgctggcgatggggctggcggggccggcggccgtggtccgcagcctcgcggcggcgggcggcg

SEQ ID NO: 30138 - DNA, 412 bp, Chlorella protothecoides
  modified_base (142)..(334): a, c, t, g, unknown or other
gagccgcgctcgccacgtgacgccgcggttccgctccagctccgccgccaggtggtcccgctcctgtgaggtgagtctcggtggtgtggggtgaatgagggggtctccaaaggatgagacgatggagggtggttggtgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcagaaacatccacagaagcacgaaagtcgccctgtacagtaaagtagacgacgaaactcaccgcctgctccgct

SEQ ID NO: 30139 - DNA, 79 bp, Chlorella protothecoides
cacagccgcggcagccgacgtggcgaattgaaaattgccatgcagtagactgcctcccttgctgtagcgtagcctgcca

SEQ ID NO: 30140 - DNA, 150 bp, Chlorella protothecoides
gtgatccccgccacgatgactgcaggggagcggggtgtttgtgtgtgcatgggtgtgggtgacgaggggccaccggtgggcagtggaggccgtgtgtgacgctcggcggctggaccaacccgcagtggccttcgcacccctggcaccgct

SEQ ID NO: 30141 - DNA, 76 bp, Chlorella protothecoides
agggggtagcagcgcagagggaatatgaagattaaagagcagggcggaggaggtttggggtgacatgcagattcag

SEQ ID NO: 30142 - DNA, 115 bp, Chlorella protothecoides
tgaaagttacaacatcctgctttctttttaagaaccttgcgctgaagttcctttgatttcccccccaacaagcctgggccctgaggcggatcccgctgtgtgctcttacttggca

SEQ ID NO: 30143 - DNA, 128 bp, Chlorella protothecoides
gcaggcccttgtccacgatggcaaactccaggccggcggggccgtgcgccagcaggttctgcagcgccagcagcgccacgcggaccagcttctccttctgcgccacgcgcactgcgtccaccaggccc

SEQ ID NO: 30144 - DNA, 481 bp, Chlorella protothecoides
  modified_base (156)..(303): a, c, t, g, unknown or other
cgcgtcgcctcggcggccagcgcgcccgcgccgcgcgcggccgcctcgcgcgccgcgtccagctccacgctcagcgccttgacgcgcgactgaaggtccgcgtacgccgccagcagcgcctcgtggctcgacgcctgctccgccagcttctcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgccgcacctccgcgtcgcgggcctccagcagcaaggccaggcgcgcgctgtcgtcggagcgcaggggcaggggggaggtgggcggggaggtcgccgagcggtcgtgcccgagcgtgccgggcgcggcgccgccggcctgcgagcgccgccaggagggccgcgccgacgtcgacgg

SEQ ID NO: 30145 - DNA, 76 bp, Chlorella protothecoides
gggacccacccagagcgggcagccttcggtgtgggttgggaggcggttgaggagcgggaatcccgccggtcctcgt

SEQ ID NO: 30146 - DNA, 95 bp, Chlorella protothecoides
aaacaagttcttcgagtgcaggtgcagtcttcctcgaaatatggcataaaggcgggcttgagatccagctagtgcgatgcagggaggcgtccctg

SEQ ID NO: 30147 - DNA, 77 bp, Chlorella protothecoides
ggccatgactccctgcaaccagccatcaataaggaactgaatgttacggagcggccatgtaatttcctgggtacatg

SEQ ID NO: 30148 - DNA, 98 bp, Chlorella protothecoides
tcctcccagccctccaccgttccctccaccgtcacctcctcctcccagtcctccaccatctccacctaatgaatgctggacggcgcctgtggtgtctg

SEQ ID NO: 30149 - DNA, 421 bp, Chlorella protothecoides
  modified_base (118)..(348): a, c, t, g, unknown or other
agcagcacccatgcgcactggcatgcacctctgtgcagggctgtccaggcagagcttattgcccggcacttgtggcgcccagcccccatttccatcaggagcttgacaccgcaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccccacagccttgagcaacccctaacaaacgacacatgcaaccccccgcacctgggcaaacacatcctgca

SEQ ID NO: 30150 - DNA, 79 bp, Chlorella protothecoides
actccaatgccaagcattagtgcttctcatggacctcgggtaaaaagattagccgcactcgtcattactgcttcctgta

SEQ ID NO: 30151 - DNA, 77 bp, Chlorella protothecoides
taccagcttgaggtcgaatcaggtgggttgcagtaaatgcgaatgtaatcattccatgtgggaattcacaagctcat

SEQ ID NO: 30152 - DNA, 97 bp, Chlorella protothecoides
cacagcctccccctctgcgagctcgagctcctcgggcagtgagtgggatgtcgaccctgctgccgccagtgaggcggacagcagcccggccaagggg

SEQ ID NO: 30153 - DNA, 77 bp, Chlorella protothecoides
cactgggatggtggagacagactccaggggggtgcacagagctgagtggcggaagagcaaaccctctggcatggggg

SEQ ID NO: 30154 - DNA, 80 bp, Chlorella protothecoides
gtgaaagttgggcatgagtcttcatgcatggcaatgcgggcatgatcgccttttcgcaggcgtgtcgcacgggggccgac

SEQ ID NO: 30155 - DNA, 100 bp, Chlorella protothecoides
gggagaggccattgcgagctttggtgggattgtggaccactggagctgctgaaccaagtcgcctcgatgggtgcgcagctgtgaagggggagtggtgcca

SEQ ID NO: 30156 - DNA, 62 bp, Chlorella protothecoides
cctcgcaattgggtgagatcaggagcagggcacgtggctcggaggggtggtttcatggatct

SEQ ID NO: 30157 - DNA, 72 bp, Chlorella protothecoides
tcccccccccccccccccccccccccaaccattccccttcccacaggccgagaagctggactccatgctctc

SEQ ID NO: 30158 - DNA, 61 bp, Chlorella protothecoides
tgcgcatacccctaccagtggatcgttaggtggagcgccttgtcttgagcattgaggaggc

SEQ ID NO: 30159 - DNA, 75 bp, Chlorella protothecoides
gctggccagggcgggtacggtgcgcgccccacccacgactacgacgaggccgctcgaggcaggggctgatgaggg

SEQ ID NO: 30160 - DNA, 76 bp, Chlorella protothecoides
caaccgggatcggttcaggggcatggtgctgggccctgtagccgcgtgcgtggaggtgtccagcattgagcatgcc

SEQ ID NO: 30161 - DNA, 101 bp, Chlorella protothecoides
cagctccggcgagcggcgcgcgtgcgcgcccgactcggccaggcgccgcgcccagaacgcgccctggcgcgcgcgcagccacgccacggtctcgttggggt

SEQ ID NO: 30162 - DNA, 147 bp, Chlorella protothecoides
tagctgatggaccacatgcctgaaagtgtgattggcgaacaacacggcacatataatctgatgccacggtgccatgagctgcttctaggacatagctctgtcccagtgagaacccacgaacatctgtaagggtagtccctgtgccgc

SEQ ID NO: 30163 - DNA, 70 bp, Chlorella protothecoides
gggggggggcacggagggagctgaccgcggcgacgccgtacttggagactgacattggggcgcacaagga

SEQ ID NO: 30164 - DNA, 448 bp, Chlorella protothecoides
  modified_base (142)..(311): a, c, t, g, unknown or other
tgctggaggcatgggtctggccatgtgcaatactgagtgtgcagaatggcactatacatgccggacatccaagggatggcccctgtgactcaccctattttatgatcctcgctggtctccaggggagcctgccgacgagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctccatcgtcgatggaatgccgtccagggttgcagggctttcaccacagggcttgaacctgcacatgtcaatgagcgggccctcaagctggggtactatctactcaccaccatgccgatagtctagggcatcgac

SEQ ID NO: 30165 - DNA, 61 bp, Chlorella protothecoides
gcctgtgcgcctctgcgaaggtatgcgccgaccctcgccccgccgtctcaggttcatgagg

SEQ ID NO: 30166 - DNA, 78 bp, Chlorella protothecoides
atgcattacagataaggcatagacacattacactatcagactgccatggtcctcggcgtacagcgagaggatgtgctc

SEQ ID NO: 30167 - DNA, 113 bp, Chlorella protothecoides
atcttggcgaagccgtgagatgctggggccggcactgaagtccaagggtgcgagcgtgctggaccccacctcccatcctgctgcccgaaccctgccctcacaggcgagaaccc

SEQ ID NO: 30168 - DNA, 80 bp, Chlorella protothecoides
cccccccccccccgccattaccagcatacccaccacctcccgtggaggccaatggggcctgagacctggtacatagagga

SEQ ID NO: 30169 - DNA, 77 bp, Chlorella protothecoides
gatgacgcagccggtgggcgggtgctggggggctggctgggttttggtagggaggagaaggggggagaggaggagga

SEQ ID NO: 30170 - DNA, 123 bp, Chlorella protothecoides
tcgcacagcgacgactttgccacggacgacgacgcgcctttgttcgagttcttcgcgaaggtcacggcggcaaagtcggtgccccccataaacagcaacacgaccgccttctttgctgccagc

SEQ ID NO: 30171 - DNA, 80 bp, Chlorella protothecoides
gtgaagtccgggaggctggcctggccagcaagacgacaattcaccagccaccgctgcccattccttatggcacgcaccac

SEQ ID NO: 30172 - DNA, 95 bp, Chlorella protothecoides
caaactcggttggcgttgctcacgaaagtacgcctggggttaaaagaaaatcgtgatggacgaggtaccgatcgcgatccgatcatggaaaccgg

SEQ ID NO: 30173 - DNA, 73 bp, Chlorella protothecoides
cggcgtgtacctgtacgccaaccagcagggttgcgatggtggtcgcctctactacgacggctgcgcggcggcg

SEQ ID NO: 30174 - DNA, 76 bp, Chlorella protothecoides
tgtacagcaagaccacatattccataaagggcgatctattccctttccctcagtctttggagtccgtgcctaagat

SEQ ID NO: 30175 - DNA, 90 bp, Chlorella protothecoides
tgatccagacttgcaccgcgcacgcctaccgagacctgtagtcggattgacctcatgacagagaaggatgtcgtaagcgattccaaaaag

SEQ ID NO: 30176 - DNA, 136 bp, Chlorella protothecoides
gctctgggtgtcgtcaggcctgcccgcatttggggtgctgtgcattaccatagtgatcagggggctgccgtccggcgttcatgccgggcgagagatgaagggctgcatgtttcaagtctcgccttggagcccttac

SEQ ID NO: 30177 - DNA, 62 bp, Chlorella protothecoides
ctagacgaatgggagggtgcggtcgactcggaccccccctggtcccatgaagggcatgcact

SEQ ID NO: 30178 - DNA, 73 bp, Chlorella protothecoides
ctgaggtgcgcggagcccctcgggtgggctataactgaaactctgggcaagggattttgccatgcccatagaa

SEQ ID NO: 30179 - DNA, 107 bp, Chlorella protothecoides
acaggctcaggtgcagcgtgcaaagaaaaccacgcctcacacggcattacatcacccacatcccactcccactccttcttcctgcaggccatgcgcagcgtgcggtc

SEQ ID NO: 30180 - DNA, 61 bp, Chlorella protothecoides
tacgttgcgggttacggtgtcccccagcccaagctgccccttgtcgttccttccccaggtg

SEQ ID NO: 30181 - DNA, 64 bp, Chlorella protothecoides
acctgctttcgctccccaaaacatggatccaatgaccagctcacctataagaagcttctgtggg

SEQ ID NO: 30182 - DNA, 99 bp, Chlorella protothecoides
gcgacgaggccccgggccagcgagcacggctggcatgtgacggatgcctgtgcttgcgacaccaatgcatcagcgatgatccctctacctgtctccaaa

SEQ ID NO: 30183 - DNA, 78 bp, Chlorella protothecoides
gagacttcagtgagggtgccggattagagcccttacaagggcgctaagcaggagcagctgtgagttgtaaagtgcatg

SEQ ID NO: 30184 - DNA, 73 bp, Chlorella protothecoides
gttgcctggtcgctggtgctgattccatttcaagggtagcgaatttaggcaggcattgagggagatccgcagc

SEQ ID NO: 30185 - DNA, 136 bp, Chlorella protothecoides
gaagctggaaagcagggcctcggagtcggaatcgcgctgcgcctcctccctggcgtgaaggggatcgggtgaggtggggtgggtgtgaacctgggagagctacggaggccgatcgcgggctgtcaaatgacaagtg

SEQ ID NO: 30186 - DNA, 61 bp, Chlorella protothecoides
caccgtgcccgagatggagtccaacgtcgaccggatctgcgcctgggtggctgcctggaag

SEQ ID NO: 30187 - DNA, 74 bp, Chlorella protothecoides
gggatggcgaggccgcagggctggctgccgcggatggggaggtagcagggctggccgctggcgagcgtgagggc

SEQ ID NO: 30188 - DNA, 122 bp, Chlorella protothecoides
catgccgggcacgagggcgtgccgcctccggcgtgcgtctgaccagacaccagctggacacctcgctcgctcagagcacggcctcccagacggcaaaattggggcccgaatgcagcagcttc

SEQ ID NO: 30189 - DNA, 4322 bp, Chlorella protothecoides
  modified_base (922)..(931): a, c, t, g, unknown or other
  modified_base (985)..(1159): a, c, t, g, unknown or other
  modified_base (1283)..(1292): a, c, t, g, unknown or other
  modified_base (1987)..(1996): a, c, t, g, unknown or other
  modified_base (3313)..(3322): a, c, t, g, unknown or other
  modified_base (3576)..(3585): a, c, t, g, unknown or other
ggtgggggagggggggagggagggggaaagggtgctcagcccattgggggtggccgcagcacgggaggcatcggtggcgccctgtggagcgaggtggggacggggttgggtgccagggaggatagaaactgagaaatgcatgctccaagtatctgcatgcaccaaatcggtccggctggcgcctccgccagtgtccggccgggggaccaacgtgcctgtggacggaagggtcttcgttgccgcaccggctcgccgaatcctgtggagttgaatggatacgtggctggttggagagtgcagcacgaatgcgcatccccaccaaccccaccgagcaccacgcacgtgcagcagcgccgcgccgggaggccggggtgcacaccccaaaaccgggggcggggccggccttcatgcagctgcagcccgctagagacatggctagatggtgctggctaatacagaggcacgccctcggccacggccgtgtggaggggggaattgggagtgtatcgacaggtgggttacggacataaagcgccttccccttctcctggcggcaatcgagcttgttcccgccatgccccacgtaccggaagggggtgcgatggaaaaaccctgacgcgtgggatcttagaccttggggcggggcattctgctgcactaaggctgagacacgcttgagcggaagtgtcaattttcgaaggacatgcaaagatctcccactccatgcatgtctcgcggcatattcccacggtagctacaactgcaactgagacccccgttcccaccctgtcctcctgctccctttccttggagatgcatgtggaggctggatcacgagatccattgacagcctgatccatcaccatatctcagatccagccccttggaggcatgggggtttttgacggcctgttcaagggcnnnnnnnnnnacggaagcgtcaattttcgaagaacatgcaaagatctcccactccatgcatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcagatccagccccttggaggaatgggggtttttgacggcctgttcaagggctcccggcccggcgcaggcacgcccaggcgggggacccagatgacccgccagccctccagccccggcgcgnnnnnnnnnnaggcccgacgcaggcacgcccaggcgggggacccaaatgacccgccagccctccagccccggcgcgccagacgcccgcccgcagcgcacccccgagcaggtgctcatcgacgccgcggcctggtccctgccggactggacggggcgaggcgcgcagcgtgcgcagcgtgccgagcaggaggccatggacgcggccctggccctggagctggcaaggtcggagagcctccacagatcggcgcggggggtggtccctccagcctccagcggcggcccgcccacgccagcgcccgtcgcagcgacagaggaaccggcgccgcatgacatggcaagcgatcaggatgaggggctggcactggctctggccgaatcggtcaagctcgcggaggcgcggtctgccgaggccgatgacacggcacgcagtttccaggtcggcgggtggtgggatctgttggaggaagccagatggggagggcagccagagcatgagcaggctgtgtcgctttggtgtgcgacgggggctcaggggtgctggcgaggagtgagagttgaccggcaaagggtgccgagctgggaaattagcagacaaagtcctgaatacagcacaccccaaggtagttccatctgaaccttcctttccaatcccgccaacactggatgcagagcgccgtggccatggccatggccgcctccctnnnnnnnnnnaggggagggcagccagagtatgtgcaggctgtgtcgttctggcgtgcgacgggggatcaggggtgctggcgaggagtgagacttgaccggcaaagggtgccgagctggtacattagcagacaaagtcctgaatacagcagacctcaaggtagttccatctgaaccttcctttccaattccgccaacactggatgcagaacgccgtggccatggccatggccgcctccctttcttcggccacctacgacgacctcctgcgcgacgtctcctgctgggtgcgcgacctgcgtgggtcgtgcggggacgtggaggccgcgctgcgggaggtggcggcctcccgcgccgaagtcgacggccagctggccgccctggggggcgctggggacgaggaggccctgccccgcgcgctgtggctctcggagcagtacgcggcggtggaggggcggctggcggagctgcagcacagggtcgcacccatccaggaggccgtggcggggctggccaccctgcacgagtacatccaggaggcgcaggtgcttgtctgggtttgggaggagggggaggctggaatcgcgggatggtgccgcaaaggggacggggtgtgtgtgtgtgagtgtgggtgggcgtgacatcatgtctgcagggggtcgcgtcttgcaagggctaccagactgactctgtcctgcaccccctcatctcctcatgtccagccggcggcgagtgaggcggagctccagcgggactacatcatcgcgcacctgtttgaggcgctgagtcagcagggcctggacgccaaccacccacttggggcctggggcaacggggagcgagatggcagccaggcaggtcgggggtgccaggccagggtgccgcgtgtgaggggtgggggctcacccggtgggccagctgggtggcaaacgcttggagtgagtggggtccatggttggatggcgatgcatcctcatggggctgtcgtgcatgtgtaccctctacacgattctctttgggactcggctatcacagcaacgctattctctttgtcgcccaggcttctggacacggaggtgacctgcgggacattgtacagcagctcatcgaggactgccgcaggatgccgccgctcccacgctttgtcatggccgaggaggaggaggaggcagggacgagccaggctctgagggagcagcgaatcgagtccgacgaggacagcaacgacgcaggtgggacaccaggatattgaggttttgagactgcatatccacaaatcttcggaggagcaactcgacggtggagaggttttcgaagcgaagcctgcannnnnnnnnngtttgaggttctgagactgcctatccacaaatcttcggaggagcagctcgatggtggagaggttttcgaagcgaagcctgcagcgcccagtgtttgtcttcaccggcaactgcctgccaatgtcatccatcatgtccaccttcacccctggcacgcaggctccatcgaggccatgcccagcgctcccgtcctgctcaaggaagaaggtccctcgcaccgccccgccgtcccctctctgaacctcccgccctcgnnnnnnnnnncgcctgccaatgtcatccatcttgtccacctttacccctggcacacaggctccatcgaggccatgcccagcgctcccgtcctgctcgaggaggaaggccccttgcaccgccctgccgtcccctctctgaacctcccgccctcgagggaagaggaggagctgccggcagcagtgccggagcctgctaccgtggcagcccctgtctctgctcccgccagcgacccagatgctgggctgcccagcgatctggcactgcacgctgcgccagccagcgagcctgcaccagttcttgcgcccgacgtcagtgcggcatcactcgcttcatcagccagcagttcatcgccagccatcccccccgcagacgatccagcaccaggtgtcgcaccaccatcacacagtgcagaccatgccgggagtggggcccccacccgccgggccaccgcatcccgagcccaggaggaggagccgcccctcgtgccaacccctccgacgccaggaggagggcgctcctcgccggacaagggcgcacgggccggtcggcccctgcgctcgccctccccgctgcccacgcccgggcaccacacgccgcgggacggcctgcgccccagcccgcgcgacgccatcgtccgcctgccccccctcgtagccctgcgccacgatctgcagcgctcggcggcgctggcggggaggggcgtgcccctgcccagcccgcgcggcggcggcgggcgggcggcggcc

SEQ ID NO: 30190 - DNA, 61 bp, Chlorella protothecoides
ggtgtggggatccctggcgtacaggagaatttattgcaatcatcacaccctccagcgtcct

SEQ ID NO: 30191 - DNA, 111 bp, Chlorella protothecoides
gggagacccatgtcgcatgcctcaatagataaagcgcgagctgcctgacgagacttgattcatgcaccgcttgcatctgacggtttggtgcgatgctgatagtatcaaacc

SEQ ID NO: 30192 - DNA, 65 bp, Chlorella protothecoides
tggtgccagcggcagcgaggaggacagccttttggatggcctcgcagactctggagccagcggta

SEQ ID NO: 30193 - DNA, 195 bp, Chlorella protothecoides
ggtgattgttgggtgcaggccgggtcgtcgcacgctggctggctgaataattcaccgctccgcctgcgatgcctccacccagtgaccatggctggccagcatgcctctgtcgccaatcccaatgcccaggcacgacctcgccaccacagcatctatggtggcccaggtccccactggacgcacctcccttcccaa

SEQ ID NO: 30194 - DNA, 113 bp, Chlorella protothecoides
gagccatgtgaaaaatggttttctcacggtatgctggggtcccgagtggtgaggagggcgcatcccatttccccacatcagaccacagctcggcaagggccgcagcacccacc

SEQ ID NO: 30195 - DNA, 125 bp, Chlorella protothecoides
ccctgagatcggaggtggagccacggggaagtttttggcgcctcagatccacgtccgtccatggacctcccagacgaacgagcagcgacctgcatgaataagagcgagcagcgaggcggtggcgg

SEQ ID NO: 30196 - DNA, 454 bp, Chlorella protothecoides
  modified_base (260)..(363): a, c, t, g, unknown or other
gtcgcgctcctcggcggcgcgctccgccagtgccacggcgccctccacgcggcggaaggcctccttgagccgcgcctcccaggcgccacgttcgcgcgatgcctgacccgcggcgaactccgcgtcgcgcgacgcctgggccagtgcgccgcgcagcgccgcggcctctgcctgcgccgcctccagcagcgacatggcctcgccggccagagcctccgcctcgcccacctccgcctcggcggccagcagccgctcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcgcgcgactccaccagcgccagcagttgggagatgcgagcctcgtaccgcgctgcctgggcggccgcctcggcgcctgggcgcgccgc

SEQ ID NO: 30197 - DNA, 497 bp, Chlorella protothecoides
  modified_base (113)..(178): a, c, t, g, unknown or other
  modified_base (265)..(371): a, c, t, g, unknown or other
ggtggggtggtggtcgtggcccgactgtcaccatgcgccgccatgggagtacatatcatcatgctccctcacacgcgccctttgcccgcccaggataccatggtctcgtgacnnnnnnnnnnnnnnnnnnnnnnnnnnnnnnnnnnnnnnnnnnnnnnnnnnnnnnnnnnnnnnnnnnacccgcctacctcgcgcatcgcggtagcggcgtatgtccagccccgccagccggccgcgcagcgtggactggatgagggcccgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggtgtggactggcgcgcgtactccgcgcccggcggcgtgctgtgcgcggaggtcagtgccacggcattagccccgccgcgcaggagcgcggccacggccgccgcgccgccgtgcagcacggcgc

SEQ ID NO: 30198 - DNA, 62 bp, Chlorella protothecoides
caaatgcaggagggagcaacgtgtcttgatcggatgcctatggaagcttcgttggaagcttc

SEQ ID NO: 30199 - DNA, 272 bp, Chlorella protothecoides
gcggtctgcttggtgcgagccattgttcttaatgtgttttaatgttgaaggatgttgaaggctggaagattttgtgggagtgcggtcccgtcgcgtggatttatgctgtcgccaaggactcaaaagacacttcccgccacctccgttgttacggagcacgtaccgatcttgtaggccaaaacggccacaacggtccatcgacttggtatgcagaatgcgtttgcaagaataaataaagcaggcccggtcgtcgaactcagcatcattctcac

SEQ ID NO: 30200 - DNA, 71 bp, Chlorella protothecoides
ccaactgattcgcatagggctggaatgcacaccagtggcaataatggtggtgtgcactgtggccaggcggg

SEQ ID NO: 30201 - DNA, 229 bp, Chlorella protothecoides
gactgcattgtggaggtacgttgctacagcacctgacacttggtgactctttggtgtattgctgtgtacaggcaaggtttggccagacaggtgcaggtgccccagtgatccaaggacatcgggtgtccgccggttttagagtgcctaacaccacgccgtttcagaaagtcaaggtagcaccacaccatcgcaccctcctccacagatggacgctctcgagaccttcacc

SEQ ID NO: 30202 - DNA, 79 bp, Chlorella protothecoides
gttcccaagcacctgcacccccacgcagtgcccccttcaatttcccttacccctccccccccccccccccccccccaaa

SEQ ID NO: 30203 - DNA, 64 bp, Chlorella protothecoides
cataaaaccccgcacacaccacatgcacacaagtcttcattccatccgcgcaggtgatcgactt

SEQ ID NO: 30204 - DNA, 98 bp, Chlorella protothecoides
tgtgcgagtttgcgcgcctgctggcggcggggccctccgaggaccagctggagcgactgggggagctcatgctggccagccacgccagctacggcgcc

SEQ ID NO: 30205 - DNA, 347 bp, Chlorella protothecoides
  modified_base (111)..(277): a, c, t, g, unknown or other
cgtgcaatatttggcaccacagggaagttttgttcctggagggatgagatttctctggccaggggtgttgcgcgggccagcgataacatgtgccaggtcccatcacgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagggacagggcgtccggtctggctcccgctgccccacctccacgccgtcctccttgcgctgccccag

SEQ ID NO: 30206 - DNA, 71 bp, Chlorella protothecoides
gtgtgtgtgtgcgcagagaggggggaggggaggaccatggaacaccctcccgcccatgccgccgctccata

SEQ ID NO: 30207 - DNA, 61 bp, Chlorella protothecoides
gggcagggccgcggccacgaccacaagcagcgcagccgccacgaggatgatgggcccggcg

SEQ ID NO: 30208 - DNA, 117 bp, Chlorella protothecoides
gccatgacgctcacaggcgcaccgccccttttccaacagaccatgcagccgtgccagggcgtgaccatccacgacatgggccacaagatgggctgcaacggcgtggtgagttgggag

SEQ ID NO: 30209 - DNA, 109 bp, Chlorella protothecoides
aggtagcccagtcgctgtgggagggggggagtatgggagccacatgctgtaggcaggcaaaagagagtttgatcccgccctactttgcaggtgcatcgtgcggtatcca

SEQ ID NO: 30210 - DNA, 61 bp, Chlorella protothecoides
tgcgagtggcatggggagacttctttgcagcgattgtggtggtagtgggggaggcagaggg

SEQ ID NO: 30211 - DNA, 213 bp, Chlorella protothecoides
tgtgcggacacctcgttgcatcgtcacaatgaagctgccccttcacctgcgaagcgcgctgcgaggaatctgcagaaccccgtctcccatcccctgatcagctgggggaagcggtatcggtccacagtctcaggctgcaggcggcttgcgtcgtgccaggcggacatcagtcccatgcgccagaagctgcggggaactcaagggggggggggg

SEQ ID NO: 30212 - DNA, 103 bp, Chlorella protothecoides
aggcgcgctttcttcagtccccaaacgacgcgctgcgaaacaggcatagggcagatgcaggacaaaatgacagtacacacaccaagggagtgacctagggtga

SEQ ID NO: 30213 - DNA, 432 bp, Chlorella protothecoides
  modified_base (103)..(284): a, c, t, g, unknown or other
ccaggcctgcacgctgaaacccaggaacgcaatctgcgcgccagaggaaaggggaacagggtgtctgttatagatggtgccggcaactcggaacacaagcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgggctctgccttcagtcggggggttgatcacccggaactgcagcccgaactccgtccttcccccgggcgagcctggcgcagtccctgccgatgcatttccctgctcctccccatacatcaacccccccccccccccccccccccc

SEQ ID NO: 30214 - DNA, 129 bp, Chlorella protothecoides
aggagcaatgcaggccgggaaagggtggccggtacatcacgcgccctgctagcgactgggtgtacctatgttttcagtctcctcctctccccaacaaccaccattcacgcaggtgaagctggcgcaggc

SEQ ID NO: 30215 - DNA, 75 bp, Chlorella protothecoides
atgtggcgctccagcatggcttctacatcctccggggtcaagtcctcgtcgcctgcgtccccatactccctccca

SEQ ID NO: 30216 - DNA, 130 bp, Chlorella protothecoides
agggctgcttgaagggcccctcatgcaggctggagtggccagggaatgcgatgttcccccgcccgtttcgctcccccgcctgtctcactccctcgcaaccacacccaccgtcccagggaacttggggctg

SEQ ID NO: 30217 - DNA, 121 bp, Chlorella protothecoides
gccgcccccactggtgggtcagccagggctctgttgacctgtgctgctgccatcaacgccggctggcagcaggttcatgcaccccatgcatccgggggagggagcagcgatgtgggacccc

SEQ ID NO: 30218 - DNA, 61 bp, Chlorella protothecoides
cgagaagccaaaggcggagtcgccctccacggccaccgtcgcgcggcccgggtcctgggtg

SEQ ID NO: 30219 - DNA, 76 bp, Chlorella protothecoides
tgcaacaaaatggagatggtcttgtcaactttgggggaaattagtgtagactcctggccaggggcagggttgcagc

SEQ ID NO: 30220 - DNA, 61 bp, Chlorella protothecoides
actcctggccaggggcagggttgcagcaggtgagctgccacatccaggcgagaggatcgag

SEQ ID NO: 30221 - DNA, 74 bp, Chlorella protothecoides
tggatctgcttccaacgattcgtgattctgctccgaccattacaaatcctcagcaccatcctccgccttcatta

SEQ ID NO: 30222 - DNA, 120 bp, Chlorella protothecoides
ctcccagtcgctgggtgggccccagctgaaaaaggaggcaaggaagctcgccccatggttaccccaaacacctcacccaggaacaccatgaacccagcgctcaccggatgaggcgcccaa

SEQ ID NO: 30223 - DNA, 93 bp, Chlorella protothecoides
gggtttctttggagaacgagcacgcggagaatcaggggtccggggggacgcgcagcgcccttggccgagacccctgccacccctaccaacaaa

SEQ ID NO: 30224 - DNA, 153 bp, Chlorella protothecoides
cagctcctggtccttgcctatgggagagggcgtggggtagtggggccttgcaagaggcagctggccaggagtgtgagcaaggggggggtgcgcccctacataaacactatgacagtgcgtccccagatggaaaggcaatgtgccttatcccca

SEQ ID NO: 30225 - DNA, 167 bp, Chlorella protothecoides
cagccaagcgatggattggaggatgcctttagaagcagggcaccagggcgcatgcactgtgcagcttgtcgagggcagcacacgagatgatgcaacgttgccgggcggtggaatcgtacctggcagcatggcaactgtggtgctttgcaaccagtgagaccgccggc

SEQ ID NO: 30226 - DNA, 61 bp, Chlorella protothecoides
gtggacgattacactcatcacactgggaggggcgtgttgaagggaatgcacatctacttct

SEQ ID NO: 30227 - DNA, 62 bp, Chlorella protothecoides
ccatcccggggtgacgaccagagctgccgcttgtgaccccttccccagcttcctgtggcagc

SEQ ID NO: 30228 - DNA, 62 bp, Chlorella protothecoides
catcagaccaggcccgagccatcacatgggagggaaccgatggatctcgcggaaaaggaaga

SEQ ID NO: 30229 - DNA, 4042 bp, Chlorella protothecoides
  modified_base (564)..(573): a, c, t, g, unknown or other
  modified_base (906)..(915): a, c, t, g, unknown or other
  modified_base (1432)..(1441): a, c, t, g, unknown or other
  modified_base (1767)..(1776): a, c, t, g, unknown or other
  modified_base (2689)..(2698): a, c, t, g, unknown or other
  modified_base (3010)..(3100): a, c, t, g, unknown or other
  modified_base (3766)..(3915): a, c, t, g, unknown or other
gcgttcaaccaagtaagatttgtgtacccgcactacatgcaaacctgaatacaaggactcgaattagtcccacggttgcgagggatggatgtgtcatgccagcacagcaacaaagtctggcaaaccttgcccactaccatctgcactgcttcctggggttgagaatgggcaccgtccaggaagatcttgaatgcatgcgggtggtgtgcacgagaacaaggagcctgcagcggatagaggtgagccgcgagatgtgcatggtatctctgttccggaatactaccgtccatgcttcaccccaatgtcacactgtctgcccatcacttctgctttgggatgagctgttgaataattcaactgtttacacactgacacagggctcatctcggcattcaaggccggcacagacaggaggcagggaagggagccggcaccagtgtcagacctgccacttcttacctcgcaaaacctggcttcaacatctaaagagcctgacacacgaggatcggtcagaaccaccaccctacaccttgttgatagtcacagcgcaccaccgcccctccnnnnnnnnnngaggaccggtcagaaccaccaccctacaccttcttgatagtcacagcgcaccaccgcccctcctgaacatccctggcaacccctccccgccaccagagggcgatccaaagttgaaagaggaacacaaaagaggatggcggcacaggtcatctgcagtatggaggagggaacactggaggagcgcactttataagaccctgacggaagccgtgctgcctgtgctgcccgctcactaggcggagagcatatcctttcaatgacacattcacgacagagtatgacgcatttgctcttaacttgagaggggggagtggcgtgagtcggcggactgcnnnnnnnnnntactaggcggagagcatatcctttgaatgacacattcacgacagagcatgacgcatttgctctcaacttgacaggggggagtggcgtgagtcggcggactgcttcagcaggtagatgaaggctagggagaccttgcacctgctgcagaacccatatattatctacaactaggctagcatccaggtatacagcgtttgaggggcacatggtcgccctggggagggtgaaggatgtgagcagttccctaggtctccacgggtctcaccaggggaaccgggtatgacggatgtgtgtcgattgcattctaatgcccctgcactcgacatcctaatgctgtgataaggtaaagcatgaatgtctgcctcgtgcggtgcgttcccagcctctactaaaccaggtaacgctatgtgatgttgcaaaatgtgtcccgccgagcgggagtcactcggcgcccgatcaagtggtgatcagttttctcagcccttctttacccatggattccccgggtgacattagnnnnnnnnnncctaaaccaggtaacgctatgtgatgtggcaaaatgtgtcccgccgagcgggagtccctcggcgcccgatcaagtggtgatcagtgttctcagcccttgtttacccatggattccccgggtgacattagactgtccaatttgtattgtcccgggacgaccaagttcgggcagtatccaagggctgctctcgaagtgtcggcagtgtgaaggaaccaccggccaaacactcgaaacatgcgcattacatgtccaatttggcaatcccagcgtacaccagccttgttaatctaccacaaaacgcgatgtgattgttgatcagggaacnnnnnnnnnngcattttgtattgtcccgggacgaccaagtttgggcagtatccaagggctgcgctcgaagtgtcggcagtgtgaaggaaccacgggccaaacactcgaaacatgcgcagtacatgtccagtttggcaatcccagcgcacaccagccttgttaatctaccataaaacgcgatgtgattgttgatcagggaacttgctgggatggccacgcggctttgcctgctggttgagaccaccacgcggcacaaggatcagtggcgggacattcgcatcaacatcgtggagcccatcctgcgtgccttggacgcctcccccacctccgagctggccctggtcctcgtgggcgtgccagggatgaggtgcgcagtggtgaaggtgctgcacctcctgcactggcccccatgcttgcgccctgcacaccagtcccgcgggcggtgccaatctcattccatcctcacgcctgcacgactctacgtccgccatgcacccctcttccacgccagcgtcaacgaggtcctgtccagccagtggacccgggacacccaggagctccggcgctggttggatggcatcgacttctgcggcggtggcaatggcaaaggcctggcactcggccaggcactcctcgccgtggcctgcctctttggcgtgcccagcgccctgccctcccccgccaaccactgcctgatgtgtctcatctcggaacctgggccgcaccccgtcgaatggccatacccccaggactgcggcaaggtgagggggagaggcacgggaattttggtgtggggacaagggaggcgaagtgtcatgttcaaccaaaattatgtgcgcaatactgagtgagctgccgttgcagaagcatgtgcatgagctgcagcctgcacggcgattcatgccatgcccctggcgcccatnnnnnnnnnnaaattttggtgtggggacaagggaggtgaagtgtcatgttcaaccaaatttatgtgtgcaatactgagtgagttgccattgcatgggcatgtgcatgagctgcagcctgcatggcgattcatgccatgcccctggcgcccatgcgcgaagtaccggtgatggcatcgttatgaatcatatgcagcctgggctagtggccagggtagtgctccccgctgctctggcctaagctcatacctctccgccgtgctcgcgttcctcgtcacacagctgcgatcccccattctccatgccctctcacaggtgacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacggcgtgagaagcccctcatccggcacgccctcctctggcacctcctcaacatgatctccgacgctccggtgggtggcggggtgcggccatggtgcatgtggaaacttgggcatgggtatgtcatgtcttccagcacatggactcaacaccgatttcccaagtcctcataccccttcctgcacccctcctggcgcgttctctcccctgacctctcccctccccggagcacaatcgcacgcagctggactggatagacagcaccactgcgctcatggaggcagccaaggcccgctccgcgctggccaagtcccacgtcgtcacgcgcggcaacagcctcgctttcttccccttctgggagagcgcgctgcgcctgctgcagaagcagagcggggtgcggggccgggagcagtcctcgggccaggccagcatggcgggcggcggcaggtccgccccgccggcgccggcaccagcgccccaggcccccgccgcggccaccgccgcggccgccgggcccgccctgccagccaccgccgccgcctcccccgcgctggccgatgtctcccccggcggcttctgggatgtgatgaactcagagctgatcaacggcccaagcgagacgctgtctgcgctgtcggccgccgccaacccggcgcatgccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccctgcccgctccccgctgggcgcactgtaccaggcggggtcgccgcctgcgattgtccctggtgcggcccggggggggccgcccggtgcggcgccgcgcgccggcgggacgccgccccacctg

SEQ ID NO: 30230 - DNA, 154 bp, Chlorella protothecoides
gatgctggtcaattcgtcggttctaaggactcctgtgcaggctcatgctgagcttggggctgtatgttacgataaacccctgccctgtgcaacacttaggtgtgacttttgcgatggggagcttaagtgcgagctggaggggggcaccatccgg

SEQ ID NO: 30231 - DNA, 260 bp, Chlorella protothecoides
gtgagtggggatggtggtgtggatgcaaacgggtggacattatttggtgggtgtgcagaggatgatgtgctgccccatcgggcacgtgtgatgtgacgtcacccgagtgcgagtggcaccttcatgtatgacctgacccatcttcctatgaggaattctctcttgcgccggatccagagcctcgctcgagaccccctcgaactttgcagatggggctaggcctcatgacgggcggcgctatcgtagcggggctgtctgat

SEQ ID NO: 30232 - DNA, 61 bp, Chlorella protothecoides
gacggtgatgctgcgcaggcgctgcgagacttcgtgcagccagccggagagcgggtagccc

SEQ ID NO: 30233 - DNA, 2590 bp, Chlorella protothecoides
  modified_base (250)..(304): a, c, t, g, unknown or other
  modified_base (588)..(597): a, c, t, g, unknown or other
  modified_base (1155)..(1164): a, c, t, g, unknown or other
  modified_base (1583)..(1592): a, c, t, g, unknown or other
  modified_base (1835)..(1844): a, c, t, g, unknown or other
gggcgcgccagctggcgccgggggtggcgctgcggaggtggcgggcgtggggaccgcgggagagccgcggacgctgggcgtgccggtgcgacccggcgcctgctccggcacgctgcgcgcgctgggcggcgcgctgctcaccagctccgcccccgcgtcgtcctctgaggagcgcaggcccaggccaaagcaggacaggccgctggcgccggaggagggcggcagcgcacgcgaggaagccagcgccacnnnnnnnnnnnnnnnnnnnnnnnnnnnnnnnnnnnnnnnnnnnnnnnnnnnnnnntggcgcccagccggctggagggctgggagggtgggtgcgcgtcggtcggcgggctggctgcgtcgacctgcaaagagagagggggggtggggcggcggcgtgaagcggggtctgcgggcggcgtgaagcggggtctgcgggcggcgactttgtcctggtatgcatcgccagttgcccacgtcctccccaggagcatgacatgcacggacagagaacccaaagccctggtggcaagaccaaggccgctcatcttccgctggccgcatgctcccacccttcgtgcnnnnnnnnnngcccaggagcatgacatgcacgggcaaagaacccaaagctctggtggcaagatcaaggccgctcatctcccgctggccgcatgctcccacccttcgtgcgtcacttcacctcccccctcagtctccaccaccaaccccccaaagtcaacatgccaccaacctcgaactcgtcgacgctgctctgactgctgctggggcgggacaggcccagattcttcctcaagaaagtgctgaatgacctgccacggcgatgtgtcttctttgtgatctcgggctctgcagtgggcacaggggcggggagggagttgacctgggtgccaaagaaaagagagcctctgcgcgggccccattggtaaatagccagccagtctcggaccgccatgcagcctgcagattgattgcaacagtttctccaccctgcgcacctggctcggcgacagcgtcctccaggctgcgggtgcgggagtggtggctggccaccactgctttgctggccgcggtgtcggggtccaggctggctgcgcggctgagtcccgtcccgaaccagcccctggactnnnnnnnnnngctgctttgctggccgcggcatcggggtcaaggctggctgtgcggttgagtcccgtcccgaaccagcccctggacttggggggaggggggtcctgtgtgccgccccgcagcgactcctctcgggtgcccctgcccagccgggcaaacagccccttccgactcgagtgctccggcaggctgggcaggcgctggagaccgccctcatgcgacatggtgcggcagagagttcgtaacccccagctgaaggtctgcggggaagggtgtgaagggccgggatgcagttttaagtcgcctgcggggccagacactgcatgactgagcctgcgtatcaccaagctcagggatgcacccacatcgataatacctggatccttcaagaaggcttgaattttcttcctgatcagtaaggccgacatagnnnnnnnnnncatacctggatccctcaagaaggcttgagttttcttcctgatcagtaaggcctacatagacgcgctctcaagcgaccctgcatcctggcactgagtgaggcaggcgcactggaagggatgagtgggaaacctcagcactgcgtcaagatgcaaggcctggggccgagtgctgtccggttataacccggcactgagggctgggtgtatggattcggattgtatgtagggcggggccggctagannnnnnnnnnagggaaacctcagcactgcgtcaaggtgcaaggcctggggccgagtgctgttcggttgtaacccggcaccgagggctgggtgtatggatccggattgtatgtagggcggggccggctagaggtcgcatcctcgtaggcaaacctgtcgaagctgctgcattcccgtgccagcgtgtttcagcaagtgatcagtccgactgccgagatgggacgatgcagcacgcggaaaaatcaatgatcctgaaacaagttcgtattcgaaagcatatgtatttgcgcatgataacatttcttgatgcatctcggtgctgagctgcaggacctgcgccatgctccttcgcctggccccgggcatcgagtgtttcctgcaggactgcgtccgccaaggcattgccagcgatgtgagatgaaggtttttgaagggatcacgacatgctgtgatgatctgggggtcccggggatgatatgtgcgatgcagcaagcatcactcccagctctccgctgccccaggacctggccaaggaggtgtcccgggcgggtgccgtgccgtgggaccagctcaagcgcctgcattgccaactgaaggctgcccgccctgacacccccaacctgtccaaggtacaggtgcaggatggcattttctggctttggatgcctggagcgcatgcacgctcgaaggctggtaactgtgcacccccacctgatccaactaccgcgtgtgctgctctgcgcattcctctttaaac

SEQ ID NO: 30234 - DNA, 98 bp, Chlorella protothecoides
ccttcacatccagccccagccacgcatagattagatcatgccccccttggtcccaaaaacactgtttcatcagcgaagcaaagcaaaggagacgcatc

SEQ ID NO: 30235 - DNA, 69 bp, Chlorella protothecoides
ttgatttacttcccggatcattctcctccctccccccctcccccttcccatcccaaggtcctggccttc

SEQ ID NO: 30236 - DNA, 61 bp, Chlorella protothecoides
ctgcccccgatacaaaacgcccggccttccaccctgccgtgagtctggctgtggcgctggg

SEQ ID NO: 30237 - DNA, 76 bp, Chlorella protothecoides
tgaatgcgggtttgcatgcgcactccggtaccccaaacttcttaccggtatcctctgaatctgatatcagcgtgcc

SEQ ID NO: 30238 - DNA, 132 bp, Chlorella protothecoides
gcaacgtcatcccggggcgagttttggaggagggtgtggagggggttggaagagggcagaggaagggggtgtttgccagaggaggcttggcatattgtttttaggagttggcaggtgattcttcagcattcc

SEQ ID NO: 30239 - DNA, 61 bp, Chlorella protothecoides
gccatggcagggttgccctgtacccgcagccccagccacaggctggggctgactgcccccg

SEQ ID NO: 30240 - DNA, 247 bp, Chlorella protothecoides
ctccgacctggtgttcaaggtgcaggggtgtgtctgtttggtggaggggttggggttgggggggaaacatgaggtggggagggtattatgtgctggagaattgccctggcgcggaggacccttcattcctgggcctccccagccaggacagctcgccaggccgccctccccttcgcccggcggcgtcgccgaatctccttcccttctccgacatctccacaaaccccgggagccctttgaatccccc

SEQ ID NO: 30241 - DNA, 73 bp, Chlorella protothecoides
gccgggcccacgcccagttggtgcgccgccgacggaggcgcggggcgcagctggcgccgaggccgtggggacg

SEQ ID NO: 30242 - DNA, 168 bp, Chlorella protothecoides
gggcagggaagcgtggtgatggggaggcgggtggttgccggggtttggaggactggagtaaaaacacatcgtcatccgcctctttgagcctccctcttccatgcacccactcccaggcagcacccaagcaggtgccctgttcacgcaccttgatcagctggccaccct

SEQ ID NO: 30243 - DNA, 74 bp, Chlorella protothecoides
gggccacagtgacgccactttccactgtctccgcctgtcccagcgggctgttgacctcgtggaggctctgctgg

SEQ ID NO: 30244 - DNA, 61 bp, Chlorella protothecoides
cgctgccggtggctggggctggaggcgtctagtcgggcgcggcgtctgggacgggcaccgc

SEQ ID NO: 30245 - DNA, 116 bp, Chlorella protothecoides
cagtccatccatgccgtacgccagtctctccagggtttggctgcacatccgaagcatttcaccaccccgagcaatgcattcagccacagagtcgcctccatcctcgcctggtagaa

SEQ ID NO: 30246 - DNA, 71 bp, Chlorella protothecoides
tggtggagactcgccgccagcctgcttgccatgcatggcaggggacactgtgactggccactcccactgtc

SEQ ID NO: 30247 - DNA, 61 bp, Chlorella protothecoides
gagcttcctgcagtgatgtccttatgataggtccttccatacaagccatcaacgcaccctc

SEQ ID NO: 30248 - DNA, 62 bp, Chlorella protothecoides
gatacagggggtccaccaaaagctgtgggattaagtgcattcgcaaaaaaacactttgtcag

SEQ ID NO: 30249 - DNA, 61 bp, Chlorella protothecoides
ggcagggtatcaataccctgcagtggcaggggtgtagagggcactgcgctcccatcggtgc

SEQ ID NO: 30250 - DNA, 61 bp, Chlorella protothecoides
tacagtggggcaccaaggtgcaggtgattgccaccaaggtgcaggtgattggcaccgagcg

SEQ ID NO: 30251 - DNA, 75 bp, Chlorella protothecoides
ctgcgtcaaaaaatgagaggaaggggtgaatagatcgtctaaccgcaaggccaccagtagagacacacgcagcgg

SEQ ID NO: 30252 - DNA, 16906 bp, Chlorella protothecoides
  modified_base (3980)..(4080): a, c, t, g, unknown or other
  modified_base (4628)..(4637): a, c, t, g, unknown or other
  modified_base (4740)..(4749): a, c, t, g, unknown or other
  modified_base (5417)..(5426): a, c, t, g, unknown or other
  modified_base (5887)..(5896): a, c, t, g, unknown or other
  modified_base (6292)..(6301): a, c, t, g, unknown or other
  modified_base (6358)..(6367): a, c, t, g, unknown or other
  modified_base (7336)..(7345): a, c, t, g, unknown or other
  modified_base (7672)..(7681): a, c, t, g, unknown or other
  modified_base (9455)..(9464): a, c, t, g, unknown or other
  modified_base (9661)..(9714): a, c, t, g, unknown or other
  modified_base (13867)..(13977): a, c, t, g, unknown or other
gccttttgggggcaagtgatgcttggagagagtagcagggtgactgcggcctgacctgacaaaggatggttacctcagtccatgcctgccagggcatgtttcccatgagcaaggagcgagatggtgtgatgtgtgcaatgccgacattgggactggcgccttcatcgaggtgcaaacatgttgctgctgggtagacaggggatgatatggacctgtgcagtatccaagcagggataaggatgggtggttcaggaagctgcgcccttgctgagacagttgtaaatgaagacggggagcattgcacaggtcatacaagagttccacttgcacttttccatgtgaagtgcatgcaattcctaaaaatcaggacacgtgctcttcctgaggccagtctcatcacctcgttactacagatacgatggcgttgcaggggcagtatcaagtggatgcacttctccaaatgcaaggaacagcatctagtgtacaagctatgtgagttttacgtaaagatcacaagagtgttggagaacttgtgctatcatgctgggcgaggttgagatcttgggcttcagataaccttttcaccagcgcaacaaaaccagcataatcatctgaagttggattctctgcctcgtcaagcactttggccactgaacccaggggggtggtccaagggtccttcagcctgtgctttttgccgatctctgcaagatcatgtctcaccattttgtatgtatcccaatggaagccgtctctctcctttgttcccatgaggaagtcccgagcagcaagaacgccattgtagaacaggacaaatttgcccagtatggacatattaaaatcaagggcgcacaccttcccagtgttgacagtctgagtcagcagcgcacactcctgcacccgatggtgatgagagggtagggaactgagtagaattggtggtcggaagatggccctcactccgtggcaccccattccccatccctctgcacacccactttgttctgggtgttgaactccacgtcttggatggcggtggccgtggtcacagaagcaactagcagttgaccaaggcctgaagtcgattgtgcctccttgggaggggacagtccaaccccaaaggtgggccagcgcacatcaaggtgtgacggcagatggaagaggttgatggggaaattggatatcacgccaccatcttgaaaacgaacctgtctcaaaggatacgggggggtgatccatgagtgccatggggcttggctgtctgggaaagggaaggacctcacccattccattcagtggccattatctaaaggtagtctatgccaacaccaaacttcactcctcgcccaaggctcccgaagcaatctcacccgatcagggatggtggaggtaaatcctgtttccgtccacttggtgaataacaggtcatctgcgcacacaccagcaaaaggcaccctctcgtccttactactgggcaccgtcatcggccggaaaaataccggcagggagacgctagcgcgcacgcacttggcagggcttaccacatctgtgattgggaaggagcaggcgtggagagtcaggccggatacgagtttactggactgagatgaagccctgcatgggtatacaggtgaagcaaatttgccttctgcagaacgtgaacgctgcctgtaacagcccatgacacaacccttgggttgactgccagacgcacctgcgttgggccagtagagctcagagtgcgtcatgggtactccggtcatcagcttgtctctcttccagctcagcaccgccttaatcccacacgtcacatcggtagctacagtgaccaccagaccctcaggagagcgccagctgtcataatcctatgggtgattggtgtgcatggcaggtgaggtttgtaaagttcgcttggaggggctcctcaagaactagacaagacgcaggtgccatgctgtggccattctgcctccgctcagcctatacctgtagcaaaaaccggccgctgcgctgaatctcttcctggtctccgccttcaaagcgtataccactcaggtcgcatttctccctcagctctgcgagcgtgccggccccatgttcagcaagttgttcgtgcacccactcttcgagggcgtcgcccgggtggacgcctccttgcttccacactcggatctgacagcgggaggggggaggacccgaattagagctgggtctgatgttcatctgcaatgtgtgcatactgctgacaagcaccccaactgtcacagaagtgattccccaaatatcctgatgtcacaaaggttatgccctcaacccaccattgccacaggaagagctggaagcagtagccacctccaccatgccgaaggcaggtcacttatgagggaaaggatagactccccaagtgtgcggtctagcatcctcccatccttgaatttctggaccggcataccaaggagcaggtctaacagcctcctccccgctggcgcgtcaggagtggggcgaagccctgcgagtagcaccgccgccagtgctccagcagacgtcccgccaatggccctggagaggaatttgggcatgctgtatggggtcagatgaccataagagacaagactttcactaaaaaatgaggcctaggcacattcgaagcttgattcggctccctttcaacactctgccccaggtttttcaaccttcaagatgtcgatttacctaaaacggatgccagcatgctctagcgcatatatgtagccaacatgcgcgattccaagcagggcacctcctatactggaaaggctagtagtgggtgtcgatggatgcggttacggagccttggggcctgggatcggcctgcaaagatgtcttcattcgctgagcttcaagagaaacctggcatagattccgctgtgacaggcacaacctggatatgcaccactcgctggcacgcccatttatcgacctgacctgccagaataagatccacccagttcagcagtttcggtatggagtcctcgttatccggggagctgtcggggttcttggacagcagattactgaccggcttgtcgaggtggatggagttcagcagaggctcgacctcggccaggaagccatcgacaaccccggcggtgtcattattcctcaataaattcttccaggtcctttccagatccttatatttcctttgttttcttatctcccgatagttgagcgggcgaaagttggttctgttgacgttcatggtgtattctgtccaattgtcggtgatgggtcctgaagggtttagcaagcgttcgcttcacggcgtttaagccagagccttcccgtgagtagtcagcaaattatcttaaagatcagtgtgtaacggataaagagcatgggcgcagtataggactggattttggcaaatcagatggtgcttacacttgcagctacctgaagccggatggaggaagatactgtgggagcggcagactcgggatgaggcgggacatcctgccgaccccgactcggtacatgatcgacgataacttcgagacggacaacccatgtttgcctccatcgactgttataggtgtttctccctccatcattgggacagagtgaaagggttcgtcttctggcgtgccacgcggtgaactaacgagtgtctattcgggtgtcgctacactgtgggtgaagtaccattttacagactcgtcggagcaggaaattcctgacctgcagtaaaagtgagacggtcacaaccagatttcttgattcaaaacgccagacaatctacgaatccgcaacataaggaagcagaggaggctgcacaaaaataaaagctccacccctcccagtgaggcatgagcttacgatggtcaaaatcaccggtcgcaaacggcgctttgctgcaaaataaggaggaatttgagctccaggactcaacattcactgagttggtgttcccaccacctgggccaagcgggcgctgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgtcgtccacgatctgagtcagcatctcatattcctggtggtggtatgggataggggtgatctgatctggcatgaaccgtagcagcgacaattcagagggcaaaccgtcgtgcgaacacaacacagccatgcggctccaatcccattcccccctttccagcccctccagctgcaccttgttctgggcaatgaactcgatgtcctggatgtgcgtcgccgtcatgatggtggcccccagcagctccagcaggttggaggtcttcttcttctccctggggggcgacagcgctaccccaaaggtgggacagcggacgggctcggtgggaggcacatgaaagaggttgatggggaagccggagaggacagcgccatcctggaaccgaacctgcatgatggagaggatggctatgtgctggatgttggagtcaccttggacaatgcattcatgagcagggcaggtgcatggctgcgtctcctcctgtcatgttcatgtcccaggccacatttggtccctggcacagagcaaggctccaccccacccgcgcnnnnnnnnnncccatgggcagggcaggtgcatggctgcgtctcctctgtcatgttcatctcccaggccacatttggtcccgtgcacagagcaaggctccaccccacccgcgcnnnnnnnnnncggtctcccacttgttcttcagcggcttggccagctcgccagcgttgggaatggtctttcccttctctgccggcacaatcttgggctggaagaagacggggatcgagacgctggccctcacacactgtgctgccttctcgctgtctgtcattgatgagagggagggggaacggcgatggggctggagggctgcagcatcacaaccccctgcagatctgggcagggcatagctcttcgatgatgctcgaaactccagatacacaagtcccttggggtgatggtgcgggcctccagggcactcctccgtacccacctggatcagcccagtacagctccgagtgtgtgacaggggagttgttgaccgccgggtccctcttccagctcaggttggccttgctcccggtcgtcacgtctgccgacacggccacaaccaggccctccaggggctgcccattgtcaggcacctgtcaacggggtggcagggtggtcgggttgggatttcggtgaggattcggagggacattccagccacagaatattcacgctctgaagggacaggggttgcagcctcatacacagcgcccctcccccgcatggccccttttgcatgcgccaaccgacctgcaacgatttcaggtgggactcggtggcaaccttttcgaacacannnnnnnnnnctttgcacgcgccaaccgacctgcaatgatttcagatgggactcggtggcaaccttttcgaacacaatgtctttcaagtcacacttggtcttcagggcgccgagcgtgccggcgcccttctcctccagctccccatgtacccatttctccagcacggtgcctgggtggatgccagccttggccacgatcctggcctggggaagggggtggggagagctgcctggttcggcaagaggcgctggtgcccgtcgacggcagaagcatgcgcatgaccgtcccagcccatccagcaccacggcttcctgctcccccaagggagcagcactgtggtgacgaggggcataccagcgccacagggaagaggggcagcagcagccagttcaggggcgacgtgtgagtgccggtggcaagcccgatgaagcagtccccgaccgccttgtccagcccagccccgtccttannnnnnnnnntaccacggcttcctgccccccccaaagggagcagcactggatgaccaggggcataccagcgccacagggaagaggggcagtagcagccagttcaggggcgacgtgtaagtgccggtggcaagcccgatgaggcagtccccaaccgccttgtccagcccagccccgtccttaaacttggggactggcatctgcaggagcgactccaggagggccgtccctgcaggggcatccggcttggggcgcagcccggcaagtaggacggcggccagtgctccggcagatgtgccgccaatcgccctacagtgcggagggaaggacttgatactccatcgccaaaggcgaactgaggacatgactatcattcgatgtgggcaccttatttcttgggattgaagnnnnnnnnnnagggccgggggaagatgtgagaactctgcgagggtgctggacagagctcaggccccnnnnnnnnnngagtaggacggcggccagtgctccagcagatgtgccgccaatcgccctacagtgtggaggggaggacttgatactccatcgccaaaggcaaactaaggacatgactatcattcaatgtgggcaccttatttcttgggattgaagaaccatattgagtgctgcatggatgagatggaccacaacccagctccctcccacctgaagcggatgcctgcatgctccagtgcatagatatagccgacgtgggcgatccccagcagggctccacctatgagatggggccgggtagaatatgagaactttgcgagggtgctggacagagctcaggcccctgatccacgatatccccctgccactcatctgcaaaccctcgtgaagatccatgctgacgtggcacatgctgggcacggtcaaggtgccccacagaccgcccacatgctcatccatgtctcacctgccaggacgagatccacccagtgcagcagtttctccgaactgttgactttcgtggtaggaggagaggccgccttcgatcgcagatcactcacagggctggcaaggtcgatctcgttcagcaggtccacgactccggcctgaaaaccttgaatgattttgtcagtaccgccgttcctcgcatactcctgccactccttctctagctgccgatatctctcatcgttctggatcacattatagtcgaggggaagccgatgggaggttgcgctggccatgggtctcttgcctggtcgatggggattgtaggtgcgcggagagtactgaatggcgatgcgaaacagccgagctgagcgccacatgtaccgagagttacctctaagagagacgatgagacggttaggaaatcctttgttttggtcattaatgctgcaaccctcatacctccagtatcttcgtgagcgggtgcgcaggtacatgaagtcgagccgagcgcagaggatcctgtgcgattcnnnnnnnnnngcgatgatacggtaggaaatcctttgtttcggtaattgatgctgcaaccctcataccttcagtatcttcgtgagcgggtgtgcaggtacatgaaggtgagccgagcgcagaggatcctgtgcgattctgcaatgatgcacgcgttttccgtactcccgagcaaggatgaccatcggaatgggctcgacgcgcaacatccggaagggtacgtaccatctgcagctagcgtgaaagttccggtgctggtcagtacggccgaccaacccacgtggatggaacggtcattcgcgcaagtctaggaccgaaaaccctacccaagctatgacnnnnnnnnnntgtcagtacggccgaccaacccacgtgggtggaacggtcattcgcgcaagtttaggaccgaaaaccctacccaagctatgacaagagcttgagatagctgggggaatacgcacaccaaaatgtactctctacataagcttgactctcaggaagtaattggaactgtcacaccaatcttgagttgctgcagctgcttggcatggaaggcctcagataaatatctgcatcgcttcgcgcggcgtacatctcgagccatgctaaagcccacgttttcaacagcaggttcctgctctgcatttgattcggtattgcgtcgtcacctctcatccattggctatcgtcatgcactgttcccaatgacggagtgaagagcatctggtttatatgaacgagacagccgccagcctgatgaggacacttgaaattcgctttgtgtcgtggttcgcagtgataacaatgcatgcgccgaggacatgcgcctatctctggagactgctccccagccacaagagcttccttgggtgacctgacggacagatcagctgccctgggagaggtcgtttaaaatagaagtgaaccccatatgggccagacgtgtgcttcaatcatcacacatgcatcatgtagataacagtgacattgcaatgcacttccatgtcattaaatcgtatttccttgggcctcagtgtgtaagcacaacggctaccgtgcaagccagtctgctccatcgggtcagatgcaccgtttgggcggggcctgtatctgccatccttgagatatgaagaatcaccccctataccgaccatcaaggaagattactaccatctcagaacatggtgctagcacttcagatcattgcggcagatacgaatcacttgcacagtggtatcagagtagtctgtcatatattcgctgatgatggacatccaaatacagcagtaacacggggcagatctaacaacggtgggttgtgcatgtacacacggtatcccacatttatactttagagcatcctcaggcactaagaacagagaagttccaactgctgtacggttgtgcacaggcgcaagctgtgatggctgattctaaacaccgaatactcgctcagccttcacttctgcacggcaggcagtcgcgcagctgccctcagcacccgtcacaaatccgcacggtcaagtccgattggcattggacagtgccaccctgagctgtttgtagtatttccagtcgaaacccgcacggcccgggccccccatcaggaagtcccgcgccgccagcacgccgttgtggaagaggacgtactttccgatgatgggcaggttgaagtccagcccaggcacgccggcgacattcaccagctgcgccagtagcttgtactcctgtgtacagcaggaaaggggggcaatcaggcttgcggcaagacatcagccttgtgtggtgcgtggtgggacgcgctgtcttgtgggaggatgtgttggaatgttagggattcccacccataaacctgccccatgacttatcctgcaccagcctgatcctctgcctcccgctcatccaatctcaccttgttctggctgacaaactcgtagtcctggatgtttgttgcagtggcggtggcggcagccagcaactcgccgaggttaccgatggacgcggcccggcgtggatcagacagccccaccccaaaggtcgggcagcgcacctgctggcctgaggcaacatggaacagattgagggggaagcacgagaggaggccgccgtcctggaattgcannnnnnnnnngatacgcacaccaaaatgtactctctacatgagtttgactctcaggaattaattcgagctgtcacatcaatcttgagttgctgcagctgcttggcatggaaggcctcggataaatatctgcatcgcttagcgcggcgtacatctcaagccatgctaaagcccacgatttcaacagcaggttcctgctctgcatttgnnnnnnnnnnnnnnnnnnnnnnnnnnnnnnnnnnnnnnnnnnnnnnnnnnnnnnatatcatccattggctatcgtcatgcactatcccagtgacggagtgatgcgcatctggttcacatgaacgagacagccgccagcctgacaaggacacttggaattcgctttgagtcgtggttccccgtggtaacaatgcatgcgccgaggaaatgcgcctgtttctggagactgctcctcagccacaagagcttccttgggtgacctgacggacagatcagctgcccggggagaggtcgtttcaaatggaagtgaacctcaaatgggccagacgtgtgcttcaatcctcacacatgcatcatgtagataacagtgacattgcaatgcacttccatgtcattaaatcgtatttccttgggcctcagtgtgtaagcacaacggctaccgtgcaagccagtctgctccatcgggtcagatgcaccgtttgggcggggcctgtatctgccatctttgagatatgaagaatcacctcctacaccgaccatcaaggaatattactaccatctcaatacatggtactagcatatcagatcattgcagcagatacaaatcacttgcacagtggtagcagagtaggccgacatatattcgctggcgattgacaaccagatacagtagtaactcggagcagatccaacaacggtgggctgtgcatgtacacacggcatcccacaattgtactttagagcatccacaggcactaagaacaaagaaattccaattgccgtacggttgtgtacaggcgcaagctgtgatggctaattctcagcaccgaatactcgcttaatcttcacttctgcacggcgggcagtcgcgcagctgccctcggcacccgtcacaaatccgcacggtcaagtccgattggctttggacagtgccgccctgagctctttgtagtgcttccagttgaaagccacccgtcccgggccgcccatgaggaagtcccgtgccgccagaacgccgttgtggaagaggacgtactttccaattatgggcaggttgaaatccagcccaggcacgccggcaacattcaccagctgggccagcagtttgtactcctgtgtgcacagggttaaggggggggaagggggcttgcggcaatagaggagccttgtgaggtgttgaggcatgaagcctcgacagaggatgtgatgaggatccaggctctccaagacacgctcttgccctgaccacaccacatcagcccccttccctcactcccaccttgttctggctgacaaactcgtagtcctggatgtttattgctgtggacgtggcggcagccagcagctcgccgaggttactgatggacgcggcccggcgtggttctgacagcccaaccccaaaggtggggcagcggacctgctggccagaggcaacgtggaataggttgatggggaaggacgagaggaggccgccgtcctggaattgcacctgtggaatggaggggtgtgataaaatggatgtaggtgacccaggcacaggtcacagcttctgtctgcagagggacgcacctggaacgatgggatcatccaagccagacggccacagcttcagaatgcccccacaatcccagcctcactcacccggtcagggatggtggcatcaaaccccacctccgaccacttgttgttggtgagggtgtttgctgtcgcgcccgcatcaggcagcttcagtgctgggtcggcggggacggtgtagggctggaagaaaatggggatggagacgctggcgcgcacgcaagtcgcggggctctcgctgtctgcatggcatacaagttggagcgacggagattgtgaagctgagtgctagtcaagattctggggacgggtaaatgagagatcactgatgctttcaggcttgcttggaagccgctggacagctccgatgaggtacaaggcactcgtggatggactgtactaccccccccacacacacctgggtcggtccagtaaagctccgagaccgtcaggggccgggtagttggattgaatggcctctcccagctcagggccgccttggtggcggttgtcacatcggctgccacggccacgactaggccctccaagggacggtccgccacagactcgacatccggcacctgcagaaggtggggttgaactcgccgacgtgaggccggcagggaccctggaaacagacccacatgaatgaaccccagccctcacagggtgatgttggcgagcaattatggtaggatgacaaggcctgcagttctcccttttctttggacgtgggagggaagcccagcccgccctaccctcatgcaagcatgacaaccgttgccacctgttcaaatttgatgccactaaggtcgcacttgcccctcagctgccccagagtgcctgctctgtgggaagccagcactccatggacccagtcatacagcgccttccctggatggatgccgccgttcttccagatgctggcctgttgatgggacggcgctgggcgtgattgcaggtaaacacgagtgttgactgccagcataccacaatgcaagctccaaatgaggacccaggcaggcctctgccagagcatctccactgcgaggccctcagcataccagagcccaaggaaagagggggaggcggaaccaggtggaccaggagatcttggtgccagtgaggagcccgatcagggcatcccccagcgctttgtctgcaggggccccatccttgaggctggggactgggaggtccaggagcttgagcaggagggcctcacccgccgctgcatctggggattcacgtagcccggccagcaagaccgccgccatggccccagcggatgtccccgccagagccctgcgatggagaatcgggtggaggctgtgcatcaccaaaggccccccaacatcatgttaaattgctgccgtgagcacgccaccgggtgtaatgaccttgaattggcactgtcaccaatccagacaccgagtaggacctatgtctgacacccatccaaccctgaagctacctgaatcggatgccagccctctcaagagcaaagatatagccgacatgggcaatgcccaggagcgcgcctcctgaggagggtggggcgggcgagcagcgactggcgcacagcgaggtactggggtgtgtgaatgtcagaatagatctctgttgaggcagagtgagtgcatgcccaagcaaaccccggtcgccagatcgggaggggcatgcgcccaggttggagtgcagggtttgtggatgcacaccatgtaccctgccccacctgccagcacaaggtcaacccattgaagagtggtcgggggatgaggaccagctccagaagcaggagagggcgggggctttgaccgcaggtcactcacgtagtccgagagctggatctccgccagtatcgggtccaccttctcctggaaatctttcgcaatcttgtcgagggagttgctctcagcatacccctgccacttgcgctccagatcggcccattcaggatcgtccttcacctgttcccagtctaggggtgtccagttggaggccgcggaggggatcacccgcctcgccaggcgccgtgtggagggaggtatggcatgcgcaacagggactttgtgcaatgaacgagccgtgatcgcaccaggaatcatgtctctagtcaactgctgaaatataggtagtacgagctgctttcactgcgtcgtgtcgtcacgcgatggtactagtgctggggtttcgccacgctcattggacctacaggaagccgcctggattcttgcgggacctgagatttggcatgcagaatcttcagatattgcaaagggattcttcgacccttgacaccatttcttcagagtcagagaacctttcaatagtatacagacctccacctttacatccaacacatgtgtatctaggtacaaggcaagcaggttttatgcagtgaaagcgatgtttttaggcgagatcaggtgcatgcattgtccttgggacgctccagatgtgctactcaaggggcagaccggcattccaagacaaggattgctttgatggaacaattcgaccaaaaatgtactggggtggggaggtcgtattgcctcgtccccatcaggaagttacagtaacagagtcgattgatcaacagtcggcctcgccagttgtgctccaccttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttatggcgcctcttgagagtgtgccagggtctgccacagctccatcagtttgccgcgctgttcctcatggatttgtacacctcccagtcgaacggtcctttgctgccgtcccctccgacaaggaagtcgtaggccgccaccaccccattgtaaaacagcacaaacttcccaacggggctgacgtcaaagttgagggccgaaattccaccagtgtgcacactggcagtgagaagcttgtactcctgccgagtggttgttggtggacggcatgaagagggatcacatgcccacttgctgcacacaccaatgaccaagcctatagtgtatcggggcaagtcccccacccccccctccttcgccgaggcctcactttgttcttggcgacaaactcaaagtcgcgtgtctggatgccggtggaaaggagcgccgcggttgtctcgatgagattcccagtacggcgagcagtgcggggtggggacaggttgacgcagaaggtggggcaccacacgaccttctcgcgtgggacatggaacaggtcaaccgggtgattggacaggaagccgccatccacgagcgtgacctgtgcggcgggaggggaggaggaagtcctggacatagcttgcagggcagtagggatggagggctgggctgagaggaacaggacgatgcatgggctctcaccggcattggcaggggggcaggtgggagccttggcaatgagcctacatgcgtgcaagtgcaggtcacagacctgcccgaatcttgcgaggggtggcactgcaaaagctccataccgttcccacacactctcccctgcacactgcccttgatgctccgcgcattcccagatgctccaaaacttcacctgctctgggatgtagtcctcgtacccaatctccttccactttgtgttcggcaggctggcggcccgctgcccggcatatggaattttctcccccggctgtgcggggaacttctttgggtagaagaagaaggggacggccatgctggcacggacgcagtgccccgggttctctccatctgcatggagggaatgccaagggcgtcaacatctcgtggagggagggaaagatgcagggggggcagtgtgcagcgctccgaatgtctcggtggttcccatgctctctgagctgtccaatacgcagctgcccctcagcccacaggtcacgccaatccccgcttcatcgcaccagggtttgccatgtaaagctccgtgtgtgtgataggaggctggtcgtaattcacaggcctctcccagctcagcacagccttggtagaggtggtgatgtcggaggccacacagcagaccaagccctccacatccttcggctgccttccatcctcggcctggcatggttataagatgatcagggtacaggcttgcagaaaaaggtgatgggagcttcccagttgcaggcccatactcagaaaagcatcaagtcttgccggctgctagtagaggcagacattcggcccctcagtgtaatctgagcacgtcaagtaccttgagccagtttatcttgctgaggtcacacttggccttgagatcgctcagtgtgccagctccatatgtttccatgaggttcttcagccagtcctcgaaaatcttgccgggatgcaggccgctgttcttcagagcactgatctgttgtgggaaaagagacgaggcacgccactggtatgagcctctgtcagagtctttgaaattccgagcatgtgcaaattttcacaccgcatatgggcaggcatggcccttccccacacaaactatgatgcagaacatttttgaaggccaataaacatagtcttaccaccgcaaggggaaacagagggaggctgaagaaatcaagggtcgaaatattcttctcgaggacgctggtgatggcggacaacaggccccgctccgccttaccgccgtcgtcaaaggtggaggtgggcatctccaccattagacgaagcaggtcctctgccactggggcatctggacttttgcgcacagcacccatgataaaggctgcaaccgctccggcagaagcacccccaatggccctgtaaagagtgtgatactagggtcagccaggttcaccacacgtgagctgagtcgatccattgttctttggggttatgcttcacggaggggtgcgggaggagatgtcatgacattatgctgacgcctgtcgcagtccccatacctgaaccggagacctgcatcctccagcgcaaggacatagcccacgtgagcatagcccaaaacgcctccacctgtgagtagtgcatacgagtcagtatgagtctgaggctatcaatggtgttagggtgctggattttgtcatctgcagtgggtaccactgcccatgcgtcgcgcccttgctggtgagccggatgtcgggagctgggggaagtcgtatctgacggcatggcaatccccggggacaaactctaaacatacaccaaacacccacccaccagccccgtaccggagaggacgagatcgacccaattaattgtttctgaagttggcccagctgactttggcaggggatctctgttgagggaccggagatcgctcacaggtttgcgcagtcggatttcgtcgaggacgggctgcaccagcttgcggaactctttggtgacctcatcccatttgtcgttccgggcaaggcgctcccatttctcctgccggtcctcccactcagcactcttcatgagtacactgaactccagcggcttgaaccttgcattattctcccaagggttggagttccggagggtggtaggactctgccccgccatgtctcaatgctgtcgatcggagttacgaatctgcttccgggaagggagggctttcaagcagttatggtttgtgtggcgggtgctgcgcaccttgcgctgcttttatcctatgt

SEQ ID NO: 30253 - DNA, 79 bp, Chlorella protothecoides
gtccaaggatgaccacgaggctatggtcacgaggtattgtgggctagaaatagccctgagagaaggtggggagctacag

SEQ ID NO: 30254 - DNA, 198 bp, Chlorella protothecoides
ttcaccaacaagctgtggaacgcgggcaagtttgtgctgcacaacatctcccaggtgtgtgtgtgtgtgagtgtgtgtgcgtgttgtctgagggagagggagggggggcaggatggggtgcgcaggcctgctctgttgcggttgatgctcttcctggcgaggaacctatgtgctctgtgctcccccgtagagttgccc

SEQ ID NO: 30255 - DNA, 4354 bp, Chlorella protothecoides
  modified_base (493)..(502): a, c, t, g, unknown or other
  modified_base (1184)..(1193): a, c, t, g, unknown or other
  modified_base (2364)..(2373): a, c, t, g, unknown or other
  modified_base (2590)..(2599): a, c, t, g, unknown or other
  modified_base (2826)..(2835): a, c, t, g, unknown or other
  modified_base (4023)..(4160): a, c, t, g, unknown or other
  modified_base (4253)..(4262): a, c, t, g, unknown or other
cggccccgggcccagccgccgccgccgcggccgtgaaggcggggctctccggctctgccagcgtcagcagcagggccaggccgcgggcggccagcagctccagcccgccccccgccgccgcggtcgcgtggggctcgggccctgggacgaggcggcccggcccctcccaggtccagggcggcacggccaggggcggggcgtgcagtgtcaggcaggccagcaccaggcgcagaggcgcggcgcagggcgcatcgcacagcatcaggcgctggtagaagaggggagtggccgccaggtaggacagcagctccatcgcggcacctgtggtgcgagtgaagaggggaggagggggacgggctttggaggcgcatcctttatagaacacgagtcgggcgccgtctaggacggcggccaaccctggggctcccacaggcccatcgggcgctgccagccccgccccctccgccccgcacgcgcgcaccgacgtggaagnnnnnnnnnngcgggctttggaggcgcatcctttgcagaacacgagtcgggcgccgtccagggcggcggccaaccccgggggctcccagaggcccgtcgggcgctgccggccccgccccccaccgccccgcacgcgcgcaccgacgtggaaggccagagcctcgagagcgggcccgcggacctccccgcccagcaccgcagcgtgcacagcgcgcacgcccaggcgcacggcgtcgaacgccgcggcgaagaagatgggcccgcgcggcgcggcgcacaccgcctccgccacggcgtgccagcacacagtgggctccccctccccgccgggcgcgacgcgccgggccgagcccgcgtaagtcagggcgcgcagcgcggccgccagcatgccgagggagtccactgccgcctgcaggggtgggggtggggagctgagtgggtgtgccgacacacgtgtctgggcgggggggtgatgagcaagaagagcaagaggaagcattgcaggacacccccagatactgagaggggcgcttgtgagggtccgcaacgggacacagccggcgttggcccggcgcaggagcacccccgcccccccccgactgggaagcttcgggtatacagccaagccattcagggaaagcatcgttatactcaacacagaccacccctgggcagcagggttgcaggtcgtnnnnnnnnnnagactcccccagatactgagaagggcgcttgtgaggggccgcaacgggacacagccggcgctggcccggcgcaggagcacccccccccaagactgggaagctttgggtatacagccaagccactcagggaaagcatcgttatactcaacacaggccacccctgggcagcagggttgcaggtcgtgggtcatgccttggccccccccccgactatccgttcattccaatgcggcagggcggactgtttgatgcaggggaccaagccttgcctgcacagtgtcctgtctcatagcagcttccaggatccctcttgcagctggacccgcaagggtcaggagcaccatgtccacggcgtccataagcatgtcgcagaagctatcatcagtcaggacctgggcctgagcaagaggcagaggagcgatgttgatgcggaagcatttgggatttgagccctggaatgaaatcgtccatgctttaggatcctgacccggataagactaacagctgggagcattgatttccaccacaactcgtgctacgtcccattctttggacagccaaacctcttattccgcacattctacccatgaggcaggcccaatcagccatatgaatcaccagcactcaccttgagctgggggatatggtcacctgaccagcacagggagctgattgcctggaacacggatgtgacgcgagcatgctgactggacggctcagctgtgccgtcatgctcatgcagggtcagatctgcaaacagcagccttcccatggccagcagtggaagaccgctggccagctcgttgatgccaacctgctcgagaggagctcaacatgcaatgttgggtgaaggtttatcagggacatttcagaccgccatgcaccaaacattgttgcctcatctgcatgctcaccttggctgggaaggtatcgggagaggctggcaccagatagtacacgcctttctccagctgagtgacctcggaaagctcagtcacctccagaatatcgacccactcgcgagcaaggccctgcggaccggctcgtccggtgttagcccaggacatgaacaagccatggaatacctcttacttatcaaaagccaccatatactgacataggaagtcattatcgattctcaccgctgcgctcgagcccatcgctcttcaannnnnnnnnncgacagagggagtcattatcgattcttaccgctgcgctcgagcccatcgctcttcaaagctggggccttgctgcgtctcgacaagtattgccgccctgcccccaaggggggttcgcagcatttgggaacattttcgtggaagattcagtacatcaatggcatgatcaatacctcctatcgctttcagcattgcatgtgccacttattgacagttcannnnnnnnnnaggctcgcagcatttggggacattttcgtggaacattcagtacatcagtggcatgatcaatacctcctgtcgctttcggcattgcatgtgccacttattgacagttcacaaatgaatcgtattggccgacagggaaagcgtgctgcgcgtgacgcgacgatcatctccatttcgattttggccgaaacagcaggcgcgggatgtgcgtcaagtcagcgacattccgnnnnnnnnnntaatcatctccatttcgattttggccgaaatagcaggcccgggatgtgcgtcaagtcagcgacattccgcggctaggactctctcgaccatgcgattcgagtagcccaggatgcccctcggcgactgtccgagggacctcatgcatggccagccctgaggaggagaaggcgtgggcacagcaactcgaaaagttactggctcacatcgagtccgcaaaggaaagcagaggaaggaagtcacaccggcaggcggtactttacccatctttgctaagggagaagagtccctcaaaggctgcatcactcaatccagtgcctttgccagtggagaatctgcctcgccacaaaggtaatcatgactactccattttacaggtccgatgacagcatcaggacagttccctccctgaccatcagcccactcccatcatgcacatggcacaggaccgtgtgctggtctacagctgtgccccaccaaatcgacgacatcggcgcctgcagaagagccagctgaggagcccaccttttccttttcacagctgtgtctggaggaagaggcactggacatgcaagtcagtccatggcttgcttccgagctggactttgcagatgtcacccagatcgagcggggagggggttcggtaccgagctggagccaactctctggcggcacacaggaggcccggctggaggcacagctcctgcttgggcagttgggagtgggcacgccaggcccggggatgcatactccctcctgcatcgccgagcctgagcctggagtcgacgcattggcacccgtcggcctgccctctgcgggcccggtcggcctgcccagcaacccagccatctaccccccggcgagccttgtccccagccagcactcggcccagctcgcggtaggatgcccgccccacctctgctcctgcctccgcacctttgcgtctcaggccgaggcctttgcgtttgcggatgcccagaacgcaagccagcccttcctggtcacccttgccccgcgggtggccgctggcgacaagttggtggccgaggcggtactggaactccctcaactatttcctgtccccgatgcagccccgaaacccgcgctgatgccggtccgggccgccctggcgagcatgaaggagaacgtgccaaggaagagccccgtgccgcgcgttccggccgccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcgagcggcgagtcgccctctgcaaaggccgatacccgtcgaggggccgacagtgagcccgagcccgaagctgtagcaccagtgccgttgnnnnnnnnnnagtcgagcggcgagtcgccccctgcaaaggccgatgcccgtccaggggccgacggtgagcctgagcccgaagctgtagcaccagtgccgttg

SEQ ID NO: 30256 - DNA, 99 bp, Chlorella protothecoides
gcctgcaattcctgctagggtagccgagccaccccgcagcactgatgttcacagcgtgcgtgctggccatgctgtgccgccaccacactcatgcatctc

SEQ ID NO: 30257 - DNA, 101 bp, Chlorella protothecoides
tgggctccacgcccacgccgggctcggcgcgtgtaggccctgtgcttgccctcgccccaggctttgcctccggctcgtctgccgccgcctcgcccatcaag

SEQ ID NO: 30258 - DNA, 79 bp, Chlorella protothecoides
gccgatgtcatcgattccaatctggtgagcttggggcgagccgagttggaagtgtggtctctgacttgaaagtagttgg

SEQ ID NO: 30259 - DNA, 167 bp, Chlorella protothecoides
tcgagagtggtcaggtcttgggtctgggtgtacatttttcatgggattgcagacgccccctccaatcacctgtgctcctgcggcggtgaaaggtgaccaggaaccagcatgggatggtgtcacatcccttccccatccaggtcgggaccatctgacctaccccaccc

SEQ ID NO: 30260 - DNA, 123 bp, Chlorella protothecoides
cacccatgtgcatcagggactggggtagggaccgtcgagaagaggtttggtggccaatgtcacacggcatgtcattatccaggtgacaacctactcctccgagttacccatgctggggcagct

SEQ ID NO: 30261 - DNA, 75 bp, Chlorella protothecoides
ggccctataggcatgcgtctttggtggccgggggaccaacccttcagagggtcgccgtgtgccaagacgcgtccg

SEQ ID NO: 30262 - DNA, 161 bp, Chlorella protothecoides
ccgaccaggcgtgcgtgcgtggatagattcctctcttcgcgccgcatcttttcggccgcccgcatgcaatggtgttaatccatatagtaataattggatccgactcgttgataccatacaccagaggtgctttggctggttcggattccgccacgttttcg

SEQ ID NO: 30263 - DNA, 143 bp, Chlorella protothecoides
gtattattgcggaaccaggcggccaaccgctatgacaacggctccccaatgatgggtgaaaccagagacgaccttgacccgcaaaggtctcgatgagcgacccgcacaatgcagatcattggcatgaattatcttggcgcatc

SEQ ID NO: 30264 - DNA, 61 bp, Chlorella protothecoides
cgcagggcataaaccaccctgcgtgctgatcgtcaatggcaagtgtagcccagcctgacat

SEQ ID NO: 30265 - DNA, 61 bp, Chlorella protothecoides
tcgcaaggaggcgtggactcggggcagagcaggaacaggtggaaggtggggaaagcgcccg

SEQ ID NO: 30266 - DNA, 77 bp, Chlorella protothecoides
ccccaacattgcactgtgcctgcaccccgtcgacgagacacccacagggacactcacatgcgaacagtactgcagtc

SEQ ID NO: 30267 - DNA, 79 bp, Chlorella protothecoides
tgtgataccaggccgagggctcggtgatggatcgtggagcctgaaaaattgtgaggggttgcttgcaatttcgaggtgg

SEQ ID NO: 30268 - DNA, 74 bp, Chlorella protothecoides
gaatatggccagcatggctcactggccaaactcctgtacacggtatccctccaagctgccacatcctgcaacgt

SEQ ID NO: 30269 - DNA, 77 bp, Chlorella protothecoides
cccaccagcttgcggctgttgctgctggtaggcaccaggctgctgccgctggtacccaccagcttgcggctgttgct

SEQ ID NO: 30270 - DNA, 73 bp, Chlorella protothecoides
ctccctggtgcacactgcatgtgcacaggccaggctgccccaacccagatccccagccccatccagagcgatc

SEQ ID NO: 30271 - DNA, 61 bp, Chlorella protothecoides
actccaaacgtcagcaaggccacttactcctcccctgccgctcccaacatcagctggagca

SEQ ID NO: 30272 - DNA, 62 bp, Chlorella protothecoides
ctctcctcatcagcggacgcagggctctccacatcagcggacgcagggctctcctcagcagc

SEQ ID NO: 30273 - DNA, 61 bp, Chlorella protothecoides
ggatggcacggccatcgagatggccttctcgaagaagaaggtggaggacaggaaggactgg

SEQ ID NO: 30274 - DNA, 149 bp, Chlorella protothecoides
aggggccctcacccagagtcgggtccctgcgtgctagccagaccacctggtgtcttgcacgcacgcgcccctactccccgctcccagtgcccctctggagcctctcatccccctccctcccggccctctgcaggtggacatctccacca

SEQ ID NO: 30275 - DNA, 187 bp, Chlorella protothecoides
ctttacccaggtctgggggagggggggggggggggggacaggggttgggggaggagagattacggtggcgttaacggtgtgggtgaggtgtgtggaccgaagggggggggcggggctcgtgctgagttcaatgaagcaagcattgcttgggtgagtgcaggagtgcggcaccctcggcgtcttcacc

SEQ ID NO: 30276 - DNA, 67 bp, Chlorella protothecoides
caagaaggcgtccccgcctcctcccaagaaaacctctccgcctcctcccaagaaggcctccccgcct

SEQ ID NO: 30277 - DNA, 75 bp, Chlorella protothecoides
cgagcgagctgcgaggtgcagggatggtaatatctgagaggaggtcctcgcgaacacgttcagggaggcacgcag

SEQ ID NO: 30278 - DNA, 181 bp, Chlorella protothecoides
gcctacattggagttccctgcagaggtagggccgttccacttctaagtcaatttaacccagggttgcagcagctgtgcaacttctgcgtgccattgaagctcccttcgtcacttaccaatattgtcatccccaacgttcccagtgccaaaattgttcttgcccttgttgccggagccaatg

SEQ ID NO: 30279 - DNA, 116 bp, Chlorella protothecoides
cggcgccgaggccaaggatatcatgtctccgccccggggggtcttgcaacgggtgcgcgggtttgaggggatcgcttgctggggggctgtcgccgggggggacgactgtacagtgg

SEQ ID NO: 30280 - DNA, 106 bp, Chlorella protothecoides
agatttgaggactgtcctcaacccacgttcaccccaggtcaaccagatgatatgcttctatccagctgaaaagctggcgatcttggcctggaaggcttgaggcaaa

SEQ ID NO: 30281 - DNA, 99 bp, Chlorella protothecoides
gtcgcgtcatgggtcgcgccatggcccgtgccctgggcagctgcgctcgcgtctcgctcggcctcgcccgtcgcgtcatgggtcgcgccatggcccgtg

SEQ ID NO: 30282 - DNA, 110 bp, Chlorella protothecoides
tgagggtgcggtgtcctgcggctcgtggggaaaaagggccatccggtcgtggtgcgtcctacagaactggaggtcctgaggattggtgagggctcgggccacactccagg

SEQ ID NO: 30283 - DNA, 62 bp, Chlorella protothecoides
atcagactcatcactgactattgaataatttaccccgccttgtagagaatcaggattccacg

SEQ ID NO: 30284 - DNA, 61 bp, Chlorella protothecoides
cggcggaagagtgggccagtggccgggtcctcgcaaagacagggcaccatgaatatcttca

SEQ ID NO: 30285 - DNA, 238 bp, Chlorella protothecoides
cgtgtgggcccgcctgcaggccgcggagctcgctggtgggtgttttaagagggggtttgggcgtctctggggtgtttatcctgctgaggcacagtggctaccggtgggcacagggcagcgtggggatggtggatggcgatctggcgggcacgggctcctggagaggccgttcacccctcgtttcccagcctttcttcaaacccacgctcctgcacgacccaacacagagcgctgcgtg

SEQ ID NO: 30286 - DNA, 61 bp, Chlorella protothecoides
ccccctttgcctgcagcagtgcactaaccaccgctgccagcacatgattcccatgaaacaa

SEQ ID NO: 30287 - DNA, 65 bp, Chlorella protothecoides
cgcgctcatcgcggtcttcgaatttccgcgatgacttttgcttttgcaatcctcgagggattgaa

SEQ ID NO: 30288 - DNA, 95 bp, Chlorella protothecoides
aattaaatgctggtctttcgtgatacatgccagtgtcttgatgcttggaggagtcatctggttgaagtctgacgggcatcgccaggaatcgcatc

SEQ ID NO: 30289 - DNA, 61 bp, Chlorella protothecoides
tcattgcaagtgatcacaacatatggcaggactcgtacttttccttgaggcgctccatacg

SEQ ID NO: 30290 - DNA, 119 bp, Chlorella protothecoides
ggaccctgccgacccgttcctccagcactttgtgaatttaagcagcgcattagatcgtcgatggcttagagaaccccgcgcctgctcccccatctccctttcacacgtttgaacacccg

SEQ ID NO: 30291 - DNA, 79 bp, Chlorella protothecoides
agcgccactgtacccgatggtcatgtcggcaatggcccgcagcgccgcatcgtcgttgctgcggtccacgggcttgccc

SEQ ID NO: 30292 - DNA, 61 bp, Chlorella protothecoides
cacgccctgtaccagtttgctggagtgagcaccagccaatcccgccccagctgcggcgctg

SEQ ID NO: 30293 - DNA, 61 bp, Chlorella protothecoides
gtcttccccccgagctcttgtattggcgagtgcagcaccagctgaaaacatgcaacgccga

SEQ ID NO: 30294 - DNA, 72 bp, Chlorella protothecoides
caagctgcgcgatactctgccacaactgtctagactcctgtacccatctgcagttctcaaacgtacggtccc

SEQ ID NO: 30295 - DNA, 67 bp, Chlorella protothecoides
aacgctgggaccttcatcacggatgccgactggtgattccagtccccatcagtttgtaacagatcca

SEQ ID NO: 30296 - DNA, 115 bp, Chlorella protothecoides
acctttggtgaggagggcgtgagtgagggggtggggtctgggccagggggtatgttgacggtgggggagtgtcgcctctttgtgaattcaaggggctgtgtcgcacgtcctcggc

SEQ ID NO: 30297 - DNA, 502 bp, Chlorella protothecoides
  modified_base (181)..(427): a, c, t, g, unknown or other
gtaggggggcggatgggtaggtggatggggaattctgaatgtgtcgggcagggttctgagcaccagatgttgtgcatgcagcaagagacttgaagcatgcaaacgaccggcctctggggcattgatgctagaggtcggcagaaggggatcctgtagtaaggtagactctacctggatacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactgccccccatgcagcttccctcatgacaaaccaaggtgaaccacacccctccctgccacgtatgctgcacc

SEQ ID NO: 30298 - DNA, 73 bp, Chlorella protothecoides
gcataccctggacacctccctgcacggtgattcctcatggaccagggtgcagggatatgccataccccccccc

SEQ ID NO: 30299 - DNA, 62 bp, Chlorella protothecoides
ggagaggatggacacggatggatcgggggcggttgactttctggagtttgcgacgtgcctag

SEQ ID NO: 30300 - DNA, 74 bp, Chlorella protothecoides
ctgggccggtcgaccaacccgactgagcaggaggatgctcaataaaaacagtcttctgtcgaggtgacgacgag

SEQ ID NO: 30301 - DNA, 65 bp, Chlorella protothecoides
tcgcagcatgagaagactcctgaacattaataaattcacttgcatcttacctctttcaatatctt

SEQ ID NO: 30302 - DNA, 97 bp, Chlorella protothecoides
ggacggagaatgtaaggggcgctgttcgccgtggtcctggatggtgggtcacctggccacctccaacatcttgaatcttcagctccttctgttgaaa

SEQ ID NO: 30303 - DNA, 171 bp, Chlorella protothecoides
cttcttcatgcgctccgtgttccagctggcatccaccgtcattcttggtgggttgagaaaggggggcaggagagggtccggtggagggtggcgcccattgaccgacgatggtgcagcctgtgcaggtcatcctccttgctagggaggattacctgaaagggtttgcttggt

SEQ ID NO: 30304 - DNA, 61 bp, Chlorella protothecoides
ctgacgagcgagaagattcagacgcaggctgagaggtgcgcgaggcgtagggtgagtgtca

SEQ ID NO: 30305 - DNA, 110 bp, Chlorella protothecoides
ttgaacctaatgcacatccacccaccctgaatttgcccccttcagaaccacttctcggagattatacactgaaaccagaaaagaaagcgatgtcgaccatcaggcaaggc

SEQ ID NO: 30306 - DNA, 61 bp, Chlorella protothecoides
aacctactgttcatccatgcgcatggcgggggtgcaatgcccgcccaagtccggtcgtcgc

SEQ ID NO: 30307 - DNA, 96 bp, Chlorella protothecoides
tacgatcgcctgcagcgcaaggtgctggatctccaggtcgtccaatttggtctcgatgggaagaacgagctccctgtacccccaggtaacgcgcga

SEQ ID NO: 30308 - DNA, 68 bp, Chlorella protothecoides
caggcatggggcgtcatcgagtgctctccctgcatgacccccccctacgacctccatgtcgatcatgc

SEQ ID NO: 30309 - DNA, 61 bp, Chlorella protothecoides
tggtgcaggccgcccgacaggtggagaaggtggacatccagtatgcacgagccgccaagca

SEQ ID NO: 30310 - DNA, 133 bp, Chlorella protothecoides
gactgccacctcagccaatgcctcccgcgtgcatgccgaactcccgcaatttgagcctggctggacgcagaggaaccgtcgcccaggccaacatccctgcaccacatacgagaccgacgcaaagaaccctcct

SEQ ID NO: 30311 - DNA, 103 bp, Chlorella protothecoides
ctcgaggtgggatgggcaccggaaaggggcgagggccgaggtgcaccgacgtgtgcggctccagggcgcacggattacctacgagatgcccttgttgtattgc

SEQ ID NO: 30312 - DNA, 125 bp, Chlorella protothecoides
gacacccagaccggcgagaaggtgggaatgaattgatggtgcctggggccaagctgaaagatagttcattatccagggcgctgatcgggcctcctccccagcagtggtatcgcctggccagcctc

SEQ ID NO: 30313 - DNA, 75 bp, Chlorella protothecoides
ttgataaggaatcacaccagagtgatgctgtaggttgtagcgaatcccccgaagcaacatcttccatgtaagctt

SEQ ID NO: 30314 - DNA, 163 bp, Chlorella protothecoides
gccggggaggtggacggaatgctggtcaccgcttcagcgtcggatacccagtccccacttcctgctggcattcaccacactccgcatccccccctgtgcattattttctctcatcttggagtgtatactgctgccccaagactgcctggtggagcgcacagca

SEQ ID NO: 30315 - DNA, 108 bp, Chlorella protothecoides
gagtggtgtgtttgggagggtgtcatgggtgctcatctcttcactggcgccaccccccacttggtatgagggacggctggccaagttcccaccgagggcaatgtgatc

SEQ ID NO: 30316 - DNA, 307 bp, Chlorella protothecoides
cccaggccgtcgccgccgtggccaccaggacctgcagaggttgatttgatcgatcggtgtgcgcgcgtgtgtgcgtgtgtgcgtgggggggggtaatagaatggagggcgggcgtgtgtgtgtgaatggacctgcgacagtcttttccccgccctgctttctggaataaggttaagataacaacccaaaaactcctgacaagctgttttcaggctcactaaaacctccccttccgaccctccaacaccccctccttcccacccccccaacgaactccaacccacctgcacggcgccggagtcaaaca

SEQ ID NO: 30317 - DNA, 70 bp, Chlorella protothecoides
ctcctccaaagaggagccccgcctctcctcatccaaagagggtccccgcctctcctcctccaaagaggag

SEQ ID NO: 30318 - DNA, 146 bp, Chlorella protothecoides
tttagccattctgttgttggggtgtccttgctggctggcctggaggtcaggaataggatgttgcattgcatctctccgtccacatcaacccccgcccggcccctacctcccatcttataaaaccctgcgcttccccctgattccca

SEQ ID NO: 30319 - DNA, 77 bp, Chlorella protothecoides
tcaacatgcgctacgccgtgtggctgtgactgggggttgaaccggggtcgttccccaccaaggatggggaagaaagg

SEQ ID NO: 30320 - DNA, 78 bp, Chlorella protothecoides
acactggcagtcctcggccgagcacggcgcgtcgttcaggtctccctcctgtccacatctcacgtttcccgctcactc

SEQ ID NO: 30321 - DNA, 68 bp, Chlorella protothecoides
atagctgagtcgttcttcggcgaagaaattaccacgcgcaaagtgaaattcaaactcgtgcgtaagat

SEQ ID NO: 30322 - DNA, 133 bp, Chlorella protothecoides
cgggccacaatgccgtgacctttcattcatcgggacgaccgtgcactgtacgcgggatcggaaatcgcgcgcgcaaaaataaagtgatctgaggtcgcactcgaaatgcatatcaacacccttgagagcagat

SEQ ID NO: 30323 - DNA, 130 bp, Chlorella protothecoides
gacacgatgaacttgaggaaacctgcatggtgggcggaagctggagcgtcaggcaccatgggcacatgccgatgtgaccctcgctcttggaggggcacactctccagtccgaccgggtccagcatattat

SEQ ID NO: 30324 - DNA, 61 bp, Chlorella protothecoides
gggcaggaggtttgtgtcctctgtctcaccgcatgttggtgatgtgaccgacctgtggcca

SEQ ID NO: 30325 - DNA, 64 bp, Chlorella protothecoides
cctgggaggggcagggacagggcgtgcatgagccgagcagggatcacatgcatgagcagagcgg

SEQ ID NO: 30326 - DNA, 61 bp, Chlorella protothecoides
gcgagaggtgacacgtatgcttctcagaacgtcccgcaccctcttgcaggcctcgggtttg

SEQ ID NO: 30327 - DNA, 146 bp, Chlorella protothecoides
ggcgggcacggcgacgacctcggcgacctctgcctcgttgacgaccggcggccggttctcgtcggcctctggaagaggcccggccccgcgccggcgccgccagcgcttgccgcccgccgcctcgcgctgggcagggccgaggggcg

SEQ ID NO: 30328 - DNA, 105 bp, Chlorella protothecoides
ggcctggtcgataccatgcacgacaaataggtgtacccggtgtcaatggttcaccaatcgtcgctggcatccgacttcacacgaaatcatgtccggtcgttttcg

SEQ ID NO: 30329 - DNA, 74 bp, Chlorella protothecoides
tgacgcatcggcaccgccgtggcggggaggccggcggcggcggaggaaccctcagcgcccgtcgccaccgcgcc

SEQ ID NO: 30330 - DNA, 64 bp, Chlorella protothecoides
gatggaggtcgagacgccgcgcccggagcgccagtaggtgatgaggtggttgtaagaactccag

SEQ ID NO: 30331 - DNA, 367 bp, Chlorella protothecoides
  modified_base (100)..(315): a, c, t, g, unknown or other
gagggtgggggggagggagagggttatgagtgcgcgggggcagatgggtgtgggggtgcagggcagaggtttgttgtggtgggggaggggggcccccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgttacgacccccccaaggcccaggccaccagcccaccagaagaatccg

SEQ ID NO: 30332 - DNA, 61 bp, Chlorella protothecoides
gcgtttggcacagggaagcggcgtgatgatgcagccaatagacctcgactggctggatgtt

SEQ ID NO: 30333 - DNA, 75 bp, Chlorella protothecoides
tgatcacacccccgatgaccaggactgcagaggggccgagagtcggtgcatgtgagacccttgcagcctcagggt

SEQ ID NO: 30334 - DNA, 61 bp, Chlorella protothecoides
cctctcctcaatgacgtggggttgccatcttgcgaggatgcaggcccgcagaacgagcagc

SEQ ID NO: 30335 - DNA, 61 bp, Chlorella protothecoides
tctgccgggaaccggtctcagggttcagcttccctctctgttcttgcggtgcacccgctgg

SEQ ID NO: 30336 - DNA, 116 bp, Chlorella protothecoides
tgaggcttagcggcgggtgtcatggggcggtggggggtgggcatgtggggatgggtacggaggagggtcttggggtgcaagctgtcagagtcaccaggcgggtacatggcagcagc

SEQ ID NO: 30337 - DNA, 533 bp, Chlorella protothecoides
tgccgctgcggctgcggggttcggcggcccgcgctcgcagtcgcagcgcctgcagctcagccgacgccgcccgcagcgcctcggccaccgtggtacccttggctggtgctgcggcatccgcaatcgcatccttttccttgctggcctcgccgtcgacgactgcctcgccactctttgctgcatcggcagccccgccgccgtcggcacccgaaccctgcgagtcgccctcgcctgcagcaccagccccctcctcccgggcatccgctggctttgcagccgcagaggcctcatcgaccagcaccttgtcgccctcccccgcctccacgcggcgctggagggcggccaccttctcggcgagttccgcgaggcgggcctccgcgtcaggaccacgcggtacctgggccaggacctcctcccgtggtcgggccgcgccgaagacgctggcgcgggaggcgccgcgcgaggccgcctcggggacggccagagacaggcgcacacgcgggggcggcgcgccctcggcggacggcgagggc

SEQ ID NO: 30338 - DNA, 68 bp, Chlorella protothecoides
tgcagtttgggttaaagactccggtggagggatcatagtggatcatggcagcacgtgccacccctcct

SEQ ID NO: 30339 - DNA, 61 bp, Chlorella protothecoides
gctcgaatgtcctgggaagcacaatcccccccccccccctcctcctccctttccctcaggt

SEQ ID NO: 30340 - DNA, 131 bp, Chlorella protothecoides
tgagtgctgcagctgagtgcgtcccctctcgtccctgcactttcacagtcaaatgtctttttgaggcgttcgacaagatccgcagccacgacgagatcactgggcaggcgggcaaggtggtcgtggcgagg

SEQ ID NO: 30341 - DNA, 499 bp, Chlorella protothecoides
cggcggtgtccggcgcggcggggccctcgcgcgcgctcgccgcccgcgcctgcgcctccctcgcctcctgcgcctgcgcgcgccagccgcccatctccgcctgcaggcgcgtgatctggcggcgcatgcgctcctgcgcctcctgcgccagcttgaactcctggtccttggccagcagccgcttctcgtattcggaggtcaggttgctgagcacgctctccagcacgggccccaccgcgtccagcgcgtaggcgggcaccggcgcctgagcgctgccggcctcggcctcgtcgccccgtcgcggcccagcgtcgggcgccggcgaggaggcgccgaggcccatgcggctgcgcagcatgtgggtgcaggagcgcatgaggtggttcagcccgtcgggcgcgtcggccgccgccgcggccaggccgtgcttggccaccagctgcgcggcggccggcgtgaagctgaagccggggcgggggggcggggtcgggcgaggcgc

SEQ ID NO: 30342 - DNA, 61 bp, Chlorella protothecoides
tacgcaatgataacacgtcatcggaggatttgggagtcaaaagccgtccgactcactcgag

SEQ ID NO: 30343 - DNA, 138 bp, Chlorella protothecoides
gtgctgggtgccaaactcttccagcagggcggccagggcggcgaagaaaggggggagcacggcctgcaggtcggacagcatgcaggcggcggctacttggcccgactccgcggccacggggccgccagggccggcgct

SEQ ID NO: 30344 - DNA, 80 bp, Chlorella protothecoides
accaccctcgggccccgacttgcttacccccccccccttccccctttcttcctccgcgcacctgaccagggccgcctgga

SEQ ID NO: 30345 - DNA, 67 bp, Chlorella protothecoides
tgtgtttttttggggggggggggggggagagaggaacctgggtgccagggcccacacgcagggagga

SEQ ID NO: 30346 - DNA, 73 bp, Chlorella protothecoides
cacccgcttctgtacggtgggatctcccaaagagagctttttaatcacgacgggaagcaacctgacgaggagc

SEQ ID NO: 30347 - DNA, 61 bp, Chlorella protothecoides
gtgccaggtgccggagcgcgagtgccagtatgggcccagctgcacggtggccaagcagctg

SEQ ID NO: 30348 - DNA, 66 bp, Chlorella protothecoides
aagcatggcactctggcttcgccagttcagaggcagcctgctgctgctacttcgatgtctgggcag

SEQ ID NO: 30349 - DNA, 98 bp, Chlorella protothecoides
agtctccatggcgcgtggacgggtgcacacgtcggatcaaacttcctctcagctggaaggcagttatgaggtgtcagggaaagcatgtatggcttcaa

SEQ ID NO: 30350 - DNA, 114 bp, Chlorella protothecoides
ttaggtccaggatgctgggactgctggcccaatgatctcggacttgtattattttgctcgtcagaacaacgtattcctgttcttcctgagagcagggacctgaactgcatcgac

SEQ ID NO: 30351 - DNA, 65 bp, Chlorella protothecoides
ctgcacaatgtgctgactggatttgttgaggccattgtgctcctgctcaggtatgagtgcagagc

SEQ ID NO: 30352 - DNA, 105 bp, Chlorella protothecoides
cctgtgagttggtggggtggaggggcacggagtgtgcacagactgctttccaatttctgtatgtctcgacccagtgccaaggctgaaaagtgcatggctggcggg

SEQ ID NO: 30353 - DNA, 61 bp, Chlorella protothecoides
aagcccgaccgcagtgtggagtcagactggctccataacagaatggtagcggacagggatt

SEQ ID NO: 30354 - DNA, 80 bp, Chlorella protothecoides
caaccctggggagaaaatcccgcgccagtgcatggagtggataggtgtggccccccttctgggtcacgccgagagtacta

SEQ ID NO: 30355 - DNA, 61 bp, Chlorella protothecoides
gaacgtctctggcggctgggtcaaaggaagagtcccgggcgtcatcgacgggtcgatgggt

SEQ ID NO: 30356 - DNA, 204 bp, Chlorella protothecoides
ggagggagtgaggtggggggcttgttcgagcgaggacaggggggtgcgggggtgtttgcgcgtgcatctgcagcgctccgacagtcgacgcccggtgcgggaggactgagctggcgtcgccgcgctggccggccgtcgattcgccggcccctgcctggccccgccacgaaccagcaaccctgccttcctcaccttggacaggcc

SEQ ID NO: 30357 - DNA, 80 bp, Chlorella protothecoides
tgtactcacacccgccccctcctcccacaacccttgctccgtgcagtaccatcaagtttgaccgcaacgcgtgcgtcctg

SEQ ID NO: 30358 - DNA, 61 bp, Chlorella protothecoides
ttccctgcatcatagagaaagggaaggtgtcaagtctgctgctgaggcaccgtcgcatccg

SEQ ID NO: 30359 - DNA, 127 bp, Chlorella protothecoides
gttagggccgaatgggatgggggaagggaccggaggacggaggagggcctcagagattcaacaaagcatctagtttgtgtcaaatgtccatacgtagtgtctctgtgatggggacacctcttcaaaa

SEQ ID NO: 30360 - DNA, 61 bp, Chlorella protothecoides
ggtcagggtcagcgcgatgccccagggcacacccagctcgtccagcgcgaggttggggtcc

SEQ ID NO: 30361 - DNA, 61 bp, Chlorella protothecoides
cggtggtcccagcaccctatgtccacgctgtatatcagtgaatgatgccttccggacgacg

SEQ ID NO: 30362 - DNA, 79 bp, Chlorella protothecoides
catgaccaagggccgctggtggcgggcatagcctcatgcatggctggctctgcactgtcatgatctcacctcgcacccc

SEQ ID NO: 30363 - DNA, 69 bp, Chlorella protothecoides
cccccatctaacccccgattcctcctcgctctcgctcagagacgtggctgaggctggagatgcagctgg

SEQ ID NO: 30364 - DNA, 61 bp, Chlorella protothecoides
agacgtggctgaggctggagatgcagctggtggcggacgccggcatcatcggcgcacccaa

SEQ ID NO: 30365 - DNA, 133 bp, Chlorella protothecoides
gccgctcttcctgcagctggagtgcacgctgcgcatgtccaatccgggcctggagctggcagtgctgctggaaccgggcctactgcccaagtccagcgagcgcctgctgcgcaagctgggggtcaccctggtg

SEQ ID NO: 30366 - DNA, 159 bp, Chlorella protothecoides
atggcaccgaggccttgtttgtggtcatgctctcccggtttgcgcccccccccccccagcgctgctctgtcgtgcctgggggtactcagtcgcaacacagggtgactgtttcccactgccccacgcctaagacccaaccccaccaacaccccaacaatg

SEQ ID NO: 30367 - DNA, 61 bp, Chlorella protothecoides
gcggctgcctcctccgcctcctgcgtgaccgagaaagcgaggggggggccagtcgatgaag

SEQ ID NO: 30368 - DNA, 61 bp, Chlorella protothecoides
cacatgggttgcgaattggggggtgactggcagctcctgtgtgtgtgaggaggccttggcg

SEQ ID NO: 30369 - DNA, 5479 bp, Chlorella protothecoides
  modified_base (436)..(445): a, c, t, g, unknown or other
  modified_base (2430)..(2439): a, c, t, g, unknown or other
  modified_base (3065)..(3074): a, c, t, g, unknown or other
  modified_base (3251)..(3260): a, c, t, g, unknown or other
  modified_base (3397)..(3406): a, c, t, g, unknown or other
  modified_base (3803)..(3914): a, c, t, g, unknown or other
  modified_base (4095)..(4104): a, c, t, g, unknown or other
  modified_base (4376)..(4385): a, c, t, g, unknown or other
  modified_base (4593)..(4602): a, c, t, g, unknown or other
ggggtgggtggggggggcaagctcctgatggaggggtgggcctggggctgccaggagcgtgcatggctggcacctcactgcagggagctccctaccatcccgaggcacaaagatgcgatacagaggctcaatcttaccaggagttgagactcgtagttgacgtaaaatgcgctggccttcaccagctcctcctccagagcggcacggaacgcctgtcccgtctctgaacgagaggtgacagggaggtggaatcttggcaccatccttcagactgtgaagcgcagacaccattccaaccgcagaatcctacgttccgcagggtctgtcagtgtgcacaatgcactccccctgtctcctccatcccaaacaaaagctaaagcgaccttgagatggaaacaccacccgattctcagcagagccacagctctgcaactcnnnnnnnnnnggggaggtggaatcttggcaccatcctttagactgtgaagcgcagacaccattccaagcgcagaaccttacattccgcggggtctgtcagtgtgcaaaatgcactccccctgtctcctccatcccggacaaaagctacagcgaccttgagatggaaacaccacccaattctcagcagagccacagctctgcaactcactgggtccaaagacagcgacgtcctggttgatggcatgcttgaggcccttgtagtcaatgtatgcctccggccagcgccgtgctgcctcctcattaagcctctttccgaactgtgcgtgcgatgggagtgcgccgagggtgggaagggagcccaatcagggcccagcacgaggggaggccaaagttccgctcaagcagccggttccccttgtcccaccttcatctcttgcacgcccagagtagcctatgtcactacacaaatatctgtgggactagtttgatggctcaagcatgctgggctggacctagacgcacagtcaacagcacagagaggggacccgaagttgaacgtgggctcgcggaggggagggaagtctgaacgcgactctctccccgccggcaggcaccaaaaggagaaaggaagcgaaagccaaacacattgacccaccctgggaggtggggccaaggtttgagggccagaaagatgccgtagggtgtcgcaatgtccggcaggatatgcgaacgtccatgaccagattccgtagcggtaccgtgtggtaccttgggtgggccttttgcgctctggatttcagggcaacgatccatcgcgacggaatatgtatgttgacgcggtggccctcccagaaaacttggtcgtgagcggaatacctgtgtacgaaggtcaatgtgatgtgagcatgggcaagacctccaccaggaagccgtatcagttgtgtcgccttcccgacacgagttccgggcccggtggacccacggcatccttccgacgcacgtcgcgcaccctagtgcgtgtcgctgagcctattgcatccctcgcaggaataagtgctgaccctgcagcaagctctcggctagacgccagtggtcgaaatcagacacctgttggtccctcgtcctccagggctgttccagcacctggtcctcctataatccccgcgacgaacatttccaaccccattctgaagcgcgtgggaaagttcaagctcgcctctgccccagtcctggatgcaagacctgtgcaggccgttgcccatgtcaggaggcctgatgctacaccccccaagggccaggcctcgcctccccctggcggggcgaggaaccagctgacatggcggcgcaccgtgcccaagactcccgaggcaccccgggctctggcactgagagccaggttgcaaaagctcaagtggcggagggaggaaggggccacgccccctcagcgttgccacagcctcaagtggcgacgcacctctggcgccctcagccctgccctcccggtagcaggggcgcccgccgagtcggggcccgccacccctctgcccagcacccagccgacaagtgagcccctggctgcacgccggcgcgccttcctcgcgctgcgcatgacgccgcggcgcctgcccacaacccgctcggcgaggcgggcggtgcagcagcgcacgcccgtgtactgccccgagtactgcaggacggggtcctgtccgcgccggggcagggggtgcagcctgcggcacgaccccactaagcgcgccgtctgcgcccggtggctggcgggcagctgcccgctgggtcccacctgtcccctccagcaccagcgggtggccgagctcatgcccctctgcatccatttcatcaaggtgccgtggggtctccatgcctgggattccctggggatgcacgacatgtggcatgcaccgtgggagggagcgccctgtttttgtcgtgcaatgaggggtggaatgtgtgtcccctcatgcctctcactggatnnnnnnnnnnaatgcacgacatgtggcatgcaccgcgggagggagcgccctgttttagtcgtacaatgaggggtggtatgtgtgtcccctcatgcctctcactggatggagggttgctttgccccggtatggctgcccatgcacaaagcggggcaggcttgggtggatcagggcaccccaacatcgcactttgatcttgccaggcccctcctcagtgctcctcccctcggcctttgcagctcatctttccccttcgagaccaccaacccctcccaacaccctcacagggttcctgcgctaatggaaactgcccgtacctgcacgtcaaactcgtggccaccgctccggtgtgcgcacgctttctcaaagggtactgcccagccggggcgcggtgcccgcaccgtcatctcacgctgcgcatgctgcgcgaagagcgcaggctgacggcgcccctccaattgaaggcatcatttgggcgggatgggagaggggtgtgggcttttttgaagggggggtggaggatcctcaggacctgtgtgggatgagtctagctgagcactgttccccccttggttgggacacatgcagatttagacttgttcttgctcctggctggagtggcctcactcgcgctgnnnnnnnnnncaaggcatcatttgggcgggaggggaaaggggtgtgggctttttttgagggggaagtggaggatattcgggacctgtgtgggatgagtctagctgagcactgttcccccatcggttgggacacatgcagatttaaacttgttctccctcctggctggagtggcctcactcgcgctgnnnnnnnnnngacaatttccaatttaatttgcaatcatacatatttgaatctgtacaacagagtagcaaagaaaaatgccgaaacagtgctggatggtcaaaaattgctgagtggcagcacctgcattgtggagtggaggggaaggnnnnnnnnnntgcatcacagattgttgcaccacgcccctctgcagaagcggcagcgtgatgagcgggccaagaggggcctgcgtgacgcagacttcctccagcttatgggtgcggatgggtgcagtgcgggttctgcaggtccgcctcaggaccagagtcaagagcttgcccttgaagatgttgctggaccagccgatgacgctgactacattgctctttgactgtttctctattttgttcgtctccattctgtttccaagtaccatcattacaatttccaattcagtttgcaatcatacatatttgaatctgtgttacagagtagcaaggaaaaatgccgaaacagtgttggatggtcaaaaattgctgagtggtagcacctgcattgtggagtggaggggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggaaggataaagccgcagcagctctcaagcctggcgaggcgaaagctctagatcgggcactgcgaatgttttgagaaacgccctaggaaattgtcatcctcggcgaacaccagtttgagaaaatagatcaggaggaggaggtcaagtggggaatagcacaagaataagtccacaaagnnnnnnnnnncagatcaggagaagtaggtcaagtgggggaatagcacaagaataagtccacaaagctgtaacaagcgcgcctcagactgcagcctgtgctgcgccatccgcacaagccgggtgcggccagggagaggcgggttctccctgaacaagcagggtgcccctccacaggtcgcggcaacgcgcatgctggctattttctatcctcggcaggaaacggcggttgcgtaaacccatggcaggcaacaaaagaaagggtgaaagggtggtctggaagtnnnnnnnnnncatcctcggcagggaacggcggttgcgtgaagccatggcagtcaacgaaagaaagggtgaaagggtggtctggaagttgcattcaatcccaggaaacaacgaaacaacaggaccgacacacaccttaggtatgcctctcaggccctagtgcaaaattgtacattacgcaggctcgtttgtgtgagagaccaggcctccagtgcggcannnnnnnnnnactcaggccctaatgcaaatttgtgcattgcgcaggctcgtctgtgtgagagaccaggcctccagtgcggcagttagagctctttgcattccagagctgctgtctgcgcggggattgggaacagaaggggtcagacaaactggaatgcaagacaacaaatggtatggggtccttggtgcagagctcaggcgtatgccaattcatcccaaaggtcagaaattggagacaggaaacctcatagagctacatcatcaatgctctgggcactaagaacaaggaggagtaatcaagacactggaaagcctcagaatgggctgcatccctcatcaacaagatcagaggatggaagcaggaaagctcctacagccagatgtcatcataggtagaagtaaaatggggggaaaacaatacgtaaacaggagtctcagacacagctgcgcgattcatccatccccgaaggaatcagagagaggaagcaggaaagctccagcagcagaaagcgtcatcaaggacagaggaggcaaatgtgcatgcaagtattaagcagcgtgattcagatggatgtgtgtccctcacaggagggcaggcggaagcaggaaagctccatgatatccatggtgtcatcagcatcacactgttgtgttgtcgcaagcacgaaatcaaggaaacagacagatcgagactcagaagttgctgcacaaatccacacagatgattaaggtagcgggagcaagaaacatcccattgtgatatgctttcgtcacagtctcacgagtcgagatcattcaaaggggaggaggccaatggagctcagacagaagtgccatcagacttcaaacacacgaacgtgcagaagaggtagagggcaggaaagccc

SEQ ID NO: 30370 - DNA, 62 bp, Chlorella protothecoides
cctgcagggatgaggggagcatgccctgcaagttttgggaagcttgtggctgtgtcgaccca

SEQ ID NO: 30371 - DNA, 80 bp, Chlorella protothecoides
cgcggtgggggggacccactggccccgctcgacatcctcctgcagggtttcgagtctcggggcagggtgactcgtggggc

SEQ ID NO: 30372 - DNA, 103 bp, Chlorella protothecoides
ctgagaaagagcgcttgtcagtgtaggatgcaagcctgcgcgcagtattctggctgctgccttccttcaggcacaccaacccagtctcccattcgggaccctc

SEQ ID NO: 30373 - DNA, 63 bp, Chlorella protothecoides
aggatgtgctgctgccataccccgccaaatttcatctgaacaaggcctgccctgcgtcgcgtc

SEQ ID NO: 30374 - DNA, 358 bp, Chlorella protothecoides
  modified_base (90)..(282): a, c, t, g, unknown or other
gtggcatgcagccccacactccactgccattgtcaacccccagacaccctgccccgcataccacccccgccgcaggcgccatcaaccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccccggcaccctccccctgacccgaggtgacttggaatggcccaggatacatgaaagtcgtacctcccggtccc

SEQ ID NO: 30375 - DNA, 890 bp, Chlorella protothecoides
ccatcgcccccaccgtcccctcctccgccatctccaccgccaccgccaccgccacccccaagcatcatcctcgcctatgcttggtgctcacctgtgcccagcgctaaggtgtggtgcaagacgcaaatcatccttcccaaggttgtcaagagggtgaacctgtggttcaggctgggcaccaccgacatttttacatccatggcccccatggaactccagacggcttccaccttcacctttgatgcacccagggtactcactggcacgtgccgatcctactattttatgaagatcataggccggtcgtatcgcaggtcgtgccagtgggaaccatcccgccaccaccgccaccaccagtgccatcgcctccaccatcaccaatgccggatttgcagccaccaatgccaccctcgccctcaccacggccttcccctcttcctccgagcccacccccaccgccacccccaccctctcctccgccaccgcccaacccttccttgcgttctccgccgccctctcagccatcactcccaaccccaacacagacaccaccaccttcgccaatcctactaccttcgccaatcctactaccctcgactctcccctccagacctaaggctgtacctccaccgcccagcgaggtccctactcagccgctgagcatgcccccgactatgtcaaggagcgagcacccaccaccgtcgcctagcgcgcacatcccaccgtcggcaagggcactcccacctgcagcgtccattgcagtccctgctccagcgctcacaacaggcccaactccatctcccagcctgcacccagcacctttgccaagcccgctcccagctccctcgcccagcccccatccagctcccttgcccagcccccacccagct

SEQ ID NO: 30376 - DNA, 61 bp, Chlorella protothecoides
cccgcccgcccatacctgtacaggcacactgtccggcgacttcagtgatgtcttaggcaca

SEQ ID NO: 30377 - DNA, 80 bp, Chlorella protothecoides
gcccagcaggcggcaggcgtggcgcagcgctggggagcgtgggccccccaccacccccgccgcgccctggccatcgtcgc

SEQ ID NO: 30378 - DNA, 171 bp, Chlorella protothecoides
gcgtccatcaccagcagctgcgcgggtggcaggggtggttttggtgggagaccatgtggttgaacaggatttggtgagggggaggggtccttggagagaacgtgccttgagatggtttgttggccatttgctgacaggccaaccgcattgcagcatcgggatctcatggca

SEQ ID NO: 30379 - DNA, 64 bp, Chlorella protothecoides
ttgggttcccagcaatcctgcgactagatgtatgattgggggcaacccaccaacaattgggggg

SEQ ID NO: 30380 - DNA, 77 bp, Chlorella protothecoides
cttccaaacccgtgccatcccagaagtgaggttgcaggctcttcttctcttgtggtagttgaactcttgagatgcac

SEQ ID NO: 30381 - DNA, 84 bp, Chlorella protothecoides
tggggagggtagggaatggagtcagagtgcgaaaggtgtgtggaaagtggggaggtgaggctgcaggtacatgatggagtctga

SEQ ID NO: 30382 - DNA, 61 bp, Chlorella protothecoides
catgtcctgcaattagtcaccgagccctgtgcccagcccaatccctcatcccccacctcac

SEQ ID NO: 30383 - DNA, 225 bp, Chlorella protothecoides
acgaagccgtacctgtgcatggatggcatcagagggtggggcctgggaaggcaggcttcccagggatgcgagccaggaatgcctcactccctcccccgcgtaataattcccaaagcacaggcgccagcacacacagacagcagatgtcgacgcgatattcaaggcggctagacatccaactacaatggtgcccgaaatgggggcccggagggcagacagactggg

SEQ ID NO: 30384 - DNA, 78 bp, Chlorella protothecoides
tcgacaggggaccaggcgggggcagggtgagtggcacaacaggatcgatctctgttcttaccatcggatgtatgatct

SEQ ID NO: 30385 - DNA, 70 bp, Chlorella protothecoides
ggaggctacgcctcaagttgggcagtctattccttgcgtttgagaatgggctggccacgtcgccattcat

SEQ ID NO: 30386 - DNA, 74 bp, Chlorella protothecoides
tctacacgatgcgcgcagggaggatgtgcagggccccagcatagtgcgtgccgccgcctcgcggcagccgtccc

SEQ ID NO: 30387 - DNA, 73485 bp, Chlorella protothecoides
  modified_base (137)..(146): a, c, t, g, unknown or other
  modified_base (539)..(548): a, c, t, g, unknown or other
  modified_base (624)..(633): a, c, t, g, unknown or other
  modified_base (743)..(752): a, c, t, g, unknown or other
  modified_base (1129)..(1138): a, c, t, g, unknown or other
  modified_base (2834)..(2843): a, c, t, g, unknown or other
  modified_base (3164)..(3173): a, c, t, g, unknown or other
  modified_base (5348)..(5357): a, c, t, g, unknown or other
  modified_base (7242)..(7251): a, c, t, g, unknown or other
  modified_base (7649)..(7658): a, c, t, g, unknown or other
  modified_base (8291)..(8300): a, c, t, g, unknown or other
  modified_base (9286)..(9295): a, c, t, g, unknown or other
  modified_base (10042)..(10089): a, c, t, g, unknown or other
  modified_base (10260)..(10269): a, c, t, g, unknown or other
  modified_base (10354)..(10363): a, c, t, g, unknown or other
  modified_base (11011)..(11020): a, c, t, g, unknown or other
  modified_base (11152)..(11161): a, c, t, g, unknown or other
  modified_base (11308)..(11317): a, c, t, g, unknown or other
  modified_base (14401)..(14410): a, c, t, g, unknown or other
  modified_base (14484)..(14671): a, c, t, g, unknown or other
  modified_base (16181)..(16190): a, c, t, g, unknown or other
  modified_base (16726)..(16735): a, c, t, g, unknown or other
  modified_base (16828)..(16837): a, c, t, g, unknown or other
  modified_base (17051)..(17076): a, c, t, g, unknown or other
  modified_base (17144)..(17153): a, c, t, g, unknown or other
  modified_base (17672)..(17681): a, c, t, g, unknown or other
  modified_base (18807)..(18816): a, c, t, g, unknown or other
  modified_base (19164)..(19251): a, c, t, g, unknown or other
  modified_base (19585)..(19594): a, c, t, g, unknown or other
  modified_base (20528)..(20537): a, c, t, g, unknown or other
  modified_base (20641)..(20650): a, c, t, g, unknown or other
  modified_base (21093)..(21102): a, c, t, g, unknown or other
  modified_base (22240)..(22249): a, c, t, g, unknown or other
  modified_base (22360)..(22546): a, c, t, g, unknown or other
  modified_base (23250)..(23259): a, c, t, g, unknown or other
  modified_base (24108)..(24117): a, c, t, g, unknown or other
  modified_base (24867)..(24876): a, c, t, g, unknown or other
  modified_base (25336)..(25345): a, c, t, g, unknown or other
  modified_base (26066)..(26075): a, c, t, g, unknown or other
  modified_base (26561)..(26570): a, c, t, g, unknown or other
  modified_base (27062)..(27071): a, c, t, g, unknown or other
  modified_base (28041)..(28050): a, c, t, g, unknown or other
  modified_base (28419)..(28428): a, c, t, g, unknown or other
  modified_base (29176)..(29185): a, c, t, g, unknown or other
  modified_base (29282)..(29412): a, c, t, g, unknown or other
  modified_base (30590)..(30599): a, c, t, g, unknown or other
  modified_base (31056)..(31065): a, c, t, g, unknown or other
  modified_base (31196)..(31205): a, c, t, g, unknown or other
  modified_base (32501)..(32510): a, c, t, g, unknown or other
  modified_base (32646)..(32655): a, c, t, g, unknown or other
  modified_base (33263)..(33272): a, c, t, g, unknown or other
  modified_base (33396)..(33405): a, c, t, g, unknown or other
  modified_base (33501)..(33510): a, c, t, g, unknown or other
  modified_base (33562)..(33571): a, c, t, g, unknown or other
  modified_base (35123)..(35132): a, c, t, g, unknown or other
  modified_base (36985)..(36994): a, c, t, g, unknown or other
  modified_base (37673)..(37682): a, c, t, g, unknown or other
  modified_base (37770)..(37779): a, c, t, g, unknown or other
  modified_base (39423)..(39432): a, c, t, g, unknown or other
  modified_base (41136)..(41145): a, c, t, g, unknown or other
  modified_base (41518)..(41527): a, c, t, g, unknown or other
  modified_base (43398)..(43407): a, c, t, g, unknown or other
  modified_base (43545)..(43554): a, c, t, g, unknown or other
  modified_base (43617)..(43626): a, c, t, g, unknown or other
  modified_base (43768)..(43777): a, c, t, g, unknown or other
  modified_base (44770)..(44779): a, c, t, g, unknown or other
  modified_base (45221)..(45230): a, c, t, g, unknown or other
  modified_base (45408)..(45417): a, c, t, g, unknown or other
  modified_base (47080)..(47089): a, c, t, g, unknown or other
  modified_base (48105)..(48114): a, c, t, g, unknown or other
  modified_base (48500)..(48509): a, c, t, g, unknown or other
  modified_base (48831)..(48840): a, c, t, g, unknown or other
  modified_base (49042)..(49051): a, c, t, g, unknown or other
  modified_base (51297)..(51306): a, c, t, g, unknown or other
  modified_base (52190)..(52199): a, c, t, g, unknown or other
  modified_base (52284)..(52293): a, c, t, g, unknown or other
  modified_base (53131)..(53140): a, c, t, g, unknown or other
  modified_base (53555)..(53564): a, c, t, g, unknown or other
  modified_base (53992)..(54001): a, c, t, g, unknown or other
  modified_base (55817)..(55826): a, c, t, g, unknown or other
  modified_base (56235)..(56244): a, c, t, g, unknown or other
  modified_base (57553)..(57613): a, c, t, g, unknown or other
  modified_base (58307)..(58316): a, c, t, g, unknown or other
  modified_base (58940)..(58949): a, c, t, g, unknown or other
  modified_base (59021)..(59030): a, c, t, g, unknown or other
  modified_base (60918)..(60927): a, c, t, g, unknown or other
  modified_base (61112)..(61121): a, c, t, g, unknown or other
  modified_base (61772)..(61781): a, c, t, g, unknown or other
  modified_base (62677)..(62686): a, c, t, g, unknown or other
  modified_base (62793)..(62802): a, c, t, g, unknown or other
  modified_base (63472)..(63481): a, c, t, g, unknown or other
  modified_base (64169)..(64178): a, c, t, g, unknown or other
  modified_base (64948)..(64957): a, c, t, g, unknown or other
  modified_base (65077)..(65086): a, c, t, g, unknown or other
  modified_base (65332)..(65341): a, c, t, g, unknown or other
  modified_base (66554)..(66563): a, c, t, g, unknown or other
  modified_base (66822)..(66831): a, c, t, g, unknown or other
  modified_base (67424)..(67433): a, c, t, g, unknown or other
  modified_base (67695)..(67704): a, c, t, g, unknown or other
  modified_base (68127)..(68136): a, c, t, g, unknown or other
  modified_base (68823)..(68832): a, c, t, g, unknown or other
  modified_base (69426)..(69435): a, c, t, g, unknown or other
  modified_base (69516)..(69525): a, c, t, g, unknown or other
  modified_base (69980)..(69989): a, c, t, g, unknown or other
  modified_base (70777)..(70786): a, c, t, g, unknown or other
  modified_base (71038)..(71047): a, c, t, g, unknown or other
  modified_base (72055)..(72064): a, c, t, g, unknown or other
  modified_base (72981)..(72990): a, c, t, g, unknown or other
ccccctcagatcctgcactcgatgagtcagtcgatgactaatcccatgcacccaccacccaccggcgtgctggaggattcgctggggcgtgcccaccaccacgtccagcggctgggccagctgcaccttttgctggnnnnnnnnnnctgatgactaatcccgtcccaccaccacccaccggcgtgctggaggatgcgctggggcgtgcccaccaccacgtctagcggctgggccagctgcaccttttgctggcggtacccggcacctggtgggcgagggagtgggtgacagtttgaggtctgaggcagcagcagaaccccaggccgtctagggcaggcgcagagctttcaccaggccagagggccctctaggagctgacgactaccaaggcgggcaccaggaaggctcaacgtcctcctgtcacgcagcagactgcgctgaaccccccaccccacaccgtcctgaatgccacactcccacccaaccccatgcagtgcctctcacccccgctgaggccggcagaacggaacttggcgtgnnnnnnnnnnaaccccaggccgcctagggcaggcgcagagctttcaccaggcctaagggccctctaggagctgacgactaccaagnnnnnnnnnnatgggagagggacttggccaccttcaggatctgatcggtcagttcgcgggtggggcccaggaccagggcccgcggccgatgcggcttggtggccgtgcccctcgcctcgnnnnnnnnnngtgggagagggacttggccacctttaggatctggtcggtcagttcgcgggtggggcccagcaccagggcccgcggccggtgcggcttggtggccgtgcccctcgcctcgccctccttcaggctttgcactgcgcaagggagggaggaagaagggggaagtgggggtggggcacgcatgggagggtgagtgcaggaggcagcatgccatgctccaagtgagaaacggagtgcatcgctctttgctattacaagccgaccaggcgccggggcagccagcgcaggcgttgcatggggcatctttatttgagggagccatgcagcaccatgcacacaccaaggatgtcagcaaagatggctagctacccgatcacactgcnnnnnnnnnnaggtgagtgcaggaggcagcatgccatgctgcaagtgaggaaaggagtacatcgctctttgctattacaagcagaccaggcgccggggcagccagcgcaggcggtgcatggggcatcttatttaagggagccatgcagcgccatgcacacaccaaggatgccaacaaagatggctagctacccgatcacactgctattcctcacccaggggtagcaggtacgccagtgtttttccgctccccgtgtgggaggccagcaggaagtctgaacctctggactccaggagggcggggatggctgagctctggacatcggtgggtgtggtgaagccccaggcgttcagggcatcatggagggcggggctgagctccgcaaaccgcacgccttcgccctcagtgctccccgcaggagttgaccgcagctcctcctgtgacgaaacgctatgtgctttgagagggcatcgctgtgtatgtgtgaagggacggcgctgaagcaggctgcgagagaatagctgcgtgggaagacgcaggcggagaccgctcagacgggcgctcatggtcgactgcatcggggagagcccttcgcacgtctcaaatggcaccttaaaccattgggcacttagagcgtacgattttgcatatgtagcgaagagttttaagtgcttacccacgtttcgagtgagtcttggtggatttgttccgctggtgtgtcgagtggggtcccatgaggcgcttcacgctcagcacgtctgatcttcggcagatactctcgaaacggggtgctgtgtggggccgcaccgaggcgacaggatcgcaaggaccaggaccctgccaggcctgccgctcgcataaccggcatatttcccaagttctgcgctctcataggaccccgcctgcacgatctgacagcgtgccacctttctggcgcatcctcacctctcattccaagcacgcgctcactctccgtcatggagtgcgtcaggagcgctgtcgtcatgagggccagacccgtcctgagcctgtgagtatagctttctctactcttgagggccgtaggaaccctgctcggaaggccatgcactgtttcatggccagctccttgggtgagcttttctcatggaagaaaccctttaatgggagagcagtataccctccactcctgctgtccacagatcggtatcccttggaggtccaagagcgcttcaccctcgccgacatgcaggccagcacctttcccaggtccggacttgcacacagcaaggtggaagagcccaacctacgagcagtcgcccacatgtctgcgccgcagcctccaacagtaggttgggatgctcactgctttcctgatcagctgttgtctatgccttaacttctacgtcccaaggttgtccatcattatctacccactcatgatcgctgtacatcttgtaggcccaacatctataggggagcccctcacagagctgaaggagctggaccagtccgagttttactccttcattgaggagcattcgcaggatcgtctggtagtggtcgatttctacactgcatggtaagaggccatgcagatgcttgggccggggatgcgtaaggagtaagagcatgatgcagggtggagctgatgtgaaacctcaaacccgagcgtcctgcacctcaaaatctacccgatggcaggtgcggaccgtgcaaactcatcnnnnnnnnnnttgaacctcaaacccgagcgtcctgcacctaaaaatctacctgatggcaggtgcggaccgtgcaaactcatccagcccacgcttgtggagtgggcaaacgagtttgcaggcgaggtggagcttgtcaggtttgagtgcaagaaggaaaacaaggagattgggtccaaggtgagcctctgggatgggggttgccagagagggtcatgtgagcattttgagccaatcttgttactttctagtcggacttcagcttgatttgttgagaacacctgagtgcaccatacataaggcagccaatcacctctttcaacactgcgcttnnnnnnnnnntagcttgatttgttgagaatatctgagtgcaccatacataagacagccaatcacctctttcaacactgcgcttaccaatgtgcagcttgggatcaaagtggcgcccacgtttttcctgtacaagaaaggagagaaggttgcgtctctgacaggtgcaaagacggatgagctgcgcaagctgatcgagacgcataagtgacagtttgtgagcattcaaaccttgcaatgagtatgtggatgtcattgccgcttcgctcgtggtaagcgggtggagccaccccttgcctggaggagtttttttatcatgtaccaatcttttcagagataataacaccgcttgggtccccaggccacgatgtaatgagtagtgggcactggtggtcagtgggttggcccctcctgtgatccggtctcgaggcaagcacccaccacagcagggtggtgtcaatgacctgtctccggaatatagagtcatcacccttgtcgacatggcgatcagcttccgaatgagctagagctgttttgtcttgcactctatcggttcacaattgtagtcgagacggtcacctcccccagcacaaagtgatctggcacggcccgctcggtgtgcgtggtcgagccagcgatccgtccaccatggctccgttgaagctcatcatagacacggatcctggcatcggtgcgtgaaatgacggaattgggtaggtcctcgaggggccctcgctgacctagccaactctgccctcccctcctcaccatccccagacgacagcatggcgatcctggccgcattccacagccctgaggtagagatcataggtctcaccaccatctttggaaatgtgccgacatcaatggccacgcgaaatgctctccacctcagagccttggctcacagaccagatgtgagggggggtggggaggggagggcaacgtgtgtgatgacaagacgcagtacagaagatggccccaaagcatcgcaactcgtcctgccaggcactcagttcccacaatcttggaacgcccaggtccctgtcgcccagggcgccctgacatcgctcaagggtgttgccaaggagcgcatcgcagactttgtgcatggcagtgatggcttcggcaatacagaccccgagttttctcaggtgggtggaatgggatggggtatggtatgtgactcgtcagcaggcaggggcgacaggcacttgatgtcttgtgtgaagccctgcggctgcgtcctgcatcatgtttatcaacttcaggactcggaggcagccactccagggtagggcctcaacctgtcttgttacttgagcaacacaatccctcattgacgtgatgaggctgcaccgcgtccctcccaagcaacgcaggaggagccgctgcccatctcagctgcccagttcatcgcggagtgtgccgcaaaatggcctggggaggtggtggtgctggccctgggaccgctgacaaacgtagcgctggccatacacctgaatccagacctgccgcagctgctggtgaggtcgcgggggttggccggggctgttgagcgaatgggtgtggaagacgggagggcgatggccccgcgattcccggagcagccgattccaggggtaggccagggtccggatccccagcaacacgtcatccaggcacagcaatgcaccgctcagtccaaacacacctgcttcccacacgcgtcagcacaaggttgttgtccttggcggcgccttcttcgtcaacggcaacgtcaacccggcagcggaggccaacatctttggcgaccccgatgctgccaacgtcgtctttgcaaagtgggcgtggtatccagggagaccgtggaagtctccggcatgagttgctgacgcgaggcttctcgccccggggtcctccctctacgcctcgcgcctggaggtcaccccctccttcatcctctccacctccaccgcctcgtgccagggcgcccaactgctgggtggtgggcctggacgtgacccaccagtgccagctctctcgccgccagctggacggcttgcagggcgtcggccggcacggctccttcctctccgccatctcccagttctacctctcataccacaagcacgttggcctgtaggggatggggcaggaaccctcatgcctgtatgaatgcagggccacagggtctgcgagcatcannnnnnnnnngtaccacaagcacgttggcctgtaggggaggggggcagggaccctcatgcctgtatcaatgcagggccacagggtctgcgagcatcaacctgcctcgtctgcatgggcagcgtcctcttacactgggtctagccctcggatccccctccattccctcctacacaccctcccccactggacgcaggtcgtcctacggcatggatgccgtgtttgtgcatgacgctgccgcactcagcgcggtgctgcgaccggagctcttccagtggcacgcgggagcggtgctggtggacaccgagggcgccttccggggccacaccctcgtggacgaaggtgggagggggcggtgctgaaggatgcctcgggatgccgacgaggcgctggcgggccaggggttcaggcacgtcgtcccgcagcaagaccatcctggcggtggaaggccgaggcgtagaggttgtctccctgttgttttaatcttacgctgcccgcgtcaagctggccccctgcggtccccgccaggtttgccccccatcactttgttgtcctgcaacaccctcacccctgccacccgacactgtcgcagggaagaaggagtgggtggggatgaacgagtggcagacccggcccaagatcaaggtggccctgggcgtcgacgccaaggcgctgacagacctcgtgctccagcgcatgagccagtgaggcagcatgcaaaggcaaagaaaggaggactgaggatctctcaggcatccgtccctcggctgatcgttaacatcaagccggtctatgctgctgtcatcctgctcatacatggcgcagactgcattcccgtggctcttggccctccttctctggctgcttgttgagatgtgtccctctgcctctgtgtgcacagcgcttgacgccatgcacaccggcagcacagccggcacagctccctccctgcctcacccacagtgttatcgtgccgccagctgctcgtcagagttctcagggagacccgagggccaggtaacttgcgcggtaccagctaggatctctcggatctcgaccatggcacgctcctcctgctcggcctgggcgttctcctccagcccctgagcctgcagcacggcatgcacagcgtcgcggacctgcagtgttggtaccatggagttcagggaagaggtgtgtagggcaaaagaaacagtgttggtgagaaccagcccaggtccgtcgggatgatggatacggcggctgtaggtcggaccattgccatgcatgtcctgccagtcaggggccatctgtggcatccctcgtccctctggacataaaagatgctggcccccagccacactgctccgcccgtccctaacctggtcaggagtgctgaatccgatgaggtgggtggcgatacccggatttgctactgaaaacatggtggcaagcttgggcaggtccacaccatgagcatccgccgccctggcagcagccctcgcggccgcttggagctccgcgggggccgggtgccaggctggcgggccatgcggggtcaggaggcccatgcccaggacagatgcattgatcacgccgacagccttggactccagatagggcaggatccttcatgggacgacggtgtgcattggccatgaccttcaacgcctcagcaccacacaggggcagcagcaccctcatgcctcatgggcacaatcagtgctccacaacatgcatcttgtcacctgcccaggctctggtcgcagagggtatagtggcagtaggagagcacgacatccacagttccacaggggactctgggcggtgggcgaggtatcattcaggggttcgaggcccctcgtgacttctcgtggggtgggcggcacacacaccaagcaggggcccaatcccagcnnnnnnnnnntgttcgaggcccctcgtgacttctcgtgggttggaaggtacacacaccaagcaggggcccaatcccagcgctgccactgggttcaacaggccgaatctcaatcagcagaacaccaggcatcaccaggagctcacctgtcaaggacgtactggaagcaggcgagtggaaggcccgtgatcccgatgtgccgcaccagccccttctccttgagtcgctggagagccggcagcgtctccgcaatgatctgagcagggtgcgtcgccgcatggcactggtgctttcagaagctatcatgaagtgcaaggtactggaacactgctattcatcctaactccactggctccatgtaccaggaggtgaaatgtacgcctagcccttacgctcctggtctggcgttnnnnnnnnnngcatcctaacaccgccggctccatgtaccaggaggtgagatgtatgcctagcccttacgctcctggtctggcgttacctggtctaggcttccaaactccatgtcgtggacctggatgagatcgatgtagctcgtgtgcagcctttccaggctttcctccacactcctggtcaccctggggccgctgcaatggtcagaggttgtgaatgagcagaccttcaaggtcattcctggggcttcagaccaacacaagagacaggtgattgccccatcatgcatgcgctgatcctcacatgcatccttgggctacctgaagtcaaaggtgtcctggccataccgtccgaccttggtggccagcacaaactgatctcgaggcagtcctgcatcccgcaacgcttggcccagcacctgaattggtctaggaggaattggtatacgcagaggcacccccaagggtctgaggttttgtcaaggtggcatcacaggaaatatcaccgcaggggacactgtgaaaaggcaatcccaacaattaccacctgtcccctattttctcaactcacagtctccgacttggtcagcccataaaagggcgaggtatcaaacagtgtgatgccgagatcgaatgcggtccgcnnnnnnnnnncggacactgtggaaaggcaatcccaacaatcaccacctttcccccattttctcaactcacatcctccgacttggtcagcccataaaagggtgaggtatcaaatagtgtgatgccgagatcgaatgcggtccgcacagcctctgtagcggtgtcttgatgcacatcctgtgagcaaaggggagggttgggcatccatccctggagaccaaaccagccaccctccagacgacactggcattcacacccgcgcgcaccggttaccacgtaccccaaatacattgccgaggggtgaagccccaaatccaatgattgatatttcgaggcccgtggaccccagagggcgcgtcggcacttttatgggcatctctgtgcttgataggtcggaccctagacaatgcaagaccacttgatgccggctcttctcgggcttcttggagatcttcggaatgtacagcgtatgtaaatgaataaattcactccatcaatgctgtcatcactcggttcattgatattcatgccgggcaggaggttttccacccgacacaatctgattcgagacccggcgggcgcgaagtcgaagtctggtccatcctgaggtggagaggacagaaacatcctggagctccccgttaacgctgcagatacatgcgagttgtgtaccgactgcatatcttgccgactgacaccgccaaacgggtagatggcggcatgtatgctgcagactgtggtggccagggcacatgcacctccaggatcttcacacctgcggaatcgcggtccagctggtcatgccttgcagcaaagaccacgcatgctggcggggtggaaacatgtgcatggaagcatatcatcgatctgtccagcactcccatttcgccgggcatggcgaagtcctggcgtcgaaccaaggttgccgggtcgcctcgtagcggcgtccgctgcgcatgccggctcattggatggccttcaacctctctccagctacnnnnnnnnnnaattatcgttctgtccagcactcccagttcgccgggcatggcgcagtcctggcgtcgaaccaaggtcgccgggtcgcctagtagcggcgtccgctgcgcatgccggctcgttggatggccttcaacctctctccagctacactcccccagcccacctccccaccccgcccgattcggcatccgtcaaggaccttttcccttacattaccaaactggctctttctcaaagcacactttactggaggctgggagtggcattggtgctcctcgtcgggtgtgtacatggcagggtgcagttgtcgctcacatagtgtctgccccagatatgtctctaacgtccagctacccatcttgagtccgctgaggttgtatgtgacaggcgcatgaggaatgctgttcctcctctgacgacactctgcactcattgccctaacccttcttgattcatctgcaggtccaaggcagctggtctgtacagccccctcctctttaagcaggcaattgacgcgctgtctgctggagcgacacccactgctgtgcagacggcctccatggcactggtcctctcaggtgccgcgagggccctgagcagtttgacccgggaggcacagcatcccatcttcacgcccatctctcaggcatgtggattggttgaatccgcttgagggcctatagccattgttccatggtgccagggctgagcctttggccctaaccaccacagtctcctgacctcttcacaccggnnnnnnnnnnnnnnnnnnnnnnnnnnnnnnnnnnnnnnnnnnnnnnnncaccttttcccatgtcctgaacctggaccttcacttccacctcaatcgcaaggtaaaaaggcgtgtgagtacgggcgatcaaatcccccagtctgccccgcatgattgaatcatagatagcactcgatggtggtgccgcatttcaaggtatagtgcctcttccttgcagannnnnnnnnntgatgtcaaggtgcaagcacacatgatcgaatccattgtgcctactttcctcctacaggccgctgcacggcgcgtctccttccannnnnnnnnncagcactcgatgatggtgccgcgttttcaaggtatagtgcctcttccttgcagatgtatgcagttccaggcaccatgcacaactgctcgtctcccccaattctcgtgcacagacaggctccctgtcgaggatgctggagcggggatctcggtccatcgccgtgatcttcagggccattgccttcaccgccattcccacgttcctggagctggctgccgtgtgtaccatcctggcgcgaacctttgacgcccgagtctcggccctggtcctcaccacctttgccgcctatgctggctggaccatcgccatagccagagtgagggccgcgggagggagcacaaggttgattgtggggtggctggggcggtcaggtggagggatgctgcatggtgggtacctgcaatgacgatttctcgcaagccagtgacgagaagactgagtgtgatgagtagcttaatttccccaaaatacgcagtggaccacccagatcaggagggaggtcaaggacctggacaatcacatcagcgggaaggtgaaggggggtggattggttggcagcagccagctttggaaggttgctgtgttattgggctaggcaaactccacgtcgctccgagcttgatgaccttctcaaagccctgccacttnnnnnnnnnnccacatcagcggaaaggtgaaggggggtggattggttgccagcagccagccttggaaggttgctgtgttactgggctaggcaaaccccacgatgctccgaccttgatgaccttctcaaagccctgccacttnnnnnnnnnntggctggggcggtcaggtggaggggtgctgcatggtgggcacctgcaatgacgatttctcgcaacatagtgaagagaagactgagtgtgatgagtagcttgatttccccaaaatatgcagtggaccacccagatcaggagggaggtnnnnnnnnnntcgactatgccttaccccacattacaacgcatctcacctcaagctgcaacctccatacgcaggcggtggatgctcttttgaactatgaaacggtggcgctgtatggcaacgagcaaggggaggtggagcagtacgatcaggggctcatccagtaccaggttgtacagggatggagtaatttttgagtccggagctgagcgtatcagtgtgcaccttgacgcctctgcggaccaaagccatgcatatgaagtttcccaagtcaatgtccttgtgggcatacacgaccccggcagcagcatctgagggatcatccccacacactgcagaaaaaatcagtgaagatggagggcgtgtctgccttgctgaatgcggggcaggcctttgtcctggcggccggcatggcggcggtgctcctggtcacagtgcggagcaagccgggtttcacagccggagacttggtgagggtgccggcctgcaggctgccataagatcagcctgagagcagaagagcatgtgaatggcgtatcttcggtgcagaggcaggtataatcgagagctggtcctgcataaatggtgtgaggtcagcatgctagaccccctcccctcctcgtcatcttctcaggtgatggtgcagggactgctgctccaggtctggtccccgctttccttccttggctggttttatcgtgagctgcgacagagcctggtggacctggtgagtgtggggtgaggatgggcagcagagggcaaaacccggattcactctcgctggattctggctgttccatttgctgagctcccttcctcaacaacctcacaggaggacatgctccgcctcctgaagaccgacaacagtgtcgtggatggctcacacgcgctgccgactgcggcagcctcggtcgccgacggctccgcgccggcacggcggggggcaactcgccagcaggcgtcccagggactggccgtgcacctgcagaacgtgacgtatggctaccccggcacaacacgcaatgtgctcaagggcgtgtcgctgagcgcggcgcccggggagagcatcgccatcgtgggtgaggatctttgtggattggcaagcagggaaagcctctctggcgctggccactgagtgtcctacctactttgcgttataggactgtgtttgaggatgtgtagtgacaaagaggaggccattccccaggcacactttgcagttgctcccattattaatgaaggtcacctccctcctctcctcatgccagggccgagtggatccggaaagagcacgatcctgagactcctagtgaggctgtttgacgccggctctggtgcagtgtttgtgaacggcgtggacgtacgggagctgagaaagaaggacttgcgcggcgctgtgggtgtcatccctcaggtgcagaagcttttcagcgattgagtctgaggatttggatctaaagagccattggtagggctgggtgacagtctaccctctggcaatgaggaggatatgaagccccccattcctgtttcatattctctttaacttccttttcacaggatacggtgctgtttaacgacaccctgcggcacaatgtggcatacagccgtcccagcgccaccttcgaggagctggagaaggcggccaaggcggccaagctggacgcagtggtggctcgcctgtccaagggctgggagtccttggtgggggagaggggcctgaagctgagcggcggggagaagcagcgtgttgcaatcgcccgtgctttcctaaggcaaggagcttggaagggtgcaagggttttggtgcacagaagacatgatataggttgcaatggatgatgctgcgttgcaaccaagtcctgagcagggttgctgctgctggtatcagcaggcaaacctgtgtttgttatcgctgggggtgcactccagtgcatggcatgccctcatcagccgccccaacccccaaaccccctcagggagcccaagctgattgtgtgcgatgaggccacatcagcgctggacacggccaccgagaaatccatcatgggaagtctgcgtgagttggccgccgggaggacctcagtcttcgtggcccatcgcctctccacagtccaggcatgtggagagcatccgcaggggaagtgagagcattggattatgaatctgaccgttcctttcgtgccactaggcgtatccctggcacattgacggtcctgtactatactgatctttccctccccaatcctgcaggcctgcgacaggatctacgtgctgagggacggcatcgtggcggagcaggggagccatccgcagctgctggcaaagggcggcttgtaccgagagatgtggcgcctccaggaagcagagcaggtgtttgttttgagggcggatatggaagtctctggggattgtacatttgctgcaagttattaatttgctcagtattctgcagcctcttgactttactgtggccggctggaagaagtctgccatcagtgactgcctcaaacatacctctcaaccatcccctgataccccacaggccgtggacagtatctgttcgcacgatgccgaggatgccgtcatcgacggtcccctccccgggacgaaggaggaggaagtctggcgtgagggctggcgtgagggctggcagcaggggctggaggaggggcaggccgccggcgtggagaatgaggagctgggaggtggaactccggcgcaggctgccaggtccattgcacccacggcgacaccctgattaggattgctgatccgggaactgccttaacaagaaacttccaacatgtacctgccatcgctgagcctcattggcgttggcttgccaaattcattgggtgacttttgtcaatagttctcccgtgcttttcattgcttgggccgccgcttcccgattcctcctctggcatcattgccagattggcctttactttcattctgacgcagacagcagactccaggggaatatgggggaactccgctgggtgcgagaacaggctccaatcgccaaatcatgcacatcagcagttgtaggaaagaactttcgaccatcccgtgcgtcctcgcgtccatggnnnnnnnnnngggattgctgatccgggaactgctttaacaagaaacttccgatatgtacctgccatcgctgagcctcattggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatgcacatcagcgcttgtaggaaagaacctgcgaccatcccgtgcgtcctcgcgtccatggagcacacccccctcctcagccccgccccgccaggccgacgggtgcgacgcggctgacccagccgcccaccccactctgtagcgcgccacgcaggctgcccagcacgccaccctcggcctggccgggggttgcctgggccaggtggggcgccagcgccgccgcctcacgttgcattcccagctcggagaagagctacggggatggttgggttggaggtgtggacatgattgtatgaagtgcatggaaatgtgcagctatgggggtgaggggagcaccaggaatggcggggcatgccaactcgcaccccgccatggtgtcccccccctgcgcaccatggccttgcgcgcgacggcgccgtcgcctgagacgcgatccacgatccaccgcaagacttccggcggggctccgtgagccctggcaggaggtgcaaggcgggtcgcaatatgagaagggttctgggtggaaggtatgggcgacttcacacaccagtcccctcccccttcccctgcctcggccccactccgagagcctcgccccactccggcagcctcgccccactcactgtgcagcgtgggcgtagtgctccagggtgagcagcgagtacctgtccaggcgactcacctgtggcatggtgtgggggaggtggaaagggggcatgctttgtttgtcctacggcgggtcaagattggcgagcacatcgcggggcccgtacaacctcagcatccagctctcatcggcgcgcaaggctttggctttgcatgggcccaggcaccctccccatcctgagacccctcccctcaatcaatcactcacagaaacaccgccgccgacctcaccttggcctgcaggcccacccagtcatgctgggcggccgcggcgtccagggccagtaactgcgcctgcttctcaggcaccttgtgctccctggcaaagcgcgccgcggcatccttcaggcctagcttgtggcactggcggatggtgccggtgaccgacaggcccaggaagccctccctgcattgcgccagcgagttcgtgcggtgaggctggcctgcgacatcacaccaggtgccggaccctgacacacggcctcatgcctgggacctcgggcccaggcatgccccccgcatgcacggcgcccaagacggccccatggctggctggctgcgcccctcaagcaaacaccgccacctcccccccctacctgctggtggatgcttccagctccagctgctgctcccgcagccgagcaagggcggtgacttgggcggcctcgaaccgggtgtccctcgtctgcagtgtggtcgggtgttgggcctgttggggggattgggtcagaagcacaagccagagcaagggtgcgaggggccggcagaagtctccaacacacattctccagtgtctgtcgataggcaccagcgcagcgcgggtgcattaagcaacttgctnnnnnnnnnntcgggtgtccctcgtctgcagtgcggtcgggtgttgggcctgtttgcggggattgagtcagaagcgcaagccagagcaagggtgcaaggggccggcagaagtctccaacatacattgtccagtctctttcgataggcaccggcgcagcgcgggtgcattaagcaacttgctcctcttccaacggcccatgacagcggagcaggtcgtcagcacgtctccgggcagcccatggaatcggagcgatgcgagtgtcacccaacgatggacccgcccaaaaccccaagaacgcaccttggattgcgcccggacgtatgcatcccgactccgggccagctcagtctggatggccgtttcccccgcgccgcctgccgtgggtgatgacactcggggagggttgcagggctgcaccccacgcgaaaccgcccgagcagcaacgccccttggaccttgcaatccagaggaggcagcacacgcaacccactcggctcagccaattcctgctgcatgcgcgcgccctctgtgcacgcccccccccnnnnnnnnnntgcaggtcgtcagcacgtctccgggcatcccatggaatctgagcgatgcgagtgtcacccgtcgatggacccgcccaaaaccccaagaacgcnnnnnnnnnncgtccaggtggacctctgccgtccgctcagggtggccggtgtgctcatacacgtctgtgaccaccagcgggtcctgtgagggggaatgtgggtgtgtaaagggttcgtggggtgaggttgaggaggtgggaggtggacagcctggaggtccagatgctgcaggcttgtgagtgggggcagggtcgaaatccagtctgaaacaaagtgactgggnnnnnnnnnnnnnnnnnnnnnnnnnncgcggatacatgagtgcttggttcaaaacttcgtactggcaggtgtgggtgcgagcaggtgactcaannnnnnnnnnaatcggcaccctcacaatcagagcgcctcccctccgtcgcacccacctgcttggcggagtagcggaggaagaccgcgcacgccagggggtgcctggtcatggccgtccagaaccgctggccggcggccacgctctgctgcggggtgggcgccgtggcctgcgcagcgggtacatgagtgcttggttcgaaacttcgtaccggcaggtgtgggtgcgagcaggtgactcaagcccgacccaagactccagctctccccacagcgattcaaacacagccccctcgcctcaccagggcacgctgcacatctgcccacagcgcgctgcaggcgtccagcatcaggtcagcgtccagcgaggtctcggccttgcccagcgcagcctccgtctcgcctgcgccgagggagggatggtggggtccgggagcacatgtgaggggctccggagactacgccgagactggggttcggatgaataaatcacgcgccgttgatccgcaaacaggccgacgcgctgcagcannnnnnnnnngggggcccgggagcacatgtgaagggctccggagactacgccgagattggggttcggatgaataaatcacacgccgccgatccgcaaacaggccgacgcgctgcagcagcacacgccgcgccctgtgctggacccctccgttttcccgtctccgcacccagctcaagcaggaggggcacttgctggtgggcccggtgctccatgtccagcaggagcgccgccagcttgggccggccctgccccgcggcgtgggaggcgatgtttgcccactccaccccgcccgcgccgtccagcttgctctgtggtggggcatggaatgtgggcgtaatggggcggtttgacgtcgcatgctctggggttgctgcagagaaattccacttcagccaggctgaacaggttgctgcacagaacaagttcattgtcagtccaaagtacatcacatgacacgccaggaccctcccatcgcctgccccttgagctgcagtgcacaaagcaaaggcccggccccccttcctccacgttcccactcttcaacaagcgcgccttgagggcggcgaggagctcggcgtcgcccagcaaacccccgcaggcggtgaccttgtcgcaggcccaggcgctgagcacggcctcccccggcaggccttgcgcacgagccacgctcagcgccaggtggtagtgccggcggcggaccaggcggcggaccaggggttcccacccctccgcctccagctgctccatggtgattgggatgcccacctctgggatgtgggattgaaggggaggttgggcatgggttgcacgagggttatgaggaggggacatgagatacacgagcatgggctccaatcattcatggccggcgactgcgacagatggtggcatgcactgccctcaagctgcccccccgccgccatgcaccgcaaggcctttgcgccgtttgccttgaagcctctgttgattccccttcccccctttcctttccctcccctctttctccccaacccacccgggtcgtgcagggcgttgaggacgcggagactgcgtgcgacctccagcgcatcgcgccgccccagccccggcacatcggccgcgtttggcagcgcggggtcgatccccaggaaagcgnnnnnnnnnntcggagactgcatgcaacctccagcgcgtcgcgccgccccagccccggcacgtcggccgcgttgggcagcgcggggtcgatccccaggaaagcgcggccatagcaggcggcgcggagcagggcctcctggcgcgcggggtccagctcggcggcggcggccgccaggcaggcagccacggcggccggcagcgtccccgcgcgcaccagttccagcagctccgcggtcgcccgcgcgtcgccggcctcgtacagtcgccgcgcatcgaagagcagggcccccggctccagcgaccccatctccagcaccgaacgctgcgcgggcggcacggcgcgcagcagccagtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnncggccaggcgcaggccgtcgggctcgggggagagagcggggcgcggcccggcgccgggggggtgcgcgcgccagcgtgccgcgccgcccaggcccacaagcagcaggcccacgccctcccagctcagcaccaaggcgcgcgagcccgcccatgccagcgcatcggggagggcgtcgggcggcgtctccatgcccaggtcctcggacaggctggacgccgtgtcggccagggcaagcgatgtgaccacgtccaggtgctctacattcgttgagcgatgggggagggggagggggattgaactgcatgggccatgctgcgacgcagagagaacccnnnnnnnnnnagatggggaagggggaggggaattggactgtatgggccatgctgcgacgcagagagaacccttcctccagatcacaatcaaatctccagcacgagaagccgctgctcccaccgcaatcaaccacacgcacgcacacacacacacacctgcggcccagacgcggatgctgccgtcctcgcagaatgcggcgacgtgcatgccatccagcgaggcctccagatgcagcacggggccgggggtgggggcgctggcgcgcggcacacccctactgccgtccacaagcaccagggtttgatacagggcgaccacgacctcgggcatcgagggcaccggctgccctgcgggggtggggaggaccgccagggcccggaccccgacggcgtgggggccgccgccgtcggcgcggggcgcgttggctccagcgggcaggggcaggcgcagctgcctgggccggtccagcgtgggcacaacccacagcgcgccgcgccgggtgaggccgaccacgccggcggggaagacccgggccagctgcaggccctcctcctccgcctccttgcccagggagaagggcggggccgattcctggccgcgcacgtcataccggtgcacctgagcagagggatttgaggtcttaactccttcctttctttctaggggaggggaagattaggcacgagattcgtgtcccgcgcaatgtaggaggaagggcagctgtgagggagctcagcgtgaccggggccaggctgcagggccaccgcagatccacggcacgtcatgcctgtgaatactgccgtgatgctgcctcacctgcctcgcttggtcctcccaaacccactccatgcaacgcttaaaggcacccctgcccgcccctaatatcacacaagcaaccctctcctgcccacgcaccgtgccctcctcctccaccaccagcagnnnnnnnnnngctgaggtcttaactccttcctttctttctaagggagtggaaggtcaggcacgagattcgtggcccgcgcgaggtaggaggaagggcagctgtgagggagctcnnnnnnnnnncaaaggcacccctgcccgcccctaccatcacacaagcaaccctctcctgcccacacaccgtgccctcctcctccaccaccagcagctcctcggcgctgctccagcccgccgccaggacgctgcccctctcccacagcaccagccccagctggcgcccggccgcagagtagatgtggatgtctgggcgggacgctgaccctatgtacagccggacctgggcctcgtcccacaccgttgccatggggccgccatgctgaccggtgaagacgctgcgggcaggggttgtgagggcatgtgaaggttgctctgggggttgagaacctgggagacgaccaccccccacttccatcatgtttgcctggccattcactgcagagaactggctgggacagagtcatccgccacgacccctcccttcacccaacacagcccgcttgtcaccnnnnnnnnnntggccacccccacttccataatgtttgcctggccaatcacgacagaaaactggctcggacagagtaatccgccatgaccccacccttcacccaacacagcccgcttgtcaccgtgtaagggcaaggtccttgtcccactccagggagtaaagggagcgcagggagtagaattccgagcccaggacttgccagtcctcctggctcaggccagaatccagcagctccatcagacgggtggcataggttttactaggctcctcggatcctgatccgagaggtaaggactgtggttgataagagtctgcgcagtttttagtcggtcgggggctggctcgagggcccaaagccagcgcccagtggcgatctagagccaagacggtatcaggggggagcaatcagtgttttcatactgtaggatgccctccgattgtatgcaccggccgcatcggaagccatcagacattccccaagtgatccagcatcgcgccggtgtggcgcgcgtgctgcgcaccctgctcaaacccgtgaaagctgtcgcgccccatcggagcacatcattgccctgtcgaccagcccctgcatcttcacaacccaccaccacctcatctactgctggcgctatgacggatcccgatgtggagcagcccgattgggagctctcgaaggagaatttccagcccttgcgacaggggcggaagggggcaggcctgaaagacaacaccgaggagctccgatccgccaacttggacgctgtcaagaggtacattgctcgattaagatgtcctttttcccgggagtgagctcggacatcgcagagataacagcctgtgagtgctttggtccctgaattgtctcaccccccatgcaggcagttctggcaggcgattgcagatgaccagagcgatgatcctctggcagcgtggcaaaggtaggccgagttgacgccgctggctaggggagtatactgatccactggagcctctgaggcagggctcactcttactgtgtgacttggaagaggtccagatgtgtgtgcaaggtttgtcaggtctacaaggtaagcctttccctcgtggtatggcctctggctgagactgactgatgacctgccgtcgcaggttcatcgactggacacggnnnnnnnnnnatgctcgattgagatgtcctttttttcctggagtgagctcggacatcgcagagagaacagcctgtgagtgctttggtccttgaattgtctcaccccccatgcaggcagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtcagggctacaaggtaagccttgccctcgtgttttggcctctggctgagactgactgatgacatgccgtcgcaggttcatcgactggacacgggagacttataccgctggcggtcacaaggcggagctgatcccactgctggagcgctgcacctcgaccttgcaatccgacgagcggtaccgcaacgatccacgcttcctccgcatctggatcctatacgtgagggggcatgtggtggcctgcgtgcgaatgtctgcgcagtgtgtgtgtggagggggaagctcttttgttgcggaagagaatcacaggttccatgccatttctctggcgcccatggcaactctgtgccgagctccccacacgatagcactgttgtttctgcatcctgcagctcactcttccattcctcccccaccaaaaacaatacaaggcggactgcctggcggagccggaggacgtcttctccttcctggcacagaacgacatcgggcagggacacgcactcttccacatcgcccacgccacctgcctggagcttcggggcgcctttggccgcgctgacgccgcgtacctgcgtggcatcgacctacacgcagccccactggagcggctgaaggccaagcacaccgagttccagtacaggatggtgggtgcagggtggtacggggtgaggctccacctcggggggccgtgtggaggnnnnnnnnnntcagtataggatggtgggtgcagggcggtacggggcgaggctccacctcggggggccgtgtggaggttttctgagctgctgatgggtgcccagcaggacatgcgctgggtttgcggacaccccacctgacaccacctggacccctcaccgcatcgcaggcacgaaggatccagcgggatgcggcggcctccgccacggccctcggccccgtagagaccggcgccgccgcacctgcccgccgcttcggccaggcagtcggcgcccttgggggcgctaggccaccgggaggcaggccggcctttgcgcccctgggcagggcggcagcggcggcagctggtcaggtccgtggcgggtcggcggccggtgctgcgcccctcagcgtcctcgccgatgacccgggagcgccggcctgcccaggcccctccctgacggcccggtgaggcgggagatgtgaggtggggggagcctggatggctacagatgcccgcgtgcagcccgcgcacatgcgcgaggcgaaaagaaagtcctcccggatacccccgtgcgcaggagtggctcgactccgacctggacccgcctgaccccggccgcggtgggcaggaaggaaaacacccaggccgccctgccctgggtggggcagcgtctggagcaggacggcagcgcggcaacggagcccgcccccgccctggaggtcttcgccgaccccgagcttgaagccagccaggcgcaggaccggcagcggctgctgggggtccagcaggtggggggtggcagagttgtggtgtccagcacagggcattggtttctggacatgggctgcatggcatgcggccgagccacgtcctctgnnnnnnnnnntagagttgtggtgtccaacaaagggcattggtttctggacatggatggcatggcatgcggccgagccacgtcctctgtcacggagagaggtctcggtcctgtgctgtatggtgtgcaatgtgtgtgacgacctgccacccggcccatgccagggaacgctgcgggatcacctggaaggaaagcggggcgccgaggccggcctgcacccgtctacctccagcatcgccgcgcctggagcctcggaccccctgcgcctgcacaaggtccgtgcctcgcgatgaccagtgggtgtacagatcgttgcgctggtgctcactcatgctcacgatcctctggcgagccggggcagcctgggtcggccatacgcagcaaagctctccagaaacaccgggcgtgccccccaatcgatcgccgcacccaacccccaccccacctgcagcaaaacctggagcggggcagggcgcagggcgcgaggccggaggaggtgctggcctgcgacacgcagctgctgcggggccctgatggcggtgcgtgaggaaggaaaggaggagatctcagggccctagtgtgttcctgttctcctggtgcgagttgcccccctgccctgcttttcaatcctgtgtgtaaatctgcatcccggtgacgacaagattcacacacagcacccctgtcccatgagcagaagagctcagcttcgaggaggtcagggcccggttgaggctgagtaggctgcgacccagccatgcagannnnnnnnnngatccatcctgtgtgtaaatctgcatcccggtgaccacaagattcacacacagcacccccgtcccatgagcagaagagctcagctttgaggaggtcagggcccgggtgatgctgagtaggctgcgccccagccaggcagagcctggtccgcccgcaggcatgtttgagtggcagaaagcgtgatggagcctctgcagcatgtgggacctgaatgagcgcagggcatgcaagtccatgatgggacttggatgatcagtgatgcaagatgctctccaggcgtgggaatcctaaatttgacacctgccccccttcacactcaccctgcagcagctagcatagacagcgcctgttgggcagagccgccggccatccatccagccctcgtgggcgtcgtggctggctcacagcaggcatcggagcgcgaatcttccccggacacgaggaggcaagccttcaaggnnnnnnnnnntcggccatccatccagccctcgtgggcgccgtggctggctcacagcaggcatcggagtgcgaatctcccccggacacgaggaggcaagccttcaaggtgaggcacgaggaggcttgggatgcaaaggggccatggctggcatctgaccgacccagtgtcccctgtactgaaggccagcaggatgggtaccagactggtgacctgcatgtcccgacgctcacccagacgcacatccacgcctccctcccctgtcagttgaggcggcagcgcaggtccagcatcatgcctgggctgcggggccgggagcccaccatgaccatcgccaccgcgggggcgtttgccgccatcggcagctactttgaggtgggtcggcgcagccctgtgcgagcgggtggctcccactctgcttgcgttgcaatcaggcacgccgccaccttggtatcactttctatgacactccgtgtgagatcaccctcctctccccctcccccccccccccccccccccccccccccgactctgccagggtggcttgtcggcggagcacgctttccagccgcccactgcattcggcggggaccccaccatgaccatctccacgcatgctgcgttccaggcggtgaacgacatgtttgcaggtatgatgtggtaaaggggtaatcaatggcatactcctgatggcaagtggagcagcaatcgtgttctgaaagaatcgacgctnnnnnnnnnnagtgaacgacatgtttgcaggtgtgatgtggtagaggggtagtcaatggcatactcctaatggcacatggaacagcaatcgtgttctgaaagaatcgacgctgctgggctccctcttctttgcaaatagagtgctccatcctctcgtcacccaaccccttcctgaacacacgtcacagggccagtatcgtcggcatggtccctatcagcacctgcggaaagacaggagcacggcccagcacggccccagatcgtgtcggggtcccctgacgagggcgggttttgcatccgagaagacacccagattctgccacatacgcctgcagagcatgggtcatcactgctggatatccggcaagacacggggctcctcgaccctggagaccagctctcagcgcatcctgctcagggaacagaccttggcttcaacatctgcgaggacacctgcttcctgaactattccaatgcatgatgttgtgtgcctgtnnnnnnnnnnacctgcagagcacgggtcatcactgctagatatccggcaagacacggggctgctcgaccctggagaccaactctcagtgcatcctgctcagggcacagaccttggcttcgacatccgcgaggacacctgcttcttgagctattccaatgcatgatgttgtgtgcctgtggcaagtgtaatctcagctgcaggggcacaatgtacagatatttatcagccaggctcgaccccgtgacccagaggactgtgagtactattctgtcagactgggaggactctgattgctcaaaccttgccgtacaccatcactctcgttgccccactgacagctccatgtttgacctcccgccatcgtcggacgcgcgcggcagcatgctgtgctcgtcaccagctatgggttgccacgcttacagcaaccacaccagtctcagagaggcgctggtacaaatcaaattaattcccttgcaataataaaatcaatgctgcgctcgnnnnnnnnnngatgggttgccacgcttacagcaaccataccagtctcagagaggcagtggtacaaatcaaattaattcgcttgcaataataaaatcaatgctgcgctcgtattgaagacgtgccgctaatcgcgaggggacgcttggggtgctcgaggggagggtctcggaccctttgcagcctcatgtcccgcgctgcccacctgctgaggcgggttgcctcccagatcgtacaggtgtcgaataccgtgggaactgtcggcacccttatagaggtgaaggccggctgcgcctgggctgcgccatcccttgcctcccgcatccagctgggggcccgtggatttgcggccgcatctgatggaggaagcagaggaacagggactggatccgtccctcccacatcatcgagaagcgtagagtccggggatcaggacgagtggggctcagccatcataacaggtatggctcgcccagtggggctgaggggtaggtttgcccggggagtgaagcctgaagctcggcgttcctacaaatgcatgtggcgacataatgttgccaggatgctggtgcgtgctcaaccgcacaagccaccccgctccaggctgggatacgaacatcgacggctgctgattttcaccacccgccttctccgttccctctcgttcaggcgactgggaccgcgcatgggagatattcgagaccacatacccggtggagggcgacaacatgcctggcgtgctggaaatcatggccctggactcggaagccgaggagaaggcagcccggcgccagcgggagctggacctccaggtgactgcgaggatcgagtgtacctgggggatccactttgggggctcaacctgtaaaaagggattgcatggaggatacggaacatgcccagacaggacggactcctcagaaatgatggccttcatctcacttccctgagcttggcttggtggctctaatgccccttcccnnnnnnnnnncaaggattgcatggaggatgcggaacatgcccagacaggatggactcctcaggaatgatggccttcatcttacttccctgaccttggcttggtggctctaatgccccttcccccaaacctcatgattcccctgcaggaggaagctgctgccagccacgtgcgtgttgttgaccacctcggccgatcgcaggccaccggcaagcgcaagacctccatcgcgagggtctggatctgggagggtcagggtgcgttggggagctgtggcggtctgggcacgcgggatccgcttctcagagaggttgcttgtcgtggtgcttgccggacatagtttgcccctttacgggcctccattccacttcctatctggcnnnnnnnnnnacgggatccgcttctcagagagattgcgtgtcgtggtgcttgccggacacagtttgaccctgtacgggcctccattccacttcctatctggcacttgctccatgggccccttcagtagagctcaaagcagagtgcatgggatgtgtgagcgccgcatcaggaagccatgctgcatggagtctcggctgcccgtaccctccacttccccatgcatttgaagctgatgtcagccgctctccacactttcctatcggcacgccaccccatgcctcacccccccagggcacatgatggtgaacaagcagccctacgaccagtacttcaagaccttgccgcggcgcaacgacgtcatcacaccctttgcggtgaccaacacgctggggtcctttgatgtcatggtcaatgtcatcggtggaggcacgaccgggcagtcccaggtgtgagaggcggggccggatctgatgatgccatttgcacgtttggcatcgcgcccttgatagtgcagggtaacctacagcactgcttggttgcttgcatacctcctcctccgcaaaccatgcaggctgtgcggcacggcattgccaaggcgctgcagttttttgaccccgcacaccgtccggagctcaagtctgcaggtctcttgacgcgcgacgcgcgtgtggtggagaggaagaagcccggaaggtgggcagagtcatctgagctgatgggtaaagcgtgtgcgctgcatgccgtctgacgaggtgcnnnnnnnnnngtcgcgcccttgatggtgcagggtaacctacagcactgtttggctgcgtgcatacctcctcctccacaaaccatgcaggctgtgcggcacggcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtcatctgggctgatgggtcaagagtgtgcgctgcatgccgtctgacgaggtgctctgccctctccctgcggggatgcatgcagcgtcgttatttgtgtcaatcacactggaccataactcatacatccacaggaagaaggcgcgaaaggcattccagtgggtcaagcgataggccccaggagaaggggtgcccacggatgtgctttggacccttcccccctcccgcatgcggaccgtgctgtgaagcaacccatatcgacacgaatcgaagtgaaaccgaggggcgatcggtgttttcaagatgcctgacaagtgatcggctgcactactttgtagcttgaccgcgacacggaccgatatgtcgtcagctctcgccagcctgaggaccgggctgcgtgtgcctcgtgcaggcgccagcagcacgtgcagctctctcgaatgtcgcgacatcatgcgtgctcccctcaatgtgcagaggtagctttcaaataggtgtcgtcgtcattgttaggggcggagggagcatgcgtgccaaagtgccagattcttggggttttctggtagcccaagtccaatcccggcgtgtgggagctgccgctctgcaattgatcagcggcccagttccatggtcttcacccctattcttctcaggatctccagcgcccctaccaaggctcggaccgtgtgccgtacctcggcacccgaggctcctgtgcagaccaatggcgctgccgcagatggcagtggacagctgcccattgcatactctccagaatggttggctctcagggagcacaccaaggaggtggactcactgtgagttgactttctgcagacacccatgctgcgggtggaagtgttcatgctgcaggcgtgcctctggccctggagctcctgggtttgatgatcgacgaggcatttggtgtaccttgagcttactctcccccatgggcagcctccctcctcccactgacttggtatcactcgccccacgcccgtcccaggcacctgcgggacctgctcatggatgaggagcgcgccgagcacttctcccgcgagcataatggcatctacatggacttcagtcgccagacgatgaccgagacgacgctaagggtgcgcatagggattgtggagcgtggcgggggcagcgggatccaggatcagcccctannnnnnnnnncaatggcatctacatggactttagtcgccagacgatgaccgagacgacgctgagggtgcgcatagggattgtggagcgtgaggggggcagcgggatccaggatcagcccctaattttcaaggagcggcaagccgtcctggctctgagacacagcaggctcacagtccctcacttcacccctccctcttccgccgcatagctgctcctgaacctggcggagcgggcgggcctgaaggggaagattgccgacatgtttgcgggcaagcacatcaaccataccgaggacagagccgtgctgcacaccgccctccgcgcctcgcgcgatgaggtgagcgggtgctcagggagggggatggcctgagagcgcctgggtgcactgttggcagggttgcgagcgtcggctgtacttgagtgccagaatgctctcctcacccggtactgcacaccgccctgcagnnnnnnnnnnaggaactgggaggcctgcgcaggagggagggagtcctagtccgtgaagagttgaccatgtgcatgtgatcgcatgcagtccgagccatctcccccaagtttgcccggggacatgtcagcagaccccagcannnnnnnnnncgcgagcgttggctgtactcgactgccagaatgctcccctcacccggtactgcacaccgccctgcagcaagtgtttacggatggcaaggacgtcgtgccagacgttcatgctgtgttggacaggatcaaggacttttcaggtgagtcgcaggggtctgttttgggggggaactgggcggcctgcgcaggggggagggagtcctggtccgtggagagttgaccatgcgcatgtgatcgcatgcagtccgagccatcccccccgagtctgcccggggacatgtcagcagaccccagcagggtccccctcagccacccggcatctccacccagccccctcccctttccctacccaaacctgcagaacgcgtgaggagtggggagtggcggggcgccaccggcaagaagctgaaggacgtggtggccgtcggcatcggcggcagctacctgggaccggccttcgtccacaccgcgctctccttcgaccacaagagccaggaggaggctgagggcaggtgcgccaaggggttcaggcgtggagtgcgggctggggtcgcggccccgctcttccagagcctctgtggcctgtgactgatcagcgtgcctcccctgcgcacctgccaggaagctgcgcttcctggcgaacgtggatcccgtggacgtcgccaaggcactgcacgggctgcgggccgagaccacgctggtcatcgtggtgtccaagaccttcaccaccacggagaccatgctcaacgcgcgcaccgtcaggtgcgcgtgtttggagggttggtgccgggagggcttgggggtgtgtgtttgggtgttctgctcagaaaaggtacattccgagcatcttcggcccagacagagcagcacatctcatctatgcgggcgggcaccggaccccaagcgagcccatcgtaccaccgtgtgcaccccgcaggacatggctgaaggccgaacttggaccggaggcagtgtccaagcatatggtcgcggtctccaccaacctcaagctggtgaaggagtttggcatcgacaccgaggtgcaatggaaaaggggggaataggtcggggatggggagtggtctcgccaatcagctctgtgcactcggttgcatgggcgggagggcgcagcaagggtgtcatttgccacccgggcgaggcctcactgccctggttgagacctgcgccgagtctggcattcacatccatgccatcctcacccgcacctcctccaccttccttccccttgccagaacgcatttgggttctgggattgggtgggcggccgctactcgnnnnnnnnnngcggtgggcgtcctgcccctggcactgcagtatggatacgaggtacgcgggagcagggaagcgagcagaaggcatgcaacagaaacgagttttgacctgatttatcggaagtgctggtgggtatgagcaggattgnnnnnnnnnngagccagcagaaggcatgcaacagaaacgagtactgacctgagttgccggaagtgctggtgggtatgagcaggattgcccgttgcacaccgcagctgtgatgatccaccattccccttgccatgctgcagaaagtggaggagttcctggcgggggctcgggatgtcgaccagcacttcaggacggcgccctttgcatccaacctgccggtcctcctgggcctgctcaggtgggtacagcgggaggggaagctcttcacgaggtgatcctcaaagacatgggctctgtgctactcaaaccattgtctcctgcccatgtcccaatcctccccatttcccctcccctttccctcagcatctggaactccaccttcatgaagaggtcctccatcgcgatcctgccctactgccaggccctcgccaagttcccggcccacattcagcaggtgcagaagttgggagggtttgcagacggatgggggagtcgttggtaaagcatgcactctgccgatcgcgtgctggaagccggccactgcgttgcagtgcccggggcgccacccatcggatgcccacctggcctcccttgtgcactgacactccctgtaagacnnnnnnnnnnattggtaaagcgtgcactctgccaatcgcgtgctggaagccggccactgcgtcgcagagcccggggcgccacatatcggatgcccacctggcttcccttgtgcactgacactccctgtaagacnnnnnnnnnntaggggggtccttttggtggaaggcttgagacatgtgtgtccaaagcactgcagtaaggcatgcaggccctgctcttcttcggccgcatagtagtnnnnnnnnnncaattattgacctacccacttactggtccgcccccgcccaggtgtccatggnnnnnnnnnnggaccattgaccaacccactcactggtccgcccccgcccaggtgtccatggagtccctcggcaagcaggtgtctatggaaggggacgccctgccgttcaaggcgggcgaggtcatctttggcgagcctggcactaacgggcagcattccttttaccagctcatccaccaggtgcaggggggtcctcgtggtgggaggcttgagacatgtgtgtccaacgcactgcagtaaggcatgccggccctgctcttcttcggccgcatagtagtaatcctcagtggagggcagtctggtgattgcctcaccctcagcaccatcgcgtcaaccctccacacacgctccgtagggccgtgtcgtgcccgccgagttcatcggcgtggtgaagagccagcagagcgtgtatctcaagggagagctggtgagcaaccacgacgagctcatgtgcaacttcttcgcccaagccgatgcgctggccatgggcaaggagtcagtggcgctgcgggccgagggccttccccagtccatcatcccccacaaaacgttcagcggtgggtggcggcatgcacctggggggtgggggaagagtggaggggagggggggtgattttattcatggcgtggagggaaagggatgcagagcttgtcgatgggaggttgctcgaggattggcggcatgtgtggaggacaacatgcctgagagatccaggcgtggcgtgcttgagcggcaaggtccctgcagcactgatcaccgccctcagcgcaccctctgcctcgcccatccctacatcaacgatccccgctcaatccacagggaaccgcccctccacctccctcctgctgcccgacatgacccccttcaccgtgggccagctgctgagcctctacgaaaaccgggtggctgtccagggcttcatctgggacatcaatgcctttgaccagtggggcgtcgagctcggcaaggtgggtcatggcggatgggcgacgtggagtggcttacagagggggatggctggttggctgggaggatcagaagaggaggcccatgcacggcaggcgtaggatcgaggtcccatggagggtgtgaaagcatcccgctgcccatcgagcctgtggcctgggagggggccgccatgcaggcgggctgtgcctgccacgtcatcgtgaagcataccggggtttggactgcacacagagcccacaaagagggtgtcagaatcatgcactgtccttttccgactgggttgacctcttgcaacagtgccgtgctgattgcagcccaaggctcctgatacccctccctcacaacaaacaccaggtcctggcctccaaggtgaggacgaagatgcacgaggctcgcaccaagctgcgcaagatcctgaaggaggacggcttcaacccctcctcacgcaagatgatcaacaggtgcatggttgaccactgggaaggacctagtgctcgtcccttccaacaagtatgcctggcactctcctaccaagcatgatactcctgctgcccatccaatcccttgtaggtatctggagggcaaggcccannnnnnnnnngtgcctggcactctcctaccgagcatgaccctcctgctgcccatccaaccccttgtaggtatctggagggcaaggcccagctgctgtaccctgagccgagggatgtgttcccctgcgaactcatccacagcgaggcgtgcgtggcgccctgggacaagcatgaaagtgaggctgaggattgatctggcgatgggagttcatgtatcgccttgtggactggatgtctggctctctgtctcaacttcctggcatgcacatgaaagcacaacgccaatattaaaaagttaaaaacaaccagatctagtcatgactatgctcgcttctcaagggaaaggactgcatgcatgctcaggtgccgggcacaccgggggctcccggaccgggctgtgagccaggcgcccctggaatcggattgggcacagatggcgggccgggctcatgtcccggaaggctcccgggttgtggttcattgggaccgggtgcggtgatggggggaaggccaggctcatgggcggggatgctgcgcggctgaggctcgggggttgggggtggcgtcgtgatgggtggctgctcgctcctcacccggaccgcatgcagacggcgggcagatatcctgcagggcatgggtgaatgggctgaaagatttgttcagcataacatgggttaagtgggcgcatgctgcggatcagggactccatcgtaccgtcgagggactgcatgacgcacatggcaacgatgccgggacggtgggagcacggtggccgtcaggcctgcatggaatgcttgggacaacatgatggcgtgtggatcaggaaatgcaatgaaacctagcaaaattttgcctgcatgttgagattccagcgagggatgcagcaaccttgagaggtagctaccccgaagtatcccggcagggcacgattcaccagatacgtttgaattcgcatagccggtgccgtccgctggctcaaaacactgaggaccatgactcccgcctattgagcacattacatgctaccgtccaaatgatttgccttttcttgcttcttgtagactctgtgccggatacttggtcaatgaaatgaggccagacgcagaccagacagggccagcgactggcatgcagcatgctgcaacatgattcttgtacttccatctctgagtgtgggccgtggcaagcccgtcgctcaggatgacttgtggctgaagaggtcgggcagggaggagatggcgacgaacagcttcttgaagctcttctccagcttgcctggggatatcgtgtacgcagggcggttcatgcgattgcctcaacatcaaaggacacgtgccgaggatgtgcggtgcacgccccttccaccaggtgccgagcccttgcagcaccttatcttgcgcacccctcctgccagactcacttgggctgctacgcatgttctccctcagggcggccgagaactcgtccaggcgctcgcgattctcctgcagccacttgatgtacgccagcagatgcgggttgtcctgcgggcaggagggcgcacgctaggcttatgggcgcagggcgtcggcatgtgctctagcacggcatggcaacgctgtccccgctctccccgtacatcgcagcggcctcacccccggcagcagatcccgcagcttgctgatgaagtgctctgtgtcctcgttggccgtcttgaggccatcccaggccgcggaggcatacaggacgtacagggcgcccttccagatcttgtccttgtgctgcttgcagatgtcgtcggtgcaatcgcctgtgaacagcatcgggtcccgatgcagaggtttgagaggtttcctgccatcgataccaacatctgcatcacctnnnnnnnnnngtcgcctgtgaacagcatcgggtcccaatgcagaggtgtgagaggtttactgccatcgataccaacatctgcatcacctccatcatgcgcgccccacacatgacttccctccctgcgcaccaaacacgtcctgcaggtagttgttgtactgcttggccacccgctgaacgtctgtgggcgtggggacaccagatacagcgccggcgcccgccgaggccgtggcgcccgccgaggccgtagcggtgacaggactcgaagggcccgcctttgtaatggggctcgccggaccagctgtggcggcggcgttggccgatgctgtcgcagcgttggtcacgacagtccagcccaggtaggaactgcgcacagtgcgaatggagtacggagaggcagtgagggcaggagctgcggcacacccagaagtctggtctcagctgctggcacgcagggctttccgtgaactattacgcaaacatccaaggggcctgacctctcgatcccgggcgcacctggtggcaggggacttgaccacgttcatctggagggcggcgggtggcgggggcccgttcgaggccgtcacaaggggcctctccatcattggagtggtcgcctcctgggaaggggcttcggcagcttcacctgcctgtaagggggtggggtaggtcagatggtcccgacctgnnnnnnnnnntcacgcagggttttctgtgtactatttcgcaaacatccaaggggcctgacctctcggtcccgggcgcacctggtggcaggggacttgnnnnnnnnnnggcctcctgggaaggggctttggctgcttcacctgcctgtaagagggtggggtaggtcagatggtcccgacctggatggggaagggatgtgacaccatgccatgctgattcctggtccccttttaccgtcgcaggagcacaggtgattggagggcgcgtctgcaatcccatgagaaatgtgcacccagacccaagacctgaccactctcgaaacatcaggcatatgccacccacctcctgcatgccacagagggtcagggcccagccattgagggcaatttgacgggtggtggagttttccaggggatcttccacctgcaggatccaggtgccctcactgccgccgtcggaggcatccttgccgtcgccatcctcgaacatgaaacccagacgctgggtggggatgtaggagtccgtgaagggggcatcgctctgttgcaaataacaaagggggatggttagaggagcgttagtgcagttgaaggcagatcgtgcccattcagtgtgcagtagccctcctgacaagtacaaatcatgatgagtctgtggcattggccattctggcccactgaacgtccaagaccctccaccctcgagatcgacgctctacagcgccgtcccaacgccagctctttcgcttgatttacgtcttccaatcttcccctaggtctcttcattccacaacccgcctccgcccacctcggcactggagaggccgctcgtggcactgtcgttgaatgtggtcttcctcaggatgctcccggcgccgcccacaccaccttgtttcaggacaatggtacgactactggtggggagggcctctgcgctcacaatgggaggctccgccgtgagggtgacctgtgcggaggaaaggggggtgcttgctttccacatgcccatggtgagactgcccctccgtgctcgggggggattcccatgggcattgcagacaatctcgtggactctatgctgaggcagacgacagacttgtaatctcatccagccatatgttgaacaatccgtcaagcaacacattaccaccttcaatgaagccacatccgggtgggcgatggacacagtgacggaaaggtcatcgaccgtgaatgcatccttgaccacgaggtagtcccgtgctactccggtgaccgtgtcaatgcgccctggcgacttgtacgtgcgacagtcctgcaaacaatggggattaagttagtttagcaactcaagcgcagagtatcatgtgctcaacgagatcctacggacgagccaccaatgttccgctgagctcctcagccgagacaagattccgctccctccacacgaaaagattgcacggaccagatcgagggcgattccagagctcaaagtcaggagtactactcctaatgtaaggataatactctgacgcgacatactgaagcgaccagtgcaatgtcgaggtcgtcgtcagtagtgggcagttagtcgtgcccagtggtcttctccctgggttgtgggtgtgcaagccagtccgaaccaggatcagtgatattcacaggtgaattgtgtacactctgaagccgtgctgctcagtgtcgacttttgggtgggacccagcgacgctctcaaaaaacagactgcctcgacgctcacgaccacctggtggtnnnnnnnnnntcagtccaaaccaggatcggtgatattcagaggtgaattgtgtacactctgaagccgtgctggtcagtgtcaacatttgggtgggacccagcgacgctctcgaaaagcagtctgcctcgacgctcacgaccacctggtggtgacatttcggggggcacggcgactccttgtcacgcacagcacgagtgccgagcagcgaatccaggaacgtgtggaaccagtttacgactcgacacggctaaaacatcctgttctagaggatcttatgggtgtcacgtatgcctgatcgccctcagtgatcccccgcccccagtccagcgcctgaccaggctcgccccgggatggtgcttgcggagctgggccagagggtaacgcaggcccttgcctccctttctgccgcccccgtcatcgatgaggcggtattggacgcttgcttgaaagagatcgcggctgccctgctgcaagcggatgtcaatgtccggctggttgccagcctgaggaacaatgtcaagaagagggtgaacgtctcagaactggggaggggcctcagcaagcagcgcatcattgaaaaggtgactggcaacatccatgcttgcctccagtcgtggccctcgttggatccagcgggacttaggacaggtgaacagatgcggagcatagatgatgctgccctgcgacctcaccctcccacgtccaaaagcctcaccgtttatctcgcaggctgtgtttgacgagctgtgcagcatgatcgagggtggccaggccgcgcaacaggagttcaagaaggggcggacgaatatcgttatgtttgtcgggctgcaaggtgaggggcaatgcatgccgtggagttggtgaggaagtaggtccagcttgcatctccacaaatgacctctacggccatatcatgtcacctactagtgttctcatccgaacctctcgacttgcccccaggtgctggaaagacaaccacgtgtacaaagtatgcgcactactataaacgcaagggcttcaaaccagccatggtctgtgcggacactttccgagcaggagctttcgatcagctgaagcaaaatgctacaaaagcgcaggtaggtgccgtcttgaggttcagcgatgattcagggcagtttcctgtgcctggactcttgtgtgggaaccttaaggccgctgctggctcgtatctgcactgtgggtccaggtcgagttacagtgctgcagaacaatgtccgcttggaatgcatgctgttgccctcatggtccacagctgtccacagcaagatgcactcttcaacacccaccacttcccagattccattttacgggagctacaccgagacagatccggcggtgattgctcagcaaggtgtcgaacggttcaagcaggagaagcggtgagatgagcggggtagagctttgcaaaggggatccactccatcctgctcgagcaatttccctgcctggtcagctccttggggtcccctccacctgttcctcctcttatcccttcagggacctgatcattgtcgatacgtcaggtcgccacaagcaggaggagtccctttttgaggagatgcggcaggtggctgccggtgagcagatgggcgatggttgagggtcatttgtcctgagtcgtggcaacggtggtgggttccaacttggaccgagtggggaacttatgccatcggagccttgcatggacacggnnnnnnnnnntttttgttctgagtcgtggcaacggtggtgggttgcaatttggaccgagtggggactttatgccatcggagccttgcatggacacgggaagggcctgcaccttgacctccacctggaactcaccatcccccgctatacccgtcaacttgcagccgtacagccagaccatgtcatctttgtcatggatggctctattggacaggcggcgtttgatcaagccaaggcgttccatgactctgtggatgtaagtctgaggacgtatttgatcctgttcttcttgtggagggaggacacgttgtcggggatgttgctaaggctggacttaagcctgtggagatgtcaagcaccatttgcacagcgtgctggtgtaggnnnnnnnnnnattccatgactctgtggatgtgagtctgagaatgtatttgatcctgttcttcttgtggagggaggacacattgtcagggatgttgctaaggcttgacttaagcctgtggaaatgtccagcaccatttgcacagcgtgctggtgtaggcttcaggacgcactccatgttggctgtgtcctcctcactttgccgatatctcaataccattctgagcatcgattgaacccctcacactcaccaggttgggcaagtgatcatcacgaaactggacgggcatgccaagggtggcggcgctctgtcggctgtcgcggccacccagtcacccatcaccttcattgggacaggtgagcgtctttgtgcaggcagcgtgccctgaggggtggagtggggcaacccggctgcccagaactaaaggttccaaggttgctgatgaggtagcccataatcatgcttgagcactgcctgccttagagttttccgggatttacagttgattcccttactcctacaggtgaacacatgcacgagtttgagcacttcgaggccaagaagtttgtcgggcgacttcttgggaagggtgattggggcggcttcattgacaaggtcaaggatgccatccccgaggtgagctctcagtggccatgcccgggatgaggtcatgagggatcctgaggggctgcagaaactttcatgtgtctgatgtggcagcccctgacctgtctgatatgccctcccggaacaatcaaattgaatcctgtgtggttttgagtcgcctcatcagtgcattgcaaggcttgccatgttgcctcatttcctacaccatcacttctcggctccaatgagtaggaggaccagcagcaggagctgattgagaagatctccaagggcgagttcaccctgcgcatcatgtacgagcagttccagaacatcatgaagatgggacccatgagccaggtgatggttgaaggcgggatggtagcagggctgtgcaggcatgcgggtggggcgacatcgctgtacaatgctagggagcttgctcaacctcgagagtggccccacacccagccaatagtcccctatgccctgcttccctgtgcatgcagcacccctccaccccatcccacacgcctccctgcgtgaactttatgcacaggtcatgagcatgattcccggcttcagcaacgccatcatgcaaccggggtccgagaaggaaagccaggccaagctgaagcgattcatgaccatcatggactccatgaccgccaaggagctggactcctcctccaccaagatcttcagcgagccctccaggtaaggcattgctgggcatgtagaagagcgcgatgggaggctgccaaggggtagagggttgcaacgtctcgggtgctgggctttgtgtgccacccctaggaagactcgtttgtcttgagattatttgctcccctgctgatgcctgtgaatccccaggatccccaagccctcacactgacaaattccatgcacacgacctgctgccgcaggatactacgatgggctcgtggcagcggaagctctgtaatcgatgtacaactcatgctggaggagtacaagcggctggccaaggtgttctcaagtaagtgcgcttggggttgtgggggagggagagactgcggagtgtcatcagaggggccgggtggatctcagttgtcctgcaggctggcctcgtgccctgcacatggcatgagatatattgcaacgagtgcgtgggcaccacacctccgcctgtctgcatggcctcaaaggtgcatggacaccctctatgactcccgtttcgacttccccccccactcattctgctccatcccctctcggcagccgccatgaagggcatnnnnnnnnnncccctatataactcccgtttcgacttgcctccccactcattctgctccctcccctctcggcagccgccatgaagggcatgaagattcccaagaacctcaagggcgacatgaaccccaggaacatgcaggtcggccccnnnnnnnnnnattgtcttgcaggctggcctcgttccctgcaaatggcatgagatatattgcaacgagtgcgtnnnnnnnnnnaattgactcttggttgtttgaggaggagcatgtgcttgagcgactgactgacatgtgctctgccgtgtgtggtgagggaggcatggtgcatgccatcgacttctaatcctgactaccttcaccccctccctcccacgcaggnnnnnnnnnngattgactcttggttgcttgaggaggagcgtgtgcttgagcgactgactgacatgcgctctgcattgtgtggtgagggaggcctggtgcatgccaacgacttctaatcctcactaccttcaccccctccctcccacgcaggccaacatcgctcagatgagcaagatgctgccgccgcacatgctaaagatgatgggtggccccggcgccatccagaacctgatgaagcagatggagggcaaattctgagggtggagcctggacgaagctgcaggacactgttcacatcgcgcccctgcctgcgtcgctgccagcacggccggctgggctccctggaccccttcccccgaaatgcctggcccctcctctgctccagccccgcatgggtggttgccgctgtacagagggcaagagattttcagtccaggggggtgctgggcttggccatcagttccatgccagtcactgtgcacacatgtcaccgcccgactgtcagctagggcgtgacgacccctggcgcggcgggggctgcagccacttcatgatggactcgtacaccacaaaggtgatggcggactggggcatgacacgcagtacattgggcgccaggccgcggtacagtccggccagtccctcacggcgcagggtcaggcgcagggcatgcgccacgcctacataacgcacgctgcggctggggtccacgcgctgctgtagccgggacctgatgacctgtggggacgaaggggggggtgggaggggcgttggggttgcttggggtgcggagggcaggcatggtccatcagaggtgggatattatgtgggaaaggcccccgagcgtggcgctgcaggcaggcaaagaaccaaaaccgctcgacacagaggccgtatactgagccagtaaggtcccgagtcagcaggcccacgcgcgtcccctcggcatccagctactgaaccctaggccggtggccttgcctgagaggggtaggttgcgacnnnnnnnnnngaaggtcccgagtcagcaggcccacgctcgtcccctcggcatccagccactgaaccccaggccgatggccttgcctgagaggggtaggtcgcgacagacgccgagagcttggacagggcgccacagaccgtgatctccaaggaggacaagggggccctgccaggctcgcgctgcgcacgctgggccggcgccgtgctgcgccggcggccggcggcgagcgccttgagctcctcgtacaccgcaaactggatggcgccatgggagacgaggaagagggatgggaccaggcccttgtacaggccccggatgccctcctgcctgccgatcttgaccaggcagtccaccaggcccctgtagggggctgcagcgacctgcaatgtttccaaggtggggacggaggcaatggcgctgagcgggtgagtgcaatgctgagcatcagatnnnnnnnnnngcctgcaatgttttcaaggtggggacggaggttatggcgcttagcgggtgagtgcaatgctgagcatcagatagcaggcggcctttcgcccgcaagggcgagggccttcagcatcgcattcttagaggaattctcagtcaatgcccgacaaaaacacagaacattgcacaccgctccnnnnnnnnnngcgcccgcaagggccagggccttcagcatcgcattctcagaggaattctcagtcaatgcccaacaaaaacacagaacattgcacaccgctcctttggacatgacacactggacccgctgcagtcacacacacatatacaaacagccgcttggccagctccgcaccgcggctgttgcagcgctgctggccgccaggacctggcgctgctgcagctgcaatcgggtcttggcgacccacagggggttggtgacaaagcacacctgagggggcactgggaagaggttggacacgggaatcctgcatgacacatacgctcccatttgatccttctcttacccatcccaccctccataacctcccatcaacgcaccagggttcctgcctcggcggcgctggcgagatgcagatgggcagggagcttgccgctgctgccctgccaggccctgtatcgctccttggcgcggttgtaggtgaagaagtataccccccaggccacgcccgcacccaggactgcaggcgccaggcctggagacattgagaaggagggaaattccccgcatggggccgaggtttggcagatgattacagcgcaactccgtcaagcagagcagtgtgcagattcttttggaccagcaggcacagcatgtgcctcacctgcatacagggcctggtagccctcctgccggacgatgctccttgctgcatcgagcgtgccctggtacagcggcagggggcccttgatgccatcctgaactgcatgaggcaggcacatgcagggtgggtagtttggagtgtgatatcacccacatgccaggcatgggagaaggtcacaattttcccgttcatgttgcacgtaagggcgtgccttggagtcgggtctttatgacgtccagcggctgcagcaggaggacggtggccacccctgcgctacccccagccaccccatggtgcctgcatgaatataaatttggtcatataatctgtgcatgcaatgaatggaagctttaagagtatctggcacgcccagcctggccgctcaccattgtgggcgtgcaggtccatccggcattcgcgtccggctcgctggtttctacaccacctgctgcctacatgccacgtacaaataaaactcgtctaaatgctcatgaacaatttccagggtacagcatctgcgcatgctgctgtcctgcgtttagagctgtagagcactcccccatcacgagtcggagcgcggaagctgggagagccacttgaggtgatttcattactgagcagttactgcccgtccagcgtgcactttatgttacaggcgactacgcatcgagcatagtatgcacgccttgatgcaccgtcatcctcattgctcctgcttgcacagcttatcaatgtccagctctgcttccagtacagccacatcagcctgcatggctgctgtactgttctctacaggcccatggtctgatggggatcttgctgcatagagtaccctgcatatgttgcagcaggcagactgagtgtgggtcgtataccaatgcattcagctcctgacacagtttgctgtccatgtcagagggacgggatatccacagcttagttccaccacaaacaaatgccaatcaccactacgatccacctgccaatgatgcttgagaggtcaaggggnnnnnnnnnncatacacagcttggttccaccacaaacaaatgtcaatcaccactatgatccacctgccaatgatgcttgagaggtcgaggggaccaaaggtacggctgtccaagactgctggaggctgcaattcttcattgtccgccagcacccagcattgcccctgatcaggagagagcattggagtggagcgcattgttgccacaagccgataccaatcattcatacaggcaaacaacatcatgagttgacatggtgccacaaatcacccctgaagaccatcacacatctgtgctgcgcaaagcagggcaagcaactccgcccctcgttcccacctgctgcaagacgacaggttcgtcctccgggtcgtcggtaaccagctcttcgcctggcatggcagcgacacgcctaaccatgtaatcgacatgctctgtgttggcgaggctgatgggctgcagggacgagggggtcttcagagccaccacgtcgcccacccacacgttgctggtggagggtcgaggtatctggcgaacaagaagctgctccactgccccggggtccttggtccccagaggattgagagtgggcgccatggacaccccggccaatgcgatcacttgcgtgagccggcgctgatatgcctctaccgtggtctgcaggacgtccgccaccgagccctggtgcggggatgcaactgcttccgacaccgcatgcttcaacttcagcaaagagtaccgcaggttccaggctcgggtggccatggtcgagcccggcgtggcaataagttctccaagctgtgattcttcgccccaagatgtgtgctatttatcgacagataataacttggaagactgacgtatagtcacggcccctttcgcctcgcatatctgctggtggtctccctgtggtgctcatcccaaccccgggccctggcgcgcgcgcttcaccgacaaatggggaggtatctcaaacccctcaactcagagcttcaaagatcaatgcggtgtcagcttatattctacatnnnnnnnnnnaacatggggagatatcttaaacccctcaactcagagcttcaaatatcaatgcggtgtcagcttatattctacatggtgcacagaaagctcataaaagcccaacaggcatgtctggcttgccactctcattgactggacaggggcccggaattcttggacccttcctgctccttcagaatggactggatctccgcctcaggaagctcctcaaatcgcttctgcatcaccgcagcctcataatccgaaagctgcttggcatacgtcatgttctgagatgtgtaaatgagatggagtggagtgatatgtatactggatgggcttgctagccaaactgccggttatcacaggaggattctactgcatgcagtgcaaacccccgactgctnnnnnnnnnngtggagtggagtgatatgtatattggatgggcacgctagccaatttgccgagtatcacaggaggattttactgcatgcagtgcaaacccccgactgctagcccaccttggtgccaacgcgccagatgtatgacccaatccagaacacgcaaatgcccaggaagacagagagctgcacccaattccctgctgagccggcgtccagacccagagcctgtacagtcgagatggtgtccaggcatgagcgcagggtcgcagggggacgcagtgcaggacagaacatgggtgccaatcggctcccaacccctggctgtgcacgcagnnnnnnnnnntagtcaagatggtgtccaggcatgagcgcagggacgcagggggacggagtgcaggacggaacatgggtgccagtcggctcccaacccctggctgtgcacgcaggcacactgacctgcagaccatagtacatggcgtagcctactccgatcaggccaaccccaatgaggacgacgtccttgcgtgtgtgcccaaactcaatcnnnnnnnnnnatagcctactccgatcaggccaacaccgatgaggacaacgtccttgcgtgtgtgcccaaactcaatcggctccttggatgactgcagagtttgtgtgaggctccaggtggcgaggacacgtagcagaaccatgccgtttgatatgcaagtcaacgctgctgtctggcagcttgcgtggcatgacgcaggcaccgacaaccatccccataccggatcattggaatctcgggaggtattacggtcttcatttcctccggacgcccgggcggctacgctgctgatggtgagggggtgacggcatccgagacctgtgtggttgcgagcgaggagtggcagggctgctcctcccacagtcaagcacgcagagcagcccactggctggtcagggaataataaaggattccatgcgatgagttcaaagcgctcgtaccaaggagagcgcccccatgcgccatgaggcgcctttggaaaactccatgtggggactgtgagggtgcacccaagcgccggccatggagtcccgcggcatgacaactcggggcgagggtgagcgccatgatctgcactggatcctagctgaagtttctgttgttttgaaacaaaggatgcgcgctgcagtcttattctaaaattacatgcacacgcgcgcgtgcatgggtgttcgtccattccagacacacgatgcgatccaaaatctttgctcgagtcccgaaacaaccagattcagcggggccagagtacacattgtcccactttgacgcgtgaagcatggcgcaagctctcacatctccacgcatacaacgcacgtcacccggctatggagtcttcaaaggctgctggcgagctcctcctcagccggccttcagacacgcgaggaacccgaggggggtggtcaggagccgagcgcagcctacaaaagctgtaatcgacgtcagtgaatcaacctttgaggccgaggtgctgaaggtaagctgctcattgcctctcgagctgtgggaaacgccatgtgagaagcctctggttaaacagtgatcgggatcagcgactcgcaatcagtcccccactccctccttactttgtccccacagtcagaaatccctgtcctcattgacttctgggccacatggtgtggtccttgcaagctcgtggctccctttgttgactgggtggcagaggtaggacagcaaatgctgcagtggtacatcctggagaactggcagtctatgcatgtgccaaatatgtgcaagctttaagtcacaccggctgccactcacactctgacatgcaattcccaacaggaatacaagggcaccctgaaggttgtgaagatcgagaccgaccccaaccctggaatcgtggagaagtacaaggtgtgtattctggaggatcgcagctttctatggttgaagcaccaccataaaatgtcagtcacctcaacgaacgctcaatgacagagctcgctcatccctccctgcaggtttatggtctgccctgcctgttgctctttgctgacggcaaggaggtccctggcagcaggcatgaagggggcatcacaaagcaaggcctggttaaatatctagataaaaataatgtggctgcaaagcctgcttgacgcagctcccttgacatacgttgatagtgatcaatgttcttgttctgtaaatgagattcttggaaaccaaaggcgcgagaaaataaaggaacaacgaggcaggctaatcgatcacagccgttccaaccaccttggtcgacataatcgcgtctttacatctttacacatcgataggagcgagcctatcgcctcaaggtcgtcttcgtcctgccaggccatggatcgcttccaacgaatgttggggcaggggggcctgggcggggccggtgccgtggcaggagacgctccccagcaggacacgagcgaacagatatacatatcctcgctcgccctgctgaagatgctcaagcatggccgggcgggggtccccctggaggtcatgggcttgatgctgggcgagttcgtggacgaatacactgtcaaggtggtcgatgtcttcgcgatgccacaatcagggacaggcgtgagcgtcgaggcggtggaccccgtgttccagaccaggatgctggacatgctgaagcaagtgggcaggtgagatcactgcactctacttggaatgactgtggccgtccgcctcttggcactgccgtcattcagtggcacgagctcgtgtatctctaccaacacatgcagnnnnnnnnnnactctactgggaatgactgtggccgtccgccttttggcactgccgtcattcagtggcatgagctcgtgtatctctaccaacacatgcagaccggagatggtcgtcggctggtaccattcccacccgggtttcggatgctggctgtctggggtggacgtcaacacccagcagtccttcgaggccctgaaccagagggccgtggcagtggtcattgacccaatccagtctgtgaagggcaaggtggtcatcgatgccttccgctgcatcagcccgcagacgatgatgctgggccaggagccgaggcagaccacgagcaacgtgggtcacctaaacaagccctccatccaggtgcagcacggcggaagggtggtttgaagatgtgcattggcatgggaactcttttctcctcctttgagtgcccgagcctgaccccttgaccgtgcgccatggttgcaggcgctcattcatggactgaaccggcactattacagcattgccatcaattataggaagacgtccctggaggagaacatgctcctgaacctgcaggcaagtacacttgcgctagtttatgtgggaacgctcgtggcgaaggatgatgtgtatttaaaaggatggcagtgcgctcttgcaagcgaggaacgccttatgtatcgctcccctgtcctgcagaagcacacatggaccaaggggttgaagctgacggactttgacgagcacgcactgaagaatggcaagctcttgaccgaggctcaggacttgacaggtgcggctggtgtgggagagttgtctgacattgactcagttacggtgctggggcttaggtttctgatgaaatcgcgtcaacattttattctccatcccttcctgacctgtttttatgnnnnnnnnnntcgaaggatgttgtgtaattaaaaggatggcagtgtgctcttgcaagcgagaagcgccttatgtatcgctcccctgtcctgcagnnnnnnnnnnatacggtgctggggcttaagtttctgatgggatcgcggcagcattttgttctccatcccttcctgacctgtttttatgcaccattcatgcttgacagagaagtacgagaagctcatcgtcgaggaggaggacatttctctggagaagcgggtggtcgccaaggctggtgcgtgggagattttatgtgggtgccaaagctcagcgactatctttgtcgtttcatgctttggagggtttgggatgggggtccatgccatgactgcggttgggtatgaatgaatagcatgatctcagagtatcgcacccactgtattgaataacaaagtgacaatgcttgcccatggacagcgtgcggaggggtgtccagtgccgcagagtcacgcactgtttcatcagcactctcagcatgtctgcaccccgctgaacctgtgcaggcaagatggatgccaagaagcgattggaggagaatgtgcagacgctgctgtctgacaacatagtgcagtgcatgggtgccatggtggacaccgtggtcttctgatggctttgcatgcacgattgttgtgagcaacatggataacacatgtcactgtagtccaccttgtcagcttggcagattgggtgtcaaggtgttgcacttgcggatgttcgcgagagaggtgtagcagtagtgcacagatcacacattgaagaagtcgttgcacgtcgagcaaggcggttcgcagggtgggagcacgggagccaccgcaaggaggaacgcggctcaattctctcaactcctggatgcctcatatctatatgaacatggtgaaaccaaaaatgaaattccttgcgaagcgannnnnnnnnnctgcacttgcgggtattcgcgagagaggtgtaggagtagttcacagatcacacattgaagaagccgctgcacgtcgagcaaggcggttcgctgggagcacgggagccaccgcaaggaggaacgcggctccattctctcgtctcctggatgcctcatatctatttgaacatggtaaaaccaaaaatgaaattccttgcgaagcgaacacgctaccactgcgtcacaacccctgtcaattttcttggagctgcgaggatttgaaccccggacttttcgcacgttcaagcaatttggttgcgtcagctcgcaataatctcaggacttctacatgtgcttccttgcatgacttcagccttcatttcgtacactcttcgccgccaatagaatgctcgcatgccaggggaggcgccctatnnnnnnnnnncttggttgcgtcagctcgcaataatttcagcacttccacatgagcttccttgcatgtcttcaggtttcatttcgtacactcttcgccgccaatataatgctcgcatgccaggggaggcgccctatccttgcccagataagagctccgacatccattcgagcaatgacgggaggtagccagggcggggacggctggcgaatagcggagcagcacacggcctccatcgcccacagcagcttgatcgcggccctgatgacagtgtggccgtcacagttccccagttcgacgagcgccaagaactccgtgcgaaaacgactggtgttcctgaatggggccccggctccggctcaaacgtgaggggagggggagggctggtttggagtgaccactgctggtgggcaccattgcctgtgcacaggacctacagnnnnnnnnnncttcctgaatggggccccggctccggctcaagcgtgaggggaggggagggctggtttggaatgaccactgctggtaggcaccattgcctgtgcacaggacctacagcaccctctctccacacacacacacacccctttgggttccgcacgatgcagcaccgtggtgccaggcgacacgctgtgcatccggcagcgcacccgcacggtgcagaggaacccgctccccgccgccactcaggaggcggcggccgcagtccgggtggtctggcaggacggctgcctggccttcgtggagaagccacgcggcctggccacgcgcgccgggtccggcccgggccccacgctggccgcctgcctgccggcggtgctggcgcccggccccggcgccgacgcgctgccggacccagcccccgtacaccgcctggacggccccacggggggcctggtgctggtggctaagacacgggccgcgctgcgcctggccagcaccgcctttgcggcgcgggaggtgcgcaagcgctaccgcgccgtggtctggggccggctggcagcaggcggcgtcgtggacatcccgctggacggcaagcccgccagcacgggctactcgccgctgcgctggcatcccatggagccgagcggggggcgtgatgcggggggtgggacaggggagcgcggtgccgggtccttggaagggaaccgctggacaggcccccgtggcgcagcccctggatcagcactggcggtgaccgtgctggatctggcgcccgtcacggggcgcacgcaccagcttcggcgccacctggcgctgatggggcaccccatcgtgggggacccaaagtacaccagcgggtacgccgcgcagcgggcgctggcgctgggggaccccgccgcggaggagggctggcgggcgggcggcggccagacggtggctccgggggccatcgcgggggcgacgccccacctgccaacaggcctgcacctctggtcggtggggctgggcctgcggcaccccatcacgagcgagccgctgaccctgcagctggacgagccgccggaggtagcggcgctgctggaggccctgcagcgcatgcacgaacgatggcgcctgctgcatggagtttgagtgactgcttgcatgtgcagctgcatgacacagcccacagagtcaagcctgggggagtgcagggctcctcgtgtgtacccatgcttttcctcagcgtccaacgtggcgcgcaagaccacacggctcgcgcggccaccggcatggaacttgaaaaggcatccaaggatcgacacgggcagacactgtcatccttgcctgtacctgctgcgcctaggcacatccagtgggagattgtgccggggcagctcctgctcagacgacggcgcaggggacagggcacggcagcgacacccgagtcccgtaacatcccgcgacatgccaggtgcgacgctggctcaatcgtggttctgcagtacagagttcaaacacatgtctgagtcttgtgatgcgatgcccctgcatgcaggcgagcccacaccccaggccgatgccgctcccgcgcctaagggcaaggccaagcccgccggcaagaagcagaaggagaccaagctgggcatgcgggctaccaaggatggcgacttcagcgagtggtactcccaggtggtcatcgagagcgagatgatctcccactatgacgtctcaggtatgcacctgcctgcagtggaggaacggcgcgggtatggcctggactgtggaagaatgtttctgcacctcgccctgcctttcccttgcctccataggatgctacattcnnnnnnnnnngacctgcctgcagtggaggaatggcgtgtgtatggcctggactgtggaggaatatttctgcacctcgccctgccttttcccttgcctccataggatgctacattctgcgaccctgggcctatgccatctgggacgagatcaagaactggtttgatgccgagatcaagaagctgggcgtgcaggtgatcactgaaggggtgggaggaggggaggcatgggaatggctgactgtgctccaggtggtgcaccagaaccctgagtggtcacagggattggtctgtgaatggaaacaccttctctgggcacgtcgagagctcccccttgatgcacgggcggtgccgcaaacgacgtccccaccctcacctccccctccctctccccctcgatgctcagaacgcctacttccccnnnnnnnnnntcgcaaacaatgtccccatcctcacctccccctccctcttcccctcgatgctcagaacgcctacttccccctcttcatcacggaggaggccctgaccacggagaaggaccacgtggagggctttgcagcagaggtgtggggtggggttgatgctgacagtctggagtgaccctccctcgccgcgctctggggatgtgcatgttggtgcagacctcctgccccccggccctacctgggcaaaggtctacaggaagttcgctcctggtcggtgtcctcatccccccttgcatgtgaccttcacggacccacctcccgattcacagcccctcaaccccccacaccaaactcctctccccaggtggcctgggtcaccaagtctggcagctccgacctggaccgcccgctggccatccgccccacctccgagacggtgatgtatcccttctaccgcgactggatccgcagccaccgtgacctgcccctgcgcctgaaccagtggaccaatgtggtgcgctgggagttcaagcaccccacgcccttcatccgctcgcgcgagttcctgtggcaggaggggcacaccgcctttgccacgcggggcgaggccgacgcggaagtgcacaccatcctcgacctgtacgcggccatctaccaggacctgctggcggtgcccgtcgtgcgtggcgtcaagtcctccaaggagaagtttgcgggggcactgtacaccaccaccgtggaggccttcatcccgaacacggggcgcggcatccaggggggcacctcccactgcctgggccagaacttctccaagatgttcaacatcgagttcgagacagaggacggcacgcgcgcgcatgcctggcaaaactcctggggcttcaccacgcgctccatcggcgtcatgatcatgacccatggcgacgaccgcggcgtggtcatcccgccccgcgtctgcgcggtgcaggtggtgctcatccccatccccagcaccaagctgggggaggaggcgcgcgccgccatggtggcgcgcgccgccgagatcgaggccgcgctcaagaccgcgggcctgcgcgttcgcgtggacgaccgcgacaactacacccccggctggaagtacaactactgggagctgcgcggcgtgcccctgcgcctggagctggggcccaaggacatggaggcgggggtggccatgctggcacgccgcgacacgggggccaaggaaagcgtggcgtgggccgacgtggccgcccgcgtgccccagctcctggacaccatccaggttgggggagtgtgtgtgtgtgtgtgtgtgtgnnnnnnnnnnnnnnnnnnnnnnnnnnnnnnnnnnnnnnnnnnnnnnnnnnnnnnnnnnnnnggaggtggaggtgtgtgcatgggatcgatggactgcgtgtgagggatgagggaggggggggcatgccggtggacgtgtggagaggtggtgaggaaccgagccggcgggagggcgcgacctcatggtgcacggccgcctcggcgcggtgcgcttcactgatggatgacagtgcgaccccctctcctcaacctcatggcccccaccactcacccaacaaccacaccctcagtcggacatgctggccaaggccaaggcgacgctggacacctgcatcgagcaggtgaccacgtgggaggggttcatggcggccctggagcgcaagcacgcggtgctggcgccctggtgcgacgaagagagcgtggaggaggacgtgaagcggcggtcggcgggcaaggacggcgagaacaaggacgcgcgggaggcaaccatgggggccaagaccctctgcatcccgctggagcagccggagctgccggagggcacgctgtgctttgcctccggcaagcccgccaagaactgggcgctgtggggccggtcctactgaagcctgaaacgtgtcgcagggggccaaggccgatacgcaggccggaggagggtacgcacgggagccctggactgccaggtgctgcctgatgagcctgccgcccgggcctgcctcaaaccacgcaagtacccaatctgggatatcaggaannnnnnnnnnacggcagggggccaaggccgatgtgcaggccggaggagggtacgcacgggagcctggactaccaggtgctgcctgatgagcctgctgcccgggcctccctcaaacaacgcaagtacccaatctgggatatcaggaacccaccctgtcagcactgcactgctgccaagaactgaggaatgccaggcctgccatagattacaacgtgtgtatacacatggcacttgctcaggcatgcaggcagcgcctgctccgcagcaacaatctccggcgcagagcgctccgcaccagcctcctgtgggggggatgatgtatgtacaggtcgtgattaggagtcgcccaagggcaaaggccgggaatgtcggcccagccagagcccacagcgcatccatgccaacaacccgctgggtgcgctgtgcgccaaaataggaaaccccaccacgccatgggggtgggcactggcggggggcaaatcggcgcgtgcgggctggaggagatgcgccatgggccgggtgactgatgagatgcaagcaggtctgctcagactccccacgatcttgtccacagggacacacaggcttgcaggaacgcagccagaggggtggtgtatcatcacagcagacaagnnnnnnnnnncagggaaagggggaaacggtgcaaagaggaagtgcacgtggttctgtgctcataggccagtgacatcacccnnnnnnnnnnaatcttgtccacagggacacaaaggcttgcaggaatgcagccggaggggtggtgtatcatcacagcagacaagctagatggtacgttgagcttgaaaggtcagctaaacaacgacagcacgatgctcgtcagccccgtccatgcccagtgaagggcaaagggagtggcaggaaagcacacatgaagggctagggatcttcattgcatcgtgcagaaggacggggaaaggggaaattggtgcaaggaggaagtgcacgtgcttctgtgctcataggccagtgacatcacccaggagggtgagctcagggggcaggaaaaccccacgcaggccaggtatcttcacagcacagaggttagcatgtgttgacgcaagaccaaataaagacaatgctctgaaacccaggtattgccgaaaaaattggcaagatcgatggcaggaaaccatctggcagggctaagtttcatcacagcagtgtggggccaggtcagacgtaagaatgtccataggggaaaaaaggagtctgctcagggacccaagcacatgccatgtagagtggcaaggagtggcggcaggaaaccaccagaattgggcacgattccaatcagcgcagaggtggggtaaagaaaacggccaggaaaattccgaaggttggttccaattgtgcatcactgatccaaatcagacccccccaaaatcagaaacaatgcccagaaaaggtggaggctcaccttgtaaactctggcattccagcggaaacgtgaagcagcaaaagtcgtccgagacaaggaaaatctgcaggaggggaggacaggggctcactcagtcaagcacagggcttggagtaaatcgggaatcgaactgcacgactatgaaaacagcactagcgttgattcaaggatatatgaagaagcggtcatcagacaaatgcctcggttgtcgctcatgagcgcgtcgaggagtgcaacagaacgttgcacaacaacgcatcagtctcgtcatctaaatgtatgtcaccatctgaccgcgggagagcaagctgagagggggcaaagcatgtacaggaagcatgcacagaatgggaaaggacatggcaagctcccaggaggcaagggatcagatattctggcaattgttgagtaattgagatagcatttgttggaatcagcgtcgatcatttggggaaagtgtcctcacgccccttgccagggagcagccatcagggaagtggagaagattcaagaggaaggggaacaaaaagggtgaatccagccatctgcaacattgcccacacaaacagaagataacattcacaaccgcctaccttggtgttgccttccaggagtgaacgctgaaactccccttggggtgctgctgacaattcaactcagcaatgtgaaccagtgccaacctgtgcaacaagagcagacacaaaggagatgaagattagtcgagagtactcaaatacacagggccccacatatggtgcaaaaacacgagggaaagagttcacaaggtgttgcttaagtatatatcagcaccaaattcgcagtgcatcacagggtgacctagcacagcgactcaagggctgtttgcctctacgtccgagttgggggccctcacggccatagacccagaactcccaagggagaaccaggccgtggcatagagggaagtatagacgctcagaatccacctcgatacccataaacagctctgcacccgtactcccagacggacagtcaacaagcacacctaagggcggtgtgctgctgagacttggacaccatctagattgtggaatcagggattgtcacatgaggtgaagtcctccaaagacctcaccaaccttgttgttgatacctgcaggtgggaaggagtgaacaggtnnnnnnnnnngagggactgtcacatgaggtgaagtcctccaaagatctcaccaaccttgttattgaatacctgcaggtgggaaggagtgaacaggtgagactgggtgcagtgctgtgctacaaccatgacgcagaccatgccagtgcagtacagtatccaagaaatcagctgccatgaaagggggaaagggggtnnnnnnnnnntagactatgccagtgcagtacaatatccaagacatcagctgccatgaaagggggaaagggggttgcaggtacgatggacctcagcaaacagccatgtttgtcatcagatccgaagatcagccggtaattccataaaagaatccgtcatcggcctgtggctgcagcaccccgtccaaaagcaagaaaacgatggtaggccacagggtcagcaaaacttcacggtgaactgatgtatgtgctcagaaagagtgagctgcggcgacacagggggcaatcgcagaaaatcaaaatgggctcaggacttcttagaggttattttgacgttcctcatctgactttcgccatcggaggattgacagacaaaattgtttcatcaccgcccaggtgagagctggctgaactggccctcagtgagggagccaggcagcagggtaggcagacaagaatcccgcaaggggggaagacgaacagcacaggagctctctgacaaggtctatcaatcactgagatcagacggcacgttcctatcatagaatgtataagtttatatcttccttgagctcaggtgccatggccacaggtttccaatcgatcatgggagagagcaaagggaacatggtgccgtgctacccccccaaacaatgtcccagnnnnnnnnnngcgggtttccaatcgatcgtgggagcgagcaaagggaacatggcgccgtgctacccccccaaacaatgtcccagcttcgacatcacacacctttgtgcagacgtgcggcgtggtgctgctcccgcacatcttcattgcccgggcgcggccagctactccatgtcggcctggcaggcaattgggattggaagagtgaggccatgcatgaccccagtacgcgtattcatcaggatgcattcatcaggggtgctgacagaaaatgtggacaacagcacgtggcaccagaaggcacacaaaggcgctcgcctggcttcctaaagtgcccagatgaaatttcagtttcagctctccctttggacagatggaagtcacagccagcgaaccggctccttcatccgtggcaaggcggctgcatagcctgggcatgcaggtactgacccactcaacacgagccccgcgccgactcaccatgaggtcgcagaagcgcccgcactcccaggcagctgcagcgggcggcgctgtgcaccgccccgcaccgtctccatcagaaataaaggtgcatgtctgcgccaccctgcaatggtgtgcaaatgggaaggatgacagactggtctaacacagcggggctccaggtgcctccacacgaggcgccagcacaggctgcaacactcggtctggcccctccgaggagggaagttctgtggcacgcgatatcgggacatgcagcccacgggatttcacaccaggtgagaggcggctgtccggggtacattcgcatgcgttgagcagcaggcagcaaggaaagatggctaggcacagcggcccctgcagctacaacctcggcattggcccagtacccataggacagcaacatggcagcctcgcacctcaggggnnnnnnnnnnttgcgcaccgcctcgcaccgtctccatcagaaatgaaggtgcatgtctgcgccaccctgcgatggtgtgcaaatgagaaggatgacagactggtctaacacagcggnnnnnnnnnncctcggcattgccccagtacccacaggccagcaacatggcagcctcgcacctcaggggcagatcagagtgcagagcgagacctgggaccagcccacctccatgctgcacctggtacagaaggggcagggcaatcaagggtttaaggggtgcaacgttttggtgacccacaggcatggctgtgagtccaagagggatggcaaggcaagggaaggagtgtgccagcgagacaggtcagcacagacatccactgagagggcgtgtgctggtttttggtctggcatgcagccgtctgcgtcccgcgcagcacccgccgcccattgtggaaggcacggcagggaaataaccatgctgtgcaagacgtgcatgtcagggcagctcgagaagggggtggcacgttgtcaatcacatccccctcatcaccaaccaacgtacccgttgtgcagcagggagcgggctccgccaaaattgtgcttcattggtgtgatcgtgcctgcggggaagatgcatctccgggtcagtgatggtgctagaacaaggttgctagtcaaaggcggcagcagggccaggacatttcccgacggaactcagagcaggtgcaccatgcacatacattcaacgtactggaatgaacaggatttgagatagaacaagcaaacggcgaggaagccnnnnnnnnnnggagcgggtgcaccatgcacatacattcaacatactggaatgaacaggattcgagatagaacaagcaaacggcgaggaagccggatcaggcagacgaaggacggcatgcgaacacatcagacgagaggccggctcagtagtgcctaatagttcgattccgtggcaggttttctcctcaaatatatcagtagagggagccttggatatcgtcaccgccggaaagggatgcaaccagccatcaaacaaaacgcaccccaccgaagtgcgtcgtaccttggcacaaggggtcccgcctgtcagctccgataaatggaagaagcgtgcagcatcgcgaaaagcaatgctgtatgctgaaaagatgataatatgtcgcagaccgggcgtggctgcgcataagaagacggcgatgcagacatcaggaggccgaagccctgggacgaaagttgtggccccctccgttgcactcgtaccgaggtgtgcaagctagggcttgtaccgctcccaagaccttcctggctccctagagatcaggtatgcgatgcattgctctatatatcaacctgaggggtggcctggcccgccgctcccgatttggaaatccctgcagtaaaaggaaggttgcagagcatgttgtgcgccagtcatacgcttcagagcggcatgatatttctgaaatcaatcatgacannnnnnnnnnttcccgatttgggaacccctgcagtaaaaggaaggttgcagagcgtgttgtgcgccagtcatacgcttcagagtggcatgatatttctgaaatcaatcatgacatgcagtggatgggctcagataccggtgacatcaagcagctgcaaccaagaacatctcgaagagtcaaggtgtcggcacaggagtcttctgataagatcaagttattgagtcatcgcccctgggctgtgcagaatacaaccaagaagcccacgaggcttgtcgacctaccatatctcggatattgcaataaatagatggaggagatctacgagaggtagcaatcatcgcatcgtcctctcctgacttcccgcatcggtgggttggcgctcaagctcctgctcttcctgctccgcatcccgcagcatctgggcaaggaagtgctcctccatctacgccatgatgcaaaggttatgcaggatttgtatgccaccctagaagcaagattccattggacatgtaggaatcaggtgggcatatgcatcttcacaggaagtaagctgcactaacagatcctacgaggtgtactcctccagacgcccagtgtcacaccatcgtcagatcagtattcgctcaccaccagtcttgcaagctgcttggtcacagtcacatgtatctgggtgagggccgaagcctcggtgcgcagcgctgtctcaatgtcctggtgcagttggtgaaggcggatacatgcgaggcaggccacgagtatacggcgacgatgcaaagtcnnnnnnnnnngttcccatcggccttgaatcgcatagcgtgaatggtccctgttgaatccaggctccatctcaatcttctttctcgcacaatacaaaggggacctcctggctgccgctcctcgttcagcannnnnnnnnngtttcataaaaggtaccgacctttggacgtcaagtgcacgagagcgacaacccccggcacctcatatgcttgccttggctttgaggttgccgatcttcctctgctgtgacatgactccgcacggactcgctaaagcgataacagatgtgcactattagagagtttacactacatgcgtcgggtcgagttcgacgtagcatgggagtacagcttctcttgcgaccaaagcatgcggcaaacaaattnnnnnnnnnngacaaatgtgcaatatgagagagtttacactacatgcgtcggatcgagttcgacgtagcacgggagtacaccttcccttgcgaccaaagcatgcggcaaacaaatttcaaccgcatgccgcataccgcatggattccacgattcccatcggccttgaaccgcatagcgttgatggtccctgttgaatccaggctccatcgccatcttctttctcgcacaacataaaggtgacctcctggctgccgctcctcgttcagcatggcccccgcgtgtttgtggcatgggcccagtctcctcaggaccccatgcgagcgatccgcgaggagcccgggtgccaacggcccagaggttgcaagcaatgtcacacggcttgccagatcatcctgcacatcaatggcatccagctctaggccaccgtgtgacagtgggagaactgggtggacccctttcacctccaggctgcatgccaccatcgcccgctcctcggtggctgcccggcctcactccaccgtgaacgctcagcaaccagccatggtgtggttcaagcacgatctgcgagtggacgaccaccccggtgtgtgtgaatgtggagagacggcgcccatgctggccgtcttctgctatgacccggaggtgtatgcgcacactgtcctggatggagcggctcatggagcccagggtgagtgagcaccagggcttcaagtaccggatgcgcatgcagagctgcttgcctgggggcttgtgccgcgcccttcctgctcctggtggtcatgtgtgcaggggaagtccccccgcctggtcgtgcaacgctttcactcccttcatccacaagaccccgcccctcacccaacacttgcaatgcacagcgctggcgactgctctgcagcggctgacccgggacctggccgaccggggcgtgcagctcctcgtcacctctggcagctggcaggaggtcatccccgacctggcggcggcggccgacgtgcgccgcgtgctggcagaggacgaggtggagagcggggcgcgggcgcgagtgcaagccgtcgctgcgaggctgccggccggcacccagctccatacctggacggccccgctgcgagctggctatagcgacacgcatgcaggcaagaaggggtgccatcatgtgtcttgattggtgtgttaggggagagataggtcgttgttttggatcttgcagcctcgagcgccagannnnnnnnnngaggggtggcatcatgcgtcttggttggtgtgtttggggagagatacgtcgtcgttttggatcttgcagcctcgagcgccagattgactgcatttctgtgaggtgcacggcgtgtgctgggcgacccaccgaggcacagatggtattgccatccgctcctggcccttccccactctaccgtgcccttccccaccctgacccgccatctcttgtcgatcgcgctcattcgcattctcatgcagatggcgccgacagccannnnnnnnnnatgctgggcgacccaccaaggcacagatggtgttgtcatccgttcctggcccttccccactctaccgtgccctcccccaccctgacctgccatctcatgtcgatcgcgctcatttgcattctcatgcagatggcgccgacagccagggagccgctgctgccccactggatcctccggcgcagctcctgggcgtgcagccgcccgcagtacagaccgctgtacccctctccgcgaaagagatggagcggctggcggtgctggccgtgggcgcccagctccatccctcgctccagtcgtggtggaaagagcgggcgagcgtcactctggggcacgatgagggtgcctccggcccggccctgccactcgacagccagggtgccttggacgccctggacgcccgccggtcggacttggaggaaggggcaggggcgccacatttgggtgcggccactagcctgcctgctccaggccgggcaaacggggcagacactgggatcgcgccgcgtggcgcctccccagcagccccaggcacccctcgggacgccgggttgtggacgcagggcggcgtcgcagcctacctccggctgggcctnnnnnnnnnntcacgtacgccccgggacgccgggttgtggacgcaggacggcgtcgcagcctacctccggctgggcctccagggcgacgctgaggaaagcggggccgagctcgccagcctggtggagcagcactccaggcctgcgcaccccagcggctgcttccccgccattttctcaaggtatgtggctgctgtggcgctcacgcggcttgcctggtgtacggcgctcacagatgtgaacgaccgtctccgctggcaggcggaacaacatnnnnnnnnnncaggtatgtggctgctgtggcgcccacgcggcttgcctggtgcaaggcgctcacggatgtgaatgaccgtctccgctggcaggcggaacaacatggccatccaagcaccccctcaccaccactccgccgttgcagggcgctcacgctgggcgcgctgagccggaggagggtggccgcccaggcgagggccgtgctggcggatcaggccgccgcggggcggcagggcctctggcgcctccggcgccagaaccgcaccgccaaggcccatgtggcgctcgccgcggtggaggcctccgacttccacctggagatggcgcgggcgcgtgaggacaggtgggcctgggtggcgactgtttcgtggggcgctggagcatttctggacgctgaatgtctgatcccacagccaccctgggcatctgtcannnnnnnnnngcaggtgggcctgggtggcgactgtttggtggggcactggagcattgctggacgctgaatgagtgatcccacagccaccctgggcatctgtcaagtcgtcaagtgccgatgccctgccggccaggccgcgtcatgtgccgcatggacatcaaagtcttttgcgcatgcacttgccgccacgcgacgagcccaaccgagcgtcccccgattctcccccccgcctgacccaatccccccttcccccccttccttcctaccctccacagggaggtgcatggcgctaggctggggcactggcgctggcgcggcacgctgaccgactacctggtggctggggacccctcggcgccggcaatcctgctggtgcacggtttcggggccttcggggagcactggcgcggcaacgtcgccgccctggcgcgcgctgggtacgccgtgtatgcacccacgctgccggggtacggacggtcggagaagcaggcgctgccctatggacaggtatggtgcggatgagtgggggaggagatgcggggaggggacgggtgggcttggacggggcggcgcgtagggccgtggagcccacgcaaggcgtgcgctgcagctcctcggtcctccccctgccgcaccaccgcctcagcgccaacggcagcatccgcaccctgtgtgaccgatgagcaagtgcctccnnnnnnnnnntctcggtcccccccctgccgcacctccgcctcagcgccaagagcagcatccggaccctgtgtgaccgatgagcaagtgcctcccgctcccgtgccccttcccctgtccccgccatcaggacctgtggacgagcttcctgtgcgagtttgtggtgcacgtcgtgcgccagcccgtcacggtggtggggaactccatcggaggcttcgtggctgccagcctcgcaggagatcaccccagcctcgtccatggtgtgggtggaggggggtctgtcgctcgttggtggggaggagtgttccacgcctgtgtctccgcacattcagcgagcaaacacccagaacagtgcagtcgcctgcgagacgctgactcaaccatttgtcaccctcacaccttgttctcggcaggcctcgtgctggtaaactctgctggcaaggtggagccaggctatgttgcaccagagaagacgtactcagacgtcgcgcaaagcggttcgcccctgctcagccccacgctgatcaacctcgtcagctcggtgaggggccttgccaaggggcggggcaaaggggcagtgctggacaatcgtatcgatgtcctggnnnnnnnnnncggtaaggaggagtgttccacgcgtgtgtctccgcacattcagcgagcacacacccagaacagtgcagtcgcctgcgagannnnnnnnnntcttgccaaggggtggggcaaaggaacagtgctggacaatcgtatcgatgtcctggacatactcatgaaaagagtttcatgcccatcccattccaggggctcttcgggctgctcaaggggaacgtcaagcggcagctgaagcagctatacccgagcgcgcctgaacgcgcggatgcctggctggcggcggagatcgtgcgggcggccacggacccggggtcaaaaggcgtgttcaccagtgtgttctaccttcagaaaccccgccccctgaaccacctggtggcagagatgtatggcggcccggttctcgtactccaggtgcttggtggaggaaaggaagaaaagagcctggcttaaggctcgggctcatgggggtggtcctgcggtggcccaaggcctgacaagctgactctgtgatgttgaaaagctgtcacagcttcgtcctttgccaggannnnnnnnnnttggtcctgctatgacccaagacctgacgagctgaccctgtgatgttgagaagctgtcacagcttcgtcctttgccaggacgcttcagacctgcgaccatcccaacctgcctgcgcagggggttagggacaccctgtctgacacccggaagagggcgcgagccctggcggcagcctgcagcaatgttcaggcacgattgtggagttagggagggtacccggtcttgaccctgccctgcttatggcaacgctatgtcgttggtaagggcagagcatgggagagaatggtctcgactgagagtgtgccacatcatgctgaaccaccataccacggccctgcttgtggtgcaggtcgtgatgttggaagcgggtcactgcccgcacgatgaggtgccagaggagttcaatgcgcgcctcttggagtggatggagggactggagccggcagggacggcaagggctggagccctgcctgcaacaatttgatggtcttctgggcgtgctggcaaccaccctgcaactgccatgggtaccgagactcctgtatcacgcctcaagttccacatgagattgagtcagtgatgagtataccaactcgatgcaaaccacttggatgtattccatttttcagctgggcggtgttggagcatgcctgtaccttttccctcatggactagatgcctgtaccttcgacagccagtcaactgcgttccacgtctgactgcgtaggaggctccaggtaacgatgcagtctccccagttagctcacctcatgctcatggctgacgnnnnnnnnnngctagatgcctgtacctttaacagccagtcaactgcattccacgtctgactgtgtaggagcctccaggtaatgatgcagtctcccgagttagctcacctcatgctcatggctgacggcggaggatccagaaatcggtggggaatctgagccattttgtgccttacatccatggagcacaaactcttgtcatccgttggcaagctctctaaattgcatgagtatattccaacacgaaggtatactctgcggannnnnnnnnntctcttttcatccgttggcaagctctctaaattacatgagcatattccaacacgaaggtatactctgcggactacgttgtcctgctgtggagtcctggaacattcagtttccccctggcatctgcttctggtgaatctgaactcgagcgcgcgcggtctgtgctcgagcacagaaggccaagtacggccctgtcttcccctgcgacaggcaggactccacccagaaattcacgccatagagaaacgagtaactaggctgtgctgacctttgccgagcagcccgatctgcaaccacacagcgccgtatttcggttggggaggggcacttgccgacagccctggggttgattcccatcgccagccatgtttgcgcggctgacggccttggtggggagcgggaacagcctcccgttggaagtcactggcgagccttccctgatatgggggtcctggacgcacacgagcggcaagtggaaggcagacgggtcggcggtgtctgtgttccgagtggcctcctccaacccttcggatcccaagctggcagcagcacgcaatggcaccaaacgcctgcgcacggtgagcagctggatgctcgaatatggatatgggggtggtgcaggtcaagcatcacgggaaggtgaacaaccgagacgctccaccttccatctgcagcttcgccacccaaacgtgctcatattcaaggagacactcgagctggaagaaaagggcgagcaggccatctacctgatcaccgaggccattgtgccgctggcagagttcctggagtcgacgacgctcactgggacagataggtgagcgtcgggtggggctccgggcggtgctgggatggtgcgttacgcacggctttgggccataccatgaatggaccctgcgacacgctccaggcccgtttgtggggaatagccgcaccgcccagcgggttcttcccgccatgcatgtcgttctgacccttgcaagtgtttgtagtgtttcaaccccgcaacagcnnnnnnnnnncccttcccgccatgcatgacgttctgacccttgcatgtgtttgtagtgtttcaaccccgcaacagcaccacgtccgcctcctctgcctccctgccggcctaatacctggtgctacaagctctactctcccatctcccccccctcggacccctcaccctcaccctctcacctgcctcaaacaggcaggagtacctgacaatgggcttccatgccctggtggcggcggtgtcgtttctgaacattgactgcagcctcatccatggcaacatctgctccggcgccattgcggtgacgcccaccctggactggaaactgtgcggcatggacctgctgacggagcacgcgcaggtgggccctgccagtcccctggccgccgcggcctggctcgtggcctcccagtacaagccgggggaggtggggcgcggggagtgggaggcggtgcgcgccgcgccgccctgggcggtcgacgcatggggcctgggctgcctcatgcaggagctgtacagcgggcatgcgctggaacggttggaggatctgcggcggacggacgtgatcccgcccagtctggtgcagtggtaccagaagctgctgagcagtacccccgcccggcgactcagccccgcgcgcctggtggagagcggcgtgctccgcaccagcctggtccagctcatggcctttttggagaacctggccctcaaggactcccaggagaaggtgcgggtcttggttttggcgtggggtgggggccgggacgccaagtgcccatgcgcccgacggcccggctttgcgggaagtggtggcatcatgacgtagcatgctggagcgcacacctcccccctcaagggaaaccccacaccccccaccgatccctccacccacaaacaacacaacaacctgcaggacgccttcttcaagcnnnnnnnnnnctggttttcgcatgggatgggtggcgggacgccaaatgcccatgcgcccgatggcccggctttgcgggaagtggtggcatcatgacgtggcatgctggagcgcacacctccccctccaagagaaaccccacaccccacaccgatccctccacccacaaacaaaacaacaacctgcaggacgccttcttcaagcgcctgccgtccctgctgccctccgtgcccaccccggtggcccagcgcaagctgctcccgctgctggcgggcgcgctggagtatggcggcgcgccccacgctgcgctgggcacgctgctgacgatcggcgagacgctgccgcccgaggagcaggcggcacgcgtggtgcccatcatcgccaagctcttcgccgcctccgaccgcaacatccggcggggattgctggagaacatcggggcctacggcgccagcctgccagaggcgctggtggaggagcaggtgggtggggggttgggtgggtgg

SEQ ID NO: 30388 - DNA, 140 bp, Chlorella protothecoides
gaggaagaggatgttggctgtccgtgtcgacacacctcggccccttgcaagacgtgggttgctgatcgcaccttgctcctttacaatcaacaggggacctgtcgaggaacaactggtgggtggggctgctggcgtttgga

SEQ ID NO: 30389 - DNA, 135 bp, Chlorella protothecoides
tggggtcatgaggaggtcaggcaatgcctgggtgtttggatcgaactgcttcgtaatgtagattagggcttgttgggtgacatcctccacacacctcaagttgatgaccattgacccctgcagattcccaccggg

SEQ ID NO: 30390 - DNA, 61 bp, Chlorella protothecoides
ccggcgaggtgtgagcgtgctcatcggactaccgccactgcctgccctccctctgctggca

SEQ ID NO: 30391 - DNA, 75 bp, Chlorella protothecoides
aaggccgccaaggtgcggagggtgggggtgttgcgggatatatctctgcagctacatcctaccaaacaatatgtg

SEQ ID NO: 30392 - DNA, 69 bp, Chlorella protothecoides
gcgccggggcgggggcggtgatatggttggatgtggtaaggtaagggctcgtggcggcgacgtggcgcc

SEQ ID NO: 30393 - DNA, 61 bp, Chlorella protothecoides
gcaccgcagggaaaggcgtccgagggccccatggtcaaggccaagcgccagggctgccgca

SEQ ID NO: 30394 - DNA, 146 bp, Chlorella protothecoides
ccaagggctttgcccacgtgcacttcaggcaaggcgggcatgggggagtgccgtggcagggacggcgagatggttctgcgactagggaggattggatggatgggtgtgcggctcttcaatggatcggagggctggttgcctggtgc

SEQ ID NO: 30395 - DNA, 78 bp, Chlorella protothecoides
gcggaaggtatggcgctcgggtgttggatccaaccccatgcgcaagccggccgagggaccgcgacctgggctgcctcc

SEQ ID NO: 30396 - DNA, 463 bp, Chlorella protothecoides
cgctccagcccacttctttgatccttgcatctttccttacctcaggaagtcgacgcgcgggtggtcagcgggcgcccggccccccctccccccgcccccgatggcccaggcctgcatcatgcacagcgcgactctggcggacgaggacggcgccgcgcgggctcatctacccgccaacggtgccggctctccccaggccgccttcatcacctccgcagcgcggtgcaagcgcaaggccgcggccgcggcctgcgctggcacgcccgcccagccccgcgaggccgacgccgacggctgcgccgccgtgcccacgcccgtgaagaccatcaagctgctgcacgccttcggctggctctccgccgcgggcggcgacgcggaggacggcgacgcggcgcggtgccccgtctcgccgcggggcaccgctggcgcgccgctttcggcgccggcgctgtcgcaggcgcag

SEQ ID NO: 30397 - DNA, 75 bp, Chlorella protothecoides
gttccctcttccggtcattggcattcacattcccactcctgcctacccattcacgacaggtgctgatctcgcggg

SEQ ID NO: 30398 - DNA, 97 bp, Chlorella protothecoides
gaggcctttgcagcgtgtcgggcgcaggtttgtgcgacgcccgggcccgtgcgccgggcccggccgggagcggcgcgtcgagtttccactgtcctgc

SEQ ID NO: 30399 - DNA, 61 bp, Chlorella protothecoides
tctctgtgtttaggagatcaatggatcgtacctagatctggatcccttgccctgacaagtc

SEQ ID NO: 30400 - DNA, 79 bp, Chlorella protothecoides
tgtcagcgatggacactgctgtgaacgaaggcccggccgcagcccgccagaggtcctgccatgtgcatcttgtcgattc

SEQ ID NO: 30401 - DNA, 76 bp, Chlorella protothecoides
atttagtgagatgtcagaggggggtgggtgaaacgatggggttcccaaggtgtttgcggcatgcgcagcattgcag

SEQ ID NO: 30402 - DNA, 61 bp, Chlorella protothecoides
cgtctttcaccgccgcgtggccgtctttcagcgccgcgtggccgtctttcaccgccgcgtg

SEQ ID NO: 30403 - DNA, 10515 bp, Chlorella protothecoides
  modified_base (2574)..(2583): a, c, t, g, unknown or other
  modified_base (5277)..(5286): a, c, t, g, unknown or other
  modified_base (7013)..(7022): a, c, t, g, unknown or other
  modified_base (7647)..(7830): a, c, t, g, unknown or other
  modified_base (10377)..(10386): a, c, t, g, unknown or other
gagccgctggatacggcgggcgcggaggatgggggcgggctgcggctgaccagcgcggggcgcaccgcgctgatgaccgcgctggcggccaacacgggcatgcaggtgcccagcatgcagctgccgctcaaggtgcctgcgcccactgcgcccgccattccggaggcggtgcgcctggaccagggcctcctgggccccgcctcgcccatccccacgcagtgcgtgctgctgaagaacatgttggacccggaggaggagagcgagccgggctggagcgaggacatcgccgccgacgtgggcgaggaatgtgccaagttcggcgagctgcagcacctccacgtggatgctgccagcaagggcttcgtctacctcaagttcgtcgccgtgccggccgccgcggccgccgtccaggccatgaacgggcgctggtttgcgggcaagcaggtcgctgccgtgttccagtttgctgccatgtacaacgcccatttcgggctgtgacgcggcagtgcaaccccgggcggaggaggaggtgattgaggggggggaactgagcgccgcggtgcgcggagaggagtgcaggcggcgcggcaccaggagatgcaagagagtggcgcgctgggaggacatgctgcagtgagatcctccctgtccttgcccctgccatctccccccccaggagcatggagctgtgggagcttggcgccgcatgttgttgcctctcccaaagccccttgcagatgccgctattcagccagagcattcgcctgccttgaacatggcctcatataaaagacacagaatcccctgcgcaggtcaatgtgctcatgaccacccgtccgattgcctcccggtaacagacctgagagagtgccagaggggattggtgcatgctgcctgtgcactggggcaggcggtggcagctgccatgctggcccaaccacaagcccgttgcccatcgaatcaacgcaacattcctgcaggtcctatcccgcaagaggatcagacacagacacatgcaaagacgtgcgtggacccttctctgcatgaccacaccctaccctcagaagagaagctgcttgaattctggacagcatgccatgggagggagaggatgggccttgcgatgcagggagatctggcattgtgaggggtcaagtcggcgtgccttccataccccaagcaaggcatgcccatgccctctccctatcgcctagaaccaggtgcagctgcgaccatgcaacatgtccctccttacagggtgcgacggtgcacaaccatttcatccggacgcacgaatgcacgggatctcaggcaggggacctgcccaggagacccgacgcggccgcctacgtctgaggtcgcgatgcgtcctttgatactcggcgacgcctgaggtcgcgatgcgtctttcgaaactccgcgacgcctggtggtgcctcaaaccccagcatgccatgcagacgagggagcggcgggggtgatggcctgcaagctgtcatcggcggtgcgtgccctcacgctcaggcggtggaccgctgcgggcggatgggcttcctcaaccgctcctgcaccgcctctaccgactggcgcgtcagcaccaggtagtccctgcgcaggatggagtagacattcaaccctatgctgggcagcaggtccacccaggggaggttggcgcaggcccggcgcagaccctcgcccccatcagggccctccgcgctcagatcgctgaggagcacgctgcggcgaggcgcgccggccagcaggccctccagcgtggaggaaagcacgcgctgtgtgtgtggggtgtgtgtgtgggggggtggggtgaggggggaggccctctgtcgagccggaggctgcgtcgacatgcgcgcttgggatcaatccccgcacatcagccagtgtcaggtttcgagcatggggttctgcgcactccgtgttgcagaccagagtctgcaatccccagatgcaccgtctaccaccgcaccgtctttggctgcggaagccgcagggtgtccaccaccagcaatcgcccttcccgcgccttggcctggcgcgatgcgtggggtgggagtgctgagagtcagggtggctacacctgtgcatgactttcgggatgtaacactcacaacagccctgcaagccctgcgtgggggctgggcgacgagctccgccctcatgccgtacatgacaatgatgcctgcaacgcccccccgccctcagcgcaccgacagggcggagcagaggcccagccgcctgatgcgtttgagcagcttgatggcgtgacttcgtgtgacagggccatgcgcgacgccgccgcctcgccactgtggcgcgcggatcgaaccctggcgggaaacgccgccgcccttctggggccggggcttccgcccgccgccccgcacctccgtcctcgtcttggtcttgtgtgtgccctgtgacacagcggggtcagagagcagtgttgtttgagggtgcaccgctgcgtccaagcatgcaccctcgacgattgctggctcacgtacagcagcggcatgttcaggcacctgcaagctgcgacagtgccgacccaannnnnnnnnnccgctggctcacatacagcagcggcatgttcagacacctgcaagctgcgacagtgccgacccaagcccccaagcccctcccccacctgctgccgtgcagcgagctgccagcgcacgacgcggtgcaggatgtctcggcggacctcggtgttgaacacgtcgccgcctagggtgtaggtgcccacctggcgcccgcgctggttcagcaggggaacgaccagatcggcctctgtgccgaaggcgggggtggaggtggaagcagatgcttcctgcagcagggaggatgcggtgcgtcgccagagcagggacgtgagcgccggtggaccctgcactgccacctggagcttggtcgcctgcatgtatgtgggagagggagatgaggtggtgaggcagatgggagacgaattagttgaggcgcgacgtcagtcgacatagggcatcctggcctacctgctggaagcaagcatcggcgacgcgccgggacagcgcgaagcgggccaggctcctcagagccatgacgcttccgggagatcccagccaatgaaccccgaccaggcaacgcgtagattatttgtttaatattgaagtgatagattttatctgcccacaggccagtccaacctcttgtgaatgcacatcgtggtgggagagagccccgagtgcattacaatgagagtgctcggttcccgccacgagccggtaccagccgcagtacactgtgtgcggcaacctgctctgctccccgtcctgggcaacaggtcagcgtcggaggggtggtacctctttccaaggtcttccaacttttagctgcagccggtccgacaacatgggtaggccgcgtgggaggaggtcggaggccatcccctcccgctcgctcggctgcttggacttgtgagcgtgaggactctcttgccgggtgcagcgatcgaccctcccgttactacttgcaggaaaggtgcacggctccctggctcgtgccggtaaggtgcgtggccagtgccccaaggtcgccaagcaggacaagaagaagacgccaaagggccgcgcactcaagcgcctgaagtacattcgccgcttcgtgaacgttggtgcgtatggatgaatctcatgtggcgagctgggggtgcgtactgccgagggatgcatcggcatgcgtggcttctggggatggtgcaaaaattggtgtgggctttgtttctgaggaaaatttccccacgtcctcatgtgcagtcgttggcttcggcaaggctcgcgggcccaactccaaccagcagtagatgcgtcctgcgggtggatataggtgggtgaagaggcagagacggatgtgagtgcgcatgccggcagctgcttccttgggttgaagtctcgtggtgactggcctttgtcttatgtaaatgctcatgatgggtacccctgatgttttcccacaggatgagtctggaatgatggctggcgagtgcccctggtgcatctgccatacctctgcgattcaattcttgggtgctgttttgtaattcagccctttcaaggcctatcgaggcatgcagagcgagggagggacaatggactatgcttgccaggactcgtggatgctcgtggaaggatgtacactggatacgaggtgtcttgttctttgaagcaggaagggatgagattgtgggatgcccacatggaagaggtccagtattagggagagatgtccatcgtgcttagtctcaaaacagggacatcttgacaatgaccctcaaatgctttgccaagtgtgtcgtactctcacctgatgaaagattattgccagccacgcagcccccgcagcagctcgctgcaaggctgccaacctcattgaaccattacaattcagattcacaagatggtgtgactgtgctttgcgcttattttggcggtcctctaacaatctggtgcaacatcaccttcagtgaagggaagctcaactcgatgtgtggggactcccacgtgtgatacggaagggggggggggaacacttcgcccatgcattgctctgcatcctcccggcaacacagttcaatccgatgtgcattttcaatcttcgaatgttgaaacctatacacttaatatgatgcgatgtaggagtccgcgggcaaaaggcagattcgttcaacattgtttgagactctactccgtgacaacccctgacaaagtccgcgcggcattcagccactgcctaagccagttgcaaacacatgattatgagaactatatttgggccgtgcaactccccaaggtaggccgtcgatgcccactcgaggatgtgcaccgttgtgcagcaccaccccaacgcctgcatgcttgttgatgtagacctcatcccggccccctcgcgtcacccactcgaccaggcactcagaccagccatagttgcccttagatccttctacatagagacagaactggtggcagagcatgcaaaatcccagtcgctggtcagcatgcggtgccaggtctgtctgggcaggcgatggggtgctggaataggtgctgggggccatccctgatcctgggtgatacagaaaagatcttcttttgcaaggacgcccatcaagcgccgtgcataccccattcttggccttcccactgtggcttctgcccgcccactcatggcacgcccaccctgccccctccccacccctgtcacccagtggtggcagagcgccgnnnnnnnnnngggtgctgggggtcatccctgatcctgggtgatacagaaaggattttcttttgcaaggatgcccatcaagcgccatgcatatcccattcttggccttcccactgtggcttctgcccgcccactcagggcatgcccaccatgccccctccccgcccctgtcacccagtggtggcagagcgccgtgaacgacctgtacaagggccacgccccagaccaccctgtcatgaccgccctggcggaggtactgcagcaggcgcagctgacgcggtaccgcctgcagcgcatcgtggccagccgggaggaggtgtcggggctgggccagcagccagagagcctggcggagctgctggcgcagctggactccagcctgggccagctgtcccagctgcagctggaggcggcccacgacgcctcccccacctcggcggaagccgcacagaaggtggcgaggggggtgggcctcgccagggtgctgcgaggcacgccccgggatgcctcccggggacgcacaaggctgcccgaggagtccactggccggcacggggtgtccctctccggactggcgcagggcaggccctcgccggaattgtgtgccgtggctgctgagctggcaggggtggccaaggtgggcggggaccggggggaaggactcaggtggagagagtgcagattgaggtagacatgggcagagggacacagggcattgttcaggcctgcgcatggcgacccctcgcattcccaccaggcatatcgctgagccccttcccctcagccgccttgctcccgggaatttcccgcagggcaacctggcagaggcgcgcaaaatgactgccgacgtgccgcaggcgagcaggccgctgctgctccctgccctccatgccagcctgtggctggaccggctggcagccgtggggcacgatgtgtttgaccccgccctccagatctcgccagtctcgcccctggggtaccagcttcgcctgaagtgggccatgctccggcaccgcttctgagctggggagcagtgcggccagatgccaggcaggatgaagaaaggcacactcatgaaggtgcccagtgcgtggttacaagtttcttctctgccagacgcggcttggaaagttattcacatgcttgccatgcatgcaagaacttggtcaggtgcttgcgctcagaggtcgacggtggtaaagacataaagcacggcatgggtgggtgttcttcccagatgtttgtgattctaatgcacatacacttgcttgaacacgagccactgccgtagtatccgcaaaactgcatgagatccatttgttcttggcacgcaggctgcactatgctgttgcacccacaacttcagcctcggtgctggggaggtgtccaggacggggcacccatcccccgttcctcttctgcctagtgtgacagctttacagagtcctcctcccctttaggagcggcatcgtcacgcaatatgtgcacgatacggtccagcaacgggaactcattccagatccaatccagctggcacgtcggcgaaatgtaactgcaaggtcggacgttggagaggggtgagtccggcatgcctgtcccacatatgtgtgggcacctacgccctgccccaagcacaccacttagaagccgccgatcctgccccactcacacttcgacgtccaggttctggagtttggggagctgcttaaggggcagcagctcctcgggcaagaggtagnnnnnnnnnntttcgacgcccaggttctggagtttggggtgctgcttgaggggcagcagctcctcgggcaagaggtagctattgaattcgccgctgaagtccaggagaccggggaatgccctggccacccagctcagcacgcctggccggggattttcgaccaagaccaggctgcgtacatgtgcgcaggagccggccgctgccacgcgccgcatccactgtgcgtcggcgcaggtgtcgaggcgcagggacctcaggcttcgcatgagcgggatgtcctctgggtgcgggcggaggccctgcaggctcaggctctccagggcctgcaggcgccccagccccgcaaggtcccgtccctgcaggtctcccagccctgacgggccccagtcccaaggtgcttcccactgacaggtgtgcacctccaggcggcggaggtcggtgagcatgcccagcgcggccaggtggcccgcacaaagccccacgcaatactggagggtaagctcgcgcaggccgcgcagctcgcctaacgtggcagcaaagccgcttggttggacggtgtggcccgccatcgcggcagcaaagacgttcggcctaacgacttggcccgccagcgcgtcggggacggcggctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcaccgtcagcgccagctcgtgcagcctgggcccacaggaggccatgaactgaagcagcacctcggtgcccggctcggagtcgcagccaaggtccagcgcctccaacatgggcaggcgcctcagcagtgcagccacggcatccccggccccctcgcctgagcctagcttgcagccaaccaggcgaaggcgccgcagggagggaaaggagagcagcaggccccaggcatcctgcccgcccctgcagtgtgagaatgagggtgttgagggcttcatctcacggttacgtagagagaagggtccggaagcctctcggaggccccctcactgcctccggctccaccacctgagtgtgtgtccagacgtggcaatcgcacaattttaacagcagaaaggaaggtttctcctcaagccaggcgcacatggtggagatgccagtatatgccaagtccagctcttccagtagaggggcgcacaggctgtctgccagacattcaaggaaatcgttggtaaatccacggctgttctccatggaaaacgatctgcgacattacgatgagaactcagggtggaggttgaagggaaggtattggtggatcttctcagacagaaaactcggtcagagtcagcaacatttccttgtccagtccctgcacacctcaggctccccaggttgtccaacatggcctgcagggagctggggtggatcccaaggccacaagtctccagtttcaggaccacaaggcggcggagccgacccagagcctgcaaaactgcttctgcgatgtgccctccgcgcatgtggactgtcaacgacgtcaggagggggcaggcatccaggctgagcatgaaatctccctgcaggtgattacacccatcgacatccaagtgccggagttctggcaggtgcctgaaagtaggggcgaggaagcagggatgtaccagaccgccagaagatgttcaatggatggtgaggtgcggagggatcatgccacaaaccacggcaaacgcgggcagaccctgcctttaataaccacatcgagccgcagtgaacccaacatgtcggaatctcaagggtccaaacaatcaatgcagcttttatttagccttccttaggagcactctgcggcttcctcctatcctaccgcacctgagcagcgattccagggcctcattcgtgacatccatttctctgagggacaggcggcgtagatggacgcactgctgcaggggtgaaacatctacagtgcggcacttgtcggtcaggtgaatctccagcagcgtgtgcttggttgctgcagattgcaggggatgaggaggttcccttcagtatctcttgatcgcttcaaactgcttaatcaatgagcgatcccctcaatgcttcaaacctttgatgagtgaccacctaccgtgcactgcacgagccagctctttggatgtcatgtgaaaggctcgcgcgccatagtcgatatgtcgcacgctgttgaagcgctcatatgcacagtcacggcccttcagggcagcagtgtgggtttgtgtcgccagcttgtcacgaagtgtcaattgtagctccggattatggacccccgacagctccaattctgcccaatctgaaagccaccccacatgagaccatgcccttcgacgcacccttgggtataggttcgggcatttgcctagaaccacatagtgccaggtcttgcaagtctggctaatggaggcacacgaggaagggatgtcccacatccatccaaacacctacggagaggggtcggagtgaagtgttggccccggcagaagcgtccagagatgtgttgcgaaacgaaccaccgcttgtgaattggttctgtgcgttatcataccggccgcacctgcgccaacagctcctcggggagctgggtccagtcgggtccacgatagatgtgcgagtgctcaagaggctcgacagcacccatgccttctcggtagttgtgcatgtacgatatagcgtatattctgcagatttaagcgcgttgtaatggaattagatgggctattggaggagggcctgtcttaagtccaggacatcaacccctcaaaacgaggtccggatccctgccagatctctcggcggatgaccaatgctgtccggaacctcagcttgcccctggtgtgcacatttccacatcccgctttcaccaaagccctcattccatgtatcgcacatggcattggatggatattgagtgtattgacagggcccagtgaggacagtcctcgaattggaagatctgagaagcctggcaatcaccttgaagtgtgcacgggaaatgggttccccccgtaaatgctttgatgtacaggtgtaccctcaatcatgtttaccttgatgtcacgtgcttggattgcatctgatgttgatgacgttccataaatcatggaggagctccagcgtgcaggggtacaggcctgctcgaggtgggcctagcaacagggccagaaattcgcactccttcaaggtccaggtccttcagcctgttagaattcgggagagctgatgacagagnnnnnnnnnnagtaccggcctgctcgaggcgggcctagcaacagggccagaaattcgcgttctttcaaggtccaggtcctccagcatgtttaggattcgggagggctcgtgacagagtgtgttgagggctcggccatgg

SEQ ID NO: 30404 - DNA, 61 bp, Chlorella protothecoides
ttgtacatgattcaagctccacgtacatgagtcaagctccacgtacatgaatcaagctcca

SEQ ID NO: 30405 - DNA, 80 bp, Chlorella protothecoides
acccttggtaggggcacctgctgcgggcaatgggtaagtacattccctgtgtgctccattgcaccacctcaccctggcct

SEQ ID NO: 30406 - DNA, 61 bp, Chlorella protothecoides
tcagctcaaatggagtgtagtctgcattgagtattgggtgtttggagggagctggcgttat

SEQ ID NO: 30407 - DNA, 179 bp, Chlorella protothecoides
gtcagtgggaggagggaggctgcccatgggagagagtaagcgcaaagtacaccatatgcctcgatcatcatcgtcaaacccaggtgctccaggccagaggcacgcctgcagcatgaacaattccacccgcagcatgggtgtgtgcaaacagtcaactcacagtgagtccacctccttgg

SEQ ID NO: 30408 - DNA, 108 bp, Chlorella protothecoides
ctggagctgccgctgcgcctgcgcgccacgcgccgcatgcgcatggacacgagcactgatgccaacggggcgcgccgacccacgctgcgcatggtgccggggtcgagc

SEQ ID NO: 30409 - DNA, 61 bp, Chlorella protothecoides
aaccccgcaaggcctgtgcagcagtgcacccagctcatcccaggaccccatcgccccccgc

SEQ ID NO: 30410 - DNA, 85 bp, Chlorella protothecoides
ccaccgtcgacatagcagaaggtaatggagcgggtggctgctgggtgccactgggatatcgtactgtttgatacgtggcctgcgt

SEQ ID NO: 30411 - DNA, 74 bp, Chlorella protothecoides
tggctggtgtcccatatgatgcatggaaccgccccgcctttcccgttgagcagacatgattgacagtccagcca

SEQ ID NO: 30412 - DNA, 143 bp, Chlorella protothecoides
ggatgcatcgggaaggggccgcatggcgtgcagagtgaagaccttgcgcctgtgtgctgtgctcggcgcctccctttcgtccatatactctcaactatacaccaatacacgaaacagcgggagattagcagaccgattctcct

SEQ ID NO: 30413 - DNA, 129 bp, Chlorella protothecoides
gcaaggtagacatcctttgccatggcaggggaggcacctatgactgctcaaacgagctctttggtatgcgagcgctcttgtcacatgctggcaacccctgtcccaacaattcggagagccgttggcctc

SEQ ID NO: 30414 - DNA, 64 bp, Chlorella protothecoides
agtgctcaaggtgggtgcacagcatgatatttttggtgtgctgctaatgatgggctcccaaccc

SEQ ID NO: 30415 - DNA, 61 bp, Chlorella protothecoides
gaactggaagagtgccttcattgggacgttaccatccactcagcctcgtataatttggatt

SEQ ID NO: 30416 - DNA, 61 bp, Chlorella protothecoides
tcggcgtcgttgcatgcagggatttcatggatgtacaccaaatgtgcgtaattttcacgta

SEQ ID NO: 30417 - DNA, 96 bp, Chlorella protothecoides
gaaggcgagacatccaagcccgcacgtactccaacacggagctcgaatggcccctcaagacatcacaaacactgtacctgtggtgccatatgggga

SEQ ID NO: 30418 - DNA, 79 bp, Chlorella protothecoides
ccatcccctcatatctcctccgcctcctccggcgcgctggtgtgctggtgcccccgctcggcatcgacccgccgtcccg

SEQ ID NO: 30419 - DNA, 103 bp, Chlorella protothecoides
ccagcactcagcgcccctgagtgcccaggcgcaccccctgagtacgcacccacgccggtcgcaggaaaacatgctccgtgtctactccaagaacagtgcgccg

SEQ ID NO: 30420 - DNA, 66 bp, Chlorella protothecoides
tgcacgggaatacccttgttcctctaccgggcttgcgccggttgctcgcagcttcttcccgcaaac

SEQ ID NO: 30421 - DNA, 155 bp, Chlorella protothecoides
gtgaatccaggagctcagataggatcctgccgccggaaaggaaatccgctccacagaactcgacagggcaacccatcactctctccagtcggtggagagctccttgtcctccctctcctcccaccaagtcttggtctgcggaatgagcatgcggc

SEQ ID NO: 30422 - DNA, 74 bp, Chlorella protothecoides
aaattgcccctgaatctcccactcccttcccttctccatgctttagtcgcgaagatcccctggccgggctggcc

SEQ ID NO: 30423 - DNA, 61 bp, Chlorella protothecoides
gagcggcggcgcgacaggctcgtccgccccccccgctggctggctctgtcattctctaccc

SEQ ID NO: 30424 - DNA, 104 bp, Chlorella protothecoides
catagagtagtattgtagatgcctcatccctgatggcaggagatccgtcctctttgctggcaaatcccctcaattcacatcacgcacgatgcagggacatgggg

SEQ ID NO: 30425 - DNA, 61 bp, Chlorella protothecoides
ggcgcgtgtggtgctgcccgagggcgtccctcgctccatccccgggcagaagctgcatagg

SEQ ID NO: 30426 - DNA, 67 bp, Chlorella protothecoides
aacaagattagtggacacgatgtgctgccttgtgtgcatgcatgtagcttgctgtagtcactcctgc

SEQ ID NO: 30427 - DNA, 74 bp, Chlorella protothecoides
atgcatgtagcttgctgtagtcactcctgcagacatgcgtcagtgctgtgcagagtcacctggagagccgcatg

SEQ ID NO: 30428 - DNA, 96 bp, Chlorella protothecoides
ccccccccaaaaaaaacacacctgatcttgtggccctcgtccaggattacgtaaccccagtccacgctcagcagcagctcgcgctgcagccgcatg

SEQ ID NO: 30429 - DNA, 61 bp, Chlorella protothecoides
gcacattccatcttgggtaacacttgtaagcagggtgatgtcggctgggtcaccttgccta

SEQ ID NO: 30430 - DNA, 67 bp, Chlorella protothecoides
taatcccccatgccatgcacgctgtgagcccgatgcggggcatgtggctgacaagcgccaccctggt

SEQ ID NO: 30431 - DNA, 61 bp, Chlorella protothecoides
cggtgatgtgcaggagcggtgacggcggggggacaatgacgatacggggcactgcctgcct

SEQ ID NO: 30432 - DNA, 65 bp, Chlorella protothecoides
ccaagaccttgcgagactgcctctcctccggcaagtccagcgacaaattgatgaactgttcgtcg

SEQ ID NO: 30433 - DNA, 102 bp, Chlorella protothecoides
ctgccaatgtgagcgatgcgggggggggggagtggggggcatgtggcttgggaagtaccacactgcaggactttcgaggtaccctcatgtgaggcatcccgg

SEQ ID NO: 30434 - DNA, 103 bp, Chlorella protothecoides
tgagtggaacgaagggggcccacaggcatggctgggcggctacgcaggcgcgcaggggagccggggaccggcggagggccagaggcggtcgtgggtcccctct

SEQ ID NO: 30435 - DNA, 6208 bp, Chlorella protothecoides
  modified_base (1584)..(1593): a, c, t, g, unknown or other
  modified_base (1822)..(1831): a, c, t, g, unknown or other
  modified_base (2196)..(2205): a, c, t, g, unknown or other
  modified_base (2426)..(2435): a, c, t, g, unknown or other
  modified_base (5183)..(5192): a, c, t, g, unknown or other
gggcgaagggcatgatcaaggctgggcatacatttttttggggggggagcgctcgaggccaacagcagtgaacacatactgagccatgcgctgagtctgaagctgggatcaggcacccccctggtccagccgctcacatgaccatgtgctcgtagccgacgccggagcgagacttgatgacggacagccactgatcggcgaagaggaaggggccggagggcatgccgacgatgccgggcgcaccgtggtcgctgcatcagggtggaaggaggcttgggtgagtcgcggcatggtgctggggtcagagaaaggctccgtgccgagaaaagggataggggccacggcaggacacatagctgtcaagcagattgcccacatgccgctgccgacaggtatttgaatcctaggatccctgaatacaccccactcacagcgggcagcgacattcctgcctcacctgtagtagacaaagacatggtcctggggcccgctttccagcacccggccgttggcgatgctgctgacctcgatgccggagcggttgccggcaagcaccgccaggaagttcagggcattgactgcggtgccgctgtaatcctgaggtgaggatggaagagggtacttgtacacaatgtccagtcctgcctctgaacgtgagtatgtgttccatccatccacatggcttgcccagtcgtgcaaaagaagctcttgcccaggcggcttaccacgcggaggccttggtagacgtctggcccaccaggcgcgttgaacagcttgttggggtgggggttcatggggtgccgcgcgacgtcatcgaacatcatgacgataatcctgtcctccttgatgccgccgcgaaggagcacctggtaggcctgtcccgggggagaagggggaggggtaaaggggaagggttgggtggagtacggggttgatgctgaaacagcgacatctctcccgactcgatggcccagctcctacatgtgcgacatcagcctgatgtcggtagttcccccagccattgctcccggcgatcagcagcgcccagttttcccctgcaaaagacgacaaatggggtttcgtgcaggatttaagcgtcagcgtcgggtgattggcatcactatacgcgtatgaattccacacccgcagacgaaactgaccctgggtctcatttgaaacagaaccctgcagcaaaacggcattccgcccgtccgctgaggcccgagcgatatccaaggccaccagggtaagtgcgaggataagctgctttcgcatcgtcgcgatctatgctgaggctttcaaagtagatttctggaccttttcgtgatcgtttgcgtgtcgcgatgggtggcgaggtcatcaaatttgccaggtccactcccagtcagctgcgcgcgctccgggatgcccccagcgttcagatcacattctcccagacgcctcgccggtatggattggaatctcgccgctctggccacactgatgcgatactcagatatttgaagtggagtattagcccgaccagggctcggatgtgagatcacaggtatgtcgatgaattttgaggcctccatgaaggcatgnnnnnnnnnncatgaagtgtagcattatcccgaccagggctcgaatgtgagatcacaggtatgttgatgaattttgaggcctccatgaaggcatgaaggggtacaacgacattcaccaccatttcattcagcttctctacaagatactcgagctggaggattttctctgcacaacttcatgcgctcatcgtgccttgtgttagcagggcctgatcggcaacccaggcgcccacagccgnnnnnnnnnnaatactcgagctggaggattttatttgcacaacttcatacgctcatcatgccttgtgttagcaggacctgatcggcaacccaggcgcccacagccggcatgctggtggggctgatcagcgacacacatggtgtctgcgatgaccaaatcatccacgccttcagggacgcgggcgtcgagcatgtggtccatgccggcgatgtcggccatcacggaggccatgcaggtgggaactagcacctacgagatgcacggcacaaggccagcattctaagcatggtagaggatctcctgctgctgtgcgcagctcactctcatgcagtcctgcagcctcctgtcactcttcgcacccatgcagaggtgctnnnnnnnnnnagatctcctgctgcagtgcaaagctcactctcatgcagtcctgcagcctcatgtcactcttcgcacccatgcagaggtgctggaatggctagcaccaattgccccagtgacggcagtccgtgggaacgtggacgatgggccagacgttgacctgccacagcatgttgtgctccgcctggccggctggaccatgctggtgctgcacatcgccggcatgccgnnnnnnnnnncgggaacgtggatgatgggccagacgttgacctgccgcagcatgtcgtgctccgcctggccggctggactatgctggtgctgcacatcgccggcatgccgcccaaaggtgggaccctcttggatggggatacgctgggcccttccccgctcggcatggtaccttggcagcctagtctagagtgcgggtggaaaaattgctcacttgcatcgtctgagccccttcctttaccctccctggtccggcagtctccaaggaagcacaggcgctgatcgctctccatgacccagagattgtggtgaccgggcacagccacaagtactcagtggagaagtgcccggcaggccgcctcttcatcaaccctggctcagcgggacccgcccgcttcaagctgcctcgctccgccgccatcctggccctcacagagacacaaggcgaggcaaaaactgattggaagaagttcttggcggcctggcaccgcaagggtagcctcttcattccatgctggcctcattgtgtagtggtgccaccaatcgcttcacgtccctgtacccccacaccacttcccaccacttcaatgaccctctgcagatacattcccagacccagacgtgaggtacattgcactccccgcaaaagggccagcccgggccacaggcgcgacccgtggcgccaagcggaaaggcatggggcagcaggcgcagcaggcgcagcaggcgcagcaggcgctgcgcccccctacgcggccccggccacggccgccctcttgaagtggaggggggccctgaggaaggccggggtgtcggggacgctgagcgcgcagcccacgccctcccaggcaccgccctggcgccccgcccgccgccccgcgtagtagagccgccagcgccccgccgccatggacacgggccaaggcgcgcccacgcccccctcgtcccaggcgccctcgccgcccgctcggaggatggggtccggggtacgctgccagtcgcccagaccgtcgggcgacaccgccaagccgatggagcgggtgttgtcggcggccacggcctcgtagaacatgaagaaagcgcgggaatccaggtcctggactacgcagtgcgccgtcgcccccgcggcgtcatggccctctcctccctggcgtggaaaggggggaatcaaggtgcagatcggactggctgaccctcacgcccgaggaggccacagaccaagcttctgcaagcaagctgctggcccatcatccctaccaccaccactcccaccccacggtacctggaagatgggacccgtcttcttccaccgaaacccgtcctcggagcgagccaggccaatcacaaagcggcccgagccctcgtcccacgaatagtagtacatcctcaggtcgttcgggccagccgccaccacctgcgacggcggggcgcacccgtggcgtgggaggcggaaattttgcggcagccttggaacatgccatcccgtgcctcctacaagctgcaaggagccacaatgagctcctgcgttccttgctctagcaagcaaggcgatgcaatccctgggaaaccccggtccggccacctgcggcccggcgatgaaatgggcgtcccactcgcccgattgacccacggggagcacggtcccgctgggctcgtcggaggtctctatcctggcccacacccgcgcgtttggcgacatggccagccccggctgcgtccgccagcccttggtcagctcgccggcgccggcgcccaggagccgcgccaggcgcggcggcagcggcgcctcctcctgcgaccctccggccgtgaacatccagtacacgcccgcatcgctcctgcccccctggctgtcgcccaggatctggacgtcggagacgctgatgtggcgcgtgtcgaaggaccaccagtcctcggcgttggggcccagcactcggccgacgtccgacgtcgcgggggcgcccctctcccccgtcacggcctccatgctccgctgccagcgcagaccatcctgggagaccgccaggcctgtgagaggggtggcgggagggttcaacaaagctggcagcagccgttgggggtgccaggagcaggctggcgtcgctgggatgagagaacctcaacccatgacgacacaccgtgcccggactgcatgccacgacccatgcgcatccccaacaaggaacaattatacacctactcctactgaaagcccggagtcgtatcggcatagagcatgcatgaacacagagccaagcctcaccgacgctgccggatccagggaagagggcgtccacgccagggtcatcctcggtgctatgcccgctgtgccacatgtaccactgctccctgccctctgacaggtaaaatcgcacgacgggggtgccaagccctccatcgtcccacgctcccgggtctcctgcgggagatgcgagacgagcgaggtgttgggctctgtagatctgtcgagcaatacttcacaccctcaccagcccaggagcaacatttcacctttggacatgacccgtcccgcagtctttaaaggggcagatacgcttgcacgtggagcgaggcgacttggacgcggctggggccgtccatggcgcccatggctgacaagcctgtgctcatgtgaatggctccatgatcttacagacaaactcatgctcgagggcactgtgatcgccgccatcctgagaatctttgaatcagaatgatggtaatgctgattgtaatatcgatatggtggagaccctagnnnnnnnnnnatctttgagtcaggaagatgataatgctaattgtaatatcgatatggtggagaccctagagctgggtccggtgttgaggagagtgggattcgactcgacatggcggtctatcttggtgaccccatcgcgccctgggtttgatccatttaaaatgggcatcgcaggttgactcttgaaacgcagtgcaaatgcagtgcgcgccgaactggagttacgaagaatgtgaaatgtcgacatacaacatgtttgcgccacgcagccccgcttcgagcgtcaccagtctcggcagcgtgctcggtgccgagggccttgacgacatccttttccaaggcccagagacagaccacgggcaggcaattcccgagaaggattttactctccgaacaaagcgatgggtgctggatgacatgtcgggagctcaaccggaatgcggaacgaggatgccccaggcgggggacagctacgaggagaatgcagagcccaacacccagcaccgcagagtatgcgagttagggtgcatatttatgtggtgacggatatctcagctccaggtctggggccaatatgtcttcccattctcccacagaccgctccctacatcagcaccaagcctgctgccacttacaatggtgcggccagctcagaggtacgggctctacctggtggggcaccccatacagcaaagcacttcactgcttgcttacgaccgccaggagcggcaaccgcttccctgccccccctaaaccgcaggaggttctgacgaggcgcataacccagctggaggcccagcttgacgacgccctggcgctgtcggcgcggcagcggctggagctggaggccgccgaggccaccgcggccgcgagtgcgagctccgccgccgccgccgcgcgggagcgggcgagcagggcggaggccgagcgacaggcgaccgaggcgcggtgccgcacgctcgaggccgagcgggaggaggcggctgctgcctcgcagcgccaggccgagcggctggccgcgctgga

SEQ ID NO: 30436 - DNA, 70 bp, Chlorella protothecoides
agctgtagagctacggctcctcttcccttttggggctggttagtccgggagtatggcgccgaacgcctcg

SEQ ID NO: 30437 - DNA, 92 bp, Chlorella protothecoides
ctgcgccccccgcatgggctgggaatgttattgatctcgtcttcggggtaatggcagtacggggggggtgcttctgcacgagcagtacggag

SEQ ID NO: 30438 - DNA, 73 bp, Chlorella protothecoides
gatattacatccatatagttgccagtggacgggtcaaggtcccttatgctcctccgccgggccctggccgtgt

SEQ ID NO: 30439 - DNA, 61 bp, Chlorella protothecoides
gtaatacagccgaccgaccctgcgggtttcacgcacctgggatacccctgactgactccca

SEQ ID NO: 30440 - DNA, 119 bp, Chlorella protothecoides
cgcctgctatcgccgtggtgatgaatgtcccaaagtccgcgatcaaatactcatcgatcgcactcggcacagaagctggcattcgatgcacgcaaaccagtatctcatattcttttcca

SEQ ID NO: 30441 - DNA, 72 bp, Chlorella protothecoides
gccatctgaggcctgtggggaccccacctccctctcatccccccccacccccaccaatgcacctgcttggtg

SEQ ID NO: 30442 - DNA, 95 bp, Chlorella protothecoides
acggcatgctgcttgcagtccagtctgactcacaaacatctcgccgcggccccttgcccccttttcccacacacccctccctgccgccatgccag

SEQ ID NO: 30443 - DNA, 97 bp, Chlorella protothecoides
caacgcatcccaggcggacgccgtgtcgcgagtcctgcgcagccccttgtccctgatccagggcccgccgggcacgggcaagaccgtgacctccgcc

SEQ ID NO: 30444 - DNA, 139 bp, Chlorella protothecoides
cgctgacgaggagctgggcgaagacgtcgcggcacgcattgccaccatcgaggtacggggtggctgggaggcttgtggcagtggcgccagctggtagtcttgcatcacacagactgggcccaggctggcctggagaaga

SEQ ID NO: 30445 - DNA, 71 bp, Chlorella protothecoides
gccccggagtcgcggtacacgaggaggagcagcggcaggcccggcacgtgcgcagcggtggccagggccac

SEQ ID NO: 30446 - DNA, 80 bp, Chlorella protothecoides
cggtcgagcaatttgctagatattttgacactcgaaagccacgcgttaaggaggatctggctgaatgtcggcccacagcc

SEQ ID NO: 30447 - DNA, 141 bp, Chlorella protothecoides
aaatgcatgtttactgtacagcaaagcgatacttggcttccttgggtgtcccatggcaggccggggcagggcaggatgacaggtgcgacaggctcgagcacgccttgatgattctcatgcctggccagtgcccaatagctg

SEQ ID NO: 30448 - DNA, 61 bp, Chlorella protothecoides
cttcacccatcccccaggaactgtgagggatgtggcagccctacagcactttgtgcagtgg

SEQ ID NO: 30449 - DNA, 139 bp, Chlorella protothecoides
gtgagttccgggatgcgatcagcggccatactttgacttaagtggatgggagggcactatgagaggccctggcgctcacactatgcggtggtgctgtcacttgcacttctgcccccacgccgtcatccggctgctcccg

SEQ ID NO: 30450 - DNA, 438 bp, Chlorella protothecoides
  modified_base (118)..(359): a, c, t, g, unknown or other
tgcccccgcacgggtttgtggcctgcgctctggatatcagacagagccacaatgaacgaagcgatgcatggcctgcgcagtttctcattgaaggcgtaatttacctgtcttgaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcgttttgctatccgcaggagcacagcgcgtatgcactcaaacaattcagcactcctgcatggtatgtaagtggctg

SEQ ID NO: 30451 - DNA, 77 bp, Chlorella protothecoides
catgtcagtcaagcatcagagcatgcgtgagactgttgcgatcatcttcatcctggcaatgcccacctgcagtgatg

SEQ ID NO: 30452 - DNA, 122 bp, Chlorella protothecoides
ggggatggagatggggtgggatgtgcgagggagggctggagggcacgccgctccttcattccgacatgtccaggcacagaagcgatatcgaccacgccatctctgactgcagtgcgggcact

SEQ ID NO: 30453 - DNA, 61 bp, Chlorella protothecoides
ttcgcagacctcatcctgccccagaaaaccacccccgccctggacaccagcaagtggcccc

SEQ ID NO: 30454 - DNA, 80 bp, Chlorella protothecoides
ccagggcggagaaggaaagcggggcgctgtgggattgagggggtgtggaacgtgtggagctttggggaaggcggggaggg

SEQ ID NO: 30455 - DNA, 77 bp, Chlorella protothecoides
cactgcgggagcatgctggctggaggctcaagcgatgacattttctcgcctcgctgcccaacctcccacctcagggc

SEQ ID NO: 30456 - DNA, 61 bp, Chlorella protothecoides
cgtgtatgctccttggcaacacgcggtcccacttacgactgcatgctgatgatctgggcgc

SEQ ID NO: 30457 - DNA, 61 bp, Chlorella protothecoides
cctctatcgatgcgtgtttggggtgcgcaacccctgtttgggtcatgggcccagccctgct

SEQ ID NO: 30458 - DNA, 105 bp, Chlorella protothecoides
tcgtgttgtttgccgtcggcatcgcttgagggacgcctgtcagccgcagcgccgctgtcagtttgtatttatatatcggggcgaaccccacatgcgagtcatgca

SEQ ID NO: 30459 - DNA, 73 bp, Chlorella protothecoides
tgtgccgtgctttcttacttggggaacccgggtgttgcagggtgcccgaggggacgggcgtgcggatgaggtc

SEQ ID NO: 30460 - DNA, 80 bp, Chlorella protothecoides
gtcgctccgacattgggatacatgggcggttacgcatggatggatgcagtgccttgggaccaggcaacacagggaaagat

SEQ ID NO: 30461 - DNA, 15550 bp, Chlorella protothecoides
  modified_base (775)..(784): a, c, t, g, unknown or other
  modified_base (1822)..(1831): a, c, t, g, unknown or other
  modified_base (2253)..(2262): a, c, t, g, unknown or other
  modified_base (6701)..(6778): a, c, t, g, unknown or other
  modified_base (8018)..(8027): a, c, t, g, unknown or other
  modified_base (10836)..(10907): a, c, t, g, unknown or other
  modified_base (13171)..(13228): a, c, t, g, unknown or other
caagctgaacaaggctgtgtggagccaggtacgcgaaggaagatggtagtatgggccaactctggggcaaggggtggtgcaagcgggggcggcatgcatttccccaagggtgcagagtgagcgcatgtgaccggaacgatgtggtgtgtggcagagttggtgatggcaatgcacaatgtgctacatcattcgctgtatgctgagttggaagaatgttagggtggcaaacggctgccgacggtggtctgactcgcccccctgactctcccttcctcgtcctgtccccgaacagggcatcaagaacgtgccacggcgcctgcgcatcgtcgtgcagcgaaagcgcaacgaggacgatgatgacaaggtgggtgaccgtgtggggcgggaggcaaaggtgcggcatggacggcgcttcgcctttctgctgaccgcaggcctcaaggcacgctctcctccctccctcatggacactgcaggagcagctgtactcttttgtcaccctggccgacgaccagaacaccaagggcaagggcaccgtcctcctggatgcctgatcttgccgccttcgccgtgctttccttctgggtgcccggcctgtaattcgttcgcacaagggtgcacctgaagtgggtgacaggcggggcaaaccttgaggcctgggaggtgggacgctacgagcgttcgcccaaactgaacaagctcggcgaaagagcgcgtttcaaaggcagttttggtccacttgagaagggcatgtgacagccttggcctgctgagnnnnnnnnnnatgggacgctacgagcgttcgcccatactggacaagctcggtgatacagcgcgttccaaggcagttttggtccacttggaaagggcatgtgacagccttggcctgctgagcgccatgtctggtgtgggagttgcgttgtaggacacccgacatcgaggcccttgggagtacgacatgtcttccctgctcttgcaccatgacgcgcacagactttggcccaggagttcgccagcagattgacgaaagcatgctgccaggccacaataggccgccccgcgccttccagttaccatcgccgacagcactggcgtccaacccagcaccccctggagctgccttcagacccgagaccaaagattctcccatccccacctcattcctcacctcccgcattcccctcacgctgccactccccgcaccccgatgcgacgaggtgtgcggtctaccccctcgaccacccccccctttcctggactgagtgcgttacaggggcgaccagcgcgggtccgggggctcagaagcgcagcttggtgaagaaccacctgttcttcccggtcttgaacttctcctccagcagggccttggcggccttgttggcctccttgcgcttggtggagttctccagcgcctcgttgctgaccacgcccttgagctccaggtccagcgtgtagcgggtgggcatgaggtgggtgtagttcacggccttgatgaaggtcttcaggctggagcgccgggcctggaccttgagggagctcttcttggtcacctgcgaggagcagagaaagcgggggggattcgggccaggcatttgcaggtcctgaagattcacaaaccacaagtttcccggctctccttgcattacagcgcacaaccattggagcccatgggtgggtggccagcccaggaaccagctcattgcaaggggccagccatccgagaagccctcctcctccccagcccgtcccgccctgcttccccgattgcgcaccttgcgcggctctttgctcaggcccagcacgagggcgtggccgtaggggnnnnnnnnnngagatgcacaaactacaagatttcccggctctccttgcattgcagcgcacaaccattggagcccctgggtgggtggccagcccagtaaccagctcagtgcaggaggccagacatctgagaagccctcctcctccccaggcccccccgccctgcttccccgattacgcaccttgcgcggctccttgctgaggcccagcacgagggcgtggccgtaggggcggctggacgcaccgtcatcgaagttcttgacgatgacagccttcttcccggcgtgccgcccggtcagaaggatcaccaccttcccggactgcaaaaacgcattacggaggaggtcttagtaggtattgggatgctacacggtgcatcctgcatcctccccgacacgggaccagcaccctccggcgccgggggcccagtcgccnnnnnnnnnntgcattacggaggaggtcttagtgggtatcgggatgctacacggcgcatcctgcatcctccccgacacggggacctgcaccctccggcgccgggggcccagtcgccaggtgctccagggccgtccgcgcccttaaccgcctcccacgcaccttcaagaacttcaccatggctgctgtagctctgcctgccagactccagcacggaaagagacagggcgctggccgagtacagtgaaatggccgccccgagcctcccgggtcaattgggcccccagctggcacccatgccccttcgcagtgcaaacatgcaggtgaccacgaggactagtcacatccatctaacgccctgcattgtcactgctgaggctgcataggtattggacttaatctcgagataacaggctccttgtcggggggcatgctgccctcttgcggggtggggcagaggcacgctgtccttctcccgcagggccctccccatgccagcatcaccctctgtcgaggagtacatcccagaccgcacctcccgtcctgcgctggagtagggtacgatgggaacagacacagcttccggcctggacccccacctcggcccaaccgtgccagcgtggcacggccagctggtgacccggatgtcgtgtccaccgctcccgcccccccctcgaaggggggcctggcccagcgggtcatctccggatccctgctggcttcactggccctcgtcatgatcggtgccgggggctggcccttcgcgagcctcgcctgcctggctgcctggcagtgctccagggagtacgtgggcctgctgcaggcctccggcatggcttccggtatggaaccccccagcaagctgacgtccagcacagtgaccctcttctgcgtcgccctgaacgtctggaccgcggcgtcccgagggagaggcagcacgcccctcgccgttgctgccttctgcctcatgttcatgcagctcgtggatgctcacaagccgcgcttcgcccagctggcgtccaccgtgtttggtctgatatactgtggtgaggagggaggaccatgtttgtcggtgcggagggagaggcgaggggcggtgacagggcaggcgtgccatggcacccgccagctcctgaccgccgtccgccccggcgcatggctgcgcgtgccgcgcaccgcgcgcctggatcggtctgatccccctggatccaactgtgcgcctgacgcatgcgtgtggtcctcagcctgtcaaggctgtcaccgaccaagaggtcttcctgatcctcggccctgcagggtacctgcccagcttctggctgaggctccggatgctggacgtgccggcaatcaactcgcagcttctgcacggctggccggtgggtcacatgtggatggaggtcgtgactgggtggggaggacctcgcatcgctctggggtgtctgatctcagcgagagggctaccctgagccatggttgctggctgcccgtgccacagtccctcccacccgtgcctgctcggtatggtgatcccccacagggcaaccccgtatctcctgcctgaggccaggccgctcaattccaccaccatcccatgcacccccacaggcctccctaggggggttgagccacgtgacggtcggcctggtggccaccctcaccaccgtggcatgcgtggtgggcgccgacacgggggcctacttcacggggcgcgcctttggccgcacgcgtctgcacagcatcagccccaagaagacggtggagggggcggcggggggcctggtggcctctgtggccgtggccctggcctcctggcgcttcctgggctggcccagcggcccggctcaggcggcgggcctgggcgccctcgtctttgtctcctcagtggccggagacctgatagagagcgtgatcaagcgtgacgcggggctgaaggacgcctccaacctcatccccgggcatggcgggctgctggaccgcctggactcctacctcttcaccggcgcctgcgtctacttcctcatcacggctgtgctgccaagctttggagtgtaggctggccaggctggcgccaaataccgcaccgggggccacgcggaagcaaggccgggagaccgtggtccccctcgcgcagcgaggacgactcccgcagccaaccctgaggcgcgccgccctccaccccgctggcgaggcgctcgccgcggatccttgtcatggggctccctagctgtgccgcatctcactgaccgaataacacgtgaaattgatcgtttcaccgcgacggataggggaccggttgacgccgcaagaggtaacatggtccggcacacaaccaaggaaacgccgctccactcctgctgcgcatgctggggtcgccccttccagcaggaaacccaaacccacggcccggctgctcccaccagttttgatggagggattgtacggcagccaaaccatacgattcgaccttggatattctgcccggggccagtacgcctgacctcacagctccgcgacacagagagactccgacgggccatgtcggccgctgccttcttcaggtcggcaccctgccagcggaccgggggcgagccctcctgcagctatgctccctctcctcagcgagcatcgcatcgccgctccgctgcacgtccccgccctgccctgcgcgcccgggcttccgcgggcggcctgtcttacaaggacgccggggtggacatcgatgcagggaacgagctagtccgccgcatccagaagctcaaccccaacatcgggggcttcagcggcatggtgcccttcggtgactccttcctcgtggcgggaaccgacggggtggggaccaagctcaagctggcctttgacgtgggcaagcatgacactgtgggcatcgacctggttgccatgagcgtgaatgacatcatcacctcgggtgccaagcccatgttcttcctggactactttgcgacggggaagctggatgtggacaccgctgagcaggtggatggaggggtgaatctgtgaggatcaccgtgtgtatggggtagggtcctggtcagggagtccctgagcatgcacctgcatccccggtcccacaccctcaagcgcacctgcatccaaacccatccgcggctttgttcccacctcggatgtggtcttgagcacgtgccacaagactggcacagattttatactgcttgcccccctttctgtccccctgaccggggacgaccatgggcattgtggcatgatccctgtggaacatctttcatgatatgcacgcaaacctccttcctatctccgctctgcattggggtgtgttgcagggcaggcctgccattccttgcatgacggtttccgtacaggtgctcgtgtccattctattgccgatgcccatcggctccccctccccctggaatcccaggtcatcaagggcatcgtggagggatgccggcagtctgactgtaccctgatggggggcgaggtgaggaggctactggggcgcacggtagctggacatgcatgagctcagcgtgcacctgccatcagctgcctccctgctctgcgcagcgccctgctccctgctccctcccccttccctcggcctcaccaatcttcccgcctcccacagacggcggagatgccgggcttctacagccccggcgagtacgacctcgccggcttcgcggtgggctccgtgctgcagtcgcgggtgatcgacggcaagcgcatcgccgccggcgacgccgtgctggccttgccctcctccggcgtccactccaacggcttcagcctggtgcgaaaggtgctggaggtcagcggcaccggcctgggcgacgccgcgccctggtccgacgacagcgtggggcgctcgctgctcacccccaccaccatctacgtccgcgacgtgctcaggctgacggaggccgtcgacgtcaaggtcagcctggtgaagggggacgggtggagagtgggaaagggtccctgcaggaacaccgcaatgtgagcaagggcgtgctgggcggcactgcctccagtcatccggaccaggtgaccaatacttgcatgcccccgaaaacccatgcgcagggcctggtacacatgaccgggggcgggttcccggaaaacatcccacgggtggtgcccaagggcctggccacccgggtcagccgcggctcctgggaggtgcccgcgctcttccagtggctgcaggaggtgcgcatggggcggggcggtgtgtgtgtgtgtgtatggaaggctgcggtggggaaccctgctgtgagcccctgcttggtgggatatgtgtggggtgtgatggagcctcgcttgctcatatgtgcttccctgtggccggctcttggacgggcaagggccccccttccgtcctcacccatgtcccctctgtgtcctgggctgcagttgcatgtccttctccatgctccacatagcgatgtttnnnnnnnnnnnnnnnnnnnnnnnnnnnnnnnnnnnnnnnnnnnnnnnnnnnnnnnnnnnnnnnnnnnnnnnnnnnnnngacgaggagatgttccggaccttcaacatgggcgtgggcatggtcatcgtggtggcgcccaaggatgtggacgccgtgctccagaccctgccccaggcctgggtgatgggggagattgtggaggggtcgggcgtcgagttcaccgactagatcggcggagtctggcggcgggtgtggaggatggcagtgggcatgtgatggagcagccgagggtgcggtggtcatgctgagctgatcgtcccgcattgctgctcggcaccaggacgccagccacccccgaccttccagccccacatgcacgctctttggtagtcagcctgcaccttctctgcgatttctgtacgactgtttgtacaacagcacgtggtcaaggagggcaacgtcgggtggaggcagaggtctttgtcagaggggtcaaggactgtgtgttgcggtggcgacctctgtctgaacaggagcagagcagagggggcgagggagcggacctcccatgcacctatgccttgtgtcgcttggacctgggcggcagcttagccccggtctttgtggttcccagggccagcgcatggtcaggcgcaggcactgagttctcctctcccgccagttctaccgaaggcttctggctggctgcctgcagggcagcacgacacatatatgtgggattgagggtgtacaagtgggtgtgggatggctgtcggcacccttccaccccctcggcaaaggtatgtacaggagcacgcgtgcagctccaggcgctctcacagcaccaccgcccctgaagccaacacaccgcatgctcacttggctgctggtgatcatctgggttgccagatcctcagctgcagcctcgtgggggaggtgcgcgtccaatagggttagcgtgaagcgcatcgtgtcacggtcagctggcttgctgatgcccacattgccgttgttgatgagctgcatgggtggcggtgggactctgactcggaatgggtacagcatggtctagggcttgggagggggcagggagtctcaccaggctgcgagaagtggacgccatcatgtcatgcggaaccccactcacgaccatgctggacatgtctgttgtccttcactcgcacatgataccccgcgccacgctttccacctacacaggacacgtgcaccacgcccgtcccatccccagccgcggggacaggtgaggcgcgcattcgtgaacctgttcagtacctggaggagggacgagaaggtgcgnnnnnnnnnnccacatgcacaacgcccgtcccatccccagccgcggggactggtgaggcgcgcattcgtgaacctgtccagtacctggaggagggacgagaaggtgcgggacacctcaaagcggtttgctgtccactgcaccacctcagagaactgggtgggggcggcaggcacagactcggcagctgttcctgtgcgggagttggagttaactgtggggtagggtgtcgcagtgtctcatcattcccccatgcactcaaaatcatgtagctgcggtggccttgctccccatccggtgctcggtgctgaagcaaagtaacccagcagggcccgatcccaggactgatcattcagacaaacacacacacacacacacacgcacacacacaaccccaactctgggcccacagccgccctcccgccgcacctggctccctcaggctgagcccctgcatggcatccagaaccctctggccgtacacgtggatgtcaaaggcggggcgggcatcctcctcctccagcaccggcccgatgcgtgagcgccacccgccaaccctgctggccagctcagtctggacctgggcggcggccgccgcggcgatcatgcggctgatgtgagccttcaggagatcgtcgaaagtcatgctggtggcatccacgcatgagcctggcgggtggtgggggagtgggaatggggcatggggtgtcgagggcttcaagggatcgggagggaacatgcttgggaccaagagtttagccagaatccaccccccaccacaaacaacatgcccctgcccatgaacgcaccatgcaatgtatgctcatcaacagcacccacgggaacccatcattcaccccactgtcactcaccgtcgatgccagtctgaaaggctgtgcttgtgagggtggggtccctccacccctcggcagctgccgccgaaaccaggaggtcatcgccgtccagtccatccgccaaagggatcggcacattttcatagtcgtcggcctcaaacccgccatcgtacccgccatcgtctgcagggtggtaggggagtagggtgagccagggtgtctgtgcggaggcaatggagcagggtagttcccgaaactctaccctttcatcctgcacatcgcatcgcctgatgggctggtggggacgtctgtcttgctgcagcgtgagaccctttccctcccctctgccaaccgcacgcacagtcgtccttggcatcgtcaaattcgtcggcatcctgtacccccgccaagtcagcaccgtcatcctcttggtcgaaggcagcctgcaaaccatggtggggccgcgaggatgcaacggtggctctctgcatcaggatgaaggggggacgagaacactgtgtaatgaatggcagaagaaattacatgctggataccttggaaccaaagggtctccacaccacttccaagctcaaagctggacattggctcctgaattctgtggttcctcgtagtgcaaattttggataccaccaccccagtaatcacacactccccaccctgtccatcagccctacccggtctatcgtcctggcctgttttgggagtccataggcaaactcccggaagaacagcccatcgggcggaacggccctgtgaattgcctcctgcagtgtctggaacggctgtgccggccgctgattccgtggcttgttgggtacctggtggtagggttgagggggcaagtatcgatcgaaggggcttctgacactggtgaccaaaccaggccgctgagcagagctggccacaggcctgccaccagctgccgcccacgaccagcacctcacccgcagcgctttgcgcaggggcttgggcgccactggtcccgaatcgttgggatccaggggtgtatatgggtcgtagacgtcctcgctctcctcctctgagtcacaggctgctgggttgcagctcagctcgccgctccgctttcctgacgccgccattgcagcactggccacccccagccgagcatccggctctcctggggatccgccgtacccgccgtccagatcgccgcggtcatcatcgtcatccatgtagtcgccgccatactcctgccctccccagtcgtcctccagtgggttgtctgctgtcgggacccctccagcatcgggctgcccatacccactcgcatcctcccgtggtcggccaaactcgtccccgggaacaccccgtgtcgcgtcagtcggctgcaggccggcgtccaggtgcatgccgtccgcgctttccagcagcagagctccagacacatgcaccgcgcagctgtggacctggggagggggggggggagccctcgtaaggggtagtcaatggatggggagaaccatgtcgatcccattgtacctacctacagctccctgattgcatgcaaacctgcatcgctctgcctggccagcttgcgcccacccagcattcagatcaactcaccctaaacccagcggcatccccctccttctgggggattcccgttagcgccagcagcgtggctgggggtcgcaagggggctacagtgcctttgtccccagcgccttcatccagatcgaggttcttgccctcctccagatcatccagggacaggaaggcttcatcctcctctatgtcactatcgtcatcgtcgtcattcttggccgtgcctgcccttttcttggcgccattcttgccctccctggtggtgaaagcagacttagctcagtacatggtatcgaaagtatgcgtcatgagccggtctttgcagtgcgcagtgcccacaaacacccactttacacagcagcagctacagaagacagccnnnnnnnnnnnnnnnnnnnnnnnnnnnnnnnnnnnnnnnnnnnnnnnnnnnnnnnnnnnnnnnnnnnnnnnncaggtactctaatgcctggaacaccagggtgtggagatactcgacctttttgctgtacacacatgctgaaccctgaatgaccagcgcagctgatcaagggaaaggcaggagaggaggctgctattgtaggagaatctgtggactccaggtggcccactactaccccgatcagcgccttgccttgacgacaggagcatcaaaaagcaggacacccccccccgccaaggcttcaccttcagcaaagttcagagatgaacctccttcgaaggtgaaggcgatgttctccaaggcatcctatgcaagataagaatgggctggtgggtgacacaggccctgttcccacccgagcacctgcctcgtcttcagcgaacagcctcacgcccttgagcgtcatcgcaccaggtattcgtctagctcggtggcgatcttcacattccagttggcagccaggtcccggatgggctgcagcaagtgtgcgaagcgctcctcggcctgcatcccgacaaccgtcgcccctaccgccgggccatgtacttggcaagtgccctctttaaggtcaaaatgccgattccaaactctcgtcgactgcctgaggacgtccgtaccctccgcccgcccctggctgttgtcactggatcgaggggatttgaacagatcgcacagcacgagcccgagacgcgggtgccgaaccaccttcgcctgcacaccagctgggcccgagtggcgccttctacccacacccccgaccttgcgtgacacaacagcaaaaatctcaggggcaagcatccctgcaaggccccgttgacacctgccagatttcccccgaccagccgtgttcggttgcgaggggacctcgtcgcctggctcccacatgccctgactccggcatgacaaaaaatagcagtattgcgccccaggcgggggttcacaccatcggatcccgagtctgggtcgaggatggtgtggagggctgggtcaaggccaaggtggttgccctggggcccacggatatcaccgtggctctggaggacggcacctccaggacctgcaaggcgcaggatcttcccctgcagaatcctgggacctatggcgtggaggtgaggacgtaatgaaggccggagatggggttgttaggtgggtgcagtcgccgtgcagtatctgtaagctcatgctgatttcggagggtgcggcggtgcagccttggtgatgcaggaatcgtgctcttgagacctgcatgctccattgcacgttgcgcaccagatcatggcccaaggggtgcaaagcttccaccgagtcgtgcgatgacacatggcgctggctggccatcagcgctctccagcaactcgccttttccctttcacacccccctcccccctcgacacccctccacttccaggacatgaccaccctgtcgtacctgaacgagccgggggtgctgtggaacctgcgcgtgcgctacgaccagaacgacatctacacctacacgggctccatcctgatcgcggtcaacccctttgcggccatgccccatctgtacggtgcccacatgatggaccagtaccgcggcgtcggcctgggcgagctgtccccgcacgtctacgccgtggccgactccgcctaccgccagatgcggcgggagggtcgaagtcagagcatcctggtgagagatgtagagtgtggggccggagggggaccggggcctgcgcttgacgggcgacggcggcgggatctgtgtcggacccccgcgcgcatgtgaccggtgcgtgccgggcttgttctgacgcccctgacctcattcaccccccacccccttcctccccttctcaacaatcacctcgactgcaggtgtctggcgagtctggagcggggaagacagagactagcaagctgatcatgcagtacctggcctggatggggggttaccgcgcagagtcagcgcccaccaacggcagcacccgcagcgtggagcagcaggtgctggagtccaacccgctgctggaggcgtttggcaacgccaagacctcacgcaacgacaactcctcccgcttcggaaagttcaccgagatccagttcggccgcgacggccgcatcacaggtgggggtgggggcgggagggcagggcggggtgctgtggtgacccttgtgtgaatggtggagcaaacgagactcaaactgtgatgggcggaggtttggagcacgcagcttgtggccagcaagggctggcccttgcctgcggctccttgtggcgggggccgggggggccnnnnnnnnnnnnnnnnnnnnnnnnnnnnnnnnnnnnnnnnnnnnnnnnnnnnnnnnnncccaacaagattcccgttccccacatcgccccacccccgccctgatcatgtgatttcaggcgccgcgatccggacctacctgctggagcggtcgcgtgtggtggcggtggcgtcccccgagcgcaactaccacgtcttctaccagctgtgcgggggcgcggacgaggcggaggccgcgcgcctgcgcctgggccccgcgcgcgggttccgctacctgaaccagagcgactgccacgagctggcgggggtgagcgacgcggaggagtaccgccgcacgcgccgcgccatgacgctggtgggcatcgacgccgcctcccaggacgccgtcttcgcggtggtggcggccgtgctgcacctgggcaacgtcgcgttcgtccccggcgacggcggcgacggcagcgccgtggccgagccggcctgggcccacctggaggctgccgcggcgctgctgggcgtggatgccgcgggcctggcccgtgcactcaccacccgcacccgccagacccccgacggtgtgtggtaggggggccttcatggagggggagatgggctgtgctggtctcacaggggataggccggggggcacaagtgctgggcgtcggtcgagttccagcgcgtgccacccacccactctattcctcaccccatgtcgtctccccccctcacccccccccccaaaacaaaaaggtcccatcgtgagcccactggacgtgggtgcggcctccgacaaccgcgactcgctggccaagacggcctactcccgcctcttcgactggctggtgggcgcggtgaacgccagcatcgggcaggatgcaggcgcggccagcctgatcggcgtgctggacatctacggcttcgagcagtttgcatgcaacgactttgagcagttctgcatcaacctggccaacgagaagctgcagcagcacttcaacgcccacgtcttcaagcaggagcaggcggagtacgagcgcgaggccatcgcctggtcctacatcgagttcgtggacaaccaggacgtgctggacctggtggaggcgcggctgggcatcctggacctcctggacgaggcgtgccgcttcccgcaggccacccacgccgacctggccgccaagctgtacgccgcgccgggcgtggcggggtcggcgcgcttctccaagccccgcctggcgcccaccgacttcaccatccagcactacgccggcgcggtgacctaccgcacccagaacttcctggccaagaaccgcgactttgtggtcgccgagcaccaggccctgctgggcgcgtcggggagtgcctttgtgcgcgcgctcttccccggcgatgccgtgccgggggcgagcgggactcccggcgccggcgcctcctccggctaccgcttctccagcgtggggtcgcagttcaagaagcagctggcggagctgatggaggccctgcgcgccatggagccgcactacgtgcgctgcatcaagcccaacggcgccaaccgccccgcgcgcttcgagaacaccaacgtcctgcaccagctgcgctgcggcggcgtgctggaggcggtgcgcatctcctgcgcgggctaccccaccaagctgccctacgacgcctttgccgaccacttctggcccctggccgtcgacagcccgggcctgggcgacgccgagctggcgcggctggtggtccagcgccacctggaccccgccggcgcgcagttcggcgccaccaagctcttcctgcgtgccggcaagatggccgagctggaccgggtgcgcacagaccgcctgaacgccgcggcgacggccatccaggcccacgtccgtgcctggctggcgcgccgcgctttccagaaggccgtggcggcggtggtcgtcctgcaggccgccgcgcgcgggtttgcggcgcggagggaggcgcgccgcctgcgccgcatccgcgcggccgtcaagctgcaggccgccgtccggcgctggcatgtgcgtcgctggatcgagggggggggggatatggtttgtctggtgtgcaaggggtgggatgggggggggttcaaggtgtcggtgctcggatgcgctgctggaccccccgcaccctgcaggcaggaatggaaagcgcggcggcgccctgcccatgcgtgccatgccaccgctcgggcgaatcccgcccccgtccctcgacacactcgcgcacacgcatcgccgtcgcaggcacgtcgcgccttcctggccgaggtggcggccgccaggacggtgcaggcggcctggcgcggtctcgtggcgcggcgccgggccacggcgatgcgccgcgagcgcgccgcgctgcgcctgcagtccgcgt

SEQ ID NO: 30462 - DNA, 61 bp, Chlorella protothecoides
ccctttcccacctagtctgccggccccatcacccccaagccctccacctccttctccgccg

SEQ ID NO: 30463 - DNA, 105 bp, Chlorella protothecoides
tcaaatgcccgcacgccacttggtggcggggctctgcacaattctggcgtactcccctcaggataaaacctaggtcagtgacaggacccatgcggtacctgaaga

SEQ ID NO: 30464 - DNA, 62 bp, Chlorella protothecoides
tcctggctcgcaacagtgttccacacctgcttgagtgccaggtccggccctggcggctcggc

SEQ ID NO: 30465 - DNA, 105 bp, Chlorella protothecoides
atggctgctgtcaccggttggcatggcagttggactcatggcatccaccgcctcgccaccaagaacactgcagtacacacctcaaggccactccagccccgcgcc

SEQ ID NO: 30466 - DNA, 61 bp, Chlorella protothecoides
attggcgccttgggagcgattgcgttgagaacagccactgggaaaggctgatgcttggggt

SEQ ID NO: 30467 - DNA, 77 bp, Chlorella protothecoides
tgagcacacacaacataacccagcagtctggtcgccctcgcccagacatccacaggctgctcaccacgactctgcag

SEQ ID NO: 30468 - DNA, 78 bp, Chlorella protothecoides
ggagcgggccatcaaccggctggcagagcacttctgcgcccccccggacatgactacggtcgtgggcgtgggcaactg

SEQ ID NO: 30469 - DNA, 65 bp, Chlorella protothecoides
acgcatcggtgggcagggcatgcagtgcgtcgagtggctgggggagcggccaccacatgagccct

SEQ ID NO: 30470 - DNA, 76 bp, Chlorella protothecoides
aggtgggagtggactgtggaacaggcagggagggattgtggacggatggaccaaggggtgctgtgcatgacgggcg

SEQ ID NO: 30471 - DNA, 80 bp, Chlorella protothecoides
aaggatgccagggccgggagtgcacatccctcgagcaaaacacccgggcggccagccacgacctaccttggagaggaagg

SEQ ID NO: 30472 - DNA, 85 bp, Chlorella protothecoides
tgattgttgatgggagcgctggggtgtgtgtgatgctggtgagacggcagcatactctcagcaccagcgctatgtaggcgtgcag

SEQ ID NO: 30473 - DNA, 99 bp, Chlorella protothecoides
gcctgatggctggcctggcattctttgaaacattgttgatgacgcgtgccatggttgggaatcatgatgcaagatgtatacgcacacgctccactgcaa

SEQ ID NO: 30474 - DNA, 113 bp, Chlorella protothecoides
tgctcgctgtcttgtgggtcgggcacctgcaggaagagggggagttttaggagagggttcggtacagttggagcgatgcgggttgtcgtggacggaactgtgggacacgaagc

SEQ ID NO: 30475 - DNA, 76 bp, Chlorella protothecoides
cagacaggaccccagccctgcgccacccctccaaaccccaggggggcacactcaccgcaggcccacatgtccacgc

SEQ ID NO: 30476 - DNA, 166 bp, Chlorella protothecoides
cattcgtcgtgcaccatttcgcattgatctgacgggggagggtcgctctcgctctccctttcttcttaaccttccaatgagtccaggtactgatggtctcaccgcgccaggggccgctctcagggacacacatatgccagccaagagcattgcatgtacatctatt

SEQ ID NO: 30477 - DNA, 74 bp, Chlorella protothecoides
gattgcggggtctgccctgaaagatccgtccaactccgtccccagatgacaatcaacattccctgctccacgtc

SEQ ID NO: 30478 - DNA, 69 bp, Chlorella protothecoides
gggcacctgggaaagcacagcattttggggtgggggaggggtgatacattggaggggacgagcacggcg

SEQ ID NO: 30479 - DNA, 136 bp, Chlorella protothecoides
tatgtatgtatgtatgtatgtatgtatgtacgtatgtatccctacatcctcagtcatcacgggagtgcatgatgttactatatatttcattaaatgtcaacacaatggcaacagaggtcatcgagctaaagagtct

SEQ ID NO: 30480 - DNA, 61 bp, Chlorella protothecoides
ccagttcatcgggaacaccatctcggggggacccgcctctatccccgtctccgccatcggc

SEQ ID NO: 30481 - DNA, 61 bp, Chlorella protothecoides
ggatgcgcacccacacgtccacgggcagggggggcaggggttccggcaccgtcaccgccgg

SEQ ID NO: 30482 - DNA, 61 bp, Chlorella protothecoides
aaactatcccaccttaacatacctttcctcgtcccctagcacagcatatacgcgcgctagg

SEQ ID NO: 30483 - DNA, 70 bp, Chlorella protothecoides
cagtgccggagccgttggtggggtggctggtgttttggaatgaaggagtttggggagaatgaaaaactgg

SEQ ID NO: 30484 - DNA, 1316 bp, Chlorella protothecoides
gggttttaggtacggtgccaggcggcgtagagggatgcagggcacagatgcaggtggaaagggggggaaagggcccaatcaaggagaaccccccacagcacaagtgaaaccccccacaacacaaggggagcctcccacagcacaaggggaccccccacaacacaaggggaaccccccgcaacacaaggggaaccccccacagcacaaggggaccccccgcaacacaaggggaaccccccacaacacaaggggaagcccccacaacacaaggggaacccccacaacaccctccccagtctgtactgtaggcctacccacagtctgcactgccctgtaggctttgtaggcgtcgagatgcgccaggttggcgcggggctccctggtggcctggtcatcagggtagccctgccacttcaccaggtactggtagccgcggccgacgcgcttgtgccggaggatggcctccacaaggtaggcgggcgcgccgctgtcattgatgaagacagggattgggcgatggttgctgtcgcggtggtagggtttcgggtaactctcgtcgaccgagggatccatccccatcgactgaggaagcgccaacgtcgccgccccagtgccgcgcatggcggtgatggtgaagggccccacaaagggggccgccagcttgcggccgttgggcgccacaagtttgaggtgcgcgctgctcagtaaaacgcgatcaccagccttgaaggcgtgggcctggcgcgtccggttggcctgtgtggccatgcgggcgttgtacttggccatggtggcccgcatgcgctcgagggtctgctgcagctgcgcggcgcgctccgattcgacggtgatgccggggtccgcaggctggtgggagatgagctgggtcggggacggtgggtcgaaaccgtacacggtctggaaggggctggcgccggtggcggcgctgacggccgagttggcggcgaactccgcgatggccaggtgcttgtcccagtccgtctcgtacgggtccaccatggcgcgcaggatctcctccagcgtgcggttggcacgttcggtctgtccatctgtctcggggcagtacacggcgctgaagcacagctccgtgcgcagcgccccaaagagctccttccaaaagtgtgccgtgaagcgcgtgtcccggtcgctgacgacgatagtgggaaggccgtgtgggcaggagatgcgattcagaaacatgtctgccagcccactggcagtcacctccttggtggtaggcgcatattgcaccatcttggaatacaggtcgacgaagaccacgatggcgttgtggc

SEQ ID NO: 30485 - DNA, 69 bp, Chlorella protothecoides
catgacacccagtccagagtgcatttcccccgaaacaaccgcaccaaaggggatgaaggcaaagtcgga

SEQ ID NO: 30486 - DNA, 61 bp, Chlorella protothecoides
atcgcgccccacatgatgagggcacccccaagggataccccctaaatgaggcactctgccc

SEQ ID NO: 30487 - DNA, 79 bp, Chlorella protothecoides
agcacatcaggagtgggtctgcacttcagcagcatattgccaactccaaaggtcagagcaataaatcacacccattatc

SEQ ID NO: 30488 - DNA, 113 bp, Chlorella protothecoides
catggccagcgagttgaaaacagtgtcgagccgtcccccgctttccaccctgccgcgttccggtgtcagcatgcaagccacttcttaatcgcgtccattatcgatcgtcagct

SEQ ID NO: 30489 - DNA, 72 bp, Chlorella protothecoides
ggacaagaccccgagtacggtgaggggcttaggtttcaagcccggtgccgggcgacgtacagggatgcaggg

SEQ ID NO: 30490 - DNA, 99 bp, Chlorella protothecoides
gcccacacccagtgctggcggggtccaaaacgacacagtcctcatcccactccccactttcctcctgactcacacctgtccagcccaccagggcagcgc

SEQ ID NO: 30491 - DNA, 78 bp, Chlorella protothecoides
accggggtcttctcgccagcacacccatgcgccaagcgcactacgtgattgacagccgagggtttgggagacctgcct

SEQ ID NO: 30492 - DNA, 103 bp, Chlorella protothecoides
ccgtctcatgcacggtctttatgggagcgataagatccatacataaaccattgagatcaacctacctgcttagacggcaggtaggttgtatgacacaaactgt

SEQ ID NO: 30493 - DNA, 79 bp, Chlorella protothecoides
gctgcacccacaccttcagccgtccaggcggttcgaacactaccgaataatgtcagccacgtctcccccatcccatggc

SEQ ID NO: 30494 - DNA, 76 bp, Chlorella protothecoides
gcggcctggatccacgacaacaaggccatgctcatctcctactccgacaagcccaacctggagtgagtagggaggg

SEQ ID NO: 30495 - DNA, 3228 bp, Chlorella protothecoides
  modified_base (317)..(326): a, c, t, g, unknown or other
  modified_base (541)..(550): a, c, t, g, unknown or other
  modified_base (1312)..(1321): a, c, t, g, unknown or other
  modified_base (1644)..(1800): a, c, t, g, unknown or other
  modified_base (2114)..(2123): a, c, t, g, unknown or other
gcgcgcgagcaagcgcaccgccgccacgctggccggcgaggagggcgccgccgcggcgcggctgtcgctgcgcctcacccgcctcgtcaccaacctggacgtccccgccacacgcgcgccctgggacgcataccgcccgggcttacccgccgacgggggcgaggccgcgctgcgcacactgggtgatctggcgctggagcggcatgcgcgcaccctgcgcgccatctggaccgagcacgccgccttccggcggtgatccggggtgccaccccctccccgacgcggtggcctggaacggccagcggcgctggcctggnnnnnnnnnngtctgggccgagcacaccgccttccggcggtgatccagggtgccaccccctccccgacgcagtgggcctggaacggccagcggcgctggcctggatgtctccgccgccgtctgtcctgctgtgcttccttgctgctctttcctcatgctcttaattcccacaccttcaaggccatcaaccttgttgcacctagggttacagggagacgcggctgnnnnnnnnnnccctcgctgctctttcctcatgctcttaatttccacaccttcaaggccatccaccttgctgcacctagggttacagggagacgcggctgctcggtgccaaagggtgcacgcaggcaagggtgagggcaccacacaggccaaatggttggggcccaggttggccagcaaagggggcatagcccctcaagctatgccgcccccaccacactcaatcccccgggcggcgccgtctccacgacacctccaaaaccctccgtgcgcctccgcgccagcaccgccaacccccagccttcgctgatcaggcgccaatgtgtgcgacgaggtcgaccaggcggttggagtagccccactcgttgtcgtaccaggacacgatcttgacaaaggtatcgttgagctggatgcccgcctgcgcgtccacgatggaggacagcgggttgccgatgaagtcggaggacaccaccgcgtcctcggtgtaccccaggatacccttcagctcgccctcggaggcagccttcagcgcggccaggatgtcggcgtacttggccggcttctccagcaccacggtcaggtcgaccacggagacgtccagggtgggcacgcggaaggccatgcccgtcagcttgccgttgagcgcgggcagcaccttgcccacggccttggcggcgccggtggaggaggggatgatgttgttccccaccgcacgcccgccgcgccagtccttcttggacggcccgtccaccgtcttctgggtggcggtggtgnnnnnnnnnnatgcaccgtggtcatcagcccctccttgatgccaaacttgtcgtggatgaccttggccaggggggccaggcagttggtggtgcaggaggcgttggacaccacggtgtcgttggccgcgtcgaactcggtgtggttgacgcccatcacgtacatgggcgcgtcgggggagggagcagagatgaccacgcgcttggcgccgcccttcaggtgcgcgccggccttggccacgtcggtgaagacgccggtggactcgcagacgatgtccacgccggcctcgccccaggggatctcctccgccttcatcttgtcgaagccgcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccccctggaccagggggcgcataccattgagttcccaactttcacaacctcgtgttcatcacgcaacaccgcatcaagacaccaacgcatggctcctctggatgataccttcagcatgtaggcggcgtactgcagagggatgggagggagggacaccgcggtgagatgggtgcagcaaggcaatgcaagagggtgcggatctggatttgccaccaaccattccagctccaaaaatctgcaccaccttgatgtttccatgccatccacacgccaaccccatgaacactcacctcgccatggatgaagggatcnnnnnnnnnntcaaaaatctgcaccacctcgatgtttccatgccttccacacaccaaccccataaacactcacctcgccatggatgaagggatcgttgtaggccacgatctcaaccttgtcgctctgcagcgcggcgcgggccacctgagggtggggtgggggagggcgagtcggacgtcagccgggcttggggcacagcctggggtgatcaacgccgatcacccctgcatcctccatcctggatctcgacggcaatgcaccggggagcgccgcagtgatcggggcccgcatgcacgtcgcgggaaaaccctctgtagaacctaccagacgtccgatgcggccgaagcctgcgcgagggagggggcaacccaaatcaggacatcggcatatgtcatcgcgaggcatgatcgagcaggtctggaccgatccccgcatcgctggcgcgatgccccgccaacctccgggccccggggttttggtcctgcccccccctccccgcccccgcaccgttgattccgagcttgaccttggccatggtggatatctgtatgggttgatcggtgaagggaagggcgattttgagggttggattggggtcgatgcctttctctggggatgtcacgcctggcgaagcctctcgcgtgtcctcggggtcgatctgtactgccccctcaccatgtgccagattcgcgagggttggtcacgaggggcggtgccccaatttcaccctgcaagcatcacgaatgtacaggcagtgcttatcagtcaggtcaggtctcgcagctcctgctgggcggctgagagcgctggtctcccgcccggcggcagggggctccgccgccctcggtcacacgcccagtgtcgccgcgccgggacgggtggcggggcccgcaactgtggaccccagactccgcgtgctgatgtacacggggtgcggcgtgttgatgggcggcggcggcggcggcagcgaaaggtccgccgcgctgtagcccggcgggccgtcagccaaggggggcgccgcgacccagggcgccggggccgcgccccattgcggcggcggcggcggccccttgccctccccgccgagctcgagcgtggccctggcgcgccagcg

SEQ ID NO: 30496 - DNA, 2902 bp, Chlorella protothecoides
  modified_base (512)..(521): a, c, t, g, unknown or other
  modified_base (1616)..(1625): a, c, t, g, unknown or other
  modified_base (2475)..(2484): a, c, t, g, unknown or other
gtcgcgccgcgagccgcggaggccgcggcggccgcggcagaggcggaggcgcggcgcgcggcgcgcctggcggcctccccctccgatgccgacctggcggggctggaggaggacgcggtgaccatcgctggggacgacacggaggaggaggagctgggccagaacctggccaccgacgacgacgcggcgacgacgcaggccaccacgggggccgggggagccgagggcagtcccggccccgccaacgcacaggccctgcagcacgtccagtccaccgcgcgcatgggggagggcggtgtgggcagcgcggaggccgggccgccggccaagcggcagcgagcggatgaggccactgagggggagtaggcgggggcagggctggaatccgcttgttatcgagcatgaagggagcatactttcatcaacaaaccgcaatgatgattctgaaagacttgaattccaatgggtttgaagggatatgagctcctagtctctccggatctggtgttgcnnnnnnnnnngatccgcttgttatcaagcatgaagggagcatactttcatcaacaaccgcaatgatgattctgaaagactcgaagtccaaggggtttgaagagatataagctcctagtctctccggatctggtgttgctgggggaatgcgggcccgggtaacaaacccggcacgcgtgcggtgcgggctgcgttcgacctgcagcatcatccgaattgcatcgccaacagctcgggctcgaagagtgcgcacctacaccccagatccacgctgtccacgccccagaaactcagctaagatgtcgtgacgcagctcggcagcatggaatccagcagcgacttcttcagcgagaggactggagagcggggggcctcacccgaagcctccccaaaggtgagctgctggatcgggcgtgcttgccctggcgatcaccggaaagactcgggcaacaatggatctgagattgcatgtttgtgattgcccctccgacccttccccttttcagcgcacgtactggaggcaccggtatgcgaccacctccttaccggaggaaacccgcctccacaatgatgtgacagccctcaccaaaaagctccaggcaagccgtccctggtttttggatgctagaaatgcatgttaaagctgcccgatccccagatcctggccttccgcgacgcccggccctggacaaatcccgtgaggattaaccgccaccatgcctgcatgccccaacaggccctgcatgccgtgcgggagcgtcaggaggtccagctggccgagctccgggccatgaccttccgcctccgtggagagaaggacgagaaggaccgggaaattggtgtgctgaggtcccaggcccaccaggtgcagcagcagctggaggaagctcgggcccagctgggcatgcaggcgtcgaccattcagcggctggaagccgccgccaaggccgaccgcagggtgcacagggaggccagggccccggaggacgggcggctgcggggctctggcgacgcacggccctcctcataccctgcctcgcccgagcaggcgaggggccccacgcatgaggtcctcgcgctgcgccgggccctggaggtcgctgcgnnnnnnnnnncggcgacgcacggccctcctcataccccgcctcgcccgagcatgcgaggggccccacacatgaggtccttgcgctgcgccgggccctggaggtcgctgcgcagcagctcacccgctgcgcagggtcgcagataggcagctctctgctcaaggcggtagccgaggtgagggggatgtgcggcaaagcccggctgggttgatgttctcttcgtgcatttatggaggaggtggagtacccatcaagctgcgtcaaagaccaacgcacgctgctcaacaccaggggacctctgcttgtcaagcctagcaccttcttcttgctgaggccaatcctctgcaccacaccccaaaaacaaatccactgcagatccaggaggaggcggggcacctgcgcgcgaaagtggacgacctggcgttgaccaacgccgcgctttcctccagcctcgagtcggaacgcggcgcggcgcaggacgcgcgcgcacacctgtcggaggcggaggcggcgctggtcgccgcccgggcgcggtgccagtccctcgaggccgagctaagggagcgccggggccagctggcggcgcagccagcggagcggcggggcgccattggccacatctcccaccgcctgtcggccgcgcagcgcgaggaggcggatggcctgcgcctgcgctgccaggagctggagaagtcggccaagatggagcgggccgcctgccgcgccgcacgacgccaggttggggtgcctcgtggagggttgtgttggtggatgggggggagggttgacgccccgtcccgtgcccttggacacagagtaacgagcagcaggtgcttggtgcaatcccgctcgccctccaggnnnnnnnnnnagggagggttgacgccccgtcctgtgcccttggacacaaagtaatgagcagcagatgcttggtgcaatcccgctcgccctccaggagtggccagcatcggcatgggcggctcctccacccagcctcccagcacctgctcaccctgccactgccacccggtaccctcctctacaggtggaggacctgcaggcacacatccgcgccatggaccagcaggcctcggtggcggcggccgccgcggcgcaggagcacgctcggcatgcccagggcgccaggccgtcccccacccggcgccgcccgcccatcaggctgtcgcgggagggcctgtacgaggccgcagaccgcggccggctcggcaatggaggcggcggggaggggcggggccgggccgccagcgcggcctcctccctggccgagg

SEQ ID NO: 30497 - DNA, 707 bp, Chlorella protothecoides
  modified_base (222)..(231): a, c, t, g, unknown or other
tcactgttcggtggcggggcctggaggccagcggttgctcgctctcgccgcatgtgagcgacagcgctgcgacaatcggtaggccaaacgatgccgtcccaacgcctctgcgcaagctgcaccacctttcctgcgctgcggtcggtgccgcatcctcaatgacagccccctcttgacgccttggcaggggtcgagggcgcggcctccgatgcctccagcgannnnnnnnnnacaattgctcgctctcgctacatgtgagcgacagcgctgcggcaatcggtcggctgaacgatgccgtcccaacgcctctgcgcaagctgcgccacctttcctgcgctgtggtcggtgccacatcctcaatgacagccccctctcgacgtcttggcaggggccgagggcgcggcctccgatgcctccagcgaggagagcggggaggagggcggcgcggactcagccgatggcgagcacgagcggcgccagctggcgcgggacctgctgatcgggcacctgctgacgcggcctgctgctgacatcattgcccccgacctgccctccgtgctgggcatgctgcagtcccagggcctgctcccgcgctgggtgggctggctgctgacccagcgccccgacctgttcgacaccgcgctgcgccgcgtcgcgcagcgcgcgcggcgcacgcggccgcccgacgccgagccccgcgccgcgtc

SEQ ID NO: 30498 - DNA, 80 bp, Chlorella protothecoides
cctcctgtgagttttgagagtgaggtagggagggggttcctttgatgtcggcatcgggcttccgaatgagcaatcggcgc

SEQ ID NO: 30499 - DNA, 161 bp, Chlorella protothecoides
cccgagattgtgctctgtccagcggctccccgtcaaacgagggctcgctgagccgtgagctatgcaattcggtcccagtcggcaaccagatccatttccgtatccttcccagaaagccaagacgatcaccctgaagccgacgtatggggctcctgatgtag

SEQ ID NO: 30500 - DNA, 165 bp, Chlorella protothecoides
gcctcccgtccatgctcgctgcgccaggggggagttcgggggccgccggtggtgaggccagactcccgtgaaatccatgagtggcagggcagggtgcgatgcacctgcttggcgctcaggacaccagactgtgcgattcccaccctccgacctgcccgtctcgac

SEQ ID NO: 30501 - DNA, 66 bp, Chlorella protothecoides
gggcgctcgagcttgttgcagcgctctccactcgcgtaggcgagggcttctgtccaggctggtctg

SEQ ID NO: 30502 - DNA, 225 bp, Chlorella protothecoides
cgtccagctgcgactgagtctgtgtggaggaaagggagaggaggacatgtgtcaggaggcccgcaacgctgctgcacagggtagtccaccagcattctgtcggggcttagatactcaaaacctaagggcggataatacaagcctggctcaggcaatcctgcaggcaggccgctcgacgtgaggcagcatgtggtggcgccccccctgccatgctcacggggaagg

SEQ ID NO: 30503 - DNA, 105 bp, Chlorella protothecoides
tcaaatgcccgcacgccacttggtggcgggtctctgcacaattctggtgtactcccttcgggataaaaactaggacagtgacaggacccatgcggtacctgaaga

SEQ ID NO: 30504 - DNA, 91 bp, Chlorella protothecoides
tcggctaattgcaattgtctctgccgacgagaacgcctattgtccctcttgccaatccaggtggaggcgctcggcagacagccaagcgcgc

SEQ ID NO: 30505 - DNA, 75 bp, Chlorella protothecoides
acaagtgattgctgaccaacgtacctacagatttaacagatgtacgacagacgatgggtctgctgtctacttccc

SEQ ID NO: 30506 - DNA, 134 bp, Chlorella protothecoides
ccctgacgggtacggtcaaacccacgagcggtcctccgtctgttacgactcatcaaagaccattgtcgttcgtactgtcgacaactgcccatggtgaggcgggaaggaaaggaaatgggggttccgcacatggc

SEQ ID NO: 30507 - DNA, 429 bp, Chlorella protothecoides
  modified_base (154)..(321): a, c, t, g, unknown or other
ggaggcagaggggcggggcggggcgggcgtcgtgcatgctggggtgccgcgccgcacgttgcaggcctgcagcgctcttcgaatggccctacccgcccacaaggaggttctcaccccctcccgcactctctcctgccaggtggtggagctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatggaagcgggctcctgtgtcgggaatgtgggaggcattgcgtctgaggctctgtgcagtgacgaggggatggcaaaacccggcgccctccagccgcctctggac

SEQ ID NO: 30508 - DNA, 155 bp, Chlorella protothecoides
aatgctgtggaacgagcagatgctggtccgttttgagaatcgccgtactccacaactgctctgcagacctgatggctgcgtgccagcaccccatctccgctggagctgcagttccctttgagtacggggccacactcagtgacagcagtcgagtg

SEQ ID NO: 30509 - DNA, 129 bp, Chlorella protothecoides
gatcaggtgacttgagacctccatgacccccttccaggcgcccctgacccctctacactcgactctctggaccctgacaccttgcccatcctctgacaccgctcacctccccccagacagctcgccctc

SEQ ID NO: 30510 - DNA, 72 bp, Chlorella protothecoides
atgaacatcgagtggactggatataatgttaatcgggggttgtcacccggtcaacacttctgcttgcgtgaa

SEQ ID NO: 30511 - DNA, 130 bp, Chlorella protothecoides
ctggctgtgcctgggatccagatacctgcgagtggcaagggacactcgtgagtgacctggccgccaagcgtcgcttgcgctcatcaaatgtgaaccctgttccggcttgcgaccccgggcacaaaacgta

SEQ ID NO: 30512 - DNA, 70 bp, Chlorella protothecoides
gcacttgcacggtggtggcgccgtgcagcgagcccaggttaaaattaggcggcggagggagcgctggggg

SEQ ID NO: 30513 - DNA, 135 bp, Chlorella protothecoides
aggagtgcatgcaccatgtgtgaaccgcgccgctgcttcagtacaccacgccatgcctgttggctgactgtacactggtcgcctgcgctccccatgccgctgttaatacccagctccacctccagcacccccttc

SEQ ID NO: 30514 - DNA, 117 bp, Chlorella protothecoides
gccccctcctcttcccttctgatcctctcttaccctgaatcccaagccccaacacaccatcccccgttcccccccgtgccagcgctcaagtaccggctggcgtgtgaatcgctggtg

SEQ ID NO: 30515 - DNA, 183 bp, Chlorella protothecoides
gggactctggtgggcccgaggaggacgagggggacgaggagggggcataccacatgcagcacatccagtttgctgagcagccgacccaaccgctcctcggacccctgtccaggggcccagtccatgcatgctttgcttacatgccgtttcatcgcactcttccaagccacccaccattggctg

SEQ ID NO: 30516 - DNA, 78 bp, Chlorella protothecoides
gccgatgaggtgggtggcagggtctgggacatcggcggggctactgtgtctttttgcattcgcaacgctgctgtcctc

SEQ ID NO: 30517 - DNA, 113 bp, Chlorella protothecoides
gagtggggagtgccaggatctcttggcccgtcctgcttaagggtcgcaccctagcatctgaaagcactcccctggacccctttcttgacccccctcttgcctggtaggaactt

SEQ ID NO: 30518 - DNA, 122 bp, Chlorella protothecoides
gtctcgtcctgcacagggagggggcgggggatctttcacgtgggggcttccgcatggcgatcaaattggctagtattgccctgtcacgtttagaccttgactgtaaagaattggacgtctcg

SEQ ID NO: 30519 - DNA, 65 bp, Chlorella protothecoides
tagccgggctggccgtagccgggctggccatacccctgaggtgggtagccctggggtgggtagcc

SEQ ID NO: 30520 - DNA, 104 bp, Chlorella protothecoides
cttttattggggtgtagggggaggtgtcttggactaggcgtgggccagggctgctggtggagagccacgccaaggacgggacaggggtgagaggtgcagggggt

SEQ ID NO: 30521 - DNA, 489 bp, Chlorella protothecoides
ggccaccgcgagcgccagccggccggcgcccaagtgcgccgccgcgcggttgcagtgcagcaccgccgcggcggcaggggagagcgtcggcgcggccagcgcgcgggcataggcctcggccgccgcgtcgaagcgccgcgccgccacgtgctcgttgccctccgccttggccgccaggaccgcgctcagcccagcccgcagctcgtccacctcggcgtcaggggggacggggaccagccagcgcaggagcgccgccgacgcggcgccggggccctcggagccaattccatcgccgtcccatcgggccaggccccgcagtgtgcccagcgcgcccagcgccccctccaggtcgccggagtggaagtcggcctgcgcggtgacccaaaagcgccagggcgccggggtcgcgccggagccgcgcccggggtgcggcgagtgcacgctgcgcccgcccgcggcgcgcgcgtcggcccagcgcgcgcgccgcag

SEQ ID NO: 30522 - DNA, 409 bp, Chlorella protothecoides
  modified_base (181)..(331): a, c, t, g, unknown or other
tggtgtgcctttggtggacagggggcttggtgagtcgaagagcagggaatccagagcacccttggcgctgctgcgctcgctgaggtcaaatctcctgcggtaccaggctttttatgagtgcgcatgtaccaagagagaggccgcattcgtggcccatcgcaggacgtcatctgcggccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctattcatcttccctccttcaccaaactcaggtatgtcgaacagacagacatacactctgcagcagcgtcagtgcg

SEQ ID NO: 30523 - DNA, 61 bp, Chlorella protothecoides
tcccagggtaccattcatcaagtcctcactatggccccacacccacacccacagcacaaca

SEQ ID NO: 30524 - DNA, 61 bp, Chlorella protothecoides
tatcgcacgagtcctgagctaggaggcagctatggcagaaggtaccattactgtgcagcaa

SEQ ID NO: 30525 - DNA, 139 bp, Chlorella protothecoides
ttgctgatgtggtgcctgaagtcgaggcaggcacgcccgagactggtgggtgtatgtgtgtgtgtgaattggggtcaggcaggggcgctggggccccaaggcgggagctgagggcgagcaggggggcactgggatcagg

SEQ ID NO: 30526 - DNA, 61 bp, Chlorella protothecoides
gaccgggatatccccagcgcgactgcttttgctcccttcaaggctttcttgagccacccga

SEQ ID NO: 30527 - DNA, 104 bp, Chlorella protothecoides
gatggaagatttcgtcgcatggcgtgccccagctagatctacatgattacatctccggaatattatgttgcggacattctgaggatatcacaacacccgatcac

SEQ ID NO: 30528 - DNA, 64 bp, Chlorella protothecoides
ggactgctgtatatcacctaaacgaggaggaattttacagaacaagaccccgaatactgtgagg

SEQ ID NO: 30529 - DNA, 140 bp, Chlorella protothecoides
cctggggcatcacagattgtgacacttggagcactggagacaattcaggttccctgtaacactcacatgatgacgaccataactaacatcatgagctcgatgaacactcaattcggcaaccagcaagggccatttctcgg

SEQ ID NO: 30530 - DNA, 61 bp, Chlorella protothecoides
accgcagcgcccgcgacaggggggctggccggccgcacggtctgcgctcctgcctgtggag

SEQ ID NO: 30531 - DNA, 87 bp, Chlorella protothecoides
tgcaccgtgtggagtggggaaggggttggttgcggcgacggcggcgggccgagtgaagggcgccagcagtgccgcactccatcgctc

SEQ ID NO: 30532 - DNA, 65 bp, Chlorella protothecoides
ggcgctgctgcgccgcgtgcaggggcaggcttggatcgaccccggagacgacctggccgcgcccg

SEQ ID NO: 30533 - DNA, 479 bp, Chlorella protothecoides
  modified_base (258)..(426): a, c, t, g, unknown or other
cgtcaccgccgatgttgacctgaatgggggcgttggcagagggggagtcttgatgcttccattcgaggtgcctgccgccaccctgcccatccatgcaggcaaggcaatggtggccaggcggaggcaggaggtgattggagccacaacttacgtaccgagaaaaaccccaagacgtcagcgcaaacctcccccggacacgcacctgcaggcagctgctctccagcagaatccaggcggcggggagcccccacacgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccgtcgctcctcgcaccacgacccccgccgccgctgggcgcaggggcttc

SEQ ID NO: 30534 - DNA, 76 bp, Chlorella protothecoides
acgtatcctcatcattttagagtttgagcccgaacctgcaccccccggtatggttcccttccatacaaggacaacc

SEQ ID NO: 30535 - DNA, 64 bp, Chlorella protothecoides
aggttcagccagggtgcagcgtgaataggcgaattgtattgtatgggaccagaactctcgcgct

SEQ ID NO: 30536 - DNA, 110 bp, Chlorella protothecoides
gtcgtgggaatctgcaggccgaggagagtaagggggtgagtgaagtgcctcgcaaggcacacgctagtgcatgggatcgaacagacgcagcaccgccagcgcacctggac

SEQ ID NO: 30537 - DNA, 64 bp, Chlorella protothecoides
aatctcatcatacaccaactcacaaatgcgctgcggccctctcccacgtcagcatcctcctcaa

SEQ ID NO: 30538 - DNA, 61 bp, Chlorella protothecoides
agaccagcggcttgctgaacgctcaggcacacctgtcgcccgatcagcgggaagtctgcat

SEQ ID NO: 30539 - DNA, 77 bp, Chlorella protothecoides
tggagcgacgagcacgccagcctttggagcaacgagcacgccagcgcttggagccacacaaggtgtgtattatctcc

SEQ ID NO: 30540 - DNA, 61 bp, Chlorella protothecoides
gagtacgcccaagcatgaacgtggctcgggtttggcagaattcacccccgggcgaggtggt

SEQ ID NO: 30541 - DNA, 80 bp, Chlorella protothecoides
tgaggaggggggtatctggcccctctaaggcctaaggaggggggcaggttcctgggccaccaggggcccatcgggcacga

SEQ ID NO: 30542 - DNA, 104 bp, Chlorella protothecoides
aatcgcccagtcaggtgccactcgagccgacccatgttcagataagatatgaaaatgcgcaaaattgcttgatggggatccgagaggcccccgttcggcggggg

SEQ ID NO: 30543 - DNA, 75 bp, Chlorella protothecoides
tgcctcgcactgattacctccctccccccctcccccccccaaaaacatgcacagggagatccctgagctgccctg

SEQ ID NO: 30544 - DNA, 907 bp, Chlorella protothecoides
  modified_base (203)..(247): a, c, t, g, unknown or other
gtcggctgaccgcgcgcgagggcgtgcgcatggacggccgcgcgccggacgcggtgcgcggaatctcgtgccgcgcgggcgcgctgccgcgcacgcacggctccgcgctcttcacgcgcggcgagacgcaggtgctggccgtggccacgctggggtgcgaggagggtgtccgccgcctggactccatggcggggcaggggggnnnnnnnnnnnnnnnnnnnnnnnnnnnnnnnnnnnnnnnnnnnnnaccgcttctacctccagtatttcttcccgccctcctgcgtgggggagacggggcgccaggggcccgcggggcgccgcgagattggccacggcgctctggcgcagcgcgccctggcccccgcagtcccgcccgaggcggagttcccctactccatccgcctggagtccacggtgaccgagagcaacggctcctccagcatggccaccgtctgcgccggctgcctcgccctgttggatgccggtgggtgggtgtgcgtgctttcttgagaggaggggccgagggagaggatgcatccccccccctccccctcatccttttgcacacgacccagcgccgctgagtgcccccccgccaacaaccaccccaccaaacccccctacaaccaccaggcgtgccgctgaagggcctggtggcgggcgtggccatgggcctggttctggacgcgcaggcgcccggcggcttccgcgtgctcaccgacatcctgggcgcggaggacgcgctgggcgacatggacttcaaggtggcgggcgatgcgcacggcatctctgcgctccagctggacgtcaaggccgcgggcggcatcacgggcgaggtggcggcggccgcgctgggcgcggcgcgcgccgcgcgcctggcggtcctgcgcgccatgggcgcctg

SEQ ID NO: 30545 - DNA, 61 bp, Chlorella protothecoides
gcccctccttcacgccccccatgctgcatttgaggcaggagatgaaaaagggtcggtgttg

SEQ ID NO: 30546 - DNA, 106 bp, Chlorella protothecoides
gggcttgcatcagacccggaaggagagtggacggccccctcgcagtgcatcctagcaccgatcactgtccacctgcgaggcctttgtctttttgagtggcggcgcc

SEQ ID NO: 30547 - DNA, 361 bp, Chlorella protothecoides
acatcggtgtgtggcgtcgggtggtagagggagggggggggttcgcagagtgtgtccatggagggaattttgcctgaagcatggtgctggggccacagagtgcgtatgcagggaggggtcctaggtgtgtggggcagggctcccccacatggggctagagtgcgacgtcgtgctcaaacttgggcgggctgtagcgcgtgtcactgcatggtagtgccccacggttgcctctggccctctttccaggcattgcctcgctggccctcctgaatgcatggggcccctcgctctgtcaaacctctgatcccaccaaacacacatgcacatcacccatcaacccccccccccccccccccccccc

SEQ ID NO: 30548 - DNA, 61 bp, Chlorella protothecoides
ggcagccacagggtccggcatgccacttcagttacaatgcccaggcacacataggaaagac

SEQ ID NO: 30549 - DNA, 61 bp, Chlorella protothecoides
acctgcaccccacttccaggcaacatggtccccctccttcaccggctcgctgccccgctcc

SEQ ID NO: 30550 - DNA, 62 bp, Chlorella protothecoides
gttgccaagtcgtgcgatgtctgcttccacagccacgtgctctgcctccagaaattggtccc

SEQ ID NO: 30551 - DNA, 196 bp, Chlorella protothecoides
ccagccagaagttgatctgaatatggggggaaagggaggagggaaaggaaggtgagcgcagcgattagatgttgggtgaatggttgcacgtgctggagcagtcggtgtgtccagcgctccccaatgccatcactggctccagtgcaagggggctcggggcgcagtgacatgcttcgtccctctccacgcaacaacc

SEQ ID NO: 30552 - DNA, 62 bp, Chlorella protothecoides
cccttgttccggcggcgccacgggtgtgggattttcccgtcgtgtcccactggctcgacatg

SEQ ID NO: 30553 - DNA, 131 bp, Chlorella protothecoides
tgggcttgtggtgcggtgtgtgaaggggggccaggtcccatccagtgaccgattcccccctccccgtgcaaacaagcatccacaaccccccgcgcacctgaagctcggtcacgatgaacttgcggaggaga

SEQ ID NO: 30554 - DNA, 63 bp, Chlorella protothecoides
gtgccttgggtcgtgggggcgtccatgccgcaattgccctttccgattgactctgacacccct

SEQ ID NO: 30555 - DNA, 153 bp, Chlorella protothecoides
ggcacctgcggctaccgtggggggtgcacactgcgtgtgtgggaagaccacgttgacaccttcatgtacggctgagcaggttgttccgatagatgtgccctgtgcgagtacatcccccgacgttaccttgaccgctccatcgtcgtcgctgta

SEQ ID NO: 30556 - DNA, 61 bp, Chlorella protothecoides
ctgtacagccccgccgacaggctcggaccctaatcaccctcacgtacatgcccagcagccg

SEQ ID NO: 30557 - DNA, 81 bp, Chlorella protothecoides
ccatgacttggtccccagcgcgcccagtatacacacctttcccccttccaccccccaaagccctttcaagcacagcacctg

SEQ ID NO: 30558 - DNA, 101 bp, Chlorella protothecoides
ccggtggggagtcttgaagagagtggggggtttgacgggggaatggtatggggccgagggattctccaggttgctcttgagaagagagggtcggaacgctg

SEQ ID NO: 30559 - DNA, 63 bp, Chlorella protothecoides
acgatccgatctgaccacgctggagaaggtagtgacttcctgcctgtgagtgcgaccgtcaaa

SEQ ID NO: 30560 - DNA, 235 bp, Chlorella protothecoides
tccagtccccaggtgtggcggagtcggcaggtgccggtggatggatgtgctccaccttccagcgggccagggatcttggtgttattgatgcgtgtggagagatccggaacacgggtgctctcctcactccttcggcccacacatttgagacctcgcgccccacctgcatcccccgcagggcgcctgagaggggcaatgtgctgcaagcccctcgccagcgaggcggagcgagcgg

SEQ ID NO: 30561 - DNA, 78 bp, Chlorella protothecoides
gactgtatctcaaggcgtcattacaagggttcagtggggttgcatgtatgagtaccatacatgcccacctggtcatga

SEQ ID NO: 30562 - DNA, 61 bp, Chlorella protothecoides
tttcgagagcgacttcacattcaaacccaagcatctgaccacctacaacacctggaacact

SEQ ID NO: 30563 - DNA, 61 bp, Chlorella protothecoides
ctctgagggcagctccaggaatgtcatttcaacggtgcatgcgacctcttgatagtacgcc

SEQ ID NO: 30564 - DNA, 79 bp, Chlorella protothecoides
ttcagcaactttctgctcgagcaggtttccctcagcacacatgtccccaaccccgcattccctgcagcttcacgaccaa

SEQ ID NO: 30565 - DNA, 154 bp, Chlorella protothecoides
cggagcaggtgggtgggtgcttgggggtgtcgcaaggcgcgggtgggagccgtcgcatcggggaccgagcgctctgctgcgctctgctgcgcatggcacccccacgtcgaggttgcgtgaccggacccgctggccgcccctgttcgcgacgcac

SEQ ID NO: 30566 - DNA, 160 bp, Chlorella protothecoides
acgcccacctcacttcaaacccaggctatccacacaaactgaacaaaggctccaaaacacgggcacgaaaacgtcatcaacagcatgagcaagtcgttcaacgacttgaacacaaaccctccctccgtttcacccacccgccagctctttggggccccag

SEQ ID NO: 30567 - DNA, 79 bp, Chlorella protothecoides
cctgcacagccgtggcgggagtccgttttctgtcctcctcggagcgagcgcgcagaggtgagtcactcattctcaggga

SEQ ID NO: 30568 - DNA, 88 bp, Chlorella protothecoides
tgacacccttgcctctcgtgggggcgccacaagccattctctttgcctcattctgtaatgtgtccagggttcctacacacatggtcgc

SEQ ID NO: 30569 - DNA, 64 bp, Chlorella protothecoides
gggactgcgtgctgaggggtgttgcgccccagcacccgtgggttgccagcggtgcggcaccccg

SEQ ID NO: 30570 - DNA, 61 bp, Chlorella protothecoides
ctcaggaggggtcggctcgcggcgacgggggggggagcggcggaagtcctcccgcccgcgc

SEQ ID NO: 30571 - DNA, 61 bp, Chlorella protothecoides
gtaggcgtgcatgactttgaggttgaaggggtcgcgctcccccaggtagtcccccacctgc

SEQ ID NO: 30572 - DNA, 75 bp, Chlorella protothecoides
cctcattgaattggctacccgacgcgctcaggagtgcctggtgtattccatcatgacccacatgatggcagcatc

SEQ ID NO: 30573 - DNA, 61 bp, Chlorella protothecoides
cagcgagtgctgagtgtcagacaccgaatcactggctgcctctccaatcctccgatccaag

SEQ ID NO: 30574 - DNA, 61 bp, Chlorella protothecoides
caggcaggtgcgcaggtccatgccaaagacggggaagtagtcctctggaaacgagtggggc

SEQ ID NO: 30575 - DNA, 70 bp, Chlorella protothecoides
ccccaccctcacccctcgtcatgtccagtacgccgtcaaatatggtatggcagcattgcatgtatcatgg

SEQ ID NO: 30576 - DNA, 64 bp, Chlorella protothecoides
ccccccccccctgcccccaacaagcaaaccccacgcccgactcatcaccaggctccctgaagcg

SEQ ID NO: 30577 - DNA, 79 bp, Chlorella protothecoides
ccagccgcaagacagccagtcgacgacctgtgcattttttgtggtaccggtccactcctactaaaatctgaaatcaggc

SEQ ID NO: 30578 - DNA, 61 bp, Chlorella protothecoides
tgtgggcccttcgcctgccccagcgaatccaccgccggccatcagtccctctccagccgca

SEQ ID NO: 30579 - DNA, 130 bp, Chlorella protothecoides
tgccttcatcgaccgacgctttggaggtgcatgggctgcatggtagctgtatgtttgggttgctgcgcttgctgcagccaggcggcactgtctcagttggtacacttggtcagcaacaacatgaattcct

SEQ ID NO: 30580 - DNA, 69 bp, Chlorella protothecoides
ctcaaacgtacacgactgcagctcgtggttttgcaagatgcgatttccgcgagagttgcctcacaatga

SEQ ID NO: 30581 - DNA, 61 bp, Chlorella protothecoides
ccccttccatttgcctgcagtggctccccccgtcctaatgctggacagctccttctgcaga

SEQ ID NO: 30582 - DNA, 80 bp, Chlorella protothecoides
agccttgccaggcacaatgtatgatgggggtgtcctatttcaatgtccatccctcctcctccttccaccatgacagccga

SEQ ID NO: 30583 - DNA, 80 bp, Chlorella protothecoides
tgccgtctgcatgcctgcccgtcactggttggccactgtgcccatcctctgccccccccatcgcgctctcctccagctgg

SEQ ID NO: 30584 - DNA, 68 bp, Chlorella protothecoides
caagcatcaactcttctatagtgggataattgctggaaggtcgagccactcacctttgttaggcactt

SEQ ID NO: 30585 - DNA, 173 bp, Chlorella protothecoides
gccggctgtccccactccctcgctggagccggcggctgagggggcctccagcgccacactggtggtcctcccgccagtcattaccagccggattgcaggacctggtgcagagccagtctccgagcctactcccgaacctgtctcagagcctgtctcagagccacccttggagc

SEQ ID NO: 30586 - DNA, 72 bp, Chlorella protothecoides
cacgagccttgcatcacaaaaggccccatctcctcaaccaatgaaggcatcacctcttccaccacgaaaggt

SEQ ID NO: 30587 - DNA, 122 bp, Chlorella protothecoides
ggcacgagcctttccctgggctgtatgtgacacaccacccgcctgtgtgacctccttcgagacccccggtggactgtgattccatgtgcgcacgcacggcatgccccagggtcacagcgagc

SEQ ID NO: 30588 - DNA, 130 bp, Chlorella protothecoides
ctggatgcggaaagtgtccccttgaaggaggcatggatcggggagtgctgagttaccggtgtgcgcgcgcgatcaacatgctttaagtagccggatctgaggggcgttcggcactcccctgcgcatcctc

SEQ ID NO: 30589 - DNA, 79 bp, Chlorella protothecoides
ttcccacccacgaagggccaggccttgcaggacccccaaaacactgcctgctggagcagctaggccgaggcccaagccg

SEQ ID NO: 30590 - DNA, 101 bp, Chlorella protothecoides
tcaacaatacgctcagctgagcaagggaaatgcatgtctcaatgcctaaaaagggcagtgctttcaccccgtttcccacccctgcacgtacttgagaggga

SEQ ID NO: 30591 - DNA, 67 bp, Chlorella protothecoides
cacccgatgttaaaaatcaaccttgtgtatgagaggcagcagcgggacccaggcgtgatggccctgc

SEQ ID NO: 30592 - DNA, 133 bp, Chlorella protothecoides
ggggagggggggtggttgaggcgggtctcctagagggcgccgtgtctggaaacgaaccctgcactgagttgagcgtgcacttcccgcacacagcctcttgcagcagtgccgccaatggccgggaaacgacacc

SEQ ID NO: 30593 - DNA, 61 bp, Chlorella protothecoides
agccttcacagagcctgcgcagggacggggtgatataacaggtttcacggacgccacgcat

SEQ ID NO: 30594 - DNA, 139 bp, Chlorella protothecoides
ggcactgtgtgcgctggagccaggcatgtgtgattatcagccgcatgccggacactcctcatcccaggaaaaggcaatgcagcctgtcatgaagggacggagcgctgtagatctgtgtgattggtgccgcgccatctct

SEQ ID NO: 30595 - DNA, 107 bp, Chlorella protothecoides
atccctcgccgcgcctccctgaggtctccaccccccaaaccatgagcgacccgcgtccatgacaaccagttccccacagcacattctccgcctgaccactccccacc

SEQ ID NO: 30596 - DNA, 61 bp, Chlorella protothecoides
gacggtgatgctgcgcaggcgctgcgagacctcgtgcagccagccggagagcgggtagccc

SEQ ID NO: 30597 - DNA, 87 bp, Chlorella protothecoides
cagcctcggacgatgcttggagtgtgctggaatcgcacattctggggtgactgctgcggcccatctggattgatggtgctgcgagac

SEQ ID NO: 30598 - DNA, 79 bp, Chlorella protothecoides
cccccccccccccccccccccccgcgcagaggagatgcagtcgctgacgggggagggcctggccaccgccctgcgtgac

SEQ ID NO: 30599 - DNA, 61 bp, Chlorella protothecoides
ctgcggccctgaggagtttgccctcgccatcgccaagcactttgtagacaactaccccctg

SEQ ID NO: 30600 - DNA, 102 bp, Chlorella protothecoides
tctccggcccccgccacctccatccctgcccccttcacccccattcacactggcgatgtggccatcacacccccactgcgtcaccagcgccgcaactctgtg

SEQ ID NO: 30601 - DNA, 61 bp, Chlorella protothecoides
gcgacccacctgatctggcggtgatcaaagtgcactcgagtccttttcccacgtctctctg

SEQ ID NO: 30602 - DNA, 68 bp, Chlorella protothecoides
agcatgcagggacccttcctgctgcgactgcgtgctgcctgctgttgattgcccgtcattgaacatgt

SEQ ID NO: 30603 - DNA, 72 bp, Chlorella protothecoides
cgggaggggttgacggtgaacctgagaacatggaaacggaacgcagtggggctacttggaattgtgcgtcac

SEQ ID NO: 30604 - DNA, 64 bp, Chlorella protothecoides
catgacctcactagcattcgttgaataatacaatcgcaatgtgtgggtcccacggggtgcgatg

SEQ ID NO: 30605 - DNA, 8035 bp, Chlorella protothecoides
  modified_base (756)..(765): a, c, t, g, unknown or other
  modified_base (3042)..(3051): a, c, t, g, unknown or other
  modified_base (3255)..(3264): a, c, t, g, unknown or other
  modified_base (3572)..(3581): a, c, t, g, unknown or other
  modified_base (3761)..(3770): a, c, t, g, unknown or other
  modified_base (4447)..(4503): a, c, t, g, unknown or other
  modified_base (5230)..(5239): a, c, t, g, unknown or other
  modified_base (5340)..(5503): a, c, t, g, unknown or other
  modified_base (6080)..(6089): a, c, t, g, unknown or other
  modified_base (6190)..(6280): a, c, t, g, unknown or other
  modified_base (7046)..(7055): a, c, t, g, unknown or other
gggggggggttcttgcaaggggccaatcacgggtgcgccagtgcagggccggcgacgcccggccaagccctcatgaacgacgccgcccggggtcgcaggcggtggcaaacccgcggagcgctgtcggcccaggcatggcgccttgacccccaccttccccggcgccggccctcacctccggacagcacgatgcgcggcgcggtgtagttctccgccaggaagtcggcgatgtctgccggggtgaggcgtgccgcggccccctcagccgcgatcaggggcttgcccaggtcacccgagtaggcggcggcgtgcaggccctcaagcagcgccagctgcgggttgtcggccaggcccttcaggtcggcctccagcttggcggcggcgtcccgcacctcgtgcggcgccaggcgcggcgccagcaccgcgtcggccaggacctccagggcttcgggcaccagcgtgcggggcaggtcaatggtgtaggccatctgctcgcgcgaggcggaggccagcacgttggcgcccagggcctccacgtcgcgtaccaggcgcaggtgggtgcggtgcgccgtggacttgaaggccaggtactccagcaggtgggagacgcctgtcagggggcagagggccgggcgaggtgaggcgcaaggcatggtacaatgactggtatgaggaccagttgtaggaaaggtgaagggggtcgcatttattgtaggatctaaggagggggctggaccaggaagggtgtcagcagcnnnnnnnnnnagcggaggggcggccgaggtgaggcgcaaggcatggtgcaatgactggcatgaggatcagatgtagaaaaggtgaagggggtcgcattcatggtaggatccaaggaggggggctggaccaggaagggtgtcagcagccctacagccagagcacgggctccctgctacgcccagtcgcctcaccagagttggcgggggtctcattcacgctcccagactccacatagatgccaagggtggccgtcgcaccctgtatataggaggaatggtgggcaatgatcatacgaaatcagccatgctgatcaccatttgtgcgccttgccgggaaaccacccccacggcaaattcactctgcccctccacccacgcaccggggtgttctcgctggcgaccttcacgccgttggagagggtggtgatgtgggtctcagggcgggaggagggggctggggcgggggtgggcagctgcacgccgggcagggggtcagtgaggggggtggtcaccctgttggagccaccgaagaggccggacaggaaacccttctctgccgtcttcgccagggcaggggcagccgcctggagtccggtgctggtggaaaagcatccccggcccagagccttggcgggctgctccagcccacgcagcagggacatcgcgggcggtccttcgggggtgcaccctcagcgattcaggccaggcgcccagggtcgcacgattccgtccttccactttgagtctgctcactgaaatgcagcagacaggcgacaggattgcaggatgcgagggctccactgtcagcccgtgccaacccaatgacaacgctggggcacggggacaaatgtggggggccgagctggtcggggacccggccaacgcgcgaggttggccagacccgagtttgctcgcaatacgctccaaggaggtctgccgacggcccacgccctaccagtgccgatctccccttcagccggctgaccaggggcatcgcattctgctggtcccccactcctcccagatcagatggacaatagtcaaaatccattccaggcaccctccaatcctttcggcgatccctttggtcacgaggccaacgtgcagacctaccagccccccagcatccggtcaggggcctggaacagcgccgatgaggtggcgggcctgggcgaggacgacacctatggcgagcccttctctgcagcgcacctagctgccgcacacgaggctgccgtgcccgccatcgttacccctactcccgccacccagccccagccggagaagccctctgtgcccctggccttcacaggcgagcccgggagggctcggggaccgatgttgcagggtcttgggcgactctccctaaatctggctaggcccgcgcatgcttcctcacccctgtcctcgccctcccataccgtagatgccacctcctcacaacaagacatctctggcaggatcgggccgggccctgcctccttacagcccccccccgcccggctggggtcagggccgccggcctatggcgtcagcctgctccccgctggcgtaccccccagcctcccgctgccggggcggggaggccccgcagacctggaggaccccaccaagtaccccttctacaacgtcaggcggtaccgcacctacttcaacgtcgacaccagcgacgtgctggggcgcatcttccgcgccatcgccctcttcttcaagtccgacttccacgaattcatctcccccaatccagacctgtacggacccttctgggtggccaccaccctcgtcttcgtgtcggcggtgacggggaactacgcctcctacctcgcatggaagcggagccacgccggcgacgaggccagcaccggctggtacggcgacatcaacaaggtacgcgaagggagggggcggtggtggctccttgtcgacgtggagggaggggatggggaggcgtcctgtcccctgaaccatgtgccaccagagctccgagacccaagcgcgccttgcccgcgtcgagaccaatgcacgcactccagaccatcccccgccccgcccccctccccccctgccaggttgggggttccatgggcctcttctacggctacgtgggagtcgtgggcctggcgctgtatgccgcgctgcgatacttccgcgccggcgtgtcccttgcccacgtctggtgcacctacggtgggctgtggtggggcgcgcggcgcgggcgcagacccttccacggccgagcatgccctgcaatgccgtgccggggggggggggttcacgcaccgtccannnnnnnnnnttggtgcacctacggtgggctgtggtgggacgcgcggcgcgggcgcagacccttcaacggccgagcatgccctgcgatgccgtgccgcgggggacgttcacgcaccgtccatggcatctggggtgtcctcgcctacccattccacgagcctgtcaaaacccgatcccctgccccaaaccccgctgctcgacaggctacgcgctnnnnnnnnnnatacctgtcaaaccctgatcccctgcctcaaaccccgctgctcgacaggctacgcgctggcggtgttcatccccatggcctttgtctgtgtgttccctgtggagatcatgcgctgggtggtggtgggcgtggccaccctgaccagcggcatcttcatcctcagcagcttccgggtggcggtggtggaggccgcgggcgccaagtctgtgccgctctttcttgtcatggccgccctgcacgccggcctgggcctggccctcaagctctacttcttccgctacgccagcgtctgaggcccagtggcttgnnnnnnnnnngaagcggtccctttgacggtcttttccccttcttgttcctgtcttgtccgcactccactctgcaagcaccagagtgacagcaagcgcgagatggtggcggtgcgcagtggtgggtctcctggacctgctccccgtgccatgtcgctgtgagctcttccaccgcctggctggcgatggacnnnnnnnnnnagcggtgcgcagtggtggatctcgtggacctgctccctgtgccatgtcgctgtcagctcttccaccgcctggctggcgatggacagcctccgtgcagggggactgaccagcaaaggacacggcgcctcgcggcacatcacgcgtcgacagcggcagcctctgtgtacgcgcggaccagtgcggcgtgcagggtcgggggcgccgcggcgatgatgccgccctgcaggccctccaggaaccgccccgccccaaagtccagcggccgcccgtggcagtcggagatgcagccacccgcctcggtgaccagcaccgcacccgcagcgtggtcccacaccttctctttgtaccccggcgcgggcatgcgcaggaagatggaggcgtccccccgcgccagcaagcctgggtggcgggagaaattgggcggggaagaagggtttcatacggggcaggcgagcagggatttagagtctgtgaccggacgccacgatgtcgtccccgaatggtccccgtggctcccaatgccggttgagttcgccaccctagctcttccccccccaaaaagaaaagatccccaacacttcccctcaccactccgccgccgctcaccgtacttggcctggctgtccagcttcagggcggggcgcgtaacccccacggcggcggccagccggtctgtnnnnnnnnnnnnnnnnnnnnnnnnnnnnnnnnnnnnnnnnnnnnnnnnnnnnnnnnnggcgcgactcccaggacgtcatgtacaccgccgccgagccctctgggtcggtctgcgcggagatgcgggcagggacctccccgccggccagcccacacacccatgcgccctggcccttcactgcatggaagaggcagccggagtcgcgcggggcgaggcgcgcgtctcgccccgccgcctccgcgtccaggctcgcttggcccacgggcgcggcctgcggcaggttggggcagcccagcacgcccagcgtgacctccccgccctcgatcaggcccaggcacaccgcgtactggcgccggcccacgaagccgcgcgtgccgtcaatcgggtccagcacccagtgccgccccgtgcgaccgccgggcgagccgccggcgtcgatcaggtcggccacctgggcgggcgccagctggcgcgccaagcccagcgtttcgttcaccagcgcggtgatgcggtccagcataacggcaccgctgggcaatcttttttgggggggggggggaagggggtagtggtggaggtgtgtgggtgtgctggggtgcagcgtgagggacggaggatgagggagcaccgtaaaggtgaatcgcctgccatcccgtgggatccagttcagtcggccatgcaaaggcttgattcttccaaatctggcaaggcgaacagtcaggcagatgaatgccggtttagcggtgaaacattgacacctatgccagtctcaggcaccacctgnnnnnnnnnnggcccagcgtttcattcaccagcgcggtgatgcggtccagcatggcggcaccgctgggcaatctttttttttttttgggggggggggggaggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaatctggcaaggcgaacagttaggcagacgaatgccgctttagcggtgaaacatcgacacctatgccagtctcaggcaccacctgaggtcatcggcatcctcctcggcgatgagcgacagcggggtgccagggaaggcctccttcagggtccatgccaccacggcctgcgcgccatagtctgccacagtcacggggctgtcgtcaggcttgtcctggtgctctgcggagcccagggtcatctggacgctctgcagtgtcgagggttgtaacagacgggcctagtgttgcactgtgaacgaaggctgttgcactgcagggcgagtaaactcgcctctagttgagatacatccatggatgcaaatgtgtgcgacatcagtgcccctcaagctacccacccggcacagccgtgaggccagcgtgacagcctgcctggccgccttgagctcttcctgcagcgccggcatcgtcgccggcatactcctggtgtcggatacagattgaaccctgaagtgaaatgatctgttgtcacctctggtcccaccctgtcgccgtgtgttggcaagggtcttgtnnnnnnnnnnattgcactgcagggcgggtgaactcgcctctagtcgacatatatccatggatgcaaatgtgtgcgacattagtgcccctcaagctacccacccggcacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactcctggtgtcggacacagattgaaccctgaagtgaaatgatctattgtcccctctggtcccaacctgtcgccgtgtgttggcaagggtcttgtgctggactctggggcagccagccctgaagatcactttcagggagacttggcagcgatgcagagccacggcaggaggtatcgcgaggctcgctaccatgacaggtgtttgatacttgggacctcgtagatgacaaatgtgcgtgcatgcgggtgcctggggcggaggaaccggcagggaatggggtccgcagggagtggcgatggaaagcgggggggcaaagatttccccagggcgccgagacactcatgaattcccggatacccgctcccgaggggcatactcccgtcacagccccgcttgtgacaggctccctgaggagccttgcgttccgaagaggaggtggtgtgcatccaggccccagccatgtcgttgcttgcttccctgcctgcgcctgtgaagacatacaccgctcccgatgctcctgcgccgacgggacccagcggcgaggattcgcggcgaccggtcaaggaggtgcctccctatggccggcgacagggattcgtgcctcgccgggtggacgacttcggcgggggtgagcggaaaggggatggcgagcaccgggctgcacccggacctggcagcgcggcgctgagttcctttcgagatttgaatggatcaattaagacctcatttgatagttgactagaccgcgtcatgccctccaccccnnnnnnnnnntgacctagcagcgcggcgctgagctcctttcgagataggaatggatcaattaagatctcattcgatgattgactagaccgcgtcatgccctccaacccctttccccacacaggcggtgccttccccgagatacacgttgcccagtaccccttggagatgggccgccccaaccagcggcccggcggtgcggggcgcacggaccagaccgtggccctgagcgtgaatgcggagggcgaggtgaactacgacgcggtggtgcggcagggcaaggacgcgcagaagtgggtggccaccacccatgccgcgctggtgcccaagctggagcagctcaactccgacatgccccgccccgacgaggaggaggtggaggcggcagccaaggagaccgcggccgcgctgcaggcagtggtctcgcgcaagcaggcggcggtgaaccccaagacgctgccctcgcagccgggcgcgccgcagtacatcaagtacacccccgcgcagtcggggggcgcacacaactcgggcgcggcaacgcgcatcatcaagatgcaggacatgcccgtggaccccatggagccgcccaagttccggcacatcaaggtgccgcgcgggcctgggtcgcccccggtccccgtcatgcactcccccccccgcgcgctgacggtgcaggaccaggcggactggaagatcccgccctgcatctccaactggaagaacagcaaggggtacaccatcccgctggacaagcgcctggccgccgacgggcgcgggctgcaggaggtccagatcaacgaccagttcgccaagttcaccgaggcgctgtacatcgccgagcagaaggcgcgcgcctcagtggacgcgcgcgccaagatgcagcgcgagctcctggcgcgcgaaaaagaaagcaaggagcaggagctgcgcgatctggccgcccgcgcgcgcatggaccgcgtgggcggcccgcccggcggcccggcggccgc

SEQ ID NO: 30606 - DNA, 79 bp, Chlorella protothecoides
gtccccacccaaactcacgtctcagcccacaacagcaccagtggaacaacagctcacccatgatgtggatctcgtttcc

SEQ ID NO: 30607 - DNA, 62 bp, Chlorella protothecoides
acctaccctggcgccgcaatcaagtccatggcttgcttgtggccgaactcgacattgtagcc

SEQ ID NO: 30608 - DNA, 61 bp, Chlorella protothecoides
actggaggggcatgcatcgcttcgataaatcctgcacatcgaccagtgtattacaacttac

SEQ ID NO: 30609 - DNA, 126 bp, Chlorella protothecoides
ccggcgtgtcgcaagcgacggcgcccacgaaggggcccgagccggcaccgagcggcgccgtgctctccccactcgctcgccagccgggcggcaacttccggaaggctccccccgtgccctgcgagg

SEQ ID NO: 30610 - DNA, 72 bp, Chlorella protothecoides
atgaacatcgagtggactggatataatgttgatcgggggttatcacccggtcaacacttctgcttgcgtgca

SEQ ID NO: 30611 - DNA, 67 bp, Chlorella protothecoides
cccctaaccctcccctcccctgttgagtgcagtgtcttgtcgtgtgcacccccctccccctaaccct

SEQ ID NO: 30612 - DNA, 95 bp, Chlorella protothecoides
aagcgtaggatgggtgaacgaccaggttctggttgataagtctattgggtttcgacgttttgttggtcccaccggttggaccatggatcttattc

SEQ ID NO: 30613 - DNA, 1328 bp, Chlorella protothecoides
  modified_base (427)..(485): a, c, t, g, unknown or other
  modified_base (580)..(589): a, c, t, g, unknown or other
  modified_base (684)..(693): a, c, t, g, unknown or other
  modified_base (819)..(906): a, c, t, g, unknown or other
tggggccctggacggagctgcgtccgcggccgtcgctacagcgacaccggcagcgacggagccgtcgccgcgcgacgcgccggtgttggacgccgccgccgccgccagcctgtccactctgctctcggcggcggtgcgccagcgcctgccggcggtgcgcgtcgcgctgggcccctcgcgcaaggaccccgcgctgggcgtcccgctggccgcctggctggtgtcggagagcctcatcgtctgggcgggggcttgggcggcgcagcagctgggcctggcggccgaggcggtgcagggcaccatcctgaccaccgccgccgccggcggtctcacagcgcaggtgtgtgtgatggtggtattgcttgaggggggtaaatgtgggtggtggaggaaaggcggaggaggagggggtctgtcagcgtgcgtnnnnnnnnnnnnnnnnnnnnnnnnnnnnnnnnnnnnnnnnnnnnnnnnnnnnnnnnnnnattggaagccccatgtgttagcagtgctgggaccctcatcttgtcgtcatgacatagtgacgcccgctgattgtgcctccacaccaccacccacnnnnnnnnnngttggaagccccacgtgttagcagtgctgggaccctcatcttttcgtcatgacatagtgacgctcgctgattgtgcctccacaccaccacccacnnnnnnnnnnaggggaatgtgggtggtggaggaaagacggaggaggagggggtctgtcagcgtgcgtgtgactgccggatggcggcgcggcgtggggtgtggcggagtccagggcaaggctggcgtcgtgctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccgctcgacctgccccctggaagcaccaaaacataccacctcatccccccccccaggcctactggctggcgtccacgctggccatcggcgcgctgctcaagatgcggaccatcggaagaaaggagggcgcgctgctgctgcgcctgggcgacgagctcatcggctttggtgcgctgcacgagtgcctggcgggggcgattgccgacaccctgcccgtcaccgtcggggtgaggaaagggggaaggggatgtggggtgaggttttactgggtttctgtgttgaaggggccctggcttcggagggaccagcaccgccagtaacactcgcgcacgtcccgacctcgtcagcccctcgcccagccctgccgcccagccccggccgtacggcctcgtgtgcctccgcccatttctcccccccc

SEQ ID NO: 30614 - DNA, 123 bp, Chlorella protothecoides
ttcgctgcacaagcacggcagacaggtctggaggagatgtcacatatgatctcactatttggagcacgctccagatggcccagagagactgcggcaggcccaggcacagagtggacatctggg

SEQ ID NO: 30615 - DNA, 80 bp, Chlorella protothecoides
ctgagccagcaagggtatcttggaatgtctcgatgtgggggggaagaacctgagagcggggcaggcaagggtttttgctc

SEQ ID NO: 30616 - DNA, 145 bp, Chlorella protothecoides
cgcgaggagcgcgcacaggcccctcacgctatgctccttctcctcgccgtctcggacccctgccaggaccgagcacctgtggagtacgagatggaaaagggggatggctgggtgcctcagcgacagaaatgtcacctgcgggaat

SEQ ID NO: 30617 - DNA, 155 bp, Chlorella protothecoides
tctccagcgctttgcacccgacctgggaagggacactcgcttgttggtgagtttgggggtttgaaaggtccggcaactgcgtccctgtggagagtctcaccatggcaggcctcctgaactctactcccccaggatgcacagtatcagcaaagcca

SEQ ID NO: 30618 - DNA, 72 bp, Chlorella protothecoides
cgcttcaatacgtggggaaggcacagtgcagtgatcaaggctcatgcttccctccaagccccctctgagcaa

SEQ ID NO: 30619 - DNA, 79 bp, Chlorella protothecoides
atggtcgccctgcaccgcctcacggtgcgcacccgggtgtttgccacatgctggggctcggggcgagcgcccgggcagg

SEQ ID NO: 30620 - DNA, 61 bp, Chlorella protothecoides
gcccggggcggtggccctgatcacagcggggcagggggacatggtgctctttgtcaccgac

SEQ ID NO: 30621 - DNA, 705 bp, Chlorella protothecoides
ggggggggcgctatgcagcttgagacattgtagggtttctgcagtgcttggtttgagaatgagcggactgggctggacagtgaggccatgcaggcatggcagcacgctcactcccccaacgggcacaaatcgtcagctcccgtgcaggtcagaggaccagcccagggccccccacccccctcacagcaagaagtcagtcacacaccttggctcttgcccagtgtcatgatgccgcgggtggggtggaaccggaggcccacctctcgagctgcccggatggtgtcatccagcgtgacatcctggattgggttgcagggtgggggatgatgggggctggatggatggaggtgcgagctgtggagcgcagtccgtgcacagttcttcgccgtgcacccagagggagagcattgtttcccccctcccccaccatgcactcacgttggggtagatgtacagatggtctgagctggtggtgcagccgctcaggagcagctccaccatggcgagcttggcagagacgtacacatcctcgccctggtgatatgagcacgcggtgtggcacatggagcgaggagttctggtggcgtctggcatcattggggcagggcatgtccacacgtaccgtcatggtgctccaagctgggtagaggctggtgagccacccaaacagggcagagtcctgctccgtggggggggggggggggg

SEQ ID NO: 30622 - DNA, 61 bp, Chlorella protothecoides
tcgactttggggaggtcacaggcgagctgatggaagctctggaaggtgagacattgcgttt

SEQ ID NO: 30623 - DNA, 112 bp, Chlorella protothecoides
ggccaggttccaccagcgctggggcatcgagtccgtgtcggaggccccccgcttcgcgccgctctaccttgccgcccgcgcacgccacttcgcctggcgccacgagctgggc

SEQ ID NO: 30624 - DNA, 61 bp, Chlorella protothecoides
gctgccctactttggctacgcgcgcgcggatcgcaagactgcggggcgcgaatccatcgcc

SEQ ID NO: 30625 - DNA, 125 bp, Chlorella protothecoides
gggggaaagcagcagtcaggaagggacggcaggcggtgtcacggccgacttccagaccccgaccagtgaacaagagcttctcgacttttgccacgcacacccagaggtgcagtttagtcgacctg

SEQ ID NO: 30626 - DNA, 62 bp, Chlorella protothecoides
gagcgggtgcctcctcggcagcaatgggcgtatcctcggcaggtgggtgagacttcgccttg

SEQ ID NO: 30627 - DNA, 61 bp, Chlorella protothecoides
tacatattcttacgccccagccactcattgagtcgatgccctagactatcggcatggtggt

SEQ ID NO: 30628 - DNA, 71 bp, Chlorella protothecoides
ggtccaaggtgcacactccctgggcaggggccccttacctgcagctccagcccggccagcaggctgacatc

SEQ ID NO: 30629 - DNA, 173 bp, Chlorella protothecoides
ttgcctgatcagtgctccattcgatgcctgtgtgttcgagcagacttaatgtttcaagacttgtgcctgatagtctgagcgtagagcggggaaagggctgcttaagcaggttagggcattttctgctagagaagctggaagcactttctgtgcaatggtgtacagtcaaccag

SEQ ID NO: 30630 - DNA, 76 bp, Chlorella protothecoides
cgctccgaggcagcgcactctcccaaacaggactcgtgtgggggccccatgccccctcctcccctttcccaggatg

SEQ ID NO: 30631 - DNA, 80 bp, Chlorella protothecoides
ccatgccccctcctcccctttcccaggatgaggcctagccggggatgtcacccccacggcactcacttgtatcgcgcggt

SEQ ID NO: 30632 - DNA, 84 bp, Chlorella protothecoides
ggggaggagcccacccaggagcaggtggacactgtgcatgcggcattctacgatgccatgcaagcgctgtggcacaagcatgcc

SEQ ID NO: 30633 - DNA, 126 bp, Chlorella protothecoides
tgcctggagacggggagggggagacttcagatggggaagtggaggaggatgtgtcagatggagaaggagacggagagtcgttgctcagacaaggggatggagagtcgtccttgggagaaggggacg

SEQ ID NO: 30634 - DNA, 6564 bp, Chlorella protothecoides
  modified_base (90)..(329): a, c, t, g, unknown or other
  modified_base (575)..(584): a, c, t, g, unknown or other
  modified_base (893)..(902): a, c, t, g, unknown or other
  modified_base (1275)..(1284): a, c, t, g, unknown or other
  modified_base (1709)..(1718): a, c, t, g, unknown or other
  modified_base (1921)..(1930): a, c, t, g, unknown or other
  modified_base (2397)..(2406): a, c, t, g, unknown or other
  modified_base (2582)..(2591): a, c, t, g, unknown or other
  modified_base (3318)..(3327): a, c, t, g, unknown or other
  modified_base (3983)..(3992): a, c, t, g, unknown or other
  modified_base (4755)..(4764): a, c, t, g, unknown or other
  modified_base (4986)..(4995): a, c, t, g, unknown or other
  modified_base (5753)..(5762): a, c, t, g, unknown or other
  modified_base (6213)..(6222): a, c, t, g, unknown or other
ggcgtcttccccctcaggtagtggcatgcttgggagcggagggaggggagcagacttcagaggcgttggggtctgtgaccaaaggactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggctgcagcacggaaaggtatctacagcaagtggtgaaggggggtaggatgggtgaattgaggcttatgtacaccatggcctttgtccagctcaaggaaagtcgaggctagagacgggtggcagggtgctgttccggctcacaccagcaccagcccaaggtcccccatcagaacaccaaactttctgtacactcaactgtacctgtcccatgacgcacaggcctacactgacgccaagagcctnnnnnnnnnngccagcccaaggttccccattagaacatcaaactttttgtacactcaactgcacttgtcccatggcgcacaggcctacactgacgccaagagcctgcggtatgggcacctcatgatcatgaccgatcaggatcatgatggctctcacatcaaggtccgagacatttcagtgcaatcgccagagacgggagggaaaggaactctttaatggggatcccagcaatataaactctagattgcagagcacgtgccatgctgttgtcctcctctggtctcagtattgccctcccttcctcccatccccccctgnnnnnnnnnncatggggatcccagcgatataaaccctagattgcggagcgggtgccatgctgttgtcctcctccggtctcagcattgccctcccttcctcccatccccccctgcagggtctgatcatgaactatttccaccatttctacccaagcctcctcaaggtcccggggttcctcgtggagttcatcacgcccatcatcaaggtgggcatggagtgagagcctggcggatgggtggggtggagctgctgcccttgatgtgaaccacccactaggcaaggtgaaatctcatccactcccaaccagcgatccatgcaatctacactgcactacgcccctcaaccccaatgcaggccactaagggcagccagtccaagtcannnnnnnnnntctgcccttgatgtgcaccaaccactaggcaatgtgaaatctcatccactcccaaccagcgatccatgcagtctacactgcaccacgcccctcaccctcaactcaggccactaagggcagccagtccaagtcattttacactatgcccgagtacgagagctggtgtgaggaggggtctcgccgtggatggaaaatcaagtactacaagggtctgggtacctcgacggcccaggaggccaagcagtactttgcgggcctggcgcaccaccgcaaggagtttgtctgggagggtgagttgtgtggaagtatggaggacatggttgcgctgaagcttcattatttgcgtgcaagtgctcttaacacgagctgctctcgtacttcccgcaggcgaggaggatggcacggccatcgagatggccttctcnnnnnnnnnnctgcgctcctttgtccccggcaccttcctggaccacaccgccgacaccatctcctactccgactttgtgcatcgggtgagcagagggcacgttcaagatcgggcgaaggtcggcacgacataaggacggcttctcaagagccactgccgcttggctggcggcacctggaacaatgaatggatcccatggctgggagatgctcnnnnnnnnnnagggtgagcagagggcacgttcaagatcggacgaaggttggcacggcacaagaacggcttctcaagagcaactgccgcatggctggcggcacctggaacgatgaatggatcccatggctgggagatgctcatggggagatggcacgaacattgacaacatgaaccacgtccatgctcaccttccacgtcacactcttccccccaaccacctgcacaggagctcatcctcttctccagggctgacctggagcgctccatcccctgcatggtggacggcctcaagcccggccagcgcaagatcctctacgcctgcttcaagcgtaacctgaaatccgacatcaaggtgcggagggttgacgcgggtttgaactgcttggctgtgatgtcacatgaccctgcaacccactctgtgccctggactccgcctgcgtggcatggcacttcccatcttcgtgctcagtttgtcnnnnnnnnnncgtcacatgaccctgctacccaatctgtgccctggactccgcctgcgtggcaaggcacttcccatcttcgtgctcagtttgtcacacagcctcctccaaccaccccttgccccctcccctccctccctggcaggtggcccaactggcgggctacgtcgccgagcactcggcctacnnnnnnnnnnactcctccaaccacccttgcccccttccctccctccctggcaggtggcccaactcgcgggctacgtcgccgagcactcggcctaccaccacggagaggcctcattgcagggcaccatcgtgggcctggcccaggatttcatcggctccaacaacatcaacctgcttgtgccccagggtgagtgaggggttgcttcactgcacagcatccccccagtccctgccccaggctggtcgtctcaccacccttgccagtccctgccccaggctggtcgtctcaccacccttgccagcccctccccaggtcaattcggtactcggctccagggtggtaaggacgctgccagcgctcgatacatcttcacccgtctggcccctgtgagtaaatctggtttgatgaggaaagggggaagggggcaggaggatgcatttgaatggaacttgaggtccttgtcatccatggacacccactgaccaccagtgagcgagccgcctgccctcgcttgcctctttccaccgccactccacagccactccacccgcactcgccatacagctggcccgcagcctcttcaacgagtcggacgacagactcctggcctacctgaacgaggagggccaaggcatcgagccgcaatggtgcgcatcctgagatgacgcaagactagttgcacgggtgccggccgctgtgctacaaagcggtggcgtttggcgcatgcttatgaagtnnnnnnnnnntacgggtgccggccgctgtgcggcaaggcggtggcgtttggcgcatgcttatgaagtatttgaactttgatgagccgcattgggtcctgtttccctcgcccaccgtcctgaaccctgccccaccctgacaacaccaggtatgctcccatcctgccgatggtgctaatcaacggcgctgacggtatcgggactgggtggtccacctccatccccaactacaacccggaggacattgtacgtgcaacgatttggcttcttagggcagctgtggtgctttgactgcaccacaccgggtgcaggagaagaattgttgagacacgatgccaaactggcgcgccacatcacctaatctcatcatgcccactgccccgccaggtggacaacctgaggcgcctgctggagggtgaggagccggtgcccatgaagccctggtaccgtgggttcacgggcaccattgaggaggtgaggtgacacggctggcgtgcacttggtgtgtcatgccctcgatgctgacctgaggaggagggtatcagtgcgtgcattgcaatgacatctttgagcaaaggagttgtcaatatcagggccccatcaggcacccccattcaatttcatcctttcctcccctgactctttatcaccagcatctttcacccccnnnnnnnnnnatgaggaggaggttatcagtgcgtacattgcaatgacatctctgagcaaatgaattgacgatatcggggccccatcaggcacccccactcaatttcatcctttcctcccccgactctttatcaccagcatctttcaccccctccccccccttcccccccccaaccaactaaccccgtaggtccccggcaagacaagcggcaagtcctaccaggtgacaggcacgatcaggcagctggacgagaccacgctggagatcacggagctgcccatccgcaagtggacccaggactacaaggagttcctggaggagctggtgaagccggaggaccgcgcggcggtgcccttcatcaccgactaccgcgagcaccacaccgacaccagcgtgcggttcgtggtgacgctgaccgaggccaagatgcgcgaggcgctggccgtgggcctggagaccaagttcaagctgaccaccaagatctcctgcggcaacatgatgctgttcaaccccgacggcgtcatccaaaagtacgactcgccggagcacatccttcgagacttcttcgacctgcgcctggagtactactcccgccgccgcgcggccctgctcaaggtttgcatgtgtgtgtgtgtgtgcgggaggggtcccaggcggcggaagaggtggagggggggaagggggctgaggggtgatcaaggtcaggaaggaaggccatcggccagatccttccagacgctggatcctcacaagtgcccaacagcgcggccgcnnnnnnnnnnaaagggggctgagggtcgatcaaggtcaggaaggaaggccattggccagatccttcgagacgctgaatcctcacaagtgcccaacagcgcggccgcttcggccaacatggggcggggcctggctctcagcccggctctgcgcccagtggttttgtccatctccacacacaaaccaacctccactacaggcagcggaggccgacctgctgcgcatctccaacnnnnnnnnnncggttttgtccatctccacacgcacaaaccaacctccactacaggccgcggaggccgacctgctgcgcatctccaacaaggtccgcttcatcctggcggtggttggcggcgagctcaagctgtccaacagaaagcgcggcgacattgaggctgagctggagcgcgaggggtacgaccgcctgccctcggccaagaaggcgctggcggtggccgccacaatgggagaggaggaggaggacgaggagggcagcgcggcggcaggcagctacgagtacctgctgtccatgcccctggccagtctgacgcacgagaaggtggaggccctgcaggaaggtggggaagaggagttttggggggatggctgtgcaccttttcatggaaacagggtgtcttcaaaggtgatgtgtgcggggcctggttgcccagggtgatcagtgagagcattggggccgtgcataaaggaggagtagaggagaccttcacctctgccaattgccaggttctcatcccctcgcccgcctcccacagagaccgaggagaaccgggccaccgtcgcccgcctgcacgccaccagcaaccgcgagatgtgggctgcagacctcgaggcctttgtcgaggtgagctgccctgacaatgtgggaggagagggtggcgcaccggccgaggcgcatcagccaccggcagctggcggggggggcatcgctactctcgactccgcctgccctcaccccacccatgcagctctggagggcgctgannnnnnnnnntggccaccggcagctggcggatggggtagtcgcaactctcgactccgcctgccctcacccccacccatgcagctctggagggcgctgatcgacgaggacacgcggcgtacagccgtgctggtcaagcagcaggcccaggcccgcaaaaattccaaggtgcgccagcggtggggatgatgtgctaccgtactgaggctctgttcccgtgtgcaggccgaagaagcaggcatcgacattcctctacacccatcacaggcggccgcctccaaatccaagaagaaggccaacgtctggtcggaggacgagagcgaggcggatgacgagtcgtcaggtgggactttgggctttcaggagttacagcctgcagtctagccggcaccgtccatccaccaccctgccctctttctttacccttcccttcatatccctccccctgacctccgtcacaccnnnnnnnnnnatttcaggagttacagcctgcagtccagcctgcaccgaccatccaccacccagccctctttctttacccttccctccatatccctccccctgacctccgtcacaccctcgccaacccccgccacaggcgaggagggcgacagcgatgcggaggccgcgccgcggcgcccagcgcccgcgaagaagccggcaccggccagggcccggcccacgcccacctcttccgtgctttccggagccccggcggcctccggcgcgtcgcttgccggcgacagcgccgccggctcgaagcgcagcggcctgggcaaggcagcggcggctcgcgcggcggcggcgcgccccg

SEQ ID NO: 30635 - DNA, 89 bp, Chlorella protothecoides
cctcgccattggagtgatcttgctcactactggcaaggttgccccacagcctcagtcaaggtctcaaccagctccaccttaccatacca

SEQ ID NO: 30636 - DNA, 105 bp, Chlorella protothecoides
ggaggagcgggttgcagatggtaaagtaaggcgcaggcatgccggggagggtaatcatccgtggatcagagcagcacagaagagaactgtagggcagtgctgcta

SEQ ID NO: 30637 - DNA, 340 bp, Chlorella protothecoides
caagattgaagatgtgcccttcaacctacacgcatttgaggatctcgtgtcaagggtggtctgagcatggaatgagcatgctggcccttgtaacttacgagcatttcgatccaagccaaaaaggctaggggtatggtggcgattcgatcggggtcgtctgcccgcttcaggccatgatggaagtacttgttggcacacaggaactctctgaactgaaggcagccatactcgtcttcttcgacgaggtccccagtcctccacactggtcctgccaggggtggggggtgtgggcgggtgggggtggggggggcaagagggggactgaagcacaatgaatcct

SEQ ID NO: 30638 - DNA, 86 bp, Chlorella protothecoides
ttgttgcattcttttaatattgatgatcggagaccggggccaacggcgtgtgccatgggaggttggtggcgccaggtccgagatct

SEQ ID NO: 30639 - DNA, 67 bp, Chlorella protothecoides
tctgaaacccatgcaggaaaggctgggggggggccgcccgcccaggagctcgtagaaggcccgttcc

SEQ ID NO: 30640 - DNA, 69 bp, Chlorella protothecoides
ggggggaagatgtgctgacactgacagagcacggacactccaggcaacatggcgtctgcccctctttca

SEQ ID NO: 30641 - DNA, 61 bp, Chlorella protothecoides
ccattccaataggctgcttattgactgaccagcttaagccgcattccggttctgagaggac

SEQ ID NO: 30642 - DNA, 76 bp, Chlorella protothecoides
ccggtcatgccgccaaaggcctgtgaccacaacgagacggcggcgctcccaccaccgcacacgggatcttcaggct

SEQ ID NO: 30643 - DNA, 96 bp, Chlorella protothecoides
gcatgttttctcacaccttcagcatcgaatccctcgcaaacgatgcgcggcgtgcccccgcagtccaccgcttcaccacagtccgcccaccgatgg

SEQ ID NO: 30644 - DNA, 61 bp, Chlorella protothecoides
ccaactcccgttttctgcatgccatagacataacttggcccttgagtgagcttgtgacggg

SEQ ID NO: 30645 - DNA, 61 bp, Chlorella protothecoides
catgccactgggcggtgcatctgccacagaacgagtggccaggccaaggtcccatggcaac

SEQ ID NO: 30646 - DNA, 75 bp, Chlorella protothecoides
tgagcacatcatttgacaggggctgcttgatgagtgtgccccatggtcggtcttgcatggcatgttctccttcct

SEQ ID NO: 30647 - DNA, 74 bp, Chlorella protothecoides
gattgccgggccgcgaccgccgtgccacgcattccccaaccccccccacgcgccacccgactcgccttggtgcg

SEQ ID NO: 30648 - DNA, 65 bp, Chlorella protothecoides
accccgagtacggtgaggggcttgggtttcgagcacggtgccgggcgacgtacagggatgcaggg

SEQ ID NO: 30649 - DNA, 61 bp, Chlorella protothecoides
ccggaaatcgagctccggaaccgatgacgggaagtgatttattgggacatagcagttttgg

SEQ ID NO: 30650 - DNA, 62 bp, Chlorella protothecoides
cgcctggcgcacagcgccacgctgcccacgctgggctccctggacctgggcggctcctccct

SEQ ID NO: 30651 - DNA, 61 bp, Chlorella protothecoides
gggctccctggacctgggcggctcctcccttgaggtctgcttcgaggctgagccggaggcc

SEQ ID NO: 30652 - DNA, 387 bp, Chlorella protothecoides
  modified_base (86)..(308): a, c, t, g, unknown or other
ctcctgctgccactgtgctacccaaaggaaactgcgatcgccaaccacgaatccaatgcactgcaacacattgactgcagctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcattccctgtgtgtggggggggaaatggaagtccattgagggggggcaggtgaagacctcagcgcgagcccctgcc

SEQ ID NO: 30653 - DNA, 61 bp, Chlorella protothecoides
tgtcgaggctccagatcatcgagatggaaaaaggaacatccatagctgttctgcatgcgcc

SEQ ID NO: 30654 - DNA, 75 bp, Chlorella protothecoides
ccctcatcagcccctgcctcgagcggcctcatcgtagttgtgagcggggcgcgcaccgtacccgccctggccagc

SEQ ID NO: 30655 - DNA, 61 bp, Chlorella protothecoides
cgctgacggtgcaggagacagtggcagggggcttggtgacgcagtctgcatagtcgatgct

SEQ ID NO: 30656 - DNA, 77 bp, Chlorella protothecoides
tcccagtcccttctcttcctctgagctcctgtcctcacgtggagttatcgcacctgtggagatgaggatggagcagg

SEQ ID NO: 30657 - DNA, 104 bp, Chlorella protothecoides
ggggggcagtggtgagcaggcgcggcttgagtgtgggcaacgtgtactcgcaaggacgacccaggcacgtcccgagatgattcaccaccctgtgcaccggccat

SEQ ID NO: 30658 - DNA, 61 bp, Chlorella protothecoides
cgcgtccatggacccctcgcccttccccgcgcccacgatggtgtggatctcgtcgatgaag

SEQ ID NO: 30659 - DNA, 66 bp, Chlorella protothecoides
caccaagcacctccatccccatccccgcgcggcgcagggcccactcacggggaagagcgcgacctt

SEQ ID NO: 30660 - DNA, 140 bp, Chlorella protothecoides
ggcgaggggtgcggagttaccgtgcgtaataaccgattccccggaccgcataaaagccataatgagcgcaatctactatacattcattatccgacattgaagtgcagtgaaccctggctgtcggcggtatgtgggggtcg

SEQ ID NO: 30661 - DNA, 61 bp, Chlorella protothecoides
gaagaagcggcgctggcggggatcgcgcagtaccttgtccgacaggaactgcttgtacacc

SEQ ID NO: 30662 - DNA, 61 bp, Chlorella protothecoides
ccatggcagtagccagcctccagttcccctgcggcaacacctctgcatgcatccaggccgc

SEQ ID NO: 30663 - DNA, 67 bp, Chlorella protothecoides
cttgtaatcgtcagaccacaccaaggtgcagtttcctgtggcaagggtgatgttcagctcgggtcct

SEQ ID NO: 30664 - DNA, 131 bp, Chlorella protothecoides
ggtggattaggacaagataggcagtacctcggtaggacagctgctgccgccatgatcctcactgcccaaaagcacaggctcatgcacatcaagacgcatattggctgcctccctccaaattctgttagatc

SEQ ID NO: 30665 - DNA, 132 bp, Chlorella protothecoides
gggaagcgggaatcctggcaagcatgcgtcaaggtgtatatgccattatcagtgccagactgcgctaggaccaaaacaaatcggcaagctgctgcggcccatttcatcgccgcgccgcagccactctgtgtt

SEQ ID NO: 30666 - DNA, 92 bp, Chlorella protothecoides
ggccaatccttcatctatgcatgctcctatctgcaaccctcgcttttgctccttatcctgacccttatcttgtcgatgcccaggttcccggc

SEQ ID NO: 30667 - DNA, 75 bp, Chlorella protothecoides
ttcgaggttcgctcttggtaatactgactgcgtagatggtttcctaccatcgaggcagctgggcagggaggacgt

SEQ ID NO: 30668 - DNA, 548 bp, Chlorella protothecoides
  modified_base (189)..(441): a, c, t, g, unknown or other
tgatctgctgaccatgctcaacgcatctgacactcacttcccatgctcctgtatttgccagggagaacctggatgtcttcaaggccaatggctttgagtttgtcgacgatgcacagggtcatttggccctctcagccgttcccttcaggtgggaagcctgtcgacgtccctgggatgggtctcatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttaagatgagctgaccactatcgaatgcagaaactgatacagactctttttgaagacttgcgcctcgcttcacgtatcccatgcgttggcaccgttcccacagag

SEQ ID NO: 30669 - DNA, 83 bp, Chlorella protothecoides
tgcatccctcccgccctggggtcccaggggatcttcctgcggcgcggcgctaaagctgcgccccttccaggctgggagtcttg

SEQ ID NO: 30670 - DNA, 122 bp, Chlorella protothecoides
atgggagcatacctggtgttgtcagggtggagtagggtccaggatggtgggcgagggtagcaggacccaatgcggctcatcaaagttcaaatacttcataagcatgcgccaaacgccaccgc

SEQ ID NO: 30671 - DNA, 82 bp, Chlorella protothecoides
tgaaaggggatcccctgctcaaatggaggggccacgcaggagcactggccgcgcgcatgctgtcgagcccgggccctttcca

SEQ ID NO: 30672 - DNA, 112 bp, Chlorella protothecoides
tgccgaatgatctccctacaaccctcgccctatgtcccaaccagcaatgcttcaacacatccaaacccaccagttgtctatacgtggactcacgaagccatagaccacattg

SEQ ID NO: 30673 - DNA, 77 bp, Chlorella protothecoides
gaatgcggatgagagacaggaggggcgatgggggaactcacaattatttaggttgcgcgcgcccattcacggcagta

SEQ ID NO: 30674 - DNA, 66 bp, Chlorella protothecoides
ccctccagtccaccaccagccatggtcgtagcatgcttggcctgaaggaggtgagcatctggggcc

SEQ ID NO: 30675 - DNA, 75 bp, Chlorella protothecoides
ggggccgcagggatcatggggtgggtgagggtctggtgcagatgcacgtgggaagacgggcgggcagggaggact

SEQ ID NO: 30676 - DNA, 66 bp, Chlorella protothecoides
tccctttgctcactcccccacccccaccacgaccccacaccccacaccctgccaggtgctggcgcg

SEQ ID NO: 30677 - DNA, 557 bp, Chlorella protothecoides
  modified_base (185)..(397): a, c, t, g, unknown or other
gggaggggggggggaatgatcggttttgcaacgtgaccagttacccaaagggtgctataatctgccgcaaatttgatcccccggccagctgcgggagggaggcagggtctcccgccttccctggcactggcaaggggtgcagatgctacgtcgtagcaccctgcaggccccgccagtcctgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggagcagggaggaagagggtcaatacagtgcaccccgttgtgaggggcacagggtatatgtacccttcccatgccacaggcatgcaccgaggaaagaggcgcaggcgcgcccggcatacatgacccgagttcctcgcacctgccatgcaggagcagc

SEQ ID NO: 30678 - DNA, 62 bp, Chlorella protothecoides
cggctggcggagcagttccgcgcgccccccttgcatgaccacaattgtcggcgttggcaact

SEQ ID NO: 30679 - DNA, 95 bp, Chlorella protothecoides
ggcaagggtgtaaatagagggttgtcaggaattacttacatcaacatacagtgagcgtagtcccccccctttgcatcgctgggctatcacaccac

SEQ ID NO: 30680 - DNA, 92 bp, Chlorella protothecoides
agtcgccgcaaggtcgcagcacgtcggcatttacaagaccaatctcgccaaacaccttggagcccccccccactccccctcctttcagcatg

SEQ ID NO: 30681 - DNA, 61 bp, Chlorella protothecoides
gagaccactgctggggcacaaaaatacaacacccccccagctcctagcctttccattcaca

SEQ ID NO: 30682 - DNA, 77 bp, Chlorella protothecoides
cctacgtgcgaccccggtgacattactttccgcacgtgccctagcacacattcctccggtcggacccgggtccctac

SEQ ID NO: 30683 - DNA, 112071 bp, Chlorella protothecoides
  modified_base (1274)..(1283): a, c, t, g, unknown or other
  modified_base (2421)..(2430): a, c, t, g, unknown or other
  modified_base (2945)..(2954): a, c, t, g, unknown or other
  modified_base (3548)..(3557): a, c, t, g, unknown or other
  modified_base (4106)..(4115): a, c, t, g, unknown or other
  modified_base (6339)..(6348): a, c, t, g, unknown or other
  modified_base (6430)..(6439): a, c, t, g, unknown or other
  modified_base (6752)..(6761): a, c, t, g, unknown or other
  modified_base (7945)..(7954): a, c, t, g, unknown or other
  modified_base (9257)..(9266): a, c, t, g, unknown or other
  modified_base (10305)..(10314): a, c, t, g, unknown or other
  modified_base (10719)..(10728): a, c, t, g, unknown or other
  modified_base (11128)..(11137): a, c, t, g, unknown or other
  modified_base (12443)..(12452): a, c, t, g, unknown or other
  modified_base (12898)..(12907): a, c, t, g, unknown or other
  modified_base (14367)..(14400): a, c, t, g, unknown or other
  modified_base (14456)..(14465): a, c, t, g, unknown or other
  modified_base (16003)..(16012): a, c, t, g, unknown or other
  modified_base (16570)..(16653): a, c, t, g, unknown or other
  modified_base (16739)..(16748): a, c, t, g, unknown or other
  modified_base (17388)..(17397): a, c, t, g, unknown or other
  modified_base (17459)..(17468): a, c, t, g, unknown or other
  modified_base (18700)..(18709): a, c, t, g, unknown or other
  modified_base (19565)..(19574): a, c, t, g, unknown or other
  modified_base (20287)..(20296): a, c, t, g, unknown or other
  modified_base (21690)..(21699): a, c, t, g, unknown or other
  modified_base (22245)..(22254): a, c, t, g, unknown or other
  modified_base (23034)..(23043): a, c, t, g, unknown or other
  modified_base (23310)..(23319): a, c, t, g, unknown or other
  modified_base (25539)..(25548): a, c, t, g, unknown or other
  modified_base (25958)..(25967): a, c, t, g, unknown or other
  modified_base (26763)..(26772): a, c, t, g, unknown or other
  modified_base (27297)..(27306): a, c, t, g, unknown or other
  modified_base (27539)..(27548): a, c, t, g, unknown or other
  modified_base (27710)..(27719): a, c, t, g, unknown or other
  modified_base (27794)..(27937): a, c, t, g, unknown or other
  modified_base (28020)..(28029): a, c, t, g, unknown or other
  modified_base (28112)..(28121): a, c, t, g, unknown or other
  modified_base (28980)..(28989): a, c, t, g, unknown or other
  modified_base (29174)..(29183): a, c, t, g, unknown or other
  modified_base (29777)..(29786): a, c, t, g, unknown or other
  modified_base (30399)..(30408): a, c, t, g, unknown or other
  modified_base (32644)..(32653): a, c, t, g, unknown or other
  modified_base (33409)..(33418): a, c, t, g, unknown or other
  modified_base (35233)..(35242): a, c, t, g, unknown or other
  modified_base (35399)..(35408): a, c, t, g, unknown or other
  modified_base (35915)..(35924): a, c, t, g, unknown or other
  modified_base (36635)..(36644): a, c, t, g, unknown or other
  modified_base (38934)..(38943): a, c, t, g, unknown or other
  modified_base (39532)..(39541): a, c, t, g, unknown or other
  modified_base (39881)..(39890): a, c, t, g, unknown or other
  modified_base (39976)..(39999): a, c, t, g, unknown or other
  modified_base (40395)..(40404): a, c, t, g, unknown or other
  modified_base (41339)..(41348): a, c, t, g, unknown or other
  modified_base (41422)..(41431): a, c, t, g, unknown or other
  modified_base (41721)..(41730): a, c, t, g, unknown or other
  modified_base (41888)..(41897): a, c, t, g, unknown or other
  modified_base (42780)..(42789): a, c, t, g, unknown or other
  modified_base (43291)..(43300): a, c, t, g, unknown or other
  modified_base (43594)..(43603): a, c, t, g, unknown or other
  modified_base (43793)..(43802): a, c, t, g, unknown or other
  modified_base (44557)..(44566): a, c, t, g, unknown or other
  modified_base (44941)..(44950): a, c, t, g, unknown or other
  modified_base (45531)..(45540): a, c, t, g, unknown or other
  modified_base (45789)..(45798): a, c, t, g, unknown or other
  modified_base (45850)..(45859): a, c, t, g, unknown or other
  modified_base (47238)..(47247): a, c, t, g, unknown or other
  modified_base (47341)..(47350): a, c, t, g, unknown or other
  modified_base (47714)..(47723): a, c, t, g, unknown or other
  modified_base (48669)..(48678): a, c, t, g, unknown or other
  modified_base (49140)..(49214): a, c, t, g, unknown or other
  modified_base (49798)..(49807): a, c, t, g, unknown or other
  modified_base (50052)..(50061): a, c, t, g, unknown or other
  modified_base (51313)..(51322): a, c, t, g, unknown or other
  modified_base (51919)..(51928): a, c, t, g, unknown or other
  modified_base (52164)..(52173): a, c, t, g, unknown or other
  modified_base (52277)..(52286): a, c, t, g, unknown or other
  modified_base (52393)..(52402): a, c, t, g, unknown or other
  modified_base (52849)..(52858): a, c, t, g, unknown or other
  modified_base (53030)..(53039): a, c, t, g, unknown or other
  modified_base (53192)..(53201): a, c, t, g, unknown or other
  modified_base (53302)..(53367): a, c, t, g, unknown or other
  modified_base (53435)..(53444): a, c, t, g, unknown or other
  modified_base (54028)..(54037): a, c, t, g, unknown or other
  modified_base (55038)..(55047): a, c, t, g, unknown or other
  modified_base (55628)..(55637): a, c, t, g, unknown or other
  modified_base (56038)..(56047): a, c, t, g, unknown or other
  modified_base (56536)..(56545): a, c, t, g, unknown or other
  modified_base (57724)..(57733): a, c, t, g, unknown or other
  modified_base (58651)..(58660): a, c, t, g, unknown or other
  modified_base (61291)..(61300): a, c, t, g, unknown or other
  modified_base (61617)..(61626): a, c, t, g, unknown or other
  modified_base (61714)..(61723): a, c, t, g, unknown or other
  modified_base (62414)..(62423): a, c, t, g, unknown or other
  modified_base (64276)..(64285): a, c, t, g, unknown or other
  modified_base (65028)..(65133): a, c, t, g, unknown or other
  modified_base (65204)..(65213): a, c, t, g, unknown or other
  modified_base (65878)..(65887): a, c, t, g, unknown or other
  modified_base (66479)..(66488): a, c, t, g, unknown or other
  modified_base (66886)..(66895): a, c, t, g, unknown or other
  modified_base (69239)..(69248): a, c, t, g, unknown or other
  modified_base (69649)..(69658): a, c, t, g, unknown or other
  modified_base (70276)..(70285): a, c, t, g, unknown or other
  modified_base (70387)..(70396): a, c, t, g, unknown or other
  modified_base (70560)..(70569): a, c, t, g, unknown or other
  modified_base (71144)..(71153): a, c, t, g, unknown or other
  modified_base (71451)..(71460): a, c, t, g, unknown or other
  modified_base (71916)..(71925): a, c, t, g, unknown or other
  modified_base (72634)..(72643): a, c, t, g, unknown or other
  modified_base (73206)..(73215): a, c, t, g, unknown or other
  modified_base (73299)..(73557): a, c, t, g, unknown or other
  modified_base (73649)..(73783): a, c, t, g, unknown or other
  modified_base (74168)..(74177): a, c, t, g, unknown or other
  modified_base (75035)..(75044): a, c, t, g, unknown or other
  modified_base (76011)..(76020): a, c, t, g, unknown or other
  modified_base (76237)..(76246): a, c, t, g, unknown or other
  modified_base (76992)..(77001): a, c, t, g, unknown or other
  modified_base (77531)..(77540): a, c, t, g, unknown or other
  modified_base (77915)..(77924): a, c, t, g, unknown or other
  modified_base (78108)..(78117): a, c, t, g, unknown or other
  modified_base (78293)..(78368): a, c, t, g, unknown or other
  modified_base (78721)..(78730): a, c, t, g, unknown or other
  modified_base (78803)..(78812): a, c, t, g, unknown or other
  modified_base (78903)..(78912): a, c, t, g, unknown or other
  modified_base (79054)..(79063): a, c, t, g, unknown or other
  modified_base (79212)..(79221): a, c, t, g, unknown or other
  modified_base (79801)..(79810): a, c, t, g, unknown or other
  modified_base (80131)..(80140): a, c, t, g, unknown or other
  modified_base (80836)..(80845): a, c, t, g, unknown or other
  modified_base (81396)..(81405): a, c, t, g, unknown or other
  modified_base (82673)..(82682): a, c, t, g, unknown or other
  modified_base (83116)..(83125): a, c, t, g, unknown or other
  modified_base (83600)..(83609): a, c, t, g, unknown or other
  modified_base (84110)..(84119): a, c, t, g, unknown or other
  modified_base (84360)..(84369): a, c, t, g, unknown or other
  modified_base (85342)..(85351): a, c, t, g, unknown or other
  modified_base (85837)..(85846): a, c, t, g, unknown or other
  modified_base (86403)..(86412): a, c, t, g, unknown or other
  modified_base (86836)..(86845): a, c, t, g, unknown or other
  modified_base (87769)..(87778): a, c, t, g, unknown or other
  modified_base (87940)..(88006): a, c, t, g, unknown or other
  modified_base (88241)..(88250): a, c, t, g, unknown or other
  modified_base (88427)..(88436): a, c, t, g, unknown or other
  modified_base (88923)..(88932): a, c, t, g, unknown or other
  modified_base (89484)..(89493): a, c, t, g, unknown or other
  modified_base (91264)..(91273): a, c, t, g, unknown or other
  modified_base (92189)..(92198): a, c, t, g, unknown or other
  modified_base (92505)..(92514): a, c, t, g, unknown or other
  modified_base (93161)..(93185): a, c, t, g, unknown or other
  modified_base (93380)..(93389): a, c, t, g, unknown or other
  modified_base (93713)..(93722): a, c, t, g, unknown or other
  modified_base (94061)..(94070): a, c, t, g, unknown or other
  modified_base (95298)..(95307): a, c, t, g, unknown or other
  modified_base (95735)..(95744): a, c, t, g, unknown or other
  modified_base (95836)..(95845): a, c, t, g, unknown or other
  modified_base (96683)..(96692): a, c, t, g, unknown or other
  modified_base (98147)..(98156): a, c, t, g, unknown or other
  modified_base (98589)..(98598): a, c, t, g, unknown or other
  modified_base (98911)..(98920): a, c, t, g, unknown or other
  modified_base (99335)..(99344): a, c, t, g, unknown or other
  modified_base (99499)..(99508): a, c, t, g, unknown or other
  modified_base (99624)..(99633): a, c, t, g, unknown or other
  modified_base (99987)..(99996): a, c, t, g, unknown or other
  modified_base (100195)..(100204): a, c, t, g, unknown or other
  modified_base (100928)..(100937): a, c, t, g, unknown or other
  modified_base (101242)..(101251): a, c, t, g, unknown or other
  modified_base (101980)..(101989): a, c, t, g, unknown or other
  modified_base (102151)..(102160): a, c, t, g, unknown or other
  modified_base (102553)..(102562): a, c, t, g, unknown or other
  modified_base (102919)..(102928): a, c, t, g, unknown or other
  modified_base (103464)..(103473): a, c, t, g, unknown or other
  modified_base (104831)..(104840): a, c, t, g, unknown or other
  modified_base (105757)..(105803): a, c, t, g, unknown or other
  modified_base (105974)..(105983): a, c, t, g, unknown or other
  modified_base (106053)..(106167): a, c, t, g, unknown or other
  modified_base (107666)..(107675): a, c, t, g, unknown or other
  modified_base (108362)..(108371): a, c, t, g, unknown or other
  modified_base (109323)..(109332): a, c, t, g, unknown or other
  modified_base (109770)..(109779): a, c, t, g, unknown or other
  modified_base (110736)..(110745): a, c, t, g, unknown or other
  modified_base (111392)..(111401): a, c, t, g, unknown or other
  modified_base (111853)..(111862): a, c, t, g, unknown or other
ctgcggttgtcgcgcgcggcgaggcggcggctgccggcgcgctgctgcgccagacggggccgctggtgcgcgtggcagcggcggcgcgggcagtcgtgacccgcctccagcgcctcttcttcctctccgaggaccagggcctgtcgcacttcctcgccgcgcacgctggcgcgctgcagtacccgcggtacctcgtgcaccgccagcaggccgtgtggtccagccgccggcagctgctggagtacgaggcggcgctgcaggccgcggcgcgcctcatggacgcgctggaggtccgtggagggtggtggccccgggccctgcagcactctgtgtgtgtcttggcgtggcgcacgcagggggggcagcccacggagtgcatgcaggggattgactgtgggcaggagggtcagacatagcgcagacccgacgcacccttcccctgcccctcctgctgcaggccggggatgaggcggccgcggaggcagagctggagggcatctggcgcagcctggacgccaaccgccacaagcagctgcccagccctctcaagcagtccttttccaagcagtccagcctcctcttcctgtcccggttccaggcaggcaagaacgagagggtgtgagcctcgagtgtcggatctgcatcagcactcggtccccacggatggcctagccagtaccgcgtcgccattggcccctcgaaaacgcgtggcaacactcctcccttctgcacatgcacaggctgggtgcactgcctgatggcgacggcgggggtgtccctgctggagaaaaagcgggagtatgtgctggccatcgagcgcctccagcagctgctaggtgggacgccacggaagggaaggggtggaactaccaagaggagtggagtgcatccccactcgccacaccaaggcgcccacctcacacccctgcatcctctcgtttcaggcggcgtgtactgcgggacgagacggggcgactggtggatccggctgtccatcaacctcgagcacctggggagggtgggagaggcgctggagatggcggaggccggcctggccgacgactggctgagccacggcgaccgcctggccctgcagcgccgcgtcctgcgcctgggtgggtgctcggtctgtgatgggcggggggtattcaggatgccacaagaatgggaatgggagtctgggaagctgggaatgcgcgtgcagcgccggtgtcgagtgtatcgtggtgtgcaagaccctccattctccctccattcacgtctttcattgcgannnnnnnnnntgagggtttcgtgggttgcaagatcctccgttctccctccattcacgtctttcattgcgacgctccccttgtcaatccatcacactgccctgtaccctcccagccaagccgccccggcgctggaagaggcctgcctgggcggggagcgtggcgctggagcccagggaggtcaggatcgtgcagcgacccatggccagcatcgtcgggttcaagagcagattcatgggcctgaacggcgagccgtgtacggttgagcagcttgctcttcaggtgcgtgtatgcttggggagaaggggggggggtgagggggacggtccaagagtggcctgctctcatggaaatctgccattcaaactctgagggcctgcgcgcctgcagggagtctcttattctggaccccgacccttacgccttgcaacccgcacatcatgcagcactatgccagagacgaggcaggcggctggactgggtgtcactgcgagggcggcatctggtcgaccttcttctccctgctcctgtgggaggcgctgtttgcccccgtccccgacgtgttcaggaccccgtttcagtcctcacccctggacctcaggaccgagagcttctacattggccgccaggtggggtgcagagtggctgggcatgaggctacagagagagctctgtttctgtctgaaaataatggaatcctgaagtttgccagacctgccctccagcgagtggcacaccccgtgatcatcggcaacgatctgatgtaataattccacctccccaggacctgatcgagcggatcctgggggagatcgcggcaggcggcgtggaggagcgcctgcgagccgtgtgggatgcgcactgcggggagctgtgcgccggcattcggtgggaccgctggccgcttgaggagctgctcaccatcgcagcctgcgtcgggggcagaggcttagcggtggtgtgccggctgctggctgaggatcactccggctgggcaggtgaggtgtggggccctggtttgggaggctggctgggggggtggcatgaggtcattggtttgttggcagagtccttctccccacctgcctcgcagcgatttcacacacaacctcacccccccacacgcttgcaggaggtatgccggacctannnnnnnnnnttggcatgaggtcattggtttgttggcaaagtccttctccccacctgcctcgcagcaatttcacacacaacctcacccccacacacgcttgcaggaggtatgccggacctactcctctggaacccagctcgcctgaaagccaagctggtggaggtcaaggggcccagggaccgcctttctgagcagcagcgggcatgggcgcatgcgttgacgcagggtggcctggaggtcgaggtgctcaaggttgtggagcccaaggcttccaagaaataattacagtcgttttacacatacaccatatgcacatttcattcagatgtgacacttttttctgcttgccttgagctcggcgtttgcggctttccaggcctcagtcagctgatgatcgacaatagggggtgtgtcggtgtggcaatccacaggcggtgtcgggggttgcagttcgcgtgatcggaggaatcccgcgctcaccttgcctcattgagaattggcatagttgcttgtaggaattgagnnnnnnnnnngtgtgcttgccttgagctcggcatttgcggctttccaggcctcagtcaactgatgatcgacaatagggggtgtgtcggtgtggcaatccaccggcggtgtcgggggttggagttcgcgtgatcggatggatctcgcgcacaccttgcctcattgggaattggcatagttgcttgtaggaattgagcgtaggatacccgcaaaatcccaacactcatgcgctgacgagggagaacgcctgatccaggcgcatggcgaacgcgcaactctcccagaagctgggccaggcccttgcacagcagtttgagaagtttgcgaacgtagttgtggtgagcagagtacatggaaaggatcgagtgcgtgcgtactgcgacagtgagagagtcgtgcaccctcacccctggctcgcccacccaccgcaggagaccgggcacgtccataacgatgaccagctgcagaggatcctggcaggcctgaaggttgtttcaggacagtaaattcagggcagaggatctattggggacgtcctgagcccagcagagggctgctcgtcctgtagcaagggcgcaggtgtctgccctccccgttttgatcgnnnnnnnnnnactgagcccagcggatggctgctcgtcctgtagcagggccgcaggtgtctgccctccccgttttgatcgcagtcgatccctttccaacctgtagggtgccacccccgatgccagcgagacggcattcgtcgacatcctgcggtggaggatcggccagctcaccaactcgccggggggcaggacggacgccctggtctccaagcgcagggtgagggacgtgctgtgaagggagcatggagttatcctggagaccgcagacctgccaccggcatcagagctgctcaccacacaccccctctcgcagatgtggacggagatcatgtttctggacgccgctatccagatcgcgggggataggggagtgctggccgaggggcaggccaaggagatcgagatcctggccttcgactggatcatcaacggcgagaaacacgtggactcgcgcttccccgacctcatccccctgcgcgaccgggtgggtgggtggtgggtgttggggctacggcgcggcagggggcctcgtgatggcggtcaccctccccggcttgnnnnnnnnnnggacctcatcccactgcgcgaccgggtgggagggtggtggggctacggcgcggcaggggggctacggcgcggcaggggggctcgtgatggcggtcaccctccccggcttgctgtgcaggagttcagggcgctcaccaccccaccaccctctgcccatccgaaaccaggtcatgaccaaggcggctgagctactgggcgtgctctcggccaccagcctggacaacatcaccgcgcgcttcctgaaggaggtggggtcccgcctgcaggccgactccgcgtccttcatcaggcaggagctgctaaacttgtgcaacggcctccgcttcatccggctcagggccggcacctccgaagaggtatgcatgaaaagctggcttggatgggtcgagattggggcctgcagcgctggtggctcgatgagcatggcgggacatgcaggggtcctcgctgcagctggacgccatccctcgcaacccctcacccacacccctctttgctctcagctgcgtgcatccatcgccttcctggaggccgcccacccgctcaagcacgtggcctccgacaagaagtctcgggtgcagcagagcatctgcgacatgctgtcctgcatcctgcagcccatcgtggacggcgccgacgcagggtgtgttttggggggtggagcgctgggccaaggatggggaagggggggcgcagggcgtgctccaggcgctgcgacagcccaagcgcttgcgcaggatctactgcccggcgcccacccggcccctgtctctcattcccttgctctctacctaccccttgcccctccttcaacaccacctgcaggtcctttggcgccggctgcgatcagggcctgatccggcgctggttcacggtgatctcggtgctacgcctggacatcctcaagtggaccaccaagcaggccaagcaggccagcgcggggctgcccctcctcactctcctcacctgcatggagaccgacaagcagatgctggccaacgtggacggcatggtggacctcctccagcgccaactcaaggtaggtggtgaggtcagggaggtcttgaaggagatgcgtgacgaccagcgacgcccagacttcccacacggaccccacaccgcgccccgagactccatcttaagctcaaatctcttgcaggacaagaagaatgccggcgtggccgcgctgtgtatctgcaggtgcgtctgcgcctacgtgctcagatttgcggggcgctgggacggcgccaccgtctccaagtgggtcgcgcgagccaccagcctggtcctgcaaaacttctccaaaggaggcctccccggcccggagatgcaggtgatgcgggctggtaagggagtgtatgttgtgtgtggggggatgtatggtatttaggcctgcccacattggcgcgcccggaggctgccaacctcatgcctgaggtcgggtggcctgagtggcaggatcatgctccgctcgtggtgcaaaggccagaccgcgagggtccttgagcactcatctatcgtcaccctcgtctgcacgcatcccatactccgcaaatgcaccccggaccccccgcccctccctcccccccctcgcaggagctggtgcgaatgctgtgcgtcaacatcaccaagcgcctgccagagcacgggtcggcgctcatcaccgacctgctgcagtacgatggcgtgaacatgaactgggaggcctgcatgtctggcgtgtccgccatcctcaccctcctggccgaggtgccggcgcgcctggccggcgccaacgaccccgtccacctgccggccaccgccggggtgagactcgatggggcagggatgtgggaatgggtgtctgggaatgacaaggccatcgtgcatgggacaagaggtgaagggaagaccatgcagccagggcattgcatcgcatgggaccccaaaccctcggcgccagatgttacctcaaccacctcacactcattttctcccaggagctggagcggctgggcggcaccgcctggctgccggagaattacgacctggaccgcctcctgcccctcattgagcagggtgggtgggtgaggtggtgtggtggaagggcactgcagaccaggagtacttttttatgtgcttgctttacataaccaggctgtaagtttgttgcacttgcccccatggaattccatcactcccctccaacctcgtaaccttgccatgcacaggctacaactgcctnnnnnnnnnngtgtgggaacgggtgtttgggaatgacaaggccatcgtgcgtgggacaaggggtgaagggaagaccatgcagccagggcatnnnnnnnnnnattttgtgcttgctttacgtcaccaggctgtaagtttggtgcacttggccccatggaattccatcattcccctccaacctcgcaaccttgccatgcacaggctacaactgcctggatgccctgagcatggggcccgccctctccgctctgtctgtgtccctcagcaaggtcatccagcaggcgcacaacctgcacggccactcgcgcttcagcaccaccaacaggtgctgcggcggggtgacgctggggtggagtcgagcctgtgttggttcgtgcacttccagcgatgcaccgccaggtgcctgggtgcagnnnnnnnnnntgccggtgggacgctggggtggagtggagcctgtgtcgcttcgtgcacttcaagcgatgcaccgccaggtgcctgggtgcagcgctcatacaaccctgaacccccccaaaacatgcctgcctgcataccacgaccccaccaactctcaccaaccccctatccgttcccagatcctttggcgatgtgcccgggcgggagcgggtcggcgcgctgcccgtctttgtggccgccctgcagtgcctgccgtttgtcgtgccatcccactgggccgacggccgcctttgggaggacctgccggcctatgccatccacggcgaccccgccatgcgcaaggtggcgtggggggaggagctttgtgtgaatacggaggccgaggcaccccagggctgaggcctcccagcagcttggggggacagatgtttggtgccttggctgggtacatgcttgcatgcatgcatcaggccccggctgctgcatcgacgcttgcccaatcacaacccccaacaggtggcggtgttggtcctgcaccgctgcctcacgggcctgccctccaagcgcgaccagctggtcagcagcatggcctccttctgcgtccgcctccctgatgacctcccagaggtatgaagggagtgaggacagacttctgggcatgtggttccccgacgtgaacgccgtggcggcttgggccccagcggatctgtataacggtagaaaaaacccatctggctcctctccttccatgtcacaggcagtggaggaggtgctgggtctgttgctggccctcatgcgcagctggctgcaggcagcggccggcgagcggggcgccgccgcagggttgaccagcctcaaggctgtggaggccgccgcgttggcactcctttgcgccaacagcacccaggtgcggggcctggcgctccagctggcccgcctgaccaaggacctgcacggcctgtcgacagcggccgccgaggcggaggtatacggcggcggcggctcggtgcgccccgcccggtccgcgcgccgccaggtctacgtccacgacatcttccaggagtgagtttgggttgtgttgtgtgttgggaggggggtctgagaagaggatgggtctggggcatggaggtagaactggctgatgggggcgagcaaggggtctttggccagatgtgtgccgccatcacctaaannnnnnnnnncttgtgtgttgggcggggggtctgagaagacgctgggtctgggacatggaggtaaaactggctgatgggggcgagcaaggggtccttggccagatgtgtgccgccatcacctaaaattcatacatcacgcctgccctggatgcgcaggcaggggcctgcggtggtgagggagtgctactgggacatcgggcgctggtccgacatctggcggctgtggcggccgctgccccccggcccgctgaccctggagaggtgcatgcgcattagccagtccaacgaggcaaggctgctgggctgtttgggaggtgcagtggtgtggggggaagggtgttgtgcatgcattctccatgggggcaggctgccaccatgtgatgttaaatgagtatcaaggatggtcttggccctgagacgcataacgattctctgcccccaccaacaaccaccgcaggacatcttccgctgggcgcgcatcatgtgcgagatgttcaaggaggcctgggcccgggtgcaggacgtggcacagctggcccagatcgagatcgccatcaagctgcaggtcagtgtcggggcatgacggtcgcagatactgtagaaagggtgaatagatgccaaggacttgatgcagggggggggggatgcggggggggtgaagaacaggcggtggtgccagaagcaagcaagaaatgccagagtgcgcgcctgctgttgttagtgccacccaggggctaatctcccagatcttttgttcaacacaggcgctgaccgtgctggactcggcggggcgccagtcgctgccacaggagggtcggtacgcgtccacagcggtgtattgcctggcgctggccgccggccccgcctccgtccccgacccgccgcgcgagacggtcttctccaagaggtgcggaggtgtgggggagggggcgttgaccctgtgtgggcgggtgccggccgggctgccaatttttacgtgtcagggaaacccatcccttgcccttcgacgcacgcgttttgcatccctcatcccatcccttccagggactacgtgcgcctgatggtgaccagcgtgcgcgcgggtctggactttcaccagtccatcgccgccatggcgctcggcaatgtgcaccccacctgccagtcgctggtggtgcaggagtgcatgctgctcaccgaggactacctcgtcgaccgccaaatgcagcgcgtgagtttggctctgggggtttaggttcctcgccctttcctctcttttcttttgtttgggtgtgtgtgtgtgtgcggtcagcagttgcggggcagtgcctgnnnnnnnnnnttctgggggtttagcttcctcgccctttcctctcttctcttttgtttgggtgcgtgtgtagtgcggtcagcagttgcggggcagtgcctgtggtgcggctcccagcaggccccaaggtgcagaggaaagagttctgatgcacattggccacgcttctgcccctcacctgccctcatcagctcacgttccctctcattccccagagcatcagcgtgtcggtgcccggcatggggcgtgcgcacaagctgcgccgggacgacgtgaggctgacgcatgcccacatctaccgcgtactgtgcgccaacctgccccccatgatcctgcagaccaaccaggtgggcgcttgatgggtgacatgtgggagggggaggggagagcgggatggaggacacactcgtcatccaggcgctggatcggccggctgctcacggcctctgcccaacttggcagctgcgtctgctttgggccacctgtctgacaccacgggcgtgcacccgcccattctcttgccctctcgtgtctcaccactgaacgcccactccttgcaatacctacatgcagatgctgcgcggcaagctggtgcagtttgtcgcggagacggcacggcacatcaacaccctgcccgagctgtcgccggagctgcagcagctgcgccactgcctctgcaccgtggcgcggcagtgcgccatgcagctggcagacgcgctgccgcaggacttcacggccgacacgcggcgaaccctcttcgacatgttttccaactactgcgaggaggggacaccaggtggatggcgggaggcgggtggctggggcgtggggagggagattcggtgctggagaggggaggagtttgcaagtaggagatcgtttcgaagaaggggtctgctcgcctatacacacacccatgcccccgctccggccttcaagggttccccctgccaaatttcacccaacaaactccccacataacctgcgggaatccatttactccgcgcaggtcagttccgcagcgagctgcggcgtggcgtcctgctggccnnnnnnnnnntgtggggagggagattcagtgctggagagaggaggagtttgcaagtaggaaatcgtttcgaagaaggggtctgctcgcctatacaaacacccgtgcccccgctccagccttcaagagttccccctgccaaatttcacccatcaaacttcccaatcaacctgcggaaaaccatgtactccgcgcaggtcagttccgtagcgagctgcggcgtggcgtcctgctggccaagtccaagatcaaagaccccgacctcgcccggcagatggaggtcgacatccagggtgcgcagtggaggactgtgatacgacgggcgcagggcactgcgcgccggatcgtcgtcctgccagaggctgtcgattgtgtctcaacccatcatctccctcctttctacccgcaggcgcgagnnnnnnnnnncgcgcagggcactgcgcgctgtatcgtcgtcctgccagaggctatcgattgtgtctcaacccataatctccctcctttctacccgcaggcgcgagcgacaacctggagttcagcgcctacctgggcatggccacgatgctgcgcggcgcgctgttcaatgcagacatccgcaacccccacggccgcatcctgacctggatcgacaggatgctggccaagccccaggtggaatgttgtgcagtgtgaggggggcgaggtttgagctggttgggagggctccgtagggtaacggacaagcatcgcagctccatcgtgaaggtgcgcagaactcactcccccccccctccgctctccctgacgcctctccctgcatcgtcagacgctgcagccgggagcccannnnnnnnnngagtgtgaggggggggaggtttgagctggttgggaggactccgtggggttacggataagcatcgcagctccatcgtgaaggtgcgcagaactcactcccctcccccctccgctttccccgatgcctctccccgcatcgtcagacgctgcagccgggagcccagggccggcactgctggggtccggacacacactgggtgggctgcgccgctctgcgcaacctgctgacctccaaccctgaactggctgctgtctacgtcaaccgctcttactccaaggagccggccgtcgcctctggcttcttcaaggcaagtattggcagtcgggctttgagtttggggctgggaaagctgtgttcagcatacatacagtggtctgcaggcacgctggggctcactggtcagtctgcggggcttgtgagtcagaggggagacacttgagctcaactccacagtatcagtcacgtggtttattgcaggaactccgggactctgacgactcccaatcacagtctcggccctccttccccctgcccgccaggtgctggcggaggtgtatggcacgatgagcggcgtgctgcccctccagcgacacatccttgtcagcctggtgctgcacaaggtggcggacgccgacccgggcatccgctccgcggcgcgcagcctgctgggcatcatgcgccagcacgcctcggtgggagaaggaaagccagcacacgaggtggaggcgccggaggaggtgaggggggggccatttggggaaggggactggcagtgagtgcctgggagaattgggagtaagggtacttgggaatgcaagggcctctctccatcgaatatcttacatcaggatggatgcgagcaagccgtgccaccctcccaagcctgtgcccctctttctccggttcctgttgcagtctcccgacgccctggtagtggtgggtgccctgacggtgtcacagaaggcgtaccagatgtctctgtcggcccagctggcggagcagtacaccagcatcggcgaggccttggccatcgaggtgctcaaacgacagctgaccaacgacaccggtgcgaggaggggtgtgaggaggtggaggagacgagggctcttctgggaaacggacttcagaaatggggtttcctggcgtgggtctgaaaccatgacgactcttcggagggccatggtccgagggcggccctccagatgccaaactacaccgataatacctctcctgttttgcatattacgtcattgtcaacccctccgtccctcccaacacacaccacaccagactccgaggcgctgcnnnnnnnnnncctcctgttttgcatattacatcactgtcaacccctccgtccctcccatcacacaccacaccagactccgaggcgctgctgtgcctctgcccctggctggccaggatcacgctgagcacgcagtggcagggcgagtgggcggaggccttcctgaacctgctgttcgagaccaccaccaagcgcagcagccggcatgggtaccagatccagcagctctggtccaccattgccgagaatcgccgcaatgtcgtccccgtgctggagttcctgctcaacaagagcctgcaggagaaccaccagaagggtgaatgtagtgtttgtgaggttgaacctggctgcgctgaaggtggcatgggcgaccgttgacgcctggtgtctctttggcgtcgtcttccccttcacactcctccacaatcccttcccccccctcgcacctccggcagccnnnnnnnnnncgaggttgaacctggctgcgctgaatgtggcatgggcggccgttgacgcctggtgtctcttgggcgtcgtcttccccttcacacccctccacaaccccttcccccccctcgcacctccggcagccgagctgacgacgttcaggacggggaagcaggcggcgcttttcctggcgcgcatcgcgccgcggcagaccatcgagcacctgacctacgagctggagaagcagatcgaggaggagcacccctccctggacgcgcgcacaccgtccaccccgcagacgcccaaggcgaggcttgggccgggtggggtggggacttgtacgacagcgccctgtcccctgggttctgctctcctgcctggaggcacgcagagtcgcgcacactcgcccgcccacagatcctggagtaccagagcaccatctccagccagaagagcgaggccatggaccagtacctgtggcgcaagtctgggcggtcggaggcctcgtccaccagcttcgctggggagtcgggggtgggccggcacacctcactggacgagaagaaggccggctccgagaactcacggtgagccatgggtagaaggggccagtgccgcgcccctgcacgcccgccggcatcacagcacctggcaccgatggcattcccagcgagtggacccttatccaccccccaaaaccaaccagggtctacctgacgcgtgctgaggtggcgctcatcttgctgagcgaggtcgccatcgagcaggacgaggagttccggccccacctccacgtgctcctgcatgccgccaccctgaactcaggtggacgagcgggggagttgagggcgagggagaggtcggcagcaactcagagtgtgtcttgctggtgctgagagtgcagcgtgccccctgctgacctctcaccctcatccgcaccatctctgcctcatccaccctccactcaaagcttgaccccctctccccttccacactctgtgccttcctttcctcacagacagctcgagcctgctggtgcggagggaggcggcgcgcctgctcgtcttcctgctctacagcttggccctgaagcacctcggccccggcgcggaccggcgctcgggcgagtacgccacgctttcctccctcatcgaggcgctgcaggccaaggacggcgagcccctgtggcagcgcgagcgccccaccctggtcaaccccttcattcccagcgccgccatggtggcctccttcgtgaacaagggtgaggtggtggtaggatgcgggggcagctggacgggtggggcactcagccatgcccacatgctgggaggccatgcctgacgctgctatgctgatgatggcaatgacggacataacgtctcactcccctcccacttgcatgctccctctaaaactcgaaaaccacacagtggtgcgctgcttccactttgacaccgacctgcgcgagcggtggtggggnnnnnnnnnnnnnnnnnnnnnnnnnnnnnnnnnnccagctcttcacctccagcctcttgcctccttccttctgctccgcccgcctgcagnnnnnnnnnncgctcgcaccaggtgtggatatctccgaggggtaaacaccagatcacctgcttgcatgccgcctgaatgtgtgcgattcctgtcccacaagatttagctctttacctccagcctcttccctccttccttctgctccgcccgcctgcagatcttctgcgcgctgcgccccacgctgagcagcctgtcgtgcaatgccatgctggcagcgctgcagaagtgcatgatcaacgccgacctgcaggtgcgcagggcacaggagtgggcaggtgctcgcatgtccgctcccgcacagcctcacacctgctccatgtgttgcctcagaggcatccatgtgtgtgctcggaccgactccccctcctcatgtcattcaccgagtgtctcagcacactcacgcctcgcctcgccctgcgctccgcgcagaagctggacacggcagtggaggtgttgtgcacgctcaaggagctgctatccaacatcgagcccgccaagttcctgctctacccccagctcctcctcgccgcggtctccctgttgaacagcagcgtggtgaagatcggggagctgaccatggccgtgctgctggaggtgaggaggattggaacaaaggatttgacccaggggggcccgatgagatactcaatttttgtccgcagtaaaggaggcggtcatgccataatgatctgcccgtcacgggcgtcgcttctggaagtcaaacctccacacaccctggcccatgcaacacacaggccctgcagaacctggacttgagcgacagcttcatccgcggcagcctgctggccctgtccgcctgctcccggccccaggagccggtgcaggctcgggagccggtgcaggcggggacgcgcggccagctggcgcgctgggagctgggggagaacctgttccatgacctgggcgacgccgacgaggcctgccagctggtgtgcctgcagcagctaatcatcaagggcctgttccagcccaacaccgagatcgtggcgctcaaggtggctggagggtgatgcagggaggaatgggagtgggtggccatgggtgggattcagggctggtgttgcaccgttcctgtggttcccgagggcgcacaccagagctcacattttcttctgaatgcagtggcaagggggggccctgctgcgctcatccctgccacccccccgcacccctctcccctcccctcctacaccccattcccaccaggtcctgggtgccctggcggcccaggtggcggccgaggaggagtcggcggcgccgctggcctcggcgggggagtgcgtgtccagcacccacctctgcgacagcagcatctgcagcccggtcggcgacacgctgtcggcggtgctcggcgacaccctgctgggcctggtgctgaccatcgcggccacgctgccctccctccacgtccacatcgccgccggcacccacaccgccgacctctcctgcttcgtggaggtgtgtgtctgtggtggaagggggcggaagcgacaaagtgctggggtccccttgccgggaaggtggtnnnnnnnnnnatctcctgcttcgtggaggtgtgtgtggggtgaaagggggcggaagcgacgaggtgctggggtccccttgccgggaaggtggtgtcgagagtgccactgctggcgtctgcactctgcttggaggctgctctggcctcatttatgggatctgaaacagggaagagggtggaggttttggaggggcgcagattattcccccgacgctcccctggatgatggagagcaccaccaggatgggcaacaacagcttgtcccctttccccatccagtcgctggcgctggcctgcgaggcggtgggctggcccgaggtcgcctgcgcctacatggccgtggcgcaggcgctgcaggacccgacgtcacgcgacgtgtcctgggcgccggcgctggtgcgcatcgtggcgctccgcgccttccccgcccacggacgctgggtgctgcagcgctttgtggagaccgtggagcgggggagcgaggaataccaggcggcgggcctgctcatcctcagggccctctttgaggtgggcgggttctcatatagggggggggggggggggtgcnnnnnnnnnnnnnnnnnnnnnnnnnnnnnnnnnnnnnnnnnnnnnnnnnnnnnnnnnnnnnnnnnnnnnnnnnnnnnnnnnnnnacacccaccccgccctgcgcaggtggaggagctggacctgggatccagcttcggggaggcggaccaggcccgcttcgctggcgtgnnnnnnnnnntcacccaccccaccctgcgcaggtggaggagctggacctggggtccagcttcggtgaggcggaccaggcccgcttcgctggcgtgctgtcccccttcatctgcacctccttgggatgctgggccctgcacgtcatgaaggccgcggtcaacaaggggggtgagtgctgggtgtgctggggatgggcgcctgggttgctgggaggcaagggtcgactggatggagggtaggaggggtgggagggatacagaccgcgatgacagcggcgtgtgcctcgtggctcgcctgccacgtccctcctcaaaggtcacatccaccatcctcgtgacagcgcgggcggcgcctgcgcagcagcaggatcaggacggccccggggtcgtgctgggctggccccactccatcgacgagctgggcacctccaacaagctgtgcagccagagcctggagcgctttgtcacggcctgcgcaggcatggaccggaacgcgatgcaggtgctccccttcatcaagtaacatgggacggggacggaaggcaccctctgacttgcgcctcacttgctgaggttggcccctggagatcccgcctgtgtgctgagtgtgcctgtgcccttggtcccgtcaaacccacttgacatggcagnnnnnnnnnntgcagggaatgcatttctgctcctgactccagcgcaccacatctgtacaaggggacccgggnnnnnnnnnncaggcaccctccgacttgcgcctcactggctgaggttggcccctggagatcccggctgtgtgctgagtgtgcttgtgcccgtggtcccgtcaaacccacttgacatggcagcaggccagggggggtttcaagcggatgcacaaaccccgtctactggaaaaatgagtggtgtactcagcgtgaggcaggaggcgtgctcagcaccgcgcagggaatgaacttctgctcctgcctccggcgcaccacatctgtacaaggggacccggggcatggcacgcccaggaacatcaagcagctatacaaaatcggccttgcgcagcttcaggtcggcgagcgtcgcgccgccccacctcagccgcagcatctgccagcaccagcccatgtggtagccacgctcgagcgcgatacgacgcaggttctcgccgtgctcgagcaccgcctctaggttcggggaggaaaggaagcgcgcgatgtcctccccgcttcgcacattgaacaggatacggtcgcggtggaggacctgcggaggcgtttgggaggagggtaatcgtgtgcagatgctggcgatggcaggcagggtcggcacaatggcctgctcccaagctgcaccccaacagagacctggttgggccagaggatgtcctcctccgtgggccccacatcgcccacaaagcccacgtaatagcgcagcaggtcaacggcgggcatgtcgtcttggagaaagggggcactttcgacggtgcagaagggttcgcagactgttcccagtacgtccacatcattgctggtaaggagctccttggaggcgtacaatctggaagaacatgggaagaaagccgcggtgtacaggaggccatccttgcaacatgttgctccctctccaagaaaatcaagtctccatggagctatggtcatgacaacctgcactcttcctcacctcgacattcccacggcggagtcctggacaatagtgatccatgacggcctgacgctcacaacttggcggttgacacgcagcagtacatggtcgacccctccctctttgcctccagcatcaggctttgcgggggaggggggtggaaacggtcagaaggcatgtcatataatagctcgatgctagaagtggagatcgacatgggcgcggagaccgaggcagaaacagcctcgacagcacccaaagctgcctcaggggccgcgacagagcagccctcacctgtacttgagcatcatcnnnnnnnnnncgatgctagaagtggacatcagcatgggcgcagagaccgaggcacaacagcctcgacagcacccaaaagctgcttcaggggccgcgacacagcagccctcacctgtacttgagcatcatcaggtagggacgccatccaagcaaggtcctcagacgggtcactgccctgccgctctgctgatgttggcgccactgctcctacccagggatcccctaggtcctccatgccgctcggggcccgctgccacatcttctcggtccgcacctgattccaggcgtctgtgatctggtgcaactcgtccacgctcctccagtgcgtcagccacgaggcttggctatcacggcaagggccactgcccgtaggtgccctaggttgcacattgctgcccgctgtagagcacaggtgtgccaatcctcgtgttactccggaacctgcaggccgcgagcggtcagaggttgatgagtgggatccgaaggaaggttctatcaatctgaaccaacaacgtttcgcggcctgcagacccatgtaaagtggcacacgcagccacacacctcgcccgggtctcgttgtgctcgagaagggcgtcctggcgtagactgccgtggccatcggcatgtctttgcagagacccacgacgcttttcagtaaggaaaaacgatttagcatggatcagcagtcgctgtggtcacaggccgagccccgcccgctgggcggttcatcaggtctacgccgaggtcctatcaatgctagactggcgcaggctttggcttcagtcggattctcgctgaaaaaatatagatatatgccgagacactcctggagctttcctgttgcggccactcgatgtcctcgcggnnnnnnnnnnagtcgtaatctcgctgaaaatatagatatatgccgagacactcctgcagctctcctgttgcggccactcgatgtcctcgcgggtttgctaggtcgcgaccacgaaggcccgcctcggcgcgcctcctgtctccacgcgaatcactagttgtagcgaggcgacgtgtaacattttacaaggccccttgtccgtggcattcaggagcggggaggggcaaaggcgccccccggcgtgcggcgggcgtgctgcgcgctctggatcacttgctcactgcagggactccacggccttgctggcggcatcgtccaggtcgttggcggcgatgatgtccacgtccgactcccgcaggatgcgcttgccctcctccacgttggtcccctccaggcgcacgatcagagggactttgacgcccacctgcttggccgcgttcacgatgcccgaggcgatcacgtcgcagcgcatgatgccgccgaagatgttgaccaggatggccttgacctggggatcggaggtcagcagcttgaaggccgccaccacctggagtgttgtgcatggtgtggtgggggtggttttacccaggggagggggggggttaccgttcaggattatgtgagaagggatatattcggtgccaggaaccagcctagagcttctgcgccacccagaagcctgttccaagcttccccccccccccccccccccaccaccgcccnnnnnnnnnntttttatccagggaaggggggggggttacggttcaggaatatgtgagaagggatattttcggtgccaggaaccagccttgagcttctgcgccacccagaagcctattccaagctctcccccccccacaaacacctaccctgcccactttcagctcctgttcaacccatcttttcccccttttcccaacccccctccacccaagatcccctcaaagtccacctgctcctcggaggcgttgccgccgacatccaggaagttggcgggggagccgccacgcagcttgatgatgtccatggtggccatggccaggcccgcaccgttgaccatgcagccgatgctgccgtccaggccgatgtagttgaggtcgtacttgtgcgcctccacctcgcgcggatcctcctggctggcgtcggccagcgcgaagaggtccttctggcggaaggcggcattgtcgtcgaagccaagcttggcgtcggccgcgatcaggccctgcgccgtctccgccagcgggttgacctccaccatggtgcagtcgcgctcgacaaagaggcggtacaggccctggatctgctccgcagcggcatcggggtcggtgcgcacgcccaggcctgccaccacctcccgtgcctggtcgggggtcaggccccggaacacgtccacgttcaccttgacaatcttctccgggaacttctcggccaggtcctcgatgctggtgcctccctcgctgcaggcgatgatgacggggccggaggttttgcggtccagcaggatggcaaagtacatctcccgctccagcgccatcttgcgtgccaggtacagcgtgttcacgggcttgcccttctccccggactgcttggtcaccagcgtgccgcccagcatctttgcggcaacctcgcgggccttgtccacgggtacgatgtgcacgccgcccttgaagccggacttgaaggtgcccaggccgcgcccgcctgccaggatctgggacttgatgacgacctgtgtgcgcgagtgtgtatgtgtgtgtgggggtgggtccccaaggatcttgaatgaggtggagtggcagcccgtttggcgcactggctgcaacaaagtaaataagaatcaaacccaaactcatgccgcttcacctcgttcttgtcgtcggccagcgccttggcagccggcaggacctcctccagggtggtcacggccttgccctccggcacgttgatgccatactcgctcatcagctccgcaccctgcaggtcggtgcaggtggagagcgcacattgaacaattgcagagctgatgctgatctgaggagacatgtgaacgtaatgcctggaccaggctgtgcgatgcccgcttgcctgccgagactcaaccacaaacgccgcccagagcccaggcnnnnnnnnnngcatgtgaacgtcatgcctggaccaggccgtgcgatgcccgcttgcctgccgagagtcaaccacaaacgccgcccagagcccaggcgctcatccaacgtgcatgatccaggtcattatgcccacctggtactcgtggatgttcaggaagcgtagctgctgtgcctgggccggggtgagggtccgcgggcccaccgaccgcgcggcacgggagagggcgtgcagcatggggaaccctgagccttgatgccctggaaaataccaatatgataccaacttccagatacaaagctgcgagatcgattgcgctcccactcccgatgttcacgttactctctgggaaattggtgactgcagactccgtgcgcgcgcgcaaactctttgggggggggtatcctttcggtttccgatgacattcgctggggatggaacaccctacaaaaatccgcgggtgcaggctgacatgcagcaattccagggcatttacagatcttccagcttcttcactgcagcagccagtggcgccttcttgtagccagtcaccgcgnnnnnnnnnnaggaacaccctaccaaaatccgcgggtgcatgctgacatgcagcaattccagggcatctacaggtcttccagcttcttcactgcagcagctagtggcgccttcttgtagccagtcaccgcgtcgatgatctccttcccatcctgcaggggcgagggggctgagttacgacaaggtccactgcacaaggatgccagacaaactcgtcaccttccgaccccaacaccccataccacaacccgtaccttgtagaacttgaaggctggcagagccttgactcccagctcagtggacaggccctccagctgctcctccgtggtatcaaacgacaggaacttgacacccttgtgtgtctcctgtgacgcatggggagcgattgagaatgggtatgggagagagggggcctgtgcaggtatcgaggccactgtgcctgccaaagaaagctcgtcaacctctgtggaccattctggggtgcgattgtacatggacaacgccttgcatcgcatccaggccagctcggagcacacagcccagacgcatgtacgggaccttccctttgcaaatctacaaggtccaaacacaccacacctgcagctcctcaacgtaaggagagatcatcttgcacttgccacaccagggtgcccagaacttaacggccacctgcaagggtttgagggaggtgaagtcccatgtcgtggacaccagcaattcccgagcaacatgacgtctcatcctgctgaccttgccggaagacacctccttctcatactgcttcttgttgnnnnnnnnnnaaacttaacagccacctgcgagggtttgagggaggtgaagttacgtgtcattgacaccagcaatacccgggcaacatgatgtctcatcctgctgaccttgccggaggacacctccttctcatactgcttcttgttggtgatgtgcaccaggctggacgtctcctcctcgtcatctcctgactgcaattggggaagcaaggaagacaggcacagagctcaacaatctgttctaccagagccagcgacagttcagaccaacaaacagtnnnnnnnnnncgtgcaccaggctggacgtctcctcatcatcatctcctgactgcgattggggaagaaaggaagacagggacagagctcaacaacctgttctaccaaagccagcgacagttcagaccaacaaacagtctcgcatgcggccttgatcagggcccgtcagtggccctatctggccgggctgcctgcgcgtgcatccatccactcacaaggcaccgtctgtcctgccccccggccccctccactcacctccccagcagtcgcaaagtactccagcgacttctcgggatctgcgtgcatggtggcaccgcccggcgtccagttggcggggcacacctcgccgtgctcggccacaaactggatggcctgtgaagagaggagcgggtggcatacggccatgagcctcaggcacactttgattctctccatgtgggccaaccaccccctccccttctgccatgcaactcgcctgcagggtgcgcttggcctcgtccacattgcgcccgatggggaagttattcatggtgatgtgctcaatcactccctgggagcgcagtggggggaaaggctgggtggatgagctgtcagccgtgcaaggtgccgcagccgagcagcatgcaagtgccagaacttccccgccaggagcaatgccagtgcatcatcgggggcacgcagatgatgcttgcagcctccacacccccacccccgcccccaagcacctctgggttgatgatgtagaggccacgtagcgcaatgccggcgtcccgcttcagaacgccgtaccgggcggcgatggactgcagatcggcggcatggatggcgtcagggacagggagggactgcagtgcatggcatcaagggccacatcccccgcttgcttcctgtgagggaggtgcgctgcacccagcctctctctttcttatgcaagccccacatgaatgtcacctttgtcacgtccgccaggatgggaatctgcatgtaccccagtccacccctcttgcgcggggtcttgatccaagccaggtgcacctctggggtgtctgttgacgcggcaatgagctgaaagaaaggaggaacaaggtggcgcatgactgattcttttggtcgaggaagctggggccttgacgcactgcatgccgaaactttcatcccagtctggcctccggtcagggcctcgggagtctcacgataagccctagtggccgccacacgatgcatttcctctttccctcagcctcccaccctcaacccacacctgggcattcaggccctggaactccttggcgcggtcgctgaaggcgatgatctcagtggggcacacaaaggtgaagtccttggggtaccagaacaggatcacatacttgcccttgtagtctgacaggctaatgtccttgatctccccatccaccacagctgcgtgcagggaatgagtggggtgcttggtgagggctgtgaggccgacaatgtgcaagggggagcagggaggagacgaaggcgagtccgatggtcgtggccacgcagaggcgactcccttggaagtgcaacaccccccgtaaaccccctcctcgcctggaccggagaattctggggccaggcctccaacctgcggaaacgatgggcgacgtgcgcatcagccaaggctccaggcactctctggtgatgcagattcgtttgcacctttctcacctcggcctccacctcagggtagaagacggtggcatagtcctggtcagcgtcactggcgaacgacctgggcgtcgggcccaccgttgggggcagggtgtttccgatccacccactctgtacgcacttatccaggcatcctagggctgggatgaacctggcgcacgccaagtctttgggtcccgagccaatggcccgagaggccagggaggcaagccgagacactgccctgcgctgcatgactggaaacagatcgccgttgtgaaatgatgtttacaacttctgatcacttttgtgcgagtaacgatgaaagtgagcggatgtattactgaccaaagcctgtcgcatgccgtcgaaagtccacatcagatcgcatgtcacatacgagcggaaggtccggggttagaggagcatgatgacacctgctgggagtatgccgtctggcatagcatcacttccggacgtttacagtgtgcattgaaagagatatagtcagattacggcggcagtcacacttgagttgcaggtgggagggaggctgcnnnnnnnnnnttaggggagagcatgatgacacctgctgggaatatgccgtctggcatagcatcacctccggacgtttagactgtgcattgaaaaagatatattcagattacggcggcagtcgcacttgagttgcaggtgggagggaggctgcagctgggtttgcggtgtgccacatgttccgcggggtcacagagacattggggcctggcttttatggtggcgcatattgaaccagacatgatgtcgtttattggacgcgtggcatgcttgtcacgggtcgtccaggcacagtgctacacacattgtgcatgcgagcacctgtccgagatgccccatcctcctcgcgcccagtgcaggaacctcgcctataaggaacgtttcaaggcattttgaactctccatcagctgctccaccgttnnnnnnnnnnaaacctcgcctataaggaacgcttcaaggcaatttgaactctccatcagctgctccaccgtttgtttggcctcgggttaccgccgacacgcttcttcttgtcactccccgcggaagtgatcgggccattacctcaggaccgcagcccagccccggcctactagtgccgagccgaaatgcggtggaggctggcagccgtgtgtggagggggtctggccctgctcggcggggcggcggcgagctccttggctgaggcacagcaccctgcaggcgacaccctggagctggtgcaggtcgtcttccggcatggtgagctcctctgaacttacggagcgggtatcttgagggttgtacgggatgtcgcggtgggggacccctgaagtaggatactgtccagaccatgcccctccaccgcctcccccccaccccccaaccgcactcgccttcaggtgcccgcacgcccctgagccaaaagtactggcccgagctggttagggagtgggacgcgtgcgggcaggcctacacgccagtccccctggatatccgcaccgaggacgggcagccccgccccgccaaccccgacgacgtgaaacaggtggagacgcgcttccccggcggctgcagcaagggcgagctcacccggctgggccagcgccaggccctggccttcgggcggtggctgcgccgccggtacgtggacaccctgggcttcctgccgggggaccgcgagcaggacaccctcctcccccgcaccaccaactacgcacgcaccgtggccacgctggccggcgtgctgnnnnnnnnnnacctgggcttcctgccgggggaccgcaagcaggacaccctcctcccacgcaccaccaactacgctcgcaccgtggccacgctggccggcgtgctgacggggctgtaccccggggacgaggggcctgtgcccgcgctcaccacgccggagatggacgaggtgctgtacgccaacgtgcgcagctgcgcgcgcctgaaggagctggttggggggctgcacgccgaggcgcgtgccagcgcgaagggcgatgagggagtgcaggcgctgggccgagagctggcggcggccatgggcctgccgccgggccaccgcgtcagctggctcaacctgcacgacgccctgacctccatgcaggcgcacgacaagcccatcccagaaggcgagatgattaaaagagggcgagaggggcaggggtatctgatggggatcgggtatggcactggcctcagcctcgcggctgggcgtggcagtggggaatagttggggatggctgggagccagaggcctcatgccattacctgcaggnnnnnnnnnntcgagcgatgcccctgtgctctcctctcacatggagacacctccctcatgcacttccaggtgtgcgcagcaggccagacctcctcctggcactggacaggcaggcggtgaccagcttcctgcacgtcgtggcgccaccccactccacgggccggcaggaggaggtgctgcgcctgggcatgggccgcatgctcagaatgctggaggaggtacgggtgggagatagggtggacnnnnnnnnnngcgcagttgagtgaggggcctcgacccgctgtggctggacccgatgccttgcattgccctgggcatgcccgtgcacaccgagcgacgcccctgtgctctcctctcacatgaacacaactccctcatgcccatccaggtgtgcgcagcaggccagacctcctnnnnnnnnnnacgcagttgagtgaagggcctcgacacgctgtgtctggacccggtgccttgcattgccctgggcatgcccgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacagggggcccggtgcggcaccaggaacttgaagaggtttgaaccgcacgcgcttttgccgctggcctccagtctcaagnnnnnnnnnnaaaacagggggcccgttgcgggtccaggagcttgaagaggtttgaaccgcatgcgcttttgccgctggcctccagtctcaagnnnnnnnnnnaactcagcaccgctcccgccccccttttcatcttcggcagcgtatggaggagacggtggcaggcacggccaagcaccgcatgctgctctactcagggcatgactccacgctcatgccgctgctggtggccctgggcaaggaggtggagacctggcccgcctacatgtccaatctggtgtttgagaactggaggcgtggcgacggccagcgctatgtcaaggtagttttcccctttttggggggggaagggggctgggtttggggaaaggggctccgagaaatggtcatgcctgttatggctggccttgggtgcaagggtggaggcctccaagacgctcacatgccagagtggctggggcgcgccacctgtcgcacgggatcggtgcaccctgcctgcctgccctcggtgctgtcgggacggctcagaacatcctatcctctccctggaactcgccttcacactcgccgagtcccttgcaggtgctgtacaacggcgaggcgttgggcctgcaggagctgtgcggcactcccgagtgcccgctgcaggacttccggcgcgcggtcatggcgccgctgcagctggactcggcgacctacgcggaggagtgcgtggtgcaccccaagcacaccgggcctgccgggacgcgggtggagacgcgccagcggggagtgagcatcggcagctccatgcaggaggaggacgagtgaggtggcgggggcctggactggtcggagcctgtgcggcagggggagccgacgccgtgtggcagcagcctcttcctgctcgccggcaggtgtgctgccttggcggtcttgccccggcacatgcttggcacccgatgctccgggcagccatggnnnnnnnnnntgcagatgtgctgccttggcggtcttgcccctgcacatccttggcacccgatgctccgggcagccatggcgatgatggacgttgcatggtctccccctgctatcttttgatgcctggtttcatctgggtaacatgctgtgcctgcaaggccttgcacacatgacacggtgaggtcagggggattnnnnnnnnnncggtctccccttgctttcttttgatacctggtttcatctgggtagcatgctgtgcctgcaaggccttacacacatgacacggtgaggtcagggggattcgacaatgcctcaggccggcgcggcggcagtggcggggaaggacagcggcaggggccccgacacggcggccaggagcttggagacggggtccgcccagtactcgaggatgtgcagctggccctcgccgtcctgtgaccaccggatgtggtacagtgtgcccgagggggactggatgaagtcggcgccaatgggtaccttgatggtcatgccctcgtccgtcagcgtcagcatctcaaatctgccctcagcctggggatgagggtgtggggtgtggaaaggcattggatgccagggggcacaggtaggcgaccttcaaaagcctccccgacggtgctggactgtcggtgtgtccctctggggttttgcacagttccctacttgggcaaatgggcatgcaggatggagggcacagcacgccacgctgccatgccccctgccattgggcctcgctagcttccaggcgtcctcccagaccaacaacctgtgcgtgctccnnnnnnnnnngttgggtctcactagcttccaggcgccctcccagaccaacaacctgtgcgtgctccagctcggccttccgggtgatggtcaggaagacatcctccaggggggtcagccgcagctgcaggtccgccacacccagctccagcttgttgacctgggagacggaatgagtggttggtggtggtagtcaaacacatgatggggactgctgggttgtgcatgcatgttgcaagggccagtgccgacctccagacccttccctctaaagccatgccaggtcagtgcgatctgtggcccgggaagcagcatcaagcaccacagcccctgctcaccttcaggtggtggaagagggatggcagcttgtcctcgttctcatacgggcacatgaagtgcacatagtccagcgactcatccgctgccgagagaaaagggagggccggttgttttgtggtgggggctggaccatgaaggcgctgcccgctggtctgcatgcccaccggcagcagagtttcagtgggttccacccggccatccccattcttgaaggctgcctgagatacaccccaattttgactctccgcgccgcctcatgcacggcccacctgccgtcacgcccagnnnnnnnnnnccttgaaggctgcctgagatacaccccaattctgactccccgcgccgccccatgcacggcccacctgccgtcacgcccaggcgatccgcaaagacggccttgatgcgggccgcctgcagcctgcccagggtgctgcgctgctcctccccggacccagatcggagctgctgctccttgcaccgcggggccgagtcggcggcggcctcggtggtgggggtggcggggatgaggaagtccccatccagcgccccctcctcagtctgggagctgctgccagagctgctggtacccccctgcaccctaatgctgatcctgtacccagacccaaacctcatcttcagccgcaggctggtgcctatgcaccgcagcctcccccgagccataatcccgatcctgtgcatgcgtgttgggaagggggtgagtctggcgccggaaggtgcagccttgagaagaactctactctactgatcctgagcctgcaaggtataagccatggcctttagacttcctgacaccccaaatgaccccgactcttgcctgtcccccaggatgtcggcctcctccatggagtgggtggtgagcacgatggctcgctgccgcttgcaggagtcaatgaggtcccacaggtggcgacgggagatggggtccagccccgtcgtcggctcgtccaagaacacaagctgtgttggggtgaaggaaagatgttgtgtggactgacatccaggagcagggatgtcaacacatccgtccggaggtggagaggtgtgggtagctcgtgcatagctggcaagcaaattcatgtgattcgacctgcaaacaggcaatacaatccgccaccctgactcattctcagatacccgtgaccctctcacaccttggggtctccaaggagggccatggcaacagagaggcggcgccgcattcctccagagtaggcccctgccctgacgctcccagcctcggtgagcttgacctcctccagcagcttcgctgcctctgcggccctggtcgccgcaggaatacctgagcagcagaaaccagaggcaagagggagctgatgcgattgatctgatggttgagagttccaccgactaccaaaaggagagccctgccatgacacctactcgggacaggcccatgacaacaacgcctatcctttgactcttggcacaaacccacctttgatggctgcaaacacatgcaggtgctccagcccagtcagctcgtcccagagcacatcaaactgtggacagacgcccatgatgggccgggtgcgagccatgccgccgcttgatgcgatgctggtaccgtacacgagggcgtcccctgcgggtgtggcggggtggcaccagcagggctttagtttgccagtgctcaaggacaccatgccaggagtggactctgggggaacaacactgggtttcatttaattagaggcttctcgtagcatgcaacctgaaatccttggcccccaagtcagcaggcacctgccgagaagggtatcactcccgtgaggcagttgatggtggtgctcttgcccgctccattgggtcccagcaaacagaagcattctcctgcagaaaagtcacagcatcagatgctgagccggagccgagtttggatccttgcatcaagcagtatcatgtgtgcactccatgctctccttcaatccatccccatcaatctctcaccacccttgtacagttgcctgccctcccccaagccctgcatccgtcccgagctccccaccgcaccttccaggactcccagccaactgctgcgcacggctacaaaaggtttccgccggaacaggcccctcccgtactccttcctcagcccgtacatctccatcgcataggcaggctgtggagtggcagccgccgtgtcgacgcctgccgccccagggtggtgggtgccgctcagcttcccagtgtaggtgaggcaccgcgtcttcatcctttccatctcttctgccacatcagcatccaccaccaggccggtggactcctgcgtggatgcctcgtaggcccgctgcgccctttccagactgggtttctgcaggagaataggggtggattgcagattggcgcgagtgccacacgagacgtgcatgcaggggtcgcccaggtgctctccgcagaaaccctgggccggcagcctccctccgccccccgccccggaacccctgcccgtctcacgtaaggcgccacccagtaactgggctgcaggaagtacnnnnnnnnnnacagaacccctgggccggcagcctccctccgccccctgccccagaacccttgcccgtctcacgtaaggtgccacccagtaactgggctgcaggaagtaccagggcgcccgcctgaccccgttgcagtctgggagcacgttgtcaaagtagagggcgagcaggcagtagcctacgcactgcagcgccagcacccagaggatagtgcccaggggcatcacgcagtcgtcctggtagtagagcggactgctagattgctcgggggacagggagcctctcacgcagtaggccccacgcatggaccaggggatgccaccgggggttgaccctgtgctcagagagaggttggggggagcactgtcgtgtgaaaccagagatggatcatttgcatgtgcagctctatgaggcacgattactcaacctctgccccgagccacgccagcaagtgcataggcctcaccagaggctgccgcagcgaggtcgcccacgcccttggagagcaggctccaggggaagaggctgaagatgaccatgccggcgggtccatactttgcagagtacgggaagtcaaaggcgatgacgatgaggcatatccaggccactacgaatatgacaaagcccacgggcacagccgccgctgcctgaagaagtgggtgggaaggagagcagggctgagcagtagcaggagacagtcatgtgtgcttgcatgctgcatactgcagtcaataatggtgggtggcatgccttcttgtagagccnnnnnnnnnncgcctgaagatgtgggtgggtaggaaagcagggctgagcaggagtaggagacagtcatgcgtgcttgcatgctgcataatccaatcaatgatggtgggtggcatgccttcttgtagagcccttgcaccatctgtatggccggtcacattccctcgatagccaatcaccacagcgcataccttgttcatgaaagtggacaggaagaacccaaaagacgtcatggccagggacaccaggatcagcaggaggtagccaagaccaaaggcattcccagtgagctgaggcggggagggagcatgggcgaggcggactggttgacaaatcgcatgcttctccacattacccctcacgctttgggtgtcggggtgaatggagcagtaggactaccacccctggcatgagggctggctgccccttgacctctcaccagcgtgaacttgaaggcgtatccaaagcccaccaacagtgagccctcgatgacggccagggtgccctgcaacccagcgggtgagggcgacagtagcttttctggggtaaggatctggatgctgctgtacgggaactcctggtggggatgaaccacccgatgcagggccaacatcctccagccccaggccctaccaaacttgctcacaactgggtcctcacctcatagaggaaccaggaggcccagaagggtgtgtcccggagtcccatggtggccatggcacgccggaccccactctcctcctcatgcacgacatcatgcagcagcaggacaaactgtgcggcggaggtagggggtgaggaggagcagggaggtgactggtttgctgtcgtcctctcagcatggaggttgcatccatgaaaggggccatgggcaggccaggctgcatgcattacattcccctgccctcctgacgtggtcacagtccccacctgaaacatgatgctggcaaagaggaaggtgggcgcaatggtgccgatcatggagggcgactgcagcggggaggcggcgatggctggtgtgagggccctcggagggcgggaaacatgcctccaagcaatgaaacgatgccgcaatccctgccccgctgcacggcgcagtagcaccacaccacatccaaagctcaccttggccgctgggtgggggaactgggtcagggcagggctccactccaggtctgggttgctcacggcgcggcgtaccagctccctctctaccgccgcctggaggggcagctgtggccgcaagacaggaaggaggggtgggtgggtggacgctctggggagctggacccgctcgcggtaatgaacttggtcctctcccccatcccacccccagcctttggacacctcacctggacgtacgtgttggggtgttgccagtcgcccttgaaccactgcacactgctgttcacctggatggtgaaagccacatttctctctccatccactgacagaatgacagccgacaggacctgcgggggattgaggagactgaggtcggtggggcggcatgttgaaaagtggagcataaggtaaccgccacatgtcacggctacgtgttcatgcaatatactgccgctggatcaatcttattcatcttccacgtccctgcaaaggggcctggatgagtatcctaacatcccctattcctgttgtctctctggccatgctagaacgtcgaccgctgctccctcaccgtttccggattggccagcaggtagtcgtcgatctcggtttcgctggcaaagcccttgaggtgggttcgtgcgatgggggggctgttgttgtccgccactgctgccagaacctcttccaccagtgcaacgnnnnnnnnnnacccttgaggtgggttcgtgggatgggggggctgttgttgtccgccaccgctgccagaacctcttccaccagtgcaacgccctgcgagatgaggggattgagaagaattgcagccattttggggaggatatccccacgggcgtcgcatgtacctatnnnnnnnnnnattgagaagaattgcagcctttggcgggaagatatccccacgggcgtcgcatgtacctatctgcagctgctggagacggtctgttcactcgccaatcttgcacgcccatgcacggggccctgcctttcccacaccacccggccccaccttgggtgcataggcaatggtgtagcaggccctgtcttgcctcaagtagatgttggtggcgcagtctgggataggcccaatatcaacagcctcggcagtcgtctgggagctgtaggctggctgtcgctggcgggaggcagtaagcgcgcggtcaacgccccagatgaggaggatgaagagcacagcctgcgccaggagcagcacgtttgtgcgccatgccagggccctgccaacggttgtgttggtgtttggcaggtcatcaatgggtggtcgttgtgagattatgatgatcaggcgcaagcccaagtgacgaggcgctgtagacctgactgaaccagctctggtcacctgatgagaagnnnnnnnnnncgacgaggcgctgtggaactgcctgaaccagctctggtcacctgatgagaaggttcttgcgaaccagggctgcaaactgagtccccagcaggcgccaccccgtgatgaggggcgccttgttctgtactggcatcctcgagtccttccgggacaccggggctgacggacccatgccatcgtaaggctctatttcgggcatgctgactagtggatcctaatcagaacctcgagatgtcctctgacccctgtgcgacactcgatgccagagactttggccctgtctggaaagtcgttccccgttagctcatgcgagtccacatggagctcaccatggcaatacgtcgcacggcatcactggccaacaacgcaccagttttcaggatattgccagagtctaacagttcgttctgtgggagggagggacccctcgacacccgcatgcctgctccttgatggtatcgaggcgaagacagtttggccacgtgaccactgaagttgtgtgcacgagtgagagtgatctgtcttgtctggacgacccatagcgcctagtgcaggaatcgcccacaataaaataccgtgaaatttgttgtgggtgcgccgaggctgggtggccgttgcccgccttgccttgactaggctcatttcagccaaggtagtatcctggtatcgatattctcaatttatcgccgcccagaacgagcatgcatgagnnnnnnnnnngatcctggtatcgatactctcaacttatcgccgcccagaacgagcatgcatgagacctgcagggaagcagtgcacaacagtgtgcgcattcccgcagtggagctaagcaatcagagattacattcgagtcggaatgcccgtgcgcccattcagtgtagcctgctaagacctgtacggccgcatgcactgacccccggtaggtagcaccgagtccgccggccacccggacctcctgagtcagcaagagcttggatggcggatatggcacaccgtcgtctattgaatttggctgcacatctcggaagttttgtccgcacacggtccgtcgccccctccccgtcccaagcacgcgccatgagctccatcttctcggaggtccccgaggtacattcaatgtaatttggcatgctacaagggttgtgaagcgttcccaatgtctgaagggtcctggcctcctgcgtctcaccccgcggacttgaccctgccacccgtccgcaggctcccgcggacgccatcctcggcatctccgtggcctacaagaatgacaagaaccctcgagctctgaaccttggagtcggagcctatcgtaccgaggcgggttgaggaggcgggaggtgatggtgggggatctacattggcatgcgtcctcccgaatgccggccgagagggctatcctcccataggctgggcaacctctacctcccactgcatgctccaagtccattcagaggcatcgatgggaccagtttatcaaatgagattgacactaggcttcccctctctgcaggatggcaagcccctcgtgctggaggttgtgcgtgaggctgaacgacgccttctggacgaccctaagcaggacaaggtgtggaggggatggcaggttgacgcgctgtattatagggtggcccaggttgtgatgtgaaggttggtgcgttcattgaggaactaagggttgttcccaaggcaccgctggcaacataccgctggtgtgttttatatggggtccctgcttgcgcccatcacagcgcgccaaatccttcgccctctccgacgacccgcgcaggagtacctgggccaggcgggggtccccgccttctgtcggggctcggccaagctggctttcggagaggacagccccgtgctgaaggagggcaggaacgccaccgtgcagggcctctccggcaccggctccctcagggtgggcatctgaagagggggtgggggcggaacccggggaattacaccctggcatagctgtctcgcacccgccaatggtgtttcaagttcccttttccaggccattggatcttgctgcgtcgcaacccatgtgctgcttccttgcccactgcattccccaaatatcaaatgatctcccccaacacgcccccacactatcacccaccttggccttcggctccagcaaggattcacattaccttcacgccctccctccccttcccctccccgcgccaacaccccttgtaggtcggtgcggagttccttgcgggcttctaccccggcgtgaagcaggtgctgatccccaacccctcatgggcgaaccacaaggccatcttcgaggccgcggggctgcagactgcgcagtaccggtactacaagcccgccacgcgcgggctggactacgagggcctgctggaggacctgggcgccgcgccgcgcggcgcagtggtgctcctgcacgcctgcgcgcacaaccccacgggcgtggacccgacgcgcgagcagtgggccggcatcctggacgccgtaagggaccgcggcctgctccccttcttcgactccgcataccaggtgaggggtgagtgcttttcaggtgatatcatcgccgtgcagggccagtgtgcgcccttgaaaagcgcacgggctggacggcaccatccttctccacctggctggtttcctcgtttccagtgtagttcctctcccccctctcaccgctcagggctttgcgagcggcgacctggacggggacgccgcctccatccgcatgtttgccgaggcggggctggagctgctgctggcgcagtcctttgccaagaacatgggcctgtacggcgagcgcgccggagcgctgacggtggtctccgccgacgccgacacctctgcccgagtggagagccagctcaagagggtcatccgcgccatgtgagctgccaagaggggaatgtgggatgaatctcccctgcccacccaggcctgcaccgcaggaacatgctcattgtatcagaatcctcccttctgttccaccgcaggtactccaacccgccgcgcnnnnnnnnnnttgggatgaatctcccctgcccgcccaggcctgcaccgcaggaacatgctcgttgtatcagaatcctcccttctgtttccaccgcaggtactccaacccgccgcgccacggcgccgagatcgtggcggccatcctgtccgaccccgagctctacgcactctggaaggcggagctgaagggcatggccgaccgcatcatctccatgcgcgagcacctgcatgccgcgctgagggagcggggcacgcccggaacctgggaccacatccaggaccagatcggcatgttctcctacaccggcctgacgcggcgccaggtggcggactgcctcaccgccaagcaccacgtctacatgaccctggatggccgcatctccatggcggggctgtcgccggagtcgtgcaagtacctcgcggccgccatcgacgacgcggtgcgcaactacgccgactgagcggctgcgccgtggtcggctgagttggggtgggggaggtggggttcggctccaggagagcctgcccccggcacgcccggctgccgccccggtcccgtttactacaggtctgcatggcacaacacggtcgagccagannnnnnnnnntcggctgccgcaccagtcccgtttactacatgtctgcatggcacaacacggtcgagccagactccaatcgcacccgcccgcgtgagagactgctgagtgtgccgcccgcattgtggcaaaggcattgcgcagcgccgtgaccatgaggtcgcccctctgtggcctcctgtgcttgtcagcgtccatcccctgggtctcgcaggaccctttcgcttgagtgatgtaggattaaccacagtgtgtgagcacgggcggtggggcagacccgtcctacccctggggctagggagacgcaagggttactgttacgccaggagtacacgaagcacccaaagtactnnnnnnnnnncccatcccctgggtctcgcaggacccttttgcttgagtgatgtaggataaaccaaagtgtgtgagcacgggcggtggggcagaccnnnnnnnnnnnnnnnnnnnnnnnntggcggcgcactgcagccatggcagcgtcgctggccccatggcgaccgcttcagatgctccctcctccgacccctggcccaggctgacatcgatggccaggcccttccgctgcgccggccgccaggtctggttgggccggaagccaggggcgtgggccgcccgcgggccccgtaggaggaggaaagcccggcaggggctcgtgacgccgctctcggcgcccgccacctgcatcaggaactggcgcatagcgcagcgggacaggccctcgtgggcgtgcggttgctggcagaggtcttcctggcgggcggagccgcgatcgcgagtgcctgcgcactcgggctctgggtccagcctggcggggggaaagcggaaggtgatggcctccaggggcctannnnnnnnnncgggtcttcctggcgggcggagccgcgatctcgagtgcctgtgcactcgggctctgggtctagcctggcgggggggaagcggaaggtgatggcctccaggggcctagcggggctccgtcccaggagcaggactgcctgtgtgccgatactggtgctgaagagcaggggcgtgatgctgcacagcagagcatcaagccctgcgagggcctgcaggccgtggagatatggagggatttggtgtctggctgggcacgatacaggcagtgctggcacagcttctgaagaggccagcaaagtcagtctggcatagcatgatacatcctcctcctgcatgcctggtaccttggcctggcggagctggctcctgtctcttggaccaaggccctcccccgccgtgccggccgtcagctggagctggtggtacgggcccggcagctggccccgcatgtacaagatgtggggaatgaggtcgcgcagcacgcatgcgcatgccgtttggctcagctcagaattcgacacaagctgggcctccagccgggtgcatgtcgggacgaccctctcccttcgcggtctcgacatgctgcgttataatgtgttacgctcagcacatgatgctgcgtttaaagggaccgaggacattaggccgtctctacatgaagtggttggatgaatcgcccctccgaccgttttgtccatgccctgtgcgaagcagcacatggtccctagccacacaagcgtggaaaatagggtagatcaaagtgcggggacgccaggaaggtcgcggcgcggcgccggggggcagcgacctggcgttcgccttttgtatacaacatgttggaaagagcgcgcgacgtggagcacccagttgcacggtgaacaggtccaatgagaaatgctcgatgacggtggtgggtagcatgaaaatgacactgtannnnnnnnnntgagaatggaggccaccacgcagagcggcatacatgtatccccgatgtcatccgggcctcccagaatcctggannnnnnnnnntagttgcacggtgaacaggtccaatgagaattgctcgataatggtggtgggtagcatgaaaatgacactgtagctccggcaggcaacgcgccggagatgcgggctttgtagcgtgccctccccggtgcggggtgtggtatacagagaatggaggccaccacgcagagcagcatacatgtgtccctgatgtcatccgggcctcccagaatcctggacgtcatgcagatcgctggtgctcgggaacaggaggtgggtgtggtggtgctggaggggtggtgggtctggcaggnnnnnnnnnngccctccctgccgagggtcatgatgggcagtgactcaaggagcagcttttggtttggacatgtacctctgccggatccactgccgcctccttgctttcggtccacatatgtgcaaagcatgcacccgacccccgcagctgcatggcctgctgtctgcnnnnnnnnnnttccactgccgcctccttgctttcgatccacatatgtgcaaacccatgcacccaacccccgcagctgcatggcctgctgtctgcgctggggccacaagacgggcacgcgctggggagcatgccccgcagcctccgccggcgcaccaccagccacaacccctaccgccacgtcctgcgccccaacaagaagctggaggcggtgcgcgcggccgcggatggactcggccccaccaaccggcgcatgcggcgccgggcggggcacctgaccgcgcgggccgtgcagtcctgcgagtggcggcccgaggacctgggtggggatgtgctgcgcgccgccgcgcctgacccccaggtcgagggcccgggggccgactgccagccagcgacggatgcgcgtccggcgcccaagcgcctggagacccacgtctggcacgccaagcgcatgcccatgcagcgggcctggggctgggtcctgccgctgcggcgcgcggggcggggcaggggccagcggtcgctcgtcgcgaggctgcgcgggggcgcagtcctcgcgcacgacgccagctactgggcggcgctggctctggggctggataagggcagccggtttccctgcatgggccgcctgctggggcctgggtgcatcgccgcctgccaggcgctcctgcacgcgccagcgggtggggaggtcgggctcatgctctacgctcccgatggcttcccggcggccgccatagcgcctgccatcctcacctgcgtcccggggactgctgccgccgaggccccttccccttcctcgcccgggcacggcgccgtcgccgtgctctgggtccatgcggcggccgtgcgcggggcagcggccgcgctcgcccaggtgggcgtgcccgcnnnnnnnnnncccccttcctcgcccgggcactgcgccctcgccgtgctctgggtccatgcggccgccgtgcgcgggacaggggccgcgctcgcccaggtgggcgtgcccgcccggcccctgtccctgcgcaggctggagctggtggggcgggggtgcgacgctctgctgcgggggctgtgcccgagcgggccccggcacggcgccccctccccgcccgccccacctgccgcggacggcgcgctggccgtgctggccgtctgggacccccgcctcccgcgcgacgcggcagagctggatccgtcgggcgcacgaggccatcccgagggagtggctggccaggggctctcctgggacgcccatgcacccccatgcccggcctcggagctggccgagcgcatgaaggcgcggcgcggcatggggagggccgaggccagtggattccttgagggagcgagcgaggacgggaaaccgctgcaccccgctgccaggcactccacggcgtgtcgcatcnnnnnnnnnnactcggagctcgccgagcgcatgaaggcgcagcgcggcatggggagggccgagtccagtggatttctcgagggagcgagcgaggacaaggacccgctgcaccctgctgccaggcactccacggcgtgtcgcatcggcctggtgcggcattcgggtgacaggaatgcccaccgatttcctggtgagtgggctgaggtgggctcctgacgcgggtccatcgtcgccaccccgcttccgacctcaggtttgtacgatcgatcccagggcagagtttgccaggcttgcgtgtgccaannnnnnnnnnagctcctgacgcgggtccatcgttgccaccccgcttccgacctcagatgtgtacgactgatcccatggcagagtttgccaggcttgcgtgtgccaagctcattcaccatccgaccacgaccctccaggtgtcaccttgctggttcctggcggctgggtagggccatggtggcagcggctggtgctgagcnnnnnnnnnnccgcccctccaggtgtcaccctgctggttcctggcggctgggtggggccatggtggcagcggctggtgctgagcggagcacagcccctgggccaggaggagtggcgtgagatccactgcctgcagcacatcccctttttcccccatgacttccccgagacagaggtaacattgcccctacagaactttaagggtggtggtttgggggtcgcagggggacaggacagatggtatcacccatctgctgtacagctgctccaccatgcgcctggagactgccagaggcgcgccatggcgcgcagcctcagggctgcctgacttgtgctccgctctggacgctgcaaacctcgtccaagcccttttcgacaacaacaacgttgcgtcacatccactcacgcaggcgggacgaggggcagcgacagaggcatcaagcgagcgggaacttcatgccagcaagcgccccgccaacaagcccgccccggagtcgcccgccctccccactccctctgactgggccaggttgtctgggaacgatggtcaaggccaggaccctgcgggtgggggtgcctccatggtggtattgcgggggcgcggcgcagcggcgcgcgccgctgccctgggcgtgggcccggccagcatcctgtgcgaggcgcgcttggcgctgcttggcaagggcagggccctcctgcccggcaccgaggtctaccgcctggccggcggcgcggcgggcggcggcccgcttggaaggcaggaggnnnnnnnnnntcagggtgtctgggaacgatggacaaggccaggaccctgcgggtgcgggtgcctccatggtggtactgcgagggcgcggcgcagcggcgcgcgccgccgccctgggcgtggccccggccagcatcctgtgcgagtcgcacttggcgctgcttggtaagggcagggccctcgtgcccggcaccgaggtctaccgcctggtcggcggcgcgacgggcggcggcccgcttggaaggcaggaggcgacctgcgccgctggcgtcgcgcgtggttgcgtccgcgaggtgacgatggcgggggcgccccagagcgtggcgctggcgggctacatcacgaccgcgtgccgcggcgcacgggagacccgggccgcgctggtcnnnnnnnnnnatgtggcgctggcgggctacatcacaaccgcgtgccgtggcgcacgggagacccgggccgcgctggtcgccgccggcttcctggcgcaggggcccacactggggctagtgcgcgccccgggggcacgggtgctgcgctgggcgcgatgcagcctggcctccgcccatgtgtgaggggcagatcctccgcttgagcctgccagcctttgtgcatcaccagcgcagtcagcaggtcccagttcacacaagattggatcaaaagctgaggggcctccgcagtcactgcatgcgtatttcgggaggtgcacaggcacctatatgcccataaattgttcatgatccgcagcgcccaacaactaatgacttgacgtcttcggtgcacttttagttctcttagaatctgcaccgaccatgcaattcagttacagcatcgcagcgatgatccggcatcgattagtgagttgaagtgcatgtgccatgatcgagcgtcgcgccccaaaccaccccccttctgggaagttccaattcatgccaatgattccaaaccccaccctactgacgatgctgctcctgggtgacgannnnnnnnnnccatgatccgcagcgcccaacaactaattacttgacgtttgcggtgcactttcagttctcttagaatctgcaccgaccatgcaattcagcaacattatcgcagcgatgatccggcatcgataagtgagttgaagtgcgtgtgccatgatcgagcgtcgcgccccaaatcatcccccttctgggaagttcccattcatgccaatgattccaaaccccatcctactgacgatgctgctcctgggtgacgannnnnnnnnncgactaaatgaaagtaacggtatgtgcaaagtgtgtgggttccgagaagtgnnnnnnnnnnattacgctcggcgacctcgccgtacatcacgcgtcatgcagcacgtcgaaggggggggttgacaagcaaacccaagcgggctccacgtcaagtgacatgaatgaggctcaaaaactatatttacgtggtgactccatgaaagtaacgggatgtgcaaagtgtgtgggttccgagaagtggaacgagtgattgcaaattccttcccgtccggaggatgcatccatgtccgccttccgagagtctggtcttcccgtccgaggttttcgccagtgcctgtagcacgcacccatcaatgagggtgccttaagatgtggcttctaccgaagggtgcaccagatttcccatcactacactgttcgcctccttctcgccacggacccgggtaacatcctcgtttacccaaagaccaccgctttgtcacgtagctaagccaccaacccgactcaagatggtttcgaaggcgggagttctggtgctcttcttgggcctcgcagcggtccatgttcaagcggaatcgaggtatgctctcattatagtgcgttggagctgcaccatccgccgcgatggctcgcatcgtgtctgcggtgaaggcccggcatgcaataggggacggatgcccttcgtgggcctttccctcggagaagcaaaggctacagcgatatcagcacgtaggcctgttttgacgaatttaaagtgcttcagagcttctgtgaatctctcgagcctccccctgtgcaggaaactactgggcaccatcgcgattggcgcggctggtggcgcgggagcgtccgctgccaactcccagtccgtgaccttcaaggaccctctcactggtaagtgcatggcatgtgtgggatgcgctaaggatgccctgctcttcgtgtcaggggggttgatgttatcgatttgaggctcaggtggcatctctgaagtgggccagtgcaggcatggctgacacgctctcgttccccacgccccccccctctcacgttcgccctcctaatccactgaccacgcatgtacagactcccagtccgacaccgccacctccaccgccgcctccctggaggggtacgccggcacctttgccggctcctccgccgagaccggcgagttcaccaccgagggccacaccggcggctggtctgagggcgtgctgcccacctctacctccaccatcaactctctcaccgaccccaaccgtgccgcctccaccggcttcaccaacaccgccgccacctccgccggcaagccggcctccaccaagtcctttgtcatcctgaacgccgagggccgcggccagcaggccaacgccaccgccaactccaccgccaccaccgacattgctggcaccgtggagaccggctccaccggccagnnnnnnnnnnctgtgggccagtgcaggcatggctgacacgctatcgttcccacgcccccccttctcacattccccctcctaatccactgaccacgcatgtacannnnnnnnnntgccaccggcaactccaccgccaccaccgacatcgacggcaccgtggagaccggctccaccggccaggccatcgtgggggatggcggcgcgagtgccctgacatccgtcaccgccatcgcccccggtgactccgccaacggcaccatcaccgccaccggtcccaccaacgccagcgtgcaggccagcgccagcgccaagggcacggcagccagccccggtgtggcagcagtcagcccctccccctcccccgccccttcccccagccccgccccgtcccccagcccctctcccagtccatccccggcaatcccttgattgggtgcgttgggagcgactccctgctgctcatcccaagtgaagctnnnnnnnnnnccagaaacctttccatcatcatgagctgaaggattattctgccggaaacccagacggcatgacccttcccacgtgtcatgtactccactgtaattcgagcactgggcattgtgttgactcccaagtggtttgccgggcatgggaagtaccttggtgactgtcccgactatgaagcaacttcagcatctaaattgatcgttcttcagtctgtgagaattcagacctggtccagcggcgggtcactgcagggtgcagggaaaaggggcgccccggccattcgggcacacctttctcctcaaaggcaaccaaaccgatcaataggctccctgcctgcatcctacatctgctgtcctggctgtgagaataatgcttgtgggtgggcaggcaggtgagccagtgagtggagtgtcagacccgggtactagcttccatgtacaagttgtaattaacagcagaaacatgcaaatccctcattccaatataacaaacgaacttcgcgccttgggtcctcagaactgttgattattggcttgatcttctgacacggtgccgctctgcgatggcgagtcgccctcatactggaaatgcccccgtatgaccgctacgttgccgaggtatgccatcgcccgacgtccccgggtccgcttctacgtcgagcataggtttgatagtctagcgaatactgtccggtttcactttgtagagaatgcatatagatatttcctgctgaaatgggagtattccacgtgccctcatgaacgaggggaatgctgcgcagcgggtaactccgctcagccaggattcacggtcatcgttgagcctttcaagacttgccggtcccggtccagaagctgtgcgatgcctatcaaaactgatgatggacgttcaagtgcgagtaacacgtccaatctatttgaatttgaggcgtaatgtcgcacgctatctnnnnnnnnnnaaagtggtttgccgggcatggggagtaccttggtgactgtcccgaatatgaagcaacttcagcatctagagtgattgttctccagtcttggagaattccgacctggtccagcagcgggtccctgcagggtgtagggaacaggggcgccccggccattcaagcagacctttctcctcaacggcaaccaacccgatcaagaggctccctgcctgcatattccatctgctgtcctggctgtgagaggaatgcttgtgggtggtcaggcaggtgagccagtgagtggagtagcataccgggtactagcttcaatgtacaagttgtcattatcagcagaaacatgcaaatccctcattccaacataacaaacggatttcgcgtcttgggtcctcagaactgttgattgttggcgtgatcttctgacacggtgcctttctgcgatggcgagtcgccctcatactggannnnnnnnnnnnnnnnnnnnnnnnnnnnnnnnnnnnnnnnnnnnnnnnnnnnnnnnnnnnnnnnnnnnnnnnnnngcgggtccgcttctacgtcgatcataggattgatagtctaattattactgtccgattccattttgtaaatactgtacatagatgtttcgtgccggaatgggagtattccacgtgccctcatgaacaaggggaatgctgagcagcgggtaactccgctcagccaggattcacggtcatcgttgtgcctttcaagacttgctggtcccggtcccaaaggctgtgcgatgcctgtcaaaactgatgatggacattcaagtgcgagtaacacgtccaatctattcgaatttgaggcgtaatgtcgcacgctatctctgaggaaaagtcatgaacctcgtccatccggacattttgctccggatacctcgaaccttgccatggttgtgagaaccttgagggaatgtcccacaaggttcctaccccttggcagattgcatcatgcacattcggctaagcgcctcatctacactcccaaaagtcgcgttgttttgagcaccaacggtgaaaaaagcgtctcctcgaaggcatccaagtatgaagtgttccgtcgtgataatgctcttagcgagcctcgctgtcagccatgnnnnnnnnnnaaagcgcctcatctacactcccaaaagtcgcattttttgcgcaccaacggtgaaaagagcttctcctcgaaggcttccaagtatgaagtgttccgtcgcgatggtgctcttagcgagcctcgctgtcagccatgccagcgtcggcacaaggtagcgtcttcatggggagacttaggagttgctatccaattatatagaccacttaaacccatacggtgacagaagctgggcgcgaatgacgtttnnnnnnnnnngcttagaagttgttatccaactatatagaccacttaaacccatagggtgacagaagctgggcgcgaatgacgtttgcaaacacacccgctccccgccatttctcaatccatgcatctctgctcccgaagccttgctccatcccctcttctcctatacactcgcgtccaggaagctcttagccacagcaggggctgtatcctccgcacaagggagtggcgctggcggggcggattccaagagcgaaattctcggtgagtgattgatctctcgagccgggtatgttgcctgcatgacacgactgtgggcctcgagccggcctggctatcgcacagcaaagggggcactgggactccatcccgggcatttatacaatatcagggctgtatatctctgaaagaatgtctttgtgccttagttcccttgacacactccgcacatctccgttgtcccaattcccatagtgattgcaccatatgttgttggcgaggctggtgccgccactggtggtgcctacgtgaacaatggtcaagcacgaacccaggccatttcttctcagaccaaggcagacctagcatccctcatctcctccactggaaagggcactggcctgaacgccacctccaactctacagttgcatcgttcttcttggatacaaatacaactggcagccagggtggaactgtggctggtggaacatctgatggagacgaaatctctaccacaggccttgccagcacctttggtatggcccttggccttggacagtcggccgtcctgttcaccaatgccactgcctcctcggacgtggagggtcctgctaacgctacagcaggagggtctgtgtacatcagaagatccgatgcaggcgcgacatatggcttcgtgacgtccaaggcccctggtaacctggcagaagggaatgcgaccgctgctggcaataataccctggtggtgctctcctcggatgctgtgggcaaggcgagtgagtctgatgaatccaccgaatcgccctcacccatcctggtccccgcctctgagtcctcccctggtccctccccatcccccaccccttccccaagccctgctccctccccctccccggccctgcccattatcccacccccgagcgctggccgctgattgggaagggcttgcaatgggagggactacctgctgctcatcccaagtgaagctcatgtaaacccttccaccatcatgagctgaaggattctgctgccggaaacccagannnnnnnnnntataaatctttccaccatcatgtgctgaaggattctgctgccggaaacccagacggcacgacccttgccgtgtgtcatgtacttcactgtaattcgagcactgggatagttgtggactctgagagcggttaccagacattagacacaggactttggtagaccctcgggggttgatctgaacataaccagagtcagcatttggatggctcttcaccctgtgtcccgacttggtccacggggtggagtcactgcagggtgcagggacaggggccgcccagctatgtaaacacacccttctcatgaatgaccgccaacctgaccaagtgcctcactgcacgtacatacccctcatcacccatacaggagacgagtaattacgtggtggggcggggaggtgttccagtgaggggagtgccatatcctgtgccagcactcggtatccatgcgacgtggtcggtgcgccacagtacggtaaccccaagagaggaaatttgcatcatgtgctcttcaacctgttccgttttggcctcatccattgacaaaccttacctcttagtttgggcacatcgcgctcacactggaaccttccctgtcggnnnnnnnnnnagtttcggcctcatccactgacaaaccttacctcttagtttgggcacgtcgcgctcacactggaaccttccctgtcggacctgagcatccgaagcatgccggtgcaccccaatgttagcggctttgcaagatcatcgcacagaagagttctaagtccaataactattatttgttgcccctttgtggggaaagtaatctctctccacctgctgcgatgggatttgtccacgcgtccnnnnnnnnnnaatcgcacagaagagttctaagtccaacaactattatttgttgcccctttgtggggaacgtaatctctcatcccctgctgcgatgggatttgtccacgcgtccnnnnnnnnnnggtccaagaagttgtcggtcccggtctcgcaagctctggcatgccgattgcagggtgtaatgacgaacacactggagtaacctctacattctgtggcaatgcggcgnnnnnnnnnntcatgaagcagtcgactgctggcgcagcggtggatccgcccatcccatgtccaggttggccgtccaagaagttgtcggtcctggtctcgcaagctctggcatgccgcttgcatggtgtaatgacgaacacactggtgtaacctctacattctgtggcaatgcggcgtgatatcgcacgctttccttgaagtgagtccctgatccttcttgatccgtacatctgtccggagacctcggtccatcccgagattgtgagaacctgaagggaatgtcccatgttccttcccccttggcgatttgcatcatatacacttgggaatacgcttcatccacaatcccacctgttaatttcttttaacaatcaagggagaggaaggagtctcccacaagattctcgagtatgaagggttccgtcatcatcgtgctcctggcgagccttgccgtcannnnnnnnnntatgttccttcccccttgggatttgcatcatatacacttgggaatatgtctcatccacaaacccacctgttaatttcttttaacaatcaagggagaggaaggagtctccttcaagactctcgagtatgaagggttccgtcgtcatcgtgctcctggcgagccttgccgtcannnnnnnnnngaattcaacgccttggaaatccattatgtgtgctcggagatcctgtggctaacccaggccctgcacggttcacgtttgcgaagcccgccgttgccgcgcggtcatcgacacccgcatcgtcgctcgtggtcccctgacccatctcaccccccnnnnnnnnnnaattcaacgccttggaaatccattatatgtgctcggagatcctgtggctcacccaggccctgctcggttgacgtttgcgaagcccgccgttgccgcgcggnnnnnnnnnnnnnnnnnnnnnnnnnnnnnnnnnnnnnnnnnnnnnnnnnnnnnnnnnnnnnnnnnncacctgcacacacaagcaggaagctgatggctacagcaggagctgtggcatctgcgcaaggaagcggnnnnnnnnnnacctgcacacacaaacaggaagctgatggctacaggaggagctgtggcatctgcgcaaggaagcggttttggcacagctgaatccgagagcgactcgttctgtgagtggtggatgtggaccgggaagggtggccagccccatcagtgcgcgcttccgaccggccggcggcatcaacgctcccggggtgcatgtctggccggcaccctgacgtttttctggagtatcggggctgggtgtacgtcatatgaaagccgtgagcttgaagacccgataaagtcgtgccctgtcgcctgatcagccccaaacccgacccctcgcaccgcagcggcctccccggccctccctggagccagcagtggatcgggcgaagccaccgtggaatttggtcaggcacgcacccaggccgtctcgtccagcattggggggaatcttgccaccctcatctcctccaccggcaagggcactggcctgaatgccacctccaactccacggtcatctctgtcatcgcctccccttccgtcggcagcggtggcagcacatcggcgggggggagctcggacggggaggagatctccgccacgnnnnnnnnnngtggtggatttggccaggggagggtagcctgtctgccccgtcggtgtgcttccggccggccggcagcatcgacactccgcgagtgcctggccgatctgcacaccgaatatctctggagtttcccttctgaacgtgcaccagctccaactcgtgaactcgaagtcccgacattccagtgtcctgtcacctgatcctcccaaacacgacccccttgcggcgcagctgcctccccggcgattcccggagccagcacagcttcgggcgaagccaccgtggagttcgggcaggcgcgcacccaggccatctcttccgcccttggcacccttatctcatccaccggcaaggggactggtttgaacgccacctccaactccacggttgtctccatcagtatttctccatctgccagcagcgcgggtgtcacctcggcagggggaagctcggacggggaggagatctccgccacgggtcttgccagcacatttggcctggcactaggcgtcggccagtctgccgtcctcttcacaaatgccaccgcctcctctgatgtggagggccccgtcaacgccactgcagggggccttgtcacgatctacaactccacctctggcgagacaattggcttcgtgaggtctgaggccccaaacaacctggccgaggggaatgccacagccaccggcaacaacaccctggtggtcttgtcctcggatgccgttggcaggtcgggtgggtctgagccatccacggagtcgccctccatcttgctccccgccccggagtcctcccctggcccttccccctcccccggtccttcccccagccctgccccctccccatctcctgagccgtcgccgtcgccgtcgccgtcgccgtcgcctgctggcccatgaggccagcctgatactcaaggtctggtggtgctcgtgcctcatgcattacatgtcaatggagtgttcaagtgctcctggcggttgcatgccccttccacattccagattgtnnnnnnnnnnatctcctgagccgtcgccttcgccatccccatctcctgagccgtcgccgtcgccgtccccatctcctgagccgtcgccgtcgccgtccccatctcctgctggcccatgaggccagcctgatgctcaaggtctggtggtgctcgtgcctcatgcattacatgttaatggagtgttcgagtgctcctggtagttgcatgccccttccacattccagattgtcacgctttcaccattcatccccactgacccattagtcgagggaagaattcatgattgttaggacttaaacacgggctgtgctgcactgactgagcatagtcctatgtaacaaccagctccatcataccaagcaagatgggaaaacacagccccaaacagttgtcagcaaatttgtgcggtgaggtggcattactggtcaacgactcacatcaaccagctagtatgctgtcatgaacaccagggcacacgggtcacagctaggatccagtttccgttttgggctgcaaatgattcctgattctattggtaatcgattcaacaatagagaaaacataccaatctgtggcgccactccctccctnnnnnnnnnnaggggaaacacagccccaatcaggtgtcagcaaatttgggctgtgaggtggcattactggtcaacgacacacatcaaccagctagtaggctgtcatgaacaccagggcacacggatcacagctagaatccagttttcgttttgggctgcaaacgatccctgatcctactggtaatcgattcaacgatagagaaagcataccaatctgtggcgccactccctccctgctcttttcaaatgtgctgcacattgaccttgagccatgcatagggcacccccacctcagtccggacattgcttgaaacccagcttttacgttccaaagtgctgtcgagccaggcgatttggtgtgtttggttttcttttctttagacgcaatcccaaacagccaagccagcgagnnnnnnnnnnacacccacacctcagtccggacattgcttggaacacagctttgacattccaaagtgctgtcgagccaggcgattcggtgtgtttggttttcttttatttcgacgcaatcccaaacagccaagccagcgagacggatgagaactgccatggtcaggcacggtctaccattgcaatgatggggcagatttcggggaatgcatcccttctgtacccgtcacgggtcctcgataaccattcctgtgccgacgggatctgaagaggacccctgcacccatctctggctacgttcatacagatttcaggactcttgtagctctgaaaaggccagcattcgacactgaccgacaatatcaaacatactgaggctatcatgaggtctaagaaggccaatcaggcggtggcattctctatcgccggggaaactgcaggtgcttttctgttcatgcgcatgctcctgacagattacccatctgacatccgcacgcagcnnnnnnnnnnccgacactgaccgacaacatttagacatactgaggctatcttgaggtctaagaaggccaatcaggcggtggcattctccatcgccggggaactgcaggtgcttttctgtccatgcgcatgcacctggcagattacccatctgacatccgcacgcagcggcgtctccgtgcggcgccttggacaccctaccgggactcgcattccacattggacctggcgtcagatgatgttgggtgcttaggcgcctacaggatggattgcaatgcgttgtttaccttccggacggtatcattgatccatgcgagggctcgcgaacttcatgcgcccggatatggcgcagaaacaataccgaggaccaatcccgcctctctgcaagacgatgcttcagcctccatgccttggtgtgcaggattggggtgggcgttcccacggggttgagtcaaagatcgccggtctagacatacgtcagctcggattttccaaggtgcgatcaaagtctgacttcgcgatggatcccaaccatttctcgactcaattctcggaggggcctggacgtgtcatgccggaccggagggggggatcgtgcatcccgatgaagccagccatgggctgaagccaaggtagagctcaagaaaaacccacccataattataaattaccgtcctgaagaattcattggtgtccacttcctacatcaatcagtaacccggtccgccccagtctttcacccggcagccggtcccccgccatggtcaggatctccaccgtcgtcgtgctgctggcatgcgtggctgctacgcaagccagcctaggaaccaggtaggtcatgtaatgactggacacctagtttgagagcttgcgcggtgtgctgcaggttgagttacagggttcccacaggaccactcagcgagttccttcggccctccccagagcctcaccacaccctcgcatccctctcgacgagcaggaaactgaagcagtccacgggatcgagcgcatttgacgcccttgagcgtggctccgcaacctcggggaccatctctgccaccgacaagttcaccggtgggtgggagatccctgcccggccctggcccgagggtacatcctcggatgcatggctgtgtcgcgccatggcccggatgtcccactccctcccagctctacggcaggatttggggnnnnnnnnnngcgagggtacatcctcggatgcaaggctgtgttgcgccatggcccggatgtcccattccctcccagctctacggcaggatttggggtctcaaacgccgagtggctcgatccctcaccatcctcaacaccctcttgcaatacccaacgcttcccccaccccaccctcacgcacacaggcaccaccatctccacccaggcgcagggcgcccaggccgacctcggcgcggccgcctccagggccaactctgtggccaccacgggcccctacaaggccaacgccacctctgccaccgcagccagcggcttcctggcgggagccggggcgggcaccaccgccatcaccacccccttctccgccctggccgctgccctcggctacggtcgggccgtcggcaacggcaccatcaacggcaacgtggccaccaaccagcaggccgagtccaccggacccggcggctccctcgcccttgtcatccagggggccaacgccaacgtcgaagacggcctcgcccaggtcgggggcggagccaccgcgactgtggttcgccaggtcgcctccgccgagggcaccaccaatgccactaccacacccttccacaacagcaccgccctcggcagcgccgacgccgtgacggccgtggacaccgccaatggcgtccttgcctcccccagcccctcccccagcccctctcccagcccctcccccagcccctctccctcccccagcccctctccctcaattccacctccctaagtcatccgcaggatgccaagtgcctgcccttcatgccagtattgctgatccctctggatgttatccagccacagctcctcatgctgtctccccggtgaaccccaccccacacatatgtaactacgccccactcttggcaacttgttcagcatgcacaggcgggnnnnnnnnnnctccacccacagctcctcatgctgtctcaccggtgaaccccactccacacacgtgtaactacgccccactcgtggcaactggttcagcatgcacaggcgggtgcacttcttcagggcaggggattggatgcaaataggatgacacacagtcacagcagcatggcggaggtggatgatggccctcccattctacaatgcatgtttgtttagcacaatggacattggctgtacaagcacccgtcatgtccaaccgatcgtcctctcaaaggaccaccagtcaccaatccttcaggacgctggccgccgacttctctcggtggtggtactgggtgtgcagcaggcgggcggcagacccggggtctagccggggcccagccagcatgtcgctgtcccccagggcacccggggtcaggtcccctcgccaggcgtggtaaccctcctccatcgcctggatcagttgtgccggtgtctggccgggggaggggcggagctgcccgcctccgttcagacaccctttgaaggggggagggagaggcagggcgtgggtgtgatgagggatgcagcatcggcgtgggaggtgcttgagcaatcaatgcaccgctgcctggtccagtcacggcaatgtggccctctgtccagtgtaaaacctggtgcacaaccccggtgtggcagggcagtacgtcgcagagggcacagcagggagcctttggtcccatttcgcccccacgcggagctgagcccccccccgccccaccagacgggcaggccatgacctcgacgtagtcgtaggggcacttgcccaggcgcaggcgtcgcatgaggccctggatgttccggaacccgtagatggctgcagcgcggaacactgtcttgctcgccacatccagcgacgtctcctggatgtctgcatacggacaggtgtgtgcaagtagaaggagggtatggggctccaggctgggtccttgcacatcgcttgccgtggtgcagcggtgctcggttgacacatgcgctgggcagtccattccctcccattcgcaaggggaaagacattcacaaacagtgcttcagcttagaccccgtgctcacaggaacctgagcaaacaccccaccccgccctgccgcccagctcacctgggttccgcccggcctgcgtgaccagcgtgccctcttccagctctacgccatgcagctctgaggccacaccacggagcacggcttccatgtagcttcctgacccggcgtggacggcccccatccaccccgcccggccgacaagcccccgcccgggcgagcccgggcggggcacggtgtccagcccgacctcctccccgggcaggggtgagtccaggcgcaggcctcgctcctgcagcagggccgccacctccgccgtggccagcacacagtccgtctccgcgacgcgccggctggaccctgcgatggagaagggcaggaaagaagggggggaaaggagttggttgttatggcataccgtccctggtttggtgtggcctttgctcccaaaaagcacagccgtctgtctgtccagcacagcacccaaaccccctaccacaccctcaccctcaatgccgagggtgaagtcctcgcggctggcctccagctttttgtcgaagcagggcatgatggagcagtggaagacgtcctcaggcgccaccccctcccccgccgcccagctacccttgatcaggctggccgtgactgcctgcgcgctcttggtgcgggagaggaagggcaggacccaggcgccgtgcgtcttctccgcgtagcacacccagccggggcaggtggaggccagcacggggaggcgcggcgccgcactttcttctcccgcacggggcgaccgcgccgcggcgcgcagccgccccactgcctcggcggcggcgtctgccagcgctaggtcccgtgccggcgccgtgctgaagacggcgtgggcgcccagcgcgcggagcgccgcggccaggcgcgactgcgtcagcgcgggggcctggccggccgccacggccagcgacaccacggactggggggagagggatatggcgacgcgcaggtgcccccctgccctggcctcctccagcttgcccagcagctgcgccgtgctctgggcctggagcaggaccgtctcggcgctggtgatgcacccgctacaggccaggcagtcgttcagcgagatggtgaccggggagggtggtggatgggggccgagggtcgccactggcgccccggcctgtgcccctgcgtctttctgtaaagcgcccgcagtccggggccgctgcacctgcaccatgccggactgcatgcggtcatggagggcatgtcagtagatgcgggtgtgcatggctggacggtagctgaggaaggggctccatgcatgctcgaactgggatagtgggcccactcacctcatcgaggtcagacgtgagtatggcctctttcgttcctccaatgctcacgacgcagtcctgggatggatgtataaagtcgctgatgtcgctgatcttcaccgctccggaaaacattgcccagagcccgtgggggctcgcagcccggaactgtgttagcgaccgccaggcacgtcgactatatttgcgacggtagcatcgggaggtgggagannnnnnnnnnttataaagtcactgatgtcactgatcttcaccgccccggaaaacattgcccagagcccgcgggggctcgcagcccggaagttgttagcgaccgccaggcacgtcgactatgtttgcgacggtagcatcgggaggtgggagattcaagtgaagatcgagacgtggtcgtgatctactaataattcaaggaccctgggagaccaggccatgctgtatcggtcggtctggtgacctggtgcctacgatccttccggagtctggcggcttttaagctatcggcgcccaaggtggacacacatgagtaacttagaggctggnnnnnnnnnnggctgcaagcaccagacagactgcaggcattccactgaggaatcatgcaacttccacaagtcgcaccatccctcaggccacctgtgcnnnnnnnnnntgctttccctacaaacagtgcgtatctgatgaacttattgttacgcagaatacaactctgcagcgcaagggtgtagctgcaagcactagacagactgcaggcattcaactgaggaatcatgcaacttccataagtcgcaccatccctcaggccacctgtgcagcctccttcgccttcttcttcttcttgtgcttcttatccttcttggtttcgtcttgtcctgcctcgacaacatcggactttgcggccttcttcttgctggcaggggttggctccccgccgtcctccttccgtttcttcttcttgtgaagctgcacagggtcctcacttgccgcacagtattcccggtctgcagtgctgacttttcgtatggtcatgatccgtgtcacaggccgagctttgccgtctgctgaagccgggggaacgaagatgtgccgggcgctgttgttctctgcttctaggacgaatgatgcgcctgggagacatgaccaagaaacgaagggtgacacgtcaatgcaacttcctgcatgttgtgacaacgttgcagctggtatggacatgcacatcacgcccttcgatgtcagcctccacgattctgcacatggtcttttcgcacggaacttgccatcactgctggtcgttgcttccagtccctcttgccgttgttgattcaccctccacttcagctcgnnnnnnnnnngcacgattctgcacatggtctcttcgcacggaacttgccgtcactgctggtcgttgcttccaatccctcttgtcgttgttgattcaccctccacttcagctcggcatccagagagaactgcgagatggggaggattgggcgtcatgcctcttctctctgtgagaggataatcctgtgccagaggttgaatttaggctttcgtcctccctcagacaaccatccgccttacatcattgggagtctgaatcagccaaatctcttttccatggccgtcacctatcaactctgccatgtctattgtatcggtggccggagcatatgtggggtcgggctggtacctatagacagagtgggcaacggggtgcatagctgtggtgaccgaaattgcacaaacaaagccacagaccgtccatccgctatgagtcgagtactcaccctttcacgagttgcctgttttcgaccgccatgccactcgctgtcggggtgccacagagacctgtcgtgctcccaccgtgcgcacaaacacagaagccaaggaaagtcgctgacgaggtggcacccaaccagcacgctgtgggagcaggatatagaaagttttcggtcacttttgagtggtactccacagtctgcgggcgccccagagtgcatctacgttcccaccactcgtgagcggcgaagtttgcgcgccggcgcgcggacacgacgatttggtcatcgtcgcatgacgctcacatttccaactcaccagggtggctcgaagattcacatgttcgcagcattgtccagtcgtacctaatcattcttcagtttgcggcttcaagatcctggttgtggtttttctggagacaagctcccctgtgcaaggaagccaagcttgacttacctctagaaagctccgctccacaccatgaccgcgccggccgacaagctgagcgaagagatcgccgagcaggtcgacgatcgcacggggtgagtgggtgcaattgtcggttgcggggttcctgcccgcatgggtggctgtcgtgtttcctgaccctgcatggccactcttccccgccatcacccttcctgccaccactacatcgcccgctcctcaccacaatgataggatccacattacatccgggccccgaaaggaggtcgaggatgcgcccgccgacatatggtacttcgcctttggctccaatctggctgactcggtcctgcgcggtcgccgcagcatcacccccgccgagacggtgggggcccggctgccggggtaccgcctggccttcacgctgcaggccctgccctaccgcgagcccgccatggccagcgtggagcgcatccccacagaatcgcccccggcgagcaatggtgcggcgcacgccgcggacgcggccggagcccggaggcgagggcccgccggcgcggagccgtggagccagggcccagagaagggcggcgcagaggacaggcaggaggtgcacggcgcgctgtacagactgacgcaggggcagtgggactacatctgtgagacggagggggcagccggcagcaagcagagcgattacgagatcctggaggtggaggcggaggcgtacgacggccgcaggatcgaggcccgcaccctcaccacctccgagcgggcgctacggttcaggaacgtgagtgaaatggaaggtcacggggccaggaatttgtaccagaaggtggcaaggaggaggggggtccctctgagtcttgaggatggcacatgatgaatgatggctgttatgcatacaccatgcctgcccagcgcagtctccctgcttgctggacggggtacgttggtccgcagatggcacattcttcatgctgatgggttctccaannnnnnnnnnccttgccaagcgcagtctccctgcttgctgggcggggtacgtcggtccgcagatcgcacattcttcatgctgatgggttctccaactgtcggggcctcatgcagcaatctccccaccaaccgccacagggccggaagctgctgcccagcaagcgctacctcaccatcatccgcaccggtgccgctgagcggggcctgcacgccgagtacctggcctacctcgactccctgcagcactaccaggcgcgcaccctgggccagaaggtcatggggaccctcttcctcggcatcctcttctccttcttcgggctctttgcggcggtgaagctgaagcggaggatcatgggtgaggtccctggcgtcggcaagaaggatgcggggccaaggctgctgccccagctcttccacgccctcgccaaagcttcttgggcactccatgacatcctcgaaccggtcatgggttctggtgcttgttagccgcaggacgtgcgagtgattgcgtggcaggacgattggaatcggcgtcatgcctgtgcggtatttactgcagcactgcaatctgtacctacatctcagattgcccaaagcacccctctcgatctgtaccaaaggcggccagagagccttcgtcaccgtcctcttgtgaattttgtctctggtattgattggtacagttcctctaccatgattggtggtcatcacccaagctgtcatggccactgtagactttgtcacctgcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttggattcgacattaccccacacgcgttgcttccccctctggttgactgtacaccattgcacagaaagnnnnnnnnnntgtcatgcctgtgcggtatttgcctgcagcactgcaatctgtacctacatccttgatggcccaaagcacccctctcgacctgtaccaaaggcggcctgagagccttcgtcgccgtcctcttgtgaattttgtctctggtattgatcggtacacttcctctaccatgaatggtgatcatcaccccagctgtcttggccactgtagactttgtcacctgcagtgccttggacatactgccatttctcagggatgtctgctgaacttttttgtaggcccttcctctccctctctgtgcttgacccgcttacacatagcaaataggagatcaggatcacccggatctggtgcctctaaaagtagtcaggctagcttgctgtctgctcacccttcctttcaaccatttggatacgacattaccccacacgcgttgcttcccacactggttgactgtacaccattgcacagaaagtgcttccagcttctctagcagaaaatgccctaacctgcttaagcagccctttccccgctctacgctcagactatcaggcacaagtcttgaaacattaagtctgctcgaacacacaggcatcgaatggagcactgatcaggcaaattgtaaagacatcaggctgccttgctggtgttgctttgctgatccgaatcgnnnnnnnnnngttttaaagacaccaggctgcattgctggtgttgctttgctgatccgaatcgcgtctccccctgttaatccacctggggcaggatcgcccctgtgcaagccatagatacggacgcactgacaaatcttagatagttttacacaattacaccggcagcaatcctctctgtctctcccactttccggccctgacctcagcctcatcatgagcgtgcagggtcgtcctcgttcttggccgcagatattgggcctcctgggccgcaccggggtgcgaatttacgccagtgtgcgactagacacggttctcacagccctggttgcgtcgttcatgcccccgagcctcaaggcaaggctcgtgcagcaggtcctgagggtgctcctggccgagagggtggccgtgtcatggaggaggaaggcgcgccagctgcaggtgcgacaccgcctaatgaggcatgtagaggggatgtcagggcctcattgggcaaagcagattgtgagggcggtgcagccatcgtttcgggcacttcggcatggtggacgggcagtgacccgctgccgacgtcctgctcaccctcaaacttccccacattccnnnnnnnnnnccattgggcaaagcagatagtgaaggcggtgcagccatcgtttggggcactgtggcatggtggacgggcagtgaccgctgccgtcgccctgctcaccctcaaacttccccacattcctatcgtagcaatcccacctgcaccacctcccatgccccatttttcaggacgaagccgcagccagtcggccccctgcctttgcccaaccagcctcccggggcacaaacgcagggctttccaggcaagcggtggtgggccctgcctccccgagcgccgccccaccttccaatggacagtcggtggccgtgcccccacctccgcagccaaagggactcactcccctgcccgcaaagaagggaccccgcccctcgacgtctagtgcatcccagttgacgagcacnnnnnnnnnncgccgccacctccgcagccgaagggactcactcccctgcctgcaaagaagggaccccgccccttgacgtctagtgcatcccagttgacgagcacccttgcctcagggacggtacttgcatcacaagagggatgacaaggacctggcgattttgttgcttgctgttgctaaaagcttgctactttgacttttgggtgtatgagttgtccaggcgtgtggacaaagtgggtttgaaagtcgcacttcaggcagtttatgcagcaagtcgcagtcaaaacgcgatgctccaggagaagaaatgtcccagcttcacatcgccttcccgagcgcaatctacaccagttcccatgaaagctgtcaattatttccttcaggaaccatgcgtccgatcttccaggcgacagcgccagatgccctacaagtaatctaagtcacaccacaagccaacccgctctcagtcgcgggcgtttctttgaactgctcgcttgcactcatttgagagcatggctgccctcgctgctccaacccctgccctctcgcgcggctgtcagtacccacttccctgcgcacgccctctccatcctccattcagcggcatcgcggggacaagaaccctccgccctgcctcccgaggctctcgctctcgcgtaggggccgcaacgggtccccctcctcctaccccccccgcctccgactccctgatcaaggtaccatgtcctcgtgtagtccagcttctatgtttttcagatgggagtttgtgcgttttcttgaatgacaggtgtgagactccgcggccgccatccggcctgtcatgtcccaaatcatccccccctgagatcctccccccctgagatcctccctcaggcgacgggcgtgcccctggtggacgagttctgcaacctcccctccgtcagtgaggccctgatccagggcgtgcagatcctggtggtcaccaccgtggcctgcttcctggcgggcatcgtgctggccgccatatcgcgctggctgggcgaggacgaggacggcgcggcgcaccgctttcccacgctgcgcgccgcgctgcgctccgtcacccgccccgccgcccgcctgctgcccgcctggtggctcctccactccctcaccacggtctccgcgctgggccaggtggctggcagccggcgctgggccgagctcaaccgcctgacctggggcaacggcgcccccgccctggccctcctccgcttcacctcccagttcttccaggacctcacccagatggtggtcatcgtgggcgtggcctgggcggtgaccatcttcaaggaccgcgtggtgacctgggtccagggcctcatccgcggcgacccggggcaggacagcgcgctgtgccgcctcatccgccccgcgtcgacgctcctgggctggggcatctacggcgcggccgcctttgccacgctccagaactttggggtcaacatccagcccctgctggcctccgtgggagccagctctgtcatcatcggcctggcggcgcagagcaccctgaagaacttcacgggcgccataatgctggtgagggaggggttggggtggaggggtcgttgaaagagggattacgattatggagaagggtgatcataatgtggagggaagctgaagaacgtcagggctctgggaggagtggtgtgagatggctctggtgcctgcaggccggagttcacgctgggctgtgccatcctcaagccttggcctggagaaagtcacctgtttggcttgtgcacatacagctcggcccctctgtcacctgcccagctgccggatcacattgcgcccaccttcaccacacccatcccccccctcctccacctgttcaactgcagtacacctcccagcccttcactgctggggacaaggtccagctgctcactacgggtggcgggaaggtcatcgagggtgagtgccttgcatgggaatccagacatcactgctggtcgaggagccatctggcttggtacaccatagcccagcctgtggatcgtgctcaccctttccctctcttcttccccatccccatctgcacaggggtggtgcagtccatcgagccgagccggacggtgattcgggtggaggatggcagccccgtctacatcgccaatgccgacatcctcaactaccttgtcaagtgaggggttgcagatagatcatgatgtggctgttttgaggaggcccagcgtattggaagggattgaacactgtcaagtgcgccaactactctctcatttgtggacctgggaaatgcccttatgcaagatcatatgcaatgtaagatccaccctggtggcgcaaatggccgagcacctcactcnnnnnnnnnnacatatgcgatgcacgatccaccttggtggcgcaaatggccgagcacctcactctacggcgtgcgcttgccactttgcaggaatctgagccggtccaaccacccagtgtccaagggtggcgtgctggtgtgaagtggacagaattctatgtttctgaccgcgacgcatgctcagcatggacgccacactccccactcaagcttgtccctgcctttgacaacgtggtgcattgcacgttgatacgttgatatcgcctgactgtacaacatgacaatagtgtccaggacttcgtcttgacatgtattgagatgaacggagggatctgcactgcggtgtggacgcatcccgcgcgcgcagcatgggacaagaaccagttcgactgcagaagattacacgcaacnnnnnnnnnntaacgtggtgcattacacgttgatacgttgataccgcctgactgtacaacatgactagcgtccaggaattcgtcttgacatgtattgagatgaacggaggatctgcactgtagtgaggacacatcccgcgcgctcagcatggcacaagagccagttcgactgcagaagattacacgcaactcgctgcagatacaatggcggacttaaagcaaagacatatatagaaaatcctggaagtgcctcagacgatgtaggttgcatcgcgcttgcgtctcaacctcggaagcagcattctctccacacatcccctcgaggaaaggcgtcccaagcatgtcgttcgccaggacatttcatcgtcaaagaccgctgcacttcatgatagccgcgctgtaagtcttggcatgaggttactctccttatgcccgctgcactgttgcaaaccggcaatgaggaccgctgtccatcatgggactgctaactcgaggtctcgttcttgtgctgactggaaccttgcaaacatcactctgcagtgtgggtattgccagcggctactacatttttgagcagccactgcgagaggaatatctacgacaacaacgccttggccacccgcctccnnnnnnnnnnaactctccttgtgcccgctgcactgttgcaaaccggcaacgaggaccgctgtccatcatgggactgctaattcgaggtctcgttcttgtgctgactggaacnnnnnnnnnncagtccccccgccgcgacgccctcctccaccccacaatgagagatcgggaatgaacttttgcttgaagacacacgacatgttgatgcagtagtcactccctgaaaatgtaatgcaaagagcaagccctgcctatgctccctcccacacagtgttgccctgattnnnnnnnnnntatgtaatgcaaagggtaagccctgcctgtgctccctcccacacagtgttgccctgattctgaatgttacacatcgcaagcatgcatggtacaggaggaggctcacggcagcgagccccgaaacagagtgcagcaacctgcaccgcactcagggaggagcttcaggtctgcttggcagcactcgtgccaataaaaaagggaaccgcgtgcccgacggccaacctcaactccttgcggccctcaaacatagtcggctcaggcagcctccgcaaacccaaccctctcgttcccatagtcaaaaacagtgtggtagggacccaggaacacatctcccaggatccagagggggcccaggggagggggaatttccaggcccatgaaaccagagatgcactgctcctggcccatggcgccgacctggagagagaggaggaaagcggggcgcggagattgtctcgcgagttggtgcacgccaggctgtgggaccacaagcgcactttgaaaagacattaaaaatgcttcagggtttgtcgcgtcaactcaaaccaacgcatggcatcatgcttgatcttacnnnnnnnnnngagcgcactttgaaaagacgttaaaaatgcttcagggtttgtcgcgtcatctcacaccaacgcatggcatcatgcttgatcttacgatccaaatgatccaaatcattctcaagtccgaccctcgcaccttgaggatgtactgctccggagtgagcacaaactccttgccggagatggtcagcgtgatggcgggcatggtgtgcagcttggcgcagtccaccactgcggggaggaggtcgaagaaagggtgcacacggtcacggcgactactgacagggggtggtgcttgtacactgcnnnnnnnnnnatcgaagaaagggtgcacaaggttacagcgattactgacagggggtggtgcttgtacactgccgtcagagactcctggtttcacagctccagcagcaagaacatgccgctgtcccaaacaatcactctcctctcgtacaccaccagctctggacacaaaccccacgatcctggcacaaccagaaacttcttctaaacaagagcacaccccgggtcgactcacatgactccccgccgctgcccagggacagtgactcgcaggcggtgtccaggctgtccacgatctcggcggcggtctcgttgttggccagcgccacctgcgatggatgcagggagagcagtgggggccggcagtgtggacatgataaaagagtgtgcgcctggtgatgcaaagagtttactgcgcagtctgcctgccctacacacccagcacgccacttgcacgagacggtcgtgnnnnnnnnnnagcagtgtggacatgacagaagattgtgcgcctggtgatgcaaagagtttactgcgtagcctgcctgcccacacatccagcacgccacttgcacgagacggtcgtgctccagccatccttctgcttgggcccctcctgccccaaggcaggaaacaacccatccgcctcctcccacccagtaccaggctgccagcaccacccaccttggcgtactgcaccacaaactggcacatctggcaggcatcgccgttgctgggcatgccccagctcccgacagtgctcgactgcgcggcgtggccgggggcgtaggtctccagcagccggcggtaggccgccgtctggtgggcgccggcgctgcgcttgacgtcggtggccacgcctgcgaaagaggagtcgcagaggcccacggtcgcgcagacggctccggggggcatggtgttgatgatcttgatcatctcggggacgtagtcgtgcaccatctgctggcactgctgcacaagcacaggctttgcgccgatggcctgcggggaggaaagggagaaagggggggagggtgttagggacggggattgggtgatgcggtggggatcaaggttgctttacggcagccttggggaggcagatcggccctggcccgagatggagctgtcagggagccggaacttcactccatgtccccccaaccacatgccaaatcctggcacatagnnnnnnnnnnagggagcaaggttgctttacggtagccttggggaggcagatcggccccggcctgagatggagctgtaagggagccggaacttcactccatgtcctcccaaccacatgccaaatcctggcacatagagtaaacaatcaaggcaaggcccagccagccgcctcgccttgttgatgctgtcgatggctaggggggggcccaccatgagggaggtccctgtgtcagcgatggcctggcaaccgtcctcgcaagaacccttgccctgccaagggaggtggggggagggtccttggctcagagcctccagggaatccactgccggctgaggggatcacacgcaggggggcgctggcatcaccctgcaagcacccttaaagcatctcaccagggcgacgccctcgacctccagactatccagcttgaactgccagaagccgcggcgcgtgatgggcgccctgcaggtggggaacccagggggggtgggggttgaccccggagagtgtgcagcgtagcctcagcacacaattcattacataaagggtaccccgtccctgcacgcaagtggnnnnnnnnnncagcacaggcttcgcgccgatggcctgaggggaggaaagggggaaaggggggcagggtgttagggacggggattgggtgatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagggtcctttgctcagagcctccagggaatccactgcctgctgaggggatcacacgctgggggggcgctggcatcaccctgcaagcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggaacccagggggggtgggggttgaccctggagagtgtgcagcggagcctcagcacacaattcattacacaaagggtaccccgtccctgcacgcaagtggcccaacctcgcccctcaccagacgtgctcccccttgtagtggtccttattgacaccgcccagcaccagctcgccgccggcctcgccgtcctcgacctggagcgcgtggggtcaacaagggtgagtgcgacaactcgcagcgctgccattctacggtgtcctgtcaagctgcaaacggggctgcgctcgggccccagccccacactgccacaaccagcccccacacattccaagacctcagcaggccacctccgcaccttgcgattgagccagaaggagaagannnnnnnnnngtcaacaagggtgtgtgcgacaactcgcagcgctgccattctatggtgtcctgtcatgctgcaaaagggactgcgctcggaccccaaccccacacttccatggccaggccccacacattccaagacctcagcagaccacctcagcaccttgcgattgagccagaaggagaagacaggctcgtcgagcagcttctgcttcagggcttgctggaaggggggtggcaccttgttgacggcaatctcggggaaacccagtccctgtcaggaggggtacatggggtggggacggtgaaggcggcattggaaggcaaagcacagggagggaaccgagggtgaaccgctcacagcttcttgatcacaggatgagcaggctgtgacattcacattgggtgctgatctatacatggcccacaagtcaggtacatttacctgctatccagacacacaaacagcatgtcagagccacccgcctccatcaagctcccccccactatgagcccctgcaggcctcaccaggatgccatcaaactgtgccgcgatgaaagccagggcaggctcattcacggcctcggcaaagatctggtcctcgatcttgaggtcccccagggtcaaaacatcgttggaaaggaagccagtgagggcgcctgagccgtactggatggcaaagtcacgcccgtcctcctgggagagacaatgttgaggtaaggtgagagatagggctgtaatcataggatcggtgggccctgacgcagaagtgtagcctctacactgctgccagggaatcgcatgaaggcagcagtaaagtggcctgttgtatacatcctccatggtcagggctgccatcaaaacaacaccccnnnnnnnnnnaagtggccctttgtcgacatcctccgtggtcagggctgccatcaaaacaacaccccaccactcaagtaccaggtaggtggaggaggcctcagcattgtactgtgagtgcaggtagcaggcaatggagaagtagctgcacttagaggagggaatccacaggttgctgctcccagtgtcaaacacaacttggaagggctgagggggggtgcccagcccgatctcgccataatactgaagaggggtggggaggaggcaggcttttgaggccgcaatggtgactgatgggataaggggtcttcggggtcctgcttccactggaagcatggacgcatcggttgggccacgacccctctcacagccgatgcaaccatcatgttgccttccaatgctacctccaggcacactatctgtaatatcccccaactctcgttgtcacctgtgcatccatgaaatttgtgatggggaccatgccctccccgccgttgtcctgggtggtcagcagctgcgacttgttggagtggatggtctggcgaacgctatggtccatgggcagcttccgcagcctcacggtcatgggtgcggcataaatcgtgacggtgaaagacaggatggcgactgccaaaaccagcctcgtagacaccattgcggaatgggtccccagcgggacgggtcgactgatcactgcgagatatgcgggcgattcagcttggcctcgatgtcgtgaggtgttggttaaaacaataatctggtcaatttgaccagcaagatgtgctatgtgctactcgcactcgagaatctccctcggaaggtggacctcccacgtgcgctcatagcatggactcgcgagggatcacccggattcactactgaaccagatcatgcatgaatgacctaccatactcatacattttcaccatgcgcactcatgcaatgttagctcagccttcagtaggctcgcatgggaccnnnnnnnnnntatcatgcatgaatgactttccatactcatatattttcaccatgcgcactcatgcagtgtttgctcagccttcagtaggctcgcatgggaccgtgcggcctacatggagcccacgctcacagcgacttgaaatgcgaggacgaggctcgatccgagctcgcgcaggaagcagctgccaggaggggaaagcggcacgatggactcgacgcagcctgannnnnnnnnngaatgcgaggacgaggctggatccgagctcacgcaggaagcagctgccaggagggggaagcggcacgatggactcgacgcagcctgatgtacatcctacccggcatggctgggctggcagggctgccatcctttgcagcaggctttgaagggggtgatgccatctcatcggccaccctggggaaaactgcgtcaggcaccaccgaccctcagcagtacatggatgagcctgatgggtttgccattaccctgcctcctgggtggcaacagcgggtgggccagctggctggagttaacaaccgcctcagcaactctgccggcttgaagcgcgccataagttggtgagtggctggactggctgcagaggtgtttgtgaccgggaggcggaggttgctgaggcgtgtttcctggctcctctcacatccactctgtgctgcttgcatggatatattgtgtaacgatcacttcccacccctgtgcacgggcaggcaccccgatggaaacctgaacgtgaatgtctccgtgactgtgtcgccgctggcagccgacttcacctccatcacttcctttgggcggccaggtgagacctgttccctggggtagcattgcttgggaatggagatcgtgtggggaaggctgctgacggtcttgtcgggtgctgcctgtctcagatcacttccgggcacgacgggtgccatgctgtatgtcacacataaaacctttcccctgccacccgaaaagcgtgcnnnnnnnnnnagaaggctgctgactgtgttgccgggtgctgcctgtctcagatcacttccgggcacgggggatgccatgctgcatgtcacacataaaacctttcccctaccacccgaaaagcgtgcaccctgctgctcctaccacacccaccccccagaggagtttgggcaggcgctggtcaaccagatggaccgcagcttcctcacgcgcgccggcgccctgggcaggggcgccagcaggcgcgagcagaccgcccagctggtgtcggcgcgccaggccggcccgtcctacctcgtcagctacaccgtgtcccccgtcgaccttgcgccccgcgccgtgacgtccgtcgtgaccccgggcagccacaagcgccgcagtcggctgtacacgctcaacctctccgccccggcagaggagagggagcgctgggagcccgtcttctctggcgtgctccagtcgttctcggtgccccgggcctgatggttttttgtcccagggatgcgctctaatgtgtggccatgatgcgcaacgattcaacnnnnnnnnnnattttgtcccaggaacgcgctctgatgtgtggccatgatgcgcaacgattcaacccccaccaccttcttccacgtcgtcatgctggggccttgctgcgatgctgcctgcggcgtgccaggtactgacttatacgcctattctttatgatcgatgtaacaccaaaaaataggtgcactggcttggcgggcaggcccccgtctgccagtcagacgaggggcgccacagggaaatacacttggggatgtgctcaggcaagactgttcctggagatctagggagaaaatcacgtggcatgcagagcgtgacgagccttgcatgtcggggggccttcagaggcagaagtattggaggtgaaagcttggggtgacaggggnnnnnnnnnntgagcattgcatgtcgggggccttcagaggcagaagcattggaggtgaaagcttggggtgacaggggaacggcaatcctccttcctgatattgccgcagtcttgtgacgggagtgcgaacggacacaccctgatcatctatactctagagccgggccacgtcctccgcccagcctggtcagccnnnnnnnnnnccctgacattgccgcggtcttgtgacgggagtgcaaatggacacaccctgatcatctatattctagagccaggccacgtcctccgcccagcctggtcagcctggcaaccactcgggcggtagccagccggcagccccagggcggggcgggtctagcggcctaaacgcggcgtggcnnnnnnnnnnnnnnnnnnnnnnnnnnnnnnnnnnnnnnnnnnnnnnnnnnnnnnnnnnnnnnnnnnnnnnnnnnnngcggcatgttgcaggacgcttggtaccgggggtccgagggacccggcgaccccgtcccctggcgtcggcgggggcctgaccggggagggtgcccattgcgctgcgcgtcgcgccgcccgtacggcgcctgctggtgcgccgcgcgaaaggcagggcctgccgccgctgggggccgctgcgccgggggagcggcgcggtcgtccccgatgggaaagaagggaatcgccggcaccaggagcggggcggcactcgcgccagggcaccagatggggaaggggcccggggcgtgccccaccaggccacacggccccggcgccatcacgccggggtgagggtaggcccatggaatgggnnnnnnnnnnatgccagcgagtcgggcaacggagcaggggccgggctacctcgtcgcggattcggcaggggcggcggcggtgnnnnnnnnnnccccctggtgtcgacgggggcctgaccggggggggtgcccattgcgctgcgcgtcgcgctgcccgtacggcgcctgctggtgcgccgcgcnnnnnnnnnngaagaaggggatcgccggcaccaggagcggggcggcacccgcgccagggcaccagatggggaagggggccggggcgtgccccaccaagccacacggccccggccccatcaggccggggtgagggtaggcccatggaatgggnnnnnnnnnnggggtggggtggttgaatgagcctgctgtgctttccgtggtcgggcggcggtgcatctaccgtgtagtccattcccacagacaaaagggtcccatgcaagatgtggcaggtcagggcaaggcacggcgtcccccctgcgtcctcagcgnnnnnnnnnnctgctgacctccgtgcccacgaggccatgcttgggagagctgaacagctggcggggtaccggcgccctggttggggttatgggcaggggacacattgggtggggtggttgaatgagcctgctgggcttttccgtggtcgggcggcggtgcatctactgcgtagtccattcccacagacaaaaggggcccctgcaagatatggcaggtcagggcgaggcacggcgtcccccctgcgtcctcagcgtcctgccatgctgtcccccctccgagccccaacccccagcagcacaaacccactcacatgtctgagggcttgggcgtcaaggaagctttggacccaggatcggatgcggagtcgggcgtcggcccgctgtctctcgagggccctgatgcgctgggctcctccttccaggtgttctcgccctggtggctgtcctgcaccccatgtgctgctgccggggtaggcagccggggttggggctgtgtagggggggaaattgctggctgagagtctcctgggaggcaacctagggacagggaagtgtgcatgaacaagagcgggatgtcccagggcgagcgnnnnnnnnnntggcagccggggttggggctgtgtaggtgggggattgctggctgagagtctgctgggaggcaacctatggacagggaagcgtgcaggaacaagagcgggatgtcccagggcgagcgatctcatccacccatgcctgtgcaaaactgcacgagggcgtgcaagcacacgcatggagtatgagactgagactgctggccaacacgagcatggcgcccattctgtgtgtccctcgggagcgcacgaggtcgtggcccagtccccgacatggcgcaggtatccagccctccccacccacccacccactcctcaccccacccacgnnnnnnnnnnctgtgcaaaactgcatgagggcgtgcaagcacatgcatggagtatgagactgagactgctggccgacacgggcatggcgcccattccgtggtccctcaggagcgcacagggtcgtggcccagtcccagacacggcgcaggtattcagcccttcccgcccacccacccactcctcaccccacccacgcctgcagcctcaacgaggtcatagcaggtgtgcggcccatcatgctggttcagcagcgccaccagctctggcaggcgatccgctgcgtccactgacagcatgccgttgatcgtcatgacgtcccaccaggcacgtgtagccgacaggcgccacatggtggcagccatctgggggcagggaggaagcagtggtttggcggaaggggtggaaggtggacagtagactgagatgacatctgcagcatgttccgggctgaggccccaagcccttacagggtgccacaagataaaacatagcaaattggttggacagagactagggttacgacgccaagttcgtcccccagagaatcggccagtacagacctcgtcccaaatcaagcatgggctgccaacatgagccacacgcacgaaacggcaatctctgcaaggccactcccgtagaactgccactgagaatcctgatcagacagcccaactttgcggatgcatgcagactcacgtcgtgaannnnnnnnnngaaacatagcaaagtggttggacagagatcagggtcacgacgtcaagttcgtcccccagagactcggccagaaccgacctcgtcccgaatcaagcatgggctgccaacatgagccacacgcccgaaacgaccatctctgcaaggccactcccatagaactgccactgcaaatcctgatcagacagcccaaccttgcggatgcatgcagactcacgtcgtgaactgtgatggtacgccccagggaatgcagcgagctgatcagctcggcaagttcctccttgccacagtcatcagactgcagacagttggtgttgctcacggtgccggccaggacgaactgcggtgtatcctgcacttgtcgggggtcatagagacttgacggagcatgtgtgggaggagcacatgcaagtcccaaagcagcaagtctccacacattgcatgctcaaaggcagtgatacatcacatgtccatgtccaccgatagttgattgcagatgaggaagtggcgctgcacgttggtcgtcaggatacccctcaagccacccattgctnnnnnnnnnntatcacatttccatgtccaccaatagttgatcgcagatgaggaagtggcgctgcacgttggttgtcaggatacccctcaagccacccattgctcatcttcctccagtggcccaagggtacagcttctgtaaccgctccttccacactcacattgaggacgagcactatcttccctctggcatcaaacgtcacttcatccacgatgcgcaggcggtagcggccatggtccaggacacgcacaagggcgccgctcaggacctgtccaaacgcatgtggggcacctgcaagggtgagcgtgtggaccaggggtgagaggcatggtcaatattggcaaaagaactgaacaagatggtggaggccacatgctcgacaaaggcatgagtgagtactctgacaagaaaactgatgcgttgtgaagaaaggtagagaacagatacttgaagtgcgtacatcagcgaggtgtcggtacatactcaattgcattgccaatacatttctgaaaacaatgactttgttggtctggtagaagggacgcttgaccacacaaggacgcagtttcaatcggcggaatatgcgccccaaacccctcctcaacacgcagccgctccccaaccatgcccaagacctccctgtgcacagaagctcctccacgatggccaagggcaggatggcatcccgccccgcaaagatgatggagaggttgctgaccgacagtgcagcctcacacaagtggtgcttgggccctgcagcctggtctggtgtggacgcctgaccacctgatggtggtggaagttgggaccaggttatcaaagcttggcatatggcttcttgcacgagatgtagacgtcacaaggcatcagctgcttcattcttgtgtactgccaaggctggacacagaagacactgtgcaaattgggcaagatccaaactcatccgtcccacaccttgctgcaagggtgcaatgcttttgccctgcacgtccaaaagctgtgcggatggcaaggtcgtaggtgccacaggatctggcggcggcgttgctgcacgctgcacgtcctccctattgctgttgcgcgcaggttgaagggccattcaacagaaagacaacatagggcgtactggaatgcctcttccattcaatgtcgccttcttccaggccatacacctccccaacctgaatgccaacctgggcctgggtgcttcagctaacacacggcaaagccatagagcaccccagcatccccccatcccaagccacaagccttactctnnnnnnnnnnaaacctgggcctgggtgcttcagctcacacacggcacagccatagagcaccccagcacccccccatcccaagccacgagccttactctatgtgggtgttgggccgctgcatgacctcagggaacttgccatgctgaggacgagggtagagaggctggggcgctgccactacggggtcgaggtgacgaggtggcgagacagctctacgctccacagagtgtccccaccgtggctcctggcgattctgcagatcttggttgttcagggtacctatgcatgcggttggaggtgcagggatgaacgctcagtcagcagttgggtgtttaatcaacctggtcaggacagtcagtcgttgactgcatcgtgggtcaggaagacaggtgttcctgattggtgtccaagagggcttagctttgggtctccccgtcttgtgcnnnnnnnnnncaatcaacctgaccaggacagtcagtcgttgactgcgtcgtgggtcaggaagacaggtgcttctgattggtgtccaagtaggcttagctttgggtctccccgtcttgtgctcactccgtttcaaataagcaagagtcatccactcacggggcatcaggctgagacgtgagcgctgctcgtacaccgggagcctgtcagccttgctcctccactccaggttttcctggtcgtcctggtgagcaggccttctgggctgcgacatgtcgctcacgtccatgaccatgggaggcttgcgagtgttggggcagtaggcattccctgagcggtcagaggcaagatatctcgatttgggcatgggtagtcgtctctgcaaaaggtagcatggaccagatcagggtgtgtacgtgcgggaaattggtggctttctggtggatgtacgctgttcccatacaggcagcaaagcaatccccactgnnnnnnnnnncctcgatttgggcgtgggtagtcgtctctgcacaaggtagcatggaccagatcagggtgtgtgcgtgcaggagattggtggctttctggtggatgtacgctgtccccatacaggcagcaaagcaatccccactgcatggcgatggggaatggtagccatccatctagaggcgaggccatcactgagagcacaggtgcacaccctgggccatttgatcgggagcatattcgaccacccacccacccacctcctcgatctcatcatgagttggctcccccgccagggccggcttgatctccatggcctgcccacgcaagacacgtccctgtgggcggacaggtgagcggagagttggcccgctgtgttgcaaatgtacgtggacctccttgcaagaaggattcacatcgtcagacttcgtgtgcagggattgcatgctgtggaggggactacatatccaaccacactgaagacatccgtattaaatcttccagcaggcgatgnnnnnnnnnncgcagggattgcatgctgtaaaggggactacatatccaaccctactgaaggcatccgtattaaatcttccagcaggcgatgctaacccgggctcacctggagtgcactctgcgcagcatcagcctggtcttgcgtttcgaacaaggcgaagccaaaacgctgcaagagggggaaggggcgttgggagtgggttgggtgtatacatgtattgttaggacatgggcgcatggaggtgtcactnnnnnnnnnngcgctgcaaggagggggaaggggcgttgggagtgggttggttgtatatatgtatagttaggacatgggcgcatggaggtgtcactgactgtgaggatgctcttcctcatgcccctgacccccaacacccgccatgcgctctcaccctggactgtcccttcttgccgagcgccaccttggcatactggggcttgaacggtgcgaacaagggccttaggtcactgtccgtcacgcacttggccaggttgaagaggaagagcttgcaaggctgctcggctgggggcggagacacccggcgcagatggtgcccattgggacggtggtagtaggcctggaggggattgatcgggtccgaaatctcgtagggttcattaatggacgggtagatcaggcatgggtgcgcgggaagggcagctcatgacaatttccgtgcgttgttaccccaccgtacgacctcaccatgccgaggagaaacggggtcttggcacctcgtccaggatggaatggggccgatgagcaccaaattagacttcctgcgagcgtaggcccatatggagaggtatacctgagcacttcatgcgaactgatcatccaggcatgccgccagtgtgacaccgttcaggaggatgaccgaagttatccctgcctcacctgagggtcccttggctccacaccggctgaatgagcctcttgagagtggacaagacgatcttcatcgcccagtctggccttcatgaacggtgtttccgaaagttctctctttccccattgcagcaccgcgctggcgggaagatcacatggggttcccgaggcgagcagcttcccgtctgggcgctggctgcagggcagtttcctgatcgcgccacgcgcccatgaatgccacccagactgtgcgagaggtgacccacttgcccccgcgatcattcaccagcgccactgataagagatagtattggctcactcacgccatgtcnnnnnnnnnncgtgcgagaagtgccccacttgcccccgcgatcgttcaccagcgccactgataggagatagtattggctcactcacgccatgtcgacttctgggatcgcggaggctgagagcactgaaattgcccccccacccaccgagcccatcgcagacccctttgtgttcaatggcgagaccatgcccggcatgcgcgatcaggtcgtgaccgaaaccgtggagaccagggtttggaccgaggaagtgggtgcagccgaagggagccctccccggagccccgatcgtgacccgacctaccggtgcgccgtcgtcgtgggggggtggggaagtgagggcatgctgatggacccctgcctgccttgtgacagcagggttgtgttgattggattgaaaaacatgcagtgtttgcatggaaaatgagaactgaaaacacaacactaacctcgtacccacctcaacaccacggcaggaatgaccctgccacccctccnnnnnnnnnntatgcaatattttcatggaaaatgagaactgaaaacacaagactaaacctcatacccacctcaaccccacggcaggaatgaccctgccacccctccatactcggccgcctcacccggctcgcctcctcccgagtcgcagcagctcagcgacgcgggggccatcatccagggcactctgcactccgagctggagcgggtgcagctggcgcgggaggtggacgtgcgggccgcctttgccggcctgccccgcgtccactcccactggacgcaccgctacatgaagatcctagtggtgggcgaggcgggcattggcaagaccaccttcatcaagaacctgtttgccgcgtacgccagcgaccccaagttccccgtcgccgacacgcctgccaggggcgcgcgcaaggcgagtttgcagtcggtgaaagggggagcgagggggatggacggcatgtaggggtgtctggtgtgggactcggcgggcgctggattgggagcgtgagaattcagcagggcttgcggccctctacaccgggccgctgtcagcttcagagagcgannnnnnnnnnatgagactcggcgggcgctgaattgggagcgtgtgaattcagcacggcttggggccctctccaccgggccgctgtcagcttcagagagcgagagtgcgtcccccctaccccgcgcaggcgttccgggacaacccggagtcgctgtgcaccgaggtggtactgcaggatgtggagcgccgcgtgtgctaccactaccgcgtgcaggtgtgctgggcggagcgcttgtggcggattcctgtgacccgaggccgggtctggagtgacaggattgttgctgcacacccctcgacttcaaggccggcggggccctgcatgcaacccctgcgcctcgatcttgatgccacggtatcgaacgtccaccacgtaacacggccgcatgactcccttgcccccccagcacactacgtcaccctcatctcccccnnnnnnnnnntacccctcgacttcagggccggtggggccctgcatgcaaacccctgagcctcaaacttgatgccacggtatcaaacgttcgccacgtaacatggccgcacgactcccttgcccctccagcacactacgtcaccctcatctcccccctccccttcccctccaaaaaaaccatggaaaatctcaggacacgcccgcctttggcgacggcaaggacctggattcggaccaggccgcggtgctggaccacatccgcgcctgcaaccaggccttcctggatgcggagcaggaccccgggcgccgctcgccgctggcctcccaccccgacccccgcgtcgacgcctgcctctacttcttcccgccccacacctgccgcgccaacgacctggagtttgcgcgcctgctggccgccgccgtgcccctcatccccgtcctggccaaggccgacgccatgaccagcgaggagctggcggggcagcgcgcacgcgtggcccgcgcgctggcgcgccacggcgcgcagtggaccttctcgccccgcgcgctggccgaggcgggcgcgcacgacggcccgccctttgccgtggtgggcagccgcgacatggacctggcggtgggccgcttctggccggtgcggcgctacccctggggtcgcgtggaggccctgctcacgcgccacagcgacctccccgccctgcgccgcctcctcttcgaggccgcctttgaggacctcaaggagaacaccgatgcgcgctacctcgacttccgcagggaccaggccgcgccgggcatcgtcgccgtggtcacggtgtgtgtctgtgtgtttggagggggcacgaaggggcgcagggtgtggacatggtgcggatcctgtcaccatgcgcttgggcgaagggtggaggcggcttggatctcgtccttgccagcaagnnnnnnnnnngcaaaggggcgcagggtgtgaacatggtgcggatcccatcaccatgcgccgcggcgaagggtgggggcggcttggatctcgtccttgccagcaagatgcgcgggcccagggtgatgatcaggaatcctgcactgatgcgatgtgctggcaggtgtgaggcannnnnnnnnnnnnnnnnnnnnnnnnnnnnnnnnnnnnnnnnnnnnnnnnnnnnnnnnnnnnnnnnnncagacgccggtccgcggcctggtcaagctcgccgagtggggctttgcggtggcggccgtgctctggctgtcccagcaggcggggccactgctcaccgaccccaagtaccgccagcgcaagctggaggacgtgcgcgagaaggtgggcgctgcctgggtcttgatgggttccctccagccccctgtgcagccatgcagggcctcccttgcgcccacatttctgttggaccccgtgnnnnnnnnnncgcctgggtcttgatgggttccttccaggcccctgtgcagccatgcagggcctcgcttgcgcccacatttctgttggaccccgtgtgcatttggccccgtgtcctttgcgcaccgacgcccctccgatccctcctccctctcctgcaacaggtggacaccctggcgaccaacgtgcnnnnnnnnnncggccccgtgtcctttgcgcactgacgcccctccaatccctcctccccctcccgtaacaggtggacaccctggcgaccaacgtgcgcgagacggccgacgaggtgcgcgccaagtccgccaacgcggtggggaccgccaaggaagccgcacagaacttgacgtccacgacgcgggacgcggcgcaccgcgccaaccgggtgctggagaagaacgtgacgtccagggagaggtgggactcgggcatgggtgctgcgcggtggtgtcattggaccgggacaggcgggcatcggccctgccccggccgcaccatgcctggtcagttcacctgcgggacagacttcgcaggaggtcttgcaaggagacccacgtcagcatgccgacacctccccacacccatgcctcactggatcgagcatcacacatccccatcccatccacgcatcccatccaggcgtatggagcaggagcggcgcctgcgatacgagnnnnnnnnnntatgggtgctgcacagtggtgccgtcggactggggcagtcgggcgtcgggcctgcctcggccgcaccatgcctggtcagttcacctgcgggacagacttcgcaggaggtcttgcggggagacccacgtcagcatgccgacagctccacacacccatgcctcactggattgagcatcacatatccccatcccatccacgcgtcccatccaggcgcatggagcaggagcggcgcctgcgatacgagagcaggcccttctggcgcttctggggagagtaggggcagatatgccatgtggccccccgcgccgtctgcctttcgcacgatcacggtggggatgcgtcgctcctcgaaaggctgccgacgctcgatgctgtccccaacatccccaactgaccccgctctgtgtaccccgttggcatgtggtgctgtgttctccccacaccacactgatcactttgacatgtattgatcccactgcatcgcagcacgtgggtggggatcgcgggactgcacactggggtgcagctggtcacgacgctcaccctcgccgnnnnnnnnnnagtgggtggggatcgcgggactgcacaccaggatgcagctggtcacgacgctcaccctcgccgagcacttggcgccctgggcagcctcagtctcaccaccccaaactccagggctccattcgagctgcccaggaaagctgcaccggggcgggcctcctccgggaggatgctgcattgcgtgggcggcgctgccgccccgtcctgctccttgcccgtcaaaggcgcccctccgacaccattcccgatgcccgccccgaaatcggactccattccacgtccgagcctctccatcctgtacaggtcagccaccctccgcgccgccatcacgccctcctccccaccgctggccaggacgcagacggtgccgccgctgcccccgcccgtgatcttggcgccgtgcagcacctggcgctgccccctgcgcgccacgcgccgccgctcctcccgcaccagctccacgagccggtccgtgccggggctgcccaggccgcaggcgccgtagctggcgtggctggccagcatcagctcccccagccgctccagccggtcctcggtgggctccgccgccagcaggcgcgcaaactcgcacaccctgccgtgctcgcgcacggcgtgctcggcgggcatgcgcacggcgtaggtctcgagggggtccacctccgtcacgtcgtccagatgctcgccgtgggcgcgcaggaactccgcgccgctcagctctgccgggcagagcgcgcccagcccggcgtcccacgcctcggggctcacctgcgccaggcaccggggctgcggcagcccccggccctcgcacgcctgctgcaccagcttgagccccatgaaggcgcccgtgcgcacggcgccgtagtcggagccgctcacgctgtgccgctcccctgcgcaggggaggggggagggtccaggatggaatggagtgccacgcaaagcccgagaggccacgcctggccagccagtgcgaactgcgccatgccgggtccaaggtcagcgaggcagagcagatgccgacccggctcccaaacgcaccctgggcctgccctgccctgccacctcaatgtcggccagcacccatcacacacccagcactcccccatccccaccatccccacccgagctgatgccaatgaggctgacgtgttccgggacctccacggtgccctggaactggcagggctggcacagcagagccatgagggcgccctctctccccagcgccgaggccatctggtccatgacgccacagggcgcgcccaccacccggttctccgcgcgctggcacgccagcgccagcgccgcgccgtcgctggccaggcgtgtggcaccgaaggccgcggccagcgcggacatggccgccacctccaccgccgccgagctactcacgccccgaccctccggcacgtcggactcgatgagcacggccagcccggcaccgccggccagcgggctggactcgggggcctcgtgcgccagcaccagcaccacccccaccacgtaggctgcccaggaggtggcggggtcgcgtgtcaggagagcgcgggccgcctgcaggtccagcggctgctccgtcgtgccctgtgagggagggttgggccccggggggcagcagtgtaagcggcctggaggtgattgcgggggtgctctgtgccgaggctgtcccagcctggctgtgatcgaaccagagtgcagcctctcagcccctactcccctgagaccctcactcacacagtcgcctgcccgctcaccaacaggcgcatgggcnnnnnnnnnncgcagcctctcagtccccactcccctgaggccttcgctcacacatttgcctgcccgctcaccaacaggcgcatgggcatctcgaagcggcacgcccgctgcccgtccctggcgcccaggctgacgatgcgcagcatgggctcgccctcccccggcgcggatgcctgccgctgcagtgcgacatggcaggcctggcgcaggggaagctgcagcaccagggacccactgtagtcggcgatgccccccatcacatccaggcgccccggcgctcttgacacatagatgtcgcccccctgcatgaggttgccacatgaagggagtgctcgtccgccccacaccaggggtcgacggcgcgggcgcacaggcagctgagctcagtgtcacgtcctcgtgactcagcactcgtggtggcaggcggcttgacacgcacagcccttctgtccccggtgactgccaggcggtgtggtgcaactcagcaccatcagcatgcctcgggcccaaatatcgcagcacctgcacaccagactcgtcccatgctccatcttgcaatgaccttgcagttcagcctcaagcttcctcgacccaggagagaacacgccgccagatcaccttccagtcgaagagctgctctgcagcctcaagctcgagcggtgcaagatgtttgtcgttccactcatcaacccctccgttcaatcgagagtgagcacgttcggccagggagcgaagaaggaggatgaacgttcgagtaccagagattctggacatcttgtcttctgcatgaggcatgggagggatgtgcctggggtggtcaagtcatgaggaggggctacacattgcacaacaccgagaccaggacataagtcattgccatttccgcccaaaacgataatgccgctctgcagcaccttgcctgcaannnnnnnnnnccctaaatgtcaaaggggcgcatacttgtcactgcatgagactggaaatgacatcttctaatcgtgagccgtgccagagacgagaccgtttggtacagtgagtgccctcccgttcgtagagaacagatatgccgcggcgcgcatttcgcgattgaagccaaccaatttgttttgtttggatctgtaacaccatggccaacatgaaatggccattctccattgactttgactgtggtgagaagggtggaatggctggggggggcaaggagttcaaattcagtggcctggtgtcatccgggccgatgannnnnnnnnnagcacaacaccaagacctggatgcaagtcattgccatttccgcccaaaacgttaatgccgctctgcagcaccttgcctgcaaccccagttgggactgcatggccaatgtatgacagttcctgggcatcctggtcatctacttcatcggcccggatgacaccaggccactgactttgaactccttgggccccccagcctttccaaccttctcaccacagtcaaagtccatggagaatggccatttcaagttggccatggcgttacagatccaaacaaaacaaattggttggcgtcaatcgcgaaatgtgcgccgctgcatatctgttctctacgaacggaagggcactcactgtaccaaacggtctcgtctctggcacggctcacgattagaagatggcattgccaggctcatgcagtgaaaagcatgcgctcctttgacttttaggcccccgctaggctatgtccacctgtctcgctccggctcggcaccccatcaatcccatgctgcgcatgctcggcacagtcaaacttggcctcggcccaagtacccgcggaatcaataccatgtcttgttgggcagccctacagagtttatccgtggaccactgagctgttgttgaaaccttcttgtaggcggcattgcgagnnnnnnnnnnnnnnnnnnnnnnnnntcacgccgaagtgttccgtcccacactgtttctgagtccattcaccatcttgaacctttagcactagctcgtgaacaatcatgcagtctgtgatccaggctgccgtagagcagcaggtgctgcgagcagcagaagagatggagacagcactagacgcgcagcttcatgccatggacaacctagatcccgatgatnnnnnnnnnnccatgcagtctgtgatccaggctgccatagagcagcaggtgctgcgtgcagcagaggagatggagacagcgctagacgcgcagctccatgccatggacaacctagatcccgatgatattgaggctcttcgccaacgccgcgtacaagaaatgaaaaggtgcgctgtttgaatgcttgagtgcgggattggacacatgcatcgtgcgtctggcaagacgacgcccaggaatcatgcaatggcggtcttacatccaagtataaggcagctcggtcccatcagagcgcgcggtgtccatctcgtgctcaaagtggcatatgatgctnnnnnnnnnnacatggaatggcggtctttcatccaagtacaaggcagcttggtcccatcagagcgcgcggtgtgcatctcgtgctcaaagtggcatatgatgctgggtatcctgccacttcgctatgttgtgctccccacaggcttcaacaaaggaaggcagagtgggctgcacggggccatggagaggtgcaggaagtggaggagaaggagtttttcaaggtgaggaaggtccagagtatgatcagggactactgctgcattctgactgagcttcattgccagcatggcggctttctcctgctcatgagcgacttgaaggctgcggcctccgtgcttgctcagggggnnnnnnnnnncgactgagcttccttgccagcatggcggctgtctcctgctcatgagcgtcttggaggctgcggcctccgtgcttgctcagggggatgagtcacggctttgccgcacttgtgctgcacaggctgtgcacctcaggtcctttttgctgtgacccctgcagtgtgccaggggagaggagaggctggtggcgcatttctacaggtcctcggagccctgccgggtgatggacatgcacctggcacggctggcaccctcccacatggagaccaagtttgtcagggttgcagccgagaaagcacctttcctgacaggtgagggtgtgtagtgatggatggggagtgtggagatggagttcatgccctggagtttgattcgagtgagggctcgccatcgtggattgtcaaggcacatgctgcctggtcatccagcgagcatgcccgccaaccccattgatgccgttgaagcctgtctgggagtccttctgcatatttttcaagggttattgtttccatcctggctaccgtccataagaagccagcatgcccacatcatgctcacaccctcttgcagatcggttgaagatatggatgttgcccaccctggccattgtcaagtcgggcaaagccaccgactatgtcgtcggcttcaacgagctgggaggaagcgacgacttccccaccagtgcactggaggccaggtgcgcgtgcctgccttcttctgcacacgacaggcctcgtccgccgtgcggtgtctttgcgggggttcaagtgcccagctgggtccactccagatctgcgaccctttctagaagccgttacttaacaccctccctcctgcacgcctcgaaacacacagactggcagctgcgggggcgatctcagaggatgtgcatcacaacaaggcagcgggcgtgcagcgggaaggcacggaacgcactgtcaggcggggcgggcgacaacgcaccgactcggacgaggactcggactttgactgacgcagttcgtcgagccctcctcagtggcccaccttgcctctctgtgtcactattgtctcgcttgtatgttcccagcacctgcctcacctaccccgatgcacaataccctgtacatctgactccctaaatctgtcaaacacctcgagattgggttgtgagctggagtcacaatgcaatatccggccagcatcccgaactggacacactcagccggagaagaacagggcgagggcatnnnnnnnnnncatgcaatatccagccagcatcccgagctggacaccctcagccggagaagaacagggcgagggcatttgcatgcacctgggctgccagggcgccagcctccatcccgcgtgcccccgccactgcctccaggacctgacgaaggttggcgggctcgttcctcgacttgatcgctgcgtctgggtcccacttcttcttgtccctgacctggagcctggtctggacgtgaacatgtgctggggaacaagaggggtagcgaggggctgctgggtgctggacaggggcatgaggcgttacaggccatccttgtcgcatccctgggcggtatgggttcctccagaggcagcgaggccctcatcacacgagctcgcgtcctacccaggctggcgggatgacagtgcgtggcactcccacaccccgcccagccacnnnnnnnnnntgccaccgcgacattctccgctgcacattgggtgcggagtgagcggctgattggatgctcatgggagaacagtgccggctgctgaacctccnnnnnnnnnntgtcctacacaggctggcgggacgacagcgcgtggcactcccacaccccgcccagccacacagcctaccagcatggctcggccggatctcgcaccagggggcatccgtttcgagcaggatccggtccagcgggagggcagccgccaccgcgacattctccgctgcatcttgggtgcggagtgaacggctgactggatgctcgtgggagaacagtgccggctgctgaacctccagaaccctgtgtttccccaggctggaagactctctgtaggaatctaggaacctatagtccgcttcccaagaccatgtatgccccactcccacggccctgcaaccatgcccccacacccagcctcaggcacttgcctgtcttcaggctgcacccgttaagtcctatgaagaggcccgggtaggacagcactttgtgggcctcctccagcgtcccatcgaaagagtgcaccacgccccgcagagcacccgctgcaacaggtgacgaggagcgttgaagtaaagctccttgtgagccaccgccacccctcctgaccttacccggcagctgcttcacagacacccatccccttgtccagaccctcgatagcatggccatttgtccctgaggagacagcgctgccatccctcccccccccaaagcccccttctccccatttccccagcccaccacctggctgcctggcgagggtgtcgaggaaagcaggtgcggcggcccgcaggtgcaggaacatgggcagctggacctcggcggccaggcggaagtgggcctcgaaccagcgttgctgcgtgaccatgtcgcagaactgcagcctgtgtggtgaaagannnnnnnnnnaggccaggcggaagtgggcctcgaaccagtgctgctgcgtgaccatatcgcagaactgcagcctgtgtggtgaaagagggggcggggaggcgggtagaagccatcgctcgctgcaggcctgcgctgcaccatgcaaaagcgacccacctgtgcctgacacacagggttagcatgtgcacccgcagcactcacctgtcaccgtcgagaccacactcccccaccgccacggtcttcccctccctctttccctcctccagcacgccccgcagtgcctcccagtaggcggcggcgccctcagggacagcctcaatctccccgcagcgagtggggtgcacgcctgccgtgcagtatagccgggctgcgatgtgagggacaaggaaggggcgtgctggctggcgtgacgcatggcgcgggtacaagaccgcagctgccaacctcaggagggtatttggccagactgagtagctaagaagccttcctgcacgcatccaccctcataaggatgcggccagtcatctaggcggtgagtacagcgggggcgcaccatctgtgcgtgccagggccagtgctaccctgctttcctccagattggtggcagtgatcacaatccgtgttaggcctggtggttgagacaatgatgatgggcactgttgtgtatcatggaaagtgtaccagaaacctcatgatggcagaggagctgcaggtgcggcagaagtcctccaccactgcgctgtccttgtcttcacatctcctggcatcccagcagagcgcccggcccaaactacccagtacagtctcgacccgatcgcagcccctgaatgagaccctcttcccacctccaggatgacacacctgcactccaggccctctgcaagacgcggtccaggtcaggtgggtggacgccagtcttgccgtggtagctccccatgaacatggggtccgtgaggttggcgccgatatctgagggtcaaaggcatgcataccagtgacgtgtctcggtggtggtggtgcaacgcaaggaagagcgcacccgcgtccagcataccgatcaggttggccgcgagcttttgtgcgggcggcatggtcacagctcgaacgaccacacggcgtccgacgcttggtttgtttgggatactagcgtactcaaggcgacgagctgaaccaaggacaccgcgcaacattcacagtgcgcttgggctctatgctgagttgacagtcttgggagccttaacactgcgtcgcatgttctggggatgagacttccatccaggacgcgatatagcgctaatgccagcgtatgcatcacccgagtatcaattgctgctttgaagccgtttaccggatgtctcccggcaatcgaggatcgccctagtccatcagcttggcaaagggctccagaggggtgacggagcggggaagcacacgcatgctcttgatgagtctttttagtgctgnnnnnnnnnnagggagccttaacactgcgtcgcatgtctgggggatgagacttccatccagtacgcgatataacgctaatgccagcgtatgcatcacccgagtatcaatcgctgctttgaagccatttatcggatgtctcccggcaattgaggatcgccctagtccatcagcttcgcacagggctctagaggggtgacggagcggggagcacaggcatgctcttgatgagtctttttagtgctggccttgcttgcctcagcaggtagtgggcgctttctcaagtatactagaatctccatcagtctcctgcatctcgcggtcgcaaggcctcggggccagttcatggcaacccaggtcacttactcagcaaaccggaccagcagttcagtctcgctgaggctgttccacactcaggtctctctcgaacggtaggagacttcannnnnnnnnncactcagcgaaccggaccagcagttcagtctcggtgaggctgttccacacccaggtctctctcgaacggtaggagacttcatgggctgcatgaatcttcaagaggtctcgtcatggtacttccgtgggtgtggcctgcactacagccactgtaaaccggacacgtgcagaaagcacaccggaacaaccggagcggtttacctaggcacggcctatggggtcatttggttgcacatgcaacgtcccggcgatcttctatggccggaaggtggccatattcgaagccttgctgttcgaatcgctgtgtcttcgcnnnnnnnnnngatggtacttccgagggtgcggcttgcaatacagctgctgtgaaccggacacgtgcagaaagcgcaccggggcaaccggagcgattcacctaggcacggcctatggggtcatttggttgcacatgcaacgtcccggtggtcttcaatggctggaaggtgaccatattcgaggccttgctgttcgaatcgctgtgtcttcgctcgctgcactcacagctctgcctgcagaatggcgccatccaccttcccgcgcatatgtggcaggcatttgattttgaaactccggacggagtttgtcacagagtaaatcaagggaatctacagaagccgctccccagagcacatcaggtattgcatacctgggcagagaatcctatatttcatctgacacgtcgatgatcgtctaagaacagcnnnnnnnnnnacaggcctttgattttgaaactccggacggagtttatcacagagtaaatcaagggagtctacagaagccgctccccagagcacatcagttattgcatacctgggcacagagtcctatatttcagctgacacgtcgatgatcgtctaagaacagcnnnnnnnnnntagggcatccccatctcgagaactccgccaggccaccaccctccttacccaactcaatcgacttcgatcggcactttggcaacgtagttgaagtgtgaggctctgtgcgtccctgnnnnnnnnnnggtgtcaacgtttcacgatgcccatctgttgagcagaaattgatcgaggtcggctatcgcatttccatctcgagaactcaaccaggccacccccctccttgcccaactcaattgatttcgatcggcactttggcaacgcagttgaagtgtgaggctctgtgcgtccctgcacgctgcctgtgggggccatggctttccgggcgacagagcatcttcccgacgcgagcgggcagtctgggtgcgacgacctccggtacgcggggggtgcagggaggtggcaggcgatgccactgctgcgcacaatatagatttctggacatgtattgcagccacagccatccagactgcatgcannnnnnnnnntcacactagatatttctggacatgtcttgcagccacagccatccagactgcatgcatgatggggttcctgcatcggactccatgggttgcctcgttcgcggtcgacgtggacccctcccaccctatgtgcccctgcccacaatccagggacggtatgtcaacacctacaagaaagtcttcattcaagagattgcgcgannnnnnnnnnaggttgcctcgttcgcggtcgacgtcgacccctcccaccccacgcgcccctgcccacaatccagggacgggatgtcaacacctataagaaagtcttcattcaagagattgcgcgaggcgtatgcagaatcccccacatccccatgcaccccgccgtgccaggacgccatcggcgttcctgcctgggaccggcccctgcctccggatgcagacccgagccagtgccccgccatcctcgactccgccacctccctcatccgagccgccagccagtcccccctcatcttatcagcccttggcgctctgaacaggaggggcgccagcctcagcgaggacagctggggcggcacccacaccagcctggccgtggtgctcgccctggctcgccgggctgggtgtgaaggtggggctggttggatgtgtgtcgcgggaagatggactgtttgggatcgagagatcgaaggcgtgtgcctcgccgcgtgcatcccgcctgggccagggccgggccgaaggctgcccctctccctgacgatctccccggcgtctcctctgctcctcatgctcccagccatggaatgcttcagccctgtcaccgccggggattatggagctgtgccaccgtattgctgccctgttgccttcactcatgatgcactggggccgctgctttgagttccttgaacacgcagggccgaatgccccccctgttccgactgccgcatgcnnnnnnnnnnggacttcctcgaacacacaaggccaaatgccccccctgttccgactgccgcatgcattccccctttccagccgagcagctgaagcgggaggacctgctgctcaccctcctctggatcgccgactcctggatggatgcgcaccgctcctccgccaccaccgccctgctggagtacctggcgcccctgtcccatgcacagcctcaggtgagcgaggggtgcacccgggccgactccttctgcccctcacgggaacgcgtgacgcgcgcccccccttggcgactgtgcatgcaccgccaccccccccnnnnnnnnnngccacgcgcagccccaggtgagggaggggtgcactcaggccgactccttctgcccctcacaggcacgcgcgacacgcgcccccctggcgactgtgcatgcgccgcaccccctccgcctccccctcgccagcaccagctgcagcatgtgcgacgcccgcccgccgccccgcgcccgacgcaggtggcctcccggctggcagacatcgtgcccaccctggtgcggagcatggtcggcctgcaggccgtgctgctgccgcgcctgggctggcgcctgcgcctgcacccggacgccgacctgggacgggccgcggccgcgctctcggccgtgcgatgcgcaaaccccggcgggggcggggggcgggtgcgggccatgcccctcctcgcggccagggtgcagctcggggcccctgccgagcgccaagcggggtgagcgcatgggggcctggccagcgggcacggacccgcgccgagcccatgcagcgtgcggagcagacggcaccaggctgccgcggcccggtgtcccatcccctcggcgctcggctgcgcgcagctcccggtcccctcgccccgcatccctgtgggtggggtgggtgggaccggggtcccctgcgccgctcccagccagtccctgagtttctggcgagccgtcccttggccacaccagcagctgtgtgaccagccgcgtcgtcctcccgaggacgtcgcgcgacgggcatgcacccttcccannnnnnnnnnttggccagccgtcccttggccacaccagcagcagtgtgaccaggcgcgtcgtcctcccgagcacgtcgcgcgacgggcatgcacccttcccacgccggcccttgccaccgacaccaccaaaccactggaacacaatcctctcggcggcacctgcacagcacnnnnnnnnnnaccggcccctgccaccgacacaaccaaaccactggaatacaatcctctcggcggcacctgcacagcacgggtccgccatctgccgatgagttgcctttttacaagtcctatccagccccggagaacttttgctggacagcggcatgcatgccgagcgctccccggccaccacctgtccccactgctgtgttcgggcgggagaccatgcttgctgcgggagtgcaccagcccttgcgcatcctctgtccgcatgtgttgacactgcctccctgttctcgcactgcgtagatgaatcacttgtagtctgtctagtggggactggggctccagagagtgcgagaattcagtacatgacgttgatgagcgccgcatgcagttcgagtgttggggcgnnnnnnnnnnggttcgggcgggagaccatgcttactacggggtgcaccagcccttgcgcatcctctgtccgcatgtgttgacactgcctccctgttctcgtactgcgtagatcaatcacttgtagtctgtctagcggggactggggctctagagagtgtgagggttcagtacatgacattgataagcgccgcatgcagttcgagtgttggggcgctcgcctgcgctgagtgcctgcaggtggtgctcatgtcacgaccactgtgtgcataaggtcagtgcaaagctcagacactatccccttcagtcttcttgcacaaacaagtcctccgagcctaggagctgtatcatcaggcttacagtatcatnnnnnnnnnntcgaggactgtgtgcataaggtcatgtgcaaagctcagacattatcctcttcagctttcttgcacaaacaagtcctccgagcctgggagctgtatcatcaggcttacagtatcatgcaacgcatggaagcggagtgctacgcagtgcatagttttcagaacagaaaggggagtggggtggatggcagtggtcggccggcgcctgggttctgagcacacggtacacaccaccagatggtcagagggggcaatgtctgttgtgtcatgcatgcatgcaatgagccgacacgattggcgatggagggacagtgggcggaggcgacccaggaacgtggtcttgaggacggactctctgaaaggggttacagcctccaccaccttgccagaagccagtcccgcctcagccaggtcagcgcgtcgccgctcaccagaactgccaccagggcttgctctggaggtcgtgcttgatggcgtcgcccttgtactggcgccgtccctcactgccgtccctctccagcttgctccccgcatccttgnnnnnnnnnntaggggccacagcctccaccaccttcccagaaaccagtcccgcctcagccaggtcaccgggtcgccgttcaccagaactgccaccagggcttgctctggaggtcatgcttgatggcgtcacccttgtactgacgccgtccctcactgccatccctctccagcttgctccccgcatccttgagcgcgcgcccggtagtctcctcggccccgctggcggcggcgcccagcttgctcccggccttggccacagtgtgctcggcccggagtgccgcctgcttggaggcctcggccaggtcggcggccttgtccgccacgtaggagccagcattggaggcgccgtccttggcctgccccgccttgtccttggccgcggccttggtgtcctgccacttgtccttggcggtggccttggtgtcctgccacttgcccttggcgtcctcgcctgcgccgccggcctcgcgcttcagcccgaaccaaccgcgcttggcggaattcttggcatcgcgcgcggcgtcgccagcctggcgacccttcttcctgccccagaggccgacggagccctcctcctcctcggccttgttcagggcgccggcacccagggccacgacggcggcggcgatcagccagggcgcggcgcgggcgagcagatccttccactcctccctgttgttggggacgctgccatcgccgcctgtggtacattcaaaaaggaatttaggcctgagtgagcggcgtgggagcaccctggcctggtcagatcccttccacgccggaggagtaccctatccacccaatcgagatggaacgccagattgccccatcgagcacccctgggacaagcacgccattcagatccacctcgcgctcacttgggcggggcggggccggcacggtgggctcgagtttggtggtcttcaccacctccgcgcgccgcacggtctccttgacgtcatgagtgccggaagtgccgtaggaagccatagcgatgcgtctccctggcgtgcgagggggtccaaaaggtgtggatttgggtggattaagtaagccttcagcagtacgatggcgaagtaggctcgcgggtgtgtattttgatggggcaacggacacggggataaaggggcgatcccgtgcacgaagggagcagctagctggtacccggaatctgtcccgcaccttcccctcagcttccggtattgaactttaaccttgttgccttggcatctgagtggttcacctgcctgttgacatcgctgcgatgcttcctgtcgcatgtacagtatgctgagcaagaaaacattgtccagcccatatgtagagcagaagtacactgttggaacctcacttcacagccacagcannnnnnnnnntggagcagctagctggtacccggaacctatgctgcaccttcccctcagcttccggtattgacctttaaccttgttgccttggcatctggatggttcacctgcctgttgacatcgatgcgatgcttcctgtcgcatgtacagtatgctgagcaaggaaaatttgtccagcccatatgtagagcaaaaataagctgttggaacctcacttcacagccacagcattggcccctgcgcctagatcagtacttctctctcctgtcgacctggctcgtgcctcctgcacccagacgccaatccagtgctcctcctgagccctcgcctgcttcaccgactcggggtctagggggtgcgagaacctgtggcagtgattgggggatgaaagaaggcgggctgcttgacagaaggagtcgtagatccatgctcgattcagacgtgcacagatgtgattcgtatgcaggggctacatgtccagcatctcgatctgtgcaggcgtgtcctttctcggacgaattaaggccccacaccgtacatgaggtcgaggtggtgggctccctctgggatgatgatggccaccaaggtctccgacaggttccgaagcacgccgccagagctccctgacggggaggcacagggacagggtttagagctcaggaattgccatggctacaaagcaactggtcagtacgggaagatgcatgtgagcccctggctgatgcaccctctccgtggcctgacgatcgcagccgcttattaccacagcgagccttacatggatcgtagagcccattgctgaacacgatgttgctagcagcctccaagcgtctgcctccccacctggccggatggatggtgcaggggatgcgtttcgaatctttgccaggtggggctcgtggcgattggaaacgtagtgggcgtcnnnnnnnnnnnnnnnnnnnnnnnnnnnnnnnnnnnnnnnnnnnnnnnactcgatgctgggccagtaggcacgtggggtcaccccccacgtcttctggcatctcttcacctccttccttcggtcaaagggctgtgcatacgatgtgcgaggggtcagacatccacatacttcgaggtgcccttccactcgccggcgaactgaatattatggggcttccnnnnnnnnnntcctcggacactttcccaatacaaatccggattccaaaacaggcacaatcggcgaccagacatcaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcggtcaaagggctgtgcgtacaatgtgcgaggggggggttcagacatacacatacttcgaggtgcccttccacacgccggcgaactgaatattatggggcttcccatgtcgcacatcggtcgagccaagcccgcctgcacctttccacgctgtggccgctggtgcatccccccacatcgccccatacctgtggccagaacatgtcattctcgccatcccggctgaagggcatgaactgctcggtgcatgcctggtagccccagaggtcctccacctcgtcctcctcaggattggctcccttttattgtggggtccagggagagtggtggactgctgagccgagggggagggcgagcccatcacagtgttggctgggagcacagatgctggctgcaggcatcattgcaaaaggtccgctccccaaccaatcccacccaacacagcccacctgttcccagtcgaagcacggcaggttgccagagtggttgtagaacacgccggatgcaagacccaggcccctcaacagcgcctgggggtctttgggcagctgtggatccgccaggtgctgacaggccacccgcacggggtacgcaggaagctcgccgtcgccgttcagcatgtatccgctggggtaggggtctgcgcggcatgcgtgcagttggggtggcaccatacgagtgagcgggtgagcagaggcaccccggaacaggggtcccacaccgcgccatcggaccccacaactcaatcatcagatcccaggcgttaaaaacaaggtgccctgcccttgccctttctctgcggtgcagcgccgcagcagtgcctgtccccgcgtctctcgctgcactgggcaatccccgtcacagaccacttcactcacagttgcccatggccaggtagtcccaggccccctggagccactcggccagcgcctccacgtcggcgctggtccgcggggctgcccggctgcagaggccgagggcctgcgacagcttgtgcctccccgcctccgaatcccccagcttgaaaagcagcttccacccagcctgcacgcccagggcgtttggcatatggcactcagttgggtgccaaggcatgaggctcagtccagaaggaccctggcatccccgccctcacccttgcgttggcgacacaggccggcgcagacccgccctcctcgctggcgtctcgcgtgaccacggcggcaaaaccaccggcgtcgtacgcaggatcctcccccagaaacctgggcttggaggttgggggttgtttggtggaacgcgaggggtctcaggcccagaccccgacacccagtctagctgttcatggcagcgctcgagtacagggaagaagacgctgccatgccacgacccggagggccgtggtctctagtttccaagccactggcactggtaggttgagccagcaaccagcaatacacggaaggacccctcctcctatcccattctctcacgtccagatgggggctgatccggcannnnnnnnnngcgctgccatgccacgacccggagggacgtggtcgctggtttccaagccactggcacaggtaggatgagccagcaaccagcaatacacataaagacccctcctcctataccattgtctcacgtccagatgggggctgatccggcaatggccccgtccaggaggtgcggatatttcatgcggaaccaggccgcaagcatgccgccgtaggaccccccaaatcccacgacgggggcgtccacatcgcccagctcggtcctcagttcccagatcagctccgcatagtcggccatggcctgctcggttgtcagccagtgcatgctgtgccgcgtcctcttcttgaagggcttgctctcgccatagtaccggtgctctgcaaacaccagcagtgccgagtgcttggggcccagctcccacatcagacctggtgtgttttgggcaggggtgttgggataggggcatgtgggagggggaaaaggttggggtagggatttcagcgacctaagtttggtgaggacaacaggcaaacagtgaggagggcccatgcctgcatcccggccttcaatggccagcttttaggagccagactgtaacaaaacccatctcggaaccacttcagcctccccatctcctacaaaaacctcaagcagtaccagaattattaaggtagagcgtcacatccgcctcannnnnnnnnntggaaccatttcagcctccccatctcctacaaaaaactcaagcagtaccagagttattaaggtagagcgtcacatccgcctcattccccaggtaaaagaagattgggcctccaggcttgtagtgctccgagcagacatagtaccgctggtcaaacttggtgggggtggcctacgggtggagggtgggcactgacaggtgaggtcaagagggtcgtatgtggcccgggtgaggtcgcagggaatccaaatcgagatcaaggccccacgaggaagggaccaaacttggtgggcaagtgaggctgtgcatcccccatgacggtgcttcaagccctcgacactcacccagctgaagtgatccagatgggtggaccgggagcgcctcttacaatgtgagatgagatccttgctccgtgaggagccatacgagaactttgaactgctgcgaccaatatacggacctgtcggtggctggtaagaggccacgggagtggtgcatagtgcacacaagcatatcaagagggtcgtccgcaccccccacattcttataggggcagacattcagcgtccaacagtgtcggattttcaatcaagctgtgtgttatgcagatcagagggcaatgccgatggcctgcacaatcaaattagatgggcgtgccgggttgcggtgctgaccattgtctctcggaggcttgcgtggcaagtctgtaaaattcggtcccaccagcacaatttccaaacccgcaacttgagcagcttcacccccctctttacatcagctgggatcgatgcaaggctctctcaggatatagggctgcaagtatcgctcctacagaagggcacagctctgggcatgggagtgaccgtcataccatggtgacaaaaggccggagatgatgatactccaccaggacctcaccaagtgagcatggaaacctctttgcgatcagtgtgnnnnnnnnnntctgggatcgatgcaaggctctctcaaggacatagggctgcgaatatcgctcctacagaagggcacagccctgggcatgggagtgaccgtcataccatggcaacaaaaggccggaggtgatgatactctaccaggacctcaccaagggagcatggaaacctctttgcgatcagtgtggtagcagcaaatccatcataggagacagagatggagtatgagttccgggcctccaatactgtacaatgccatgacattcaggaagtcggtcttatggccccttttgcacaggctttccaacagcaaagtaaggatcgatgattatctggaagaagtaatctctgtgggggtggaatggggtaagctggctcgggcagcttgttgagagatgaaatgatgtcacgaacacaaggatggacatctgtaaattgcacagcacgnnnnnnnnnntgggcagcttgttgagagaagaaacgatgtcacgaacacgaggatggacatctgtaaattgcacagcacgaagaaaatggaagctgctctccatctaaataccttcactcactcactcctgaccacccacctagttctttccaaggtcagggtgcagccctgagctgcaaaggcagccccaaatcgttgaatgagggcatgagcctgtgcctcccaagctccgtagtcccctgcgtcagggttcacgcagaagaggcccagcacggctccgatgcagaagcaggaggcccactgccccatctggctcgcactgggggtctgggtgtaggggtgctgggcggccagcgtctgggtctcggtcatgaaggcgccccaaaggttctgcaggtcaaggggttctaggctggggtggcatgagccgggtgtcacatcggtggagttgtccagcagcttgggcgcctcaggatctcgagaaaaatagcgtatccttgcttagaggttacacttgcaggccttcacggcagaccaacaattcttgcgatgcttacaggatcgatacggccttggagctgaggaggaactgcgtgcggggtgtgcttcagggcgatgaccctgctcctgccgcgattgcttcgcagaaattctacaaccaccttggtgggagtttctcgccaagccatggagtgtggctacagcctccaagtcagtaaacgctgctcgttgcagttggctggacacgcccagctgtcttgaccgagggaattgaggactttgttcacacagtgcgttggtgaagtgccgcttatgcggttttcgcggggtttgagacacagtatcttacagcttgtcgcaagatcgaggaggaggctattcttgactcgttcaatgtcgtacgcgttgagcctgacagcgcgcacatcattcccgggatgtgcaccgttcagaatctaccactgnnnnnnnnnnggttgcagttggctcgacacgcccagctgtcttgaccgagggaactgaggactttcttcacacagtgcgttggtgaagtgccgcttgtgcggttttcgcggggtttgagacacaatatcttacagcttgtcgcaagatcgaggaggaggctattctttgactcgttcagtgtcgtacgcgttgaacctgccagggcgcacatcattccggggatgtgcaccgttcagaatctaccactgattctcacaaagagcttctgtctggagtggcctgcctctcaacacggaaggccgactgggtcataattgacacaaggaatactgcagtagccaggatacgggaatagatacaggaggcggagcgacgcattgttctgcgagaactcggccttcatggggcgagtcaccacgggaagtggtgaaggggttgacgatgaagcggggcaatacgtgaaagggaggggctcaagtatacggtggggcctcggccggcaagcccggcagggtggcccgctgtcgctaagctcgcagggaccggaagacccgatgagccaaccgcgctgaggccatggtgctcatggaccaatccggtggttgggaggacagcaacctggccgactccccagagtgcgcgaccattcgctgcannnnnnnnnnaagcaatgcggtggttgggaggacagcaacctggccaactccccagagtgcgcgaccattcgctgcacgtttggggattgtgggtcaggagtggcccccgagcacgcgcagcctggcaggcagagtccggcacacgcccttcaaacccccctccggcggggcctctgcatggcgacctgcgacgcgctccgcggcagctccgccagcagcctgtggatgacggtcagcgggggggtttgcgggtgggaaatcctctgcagcaggtccctgtgactgcagcagccatgcaagcgctgggccgagcaggaactcactcgtcaaaggacgcggcgtgggagacgtgtgctcccaggcgcgggcaccgggaaggggtgtgctcccgggcatccccggccccgtcgctgcgctcgccgtcgcccggcgacccctcgccggcgtcgtcgttggcaccnnnnnnnnnncgctcccaggcgcgggcgccggggaggggtgtgctcccgggcgtccccgcccccgtcgctgcgctcgccgtcgcccgacgacccctcgccggcgtcgtcgttggcacccggcgcggcctccccggccgcccgccaggggaaggcggccggctcccctccagggccctcgaacgcgccaacccccgccccgcccaggccctccgaggcgg

SEQ ID NO: 30684 - DNA, 163 bp, Chlorella protothecoides
tatgtgaggactgtcatgtgtaagcaagaataaaggctcaatctcgatttgataaatattgcagcagtctgacgctcccgcagtcctaatcgcaaagctgtcagtacagcccatacattgctggaagacaaggttaggcgtgacgagtcccaaagcgtagacc

SEQ ID NO: 30685 - DNA, 61 bp, Chlorella protothecoides
gatcacaattaatggtctggatgatggtaggtgggcgaatctactgaataaggtcctgccg

SEQ ID NO: 30686 - DNA, 61 bp, Chlorella protothecoides
ccgaatacggtgaggggcttgggtttcatacgcgtcgcaaggaggcgtagactcggtgcag

SEQ ID NO: 30687 - DNA, 67 bp, Chlorella protothecoides
aaatggtggctgccaatctgtgggacaaaggagggggtgggaaggtttgagagtcgtgagcgtgctc

SEQ ID NO: 30688 - DNA, 68 bp, Chlorella protothecoides
gtgtctctctcgtgatgcgagatgtgaaagtagctttgaccgggctgctgtcgttccgcctgtttgtg

SEQ ID NO: 30689 - DNA, 182 bp, Chlorella protothecoides
tacattgccgacgatcttgcactggagtgtcagggaaaggccccgggcgagtgcaacaggtaaggtgccgtgtctgcgacgcgggagaacgtgaggtgccatagtagggatgatgcatcacgccaacattcgatttcctctcccatgagtgcagcgatgtgaacctgccggtgctgaagctg

SEQ ID NO: 30690 - DNA, 61 bp, Chlorella protothecoides
gcttcaggcactccacggcggtaaggaccaacgtggcgccagacttcaggatctccaagtt

SEQ ID NO: 30691 - DNA, 163 bp, Chlorella protothecoides
ctttgccaaggtgcgaaagttctgctccaggactgcctggtgtgcgggactgtcggcagagcagggatgaaggcaagggtggggggtgcctccagccaggctggcgaggtctcgtggacccctgttcccgagggttacaccacccatccacccttgcgccctt

SEQ ID NO: 30692 - DNA, 115 bp, Chlorella protothecoides
cgcgccctgcgataagccgctggcgtgcggccggcatgcctgcgcgctcgcctgccacacggggccctgcacgccatgcacgcggcggtgtggggtggcgcggggggcgtgcgcg

SEQ ID NO: 30693 - DNA, 61 bp, Chlorella protothecoides
acttgccctctgctgtgccaagacgggatcgggctgggaagatgccttgaagttcatagaa

SEQ ID NO: 30694 - DNA, 109 bp, Chlorella protothecoides
agatgctgcagctgcttgatggttgtttcatgtgggcaagcccacttatgtgcaagcatattcaatgatgcgacccaccagtatgtggtacttacttgcagatggcatc

SEQ ID NO: 30695 - DNA, 61 bp, Chlorella protothecoides
gacctggcgcgccaaggccgacgtggctggtatggggggtgcagaggagacgggcgccgca

SEQ ID NO: 30696 - DNA, 97 bp, Chlorella protothecoides
gggtgagacggaatctgatgcttgcaagcattgctgaggtcatgccatcctgttggattcagtgtcattgtctgagctcagcccctccttaccactt

SEQ ID NO: 30697 - DNA, 196 bp, Chlorella protothecoides
atgatgcccactcttcacatcccacgactcaagagcattgggagcagcctagcggcggggcccaagatggggctgctttccatctgcatgctgaaacctccctccaaaacgaggtatgtggcaccatactatgctgctgaggattgcctcccccccacccccccacccccatgccctctcacgtaggagcagccga

SEQ ID NO: 30698 - DNA, 139 bp, Chlorella protothecoides
aagggactctgagcgcacaagacgaatcacctccggcactgaggcctgaacacatcgtggtcaccgtctgactcctcctgcagccctattggcaggaaaacacaaaaaacttggcaccttcggagtgcttgcggccctt

SEQ ID NO: 30699 - DNA, 373 bp, Chlorella protothecoides
gaacgcctccagcttcccgcctcctgcgatggagcatttacgaaacactgggccggcgagtgacgcatattctccagacagtgcgcatgatatgccccaagactcaactgcacaggtgctaggcgcatgctcgaggcggtgcctgtcccacagtcatccgcacctgtcatccatgcttgcttctggggctgcgatcgctgtttcccggggggcagctccgcattacggtccatggtctgtgacccagggagtccctctccagaatagcgggtggagagtctgctgagcaatgctcgcatcttggctgcagccaatagctcctatgagcatgtcgtaggagagacacacagattgctttccctgtctcatggag

SEQ ID NO: 30700 - DNA, 77 bp, Chlorella protothecoides
tgcattctttcatcagcaagcatgtcgcagatttgctctctcgggttgcgccatgccaccacccatggtgcccaatc

SEQ ID NO: 30701 - DNA, 69 bp, Chlorella protothecoides
ctcggcgatgatcctacaccgtctgcgtcgtgaccccgcgcttacccttgaacaaacaacggggacagc

SEQ ID NO: 30702 - DNA, 143 bp, Chlorella protothecoides
gaacgtgaggcgccggtggatcggggttggagtctgtggatctgacctggacggcttgaatggggtggcatcccacacctccccctcgccccccacagcacgcccctcccctcaccacccactccgccccgcaccgccctcgc

SEQ ID NO: 30703 - DNA, 126 bp, Chlorella protothecoides
cagggccgcgcaggagtcggacccaggcccctatgagctgatcggtaagcctcgttgggcaggcgggggctcctccctgggaacgtaatactatcgagctgcaggcccacctgtgtgcttggtggt

SEQ ID NO: 30704 - DNA, 115 bp, Chlorella protothecoides
ccaagatcctgacagggaggaagtgatgtgccacaggctgtgttcacactccatcaccgagtgcctgatacaattcgcacgccatgcccgcgcaggacatgcggcagaccctctg

SEQ ID NO: 30705 - DNA, 61 bp, Chlorella protothecoides
ttgaagagctggtactgagtgcagcggaaatgggacgggctgcatgctcatcacacgggcc

SEQ ID NO: 30706 - DNA, 323 bp, Chlorella protothecoides
ctccttgcacagggccgccaggtcggagcctgagtacctgtgcatggtgaaaagaggggaaaggggatggctgggcaatgctgaactgcgcccgcgaggacccggccctgtgatctgggagacagtgtgcatggggtacgggccccattcgcacatgtagtgccggcaacggctcgccctcgtgcaattcgcagcatgctcatgcctggccatgctcagcagcagcctggatcacttcatcgaggatggaccccccctgatgcgctcaaagagcaggcattctcgctggagcacggcctgagacagcccctgctcccccctca

SEQ ID NO: 30707 - DNA, 75 bp, Chlorella protothecoides
gtctggacgggcatggacgatcgtgcagcgaggtccacgccccctcgcacgcgacgcacggcatgcagatctcca

SEQ ID NO: 30708 - DNA, 61 bp, Chlorella protothecoides
ccttaggatgcctcacacggctgcataggaaccatccgctccgcggcgacttgagccatgg

SEQ ID NO: 30709 - DNA, 62 bp, Chlorella protothecoides
aaatccctgacccccatgcagtcgtgggccatgaccgtcatctttggaggtgtgcagatcgt

SEQ ID NO: 30710 - DNA, 61 bp, Chlorella protothecoides
ctcaggcctaacagctggcgtgcttgccccgcatcccatgatctcggtcagagacaagcag

SEQ ID NO: 30711 - DNA, 244 bp, Chlorella protothecoides
atggcatcgcttcgtttaaggacgtccagctccattacaagtaaagttgccagagtggtatcctctgatagcctttaaatcccattatatggtatcctacatcttggactgagacggagcccacaggaaggtccttcagtaagttgctttgatgccccaggtccacaagaactgcgtttgataaggaggggcgctccatttgttataccagtactgtgagactcgggcaccagaagcactacga

SEQ ID NO: 30712 - DNA, 110 bp, Chlorella protothecoides
gccctcggcagaacaaccgcaggccgtgccgtgcataccacgatgctacatgacgcgcacctgtgcagccggagacggtggccagggcctttgccagggcagtggcggtg

SEQ ID NO: 30713 - DNA, 73 bp, Chlorella protothecoides
caggccgacatgattttccattactggattctgtgtgatgggttggcatgcctcttgctcctgccatacccct

SEQ ID NO: 30714 - DNA, 61 bp, Chlorella protothecoides
acagcgcctgttcccccattgaccccccccactcctccatcctgacgtgctatcttttgct

SEQ ID NO: 30715 - DNA, 61 bp, Chlorella protothecoides
gcaccgagagctggccggtgtgttggcaggttgtggggcgccacagattcatgagcccgca

SEQ ID NO: 30716 - DNA, 61 bp, Chlorella protothecoides
gcagttcatcatctatgccacctatctgtccgagaagatcgggtactggcgctacatcagc

SEQ ID NO: 30717 - DNA, 61 bp, Chlorella protothecoides
ctatgtctcctggttcttccagttcaccttcgccgccaccgccgccaccatcgtctccggc

SEQ ID NO: 30718 - DNA, 81 bp, Chlorella protothecoides
cgtccagctgccgggcagagggcaaagggggttggaggagagaagagggcgcgaactttgcactgcagccggctatccccc

SEQ ID NO: 30719 - DNA, 61 bp, Chlorella protothecoides
actttggcgtcatcggcggcgcgggcaaggtcctgggcatgctctccgcgggcgtggccaa

SEQ ID NO: 30720 - DNA, 265 bp, Chlorella protothecoides
ggggggggggcaaccgctttctttgctcgtcgggggatgtgtgttgcccgggccgcgccgactctaccatgacttgggcatgccggggagctctgggtgcacccagggtgctcccaggatgcacacctggctaccctacaaagcggcttctccgccgtgtgtcaccaccccgtgcaggagccatctacaagtacgacctgtcgttcagggtggaggagatgtatggcgtcgtgattgcggcgcgggagcgcctggcctcggccta

SEQ ID NO: 30721 - DNA, 61 bp, Chlorella protothecoides
agcctgaagaggtagtactagagctgtttaggatgagaaacgtattacaattggtttgaga

SEQ ID NO: 30722 - DNA, 79 bp, Chlorella protothecoides
ccggccgtgtactgcgaccacctcacgccacaggaagcggctgacatctactcgggtgtgtggtggtgtgcgatgggct

SEQ ID NO: 30723 - DNA, 68 bp, Chlorella protothecoides
gcagggcagtccttgatctgttggaaggagaggctctggcattatacactgatgtagtatgcagtgcg

SEQ ID NO: 30724 - DNA, 71 bp, Chlorella protothecoides
gcgggcgcagggtggttgtggggattcgcatatgggacggcgaggcagtgagccaggatcatgtgcgcgag

SEQ ID NO: 30725 - DNA, 61 bp, Chlorella protothecoides
gtctggctgtgctgttcagtagggaggaggagggtggcggggtggagggatgttgtacagt

SEQ ID NO: 30726 - DNA, 61 bp, Chlorella protothecoides
atcggagacggcgctgaagatgtggctgggacctccaatcacatacccttgccctcacccg

SEQ ID NO: 30727 - DNA, 61 bp, Chlorella protothecoides
gaagcggcaggccgagctgcgcggcgccgcgcagcgcagcgtcctctcccgcttctggaag

SEQ ID NO: 30728 - DNA, 80 bp, Chlorella protothecoides
tctgagaggacccagcgcaagggtccctgggcacctgggcggaggtcccacccctgggatcaggaatgggaccagagcgg

SEQ ID NO: 30729 - DNA, 79 bp, Chlorella protothecoides
atggctggattcaccctttttgttccccttcctcttgaatcttctccacttccctgatggctgctccctggcaaggggc

SEQ ID NO: 30730 - DNA, 65 bp, Chlorella protothecoides
gggggtgcccttctttggaggaggtgaggatctcttccttggaggaggagaggcggggctcctct

SEQ ID NO: 30731 - DNA, 143 bp, Chlorella protothecoides
caagaccaccagggtgttgttgccggtggcggtggcatttccctcggccaggttgttgggggcctcagacctcacgtagccaaatgtctcgccagaggtggagttgtagatcctgacaaggccccctgcagtggcgttgacgg

SEQ ID NO: 30732 - DNA, 79 bp, Chlorella protothecoides
gatggtgcttgccccccagccgcaggccactaccgcaaacgcccaggcgaagaccgaggtggcgccgctgcggctgtag

SEQ ID NO: 30733 - DNA, 134 bp, Chlorella protothecoides
tgatgtggtggaggcggggagggtctctttttggttggtggaggcttccttgacaagggtgggggtgaagcacgtctctgaggaggaggggaacgcttgggtcttggacttggaaccagtgtcacatctacagt

SEQ ID NO: 30734 - DNA, 74 bp, Chlorella protothecoides
ggtcgcttgccccgtgggcccctcggggggagtcacccggaagcacggctgatggcaaacgagacgcgataaaa

SEQ ID NO: 30735 - DNA, 79 bp, Chlorella protothecoides
tacaggatgtaggatgttgggaggacatggatgaacacaaagaatccatggaaaacctcactccctgcagctgctactt

SEQ ID NO: 30736 - DNA, 128 bp, Chlorella protothecoides
cctccaggacgacgaggggctgcgcagcgatgaccccggcgtgcccctggcggcgctgtgccacgtgtcgttcctgcgggcgctgcagcgggttgctgcgcatgcctaggagccccgcccccgggatg

SEQ ID NO: 30737 - DNA, 77 bp, Chlorella protothecoides
tcctcatctgcttcaaggtgcggaatccgtagctcagtacgggggatcctggccgatgcgtctgcgcgccgataagc

SEQ ID NO: 30738 - DNA, 73 bp, Chlorella protothecoides
gttgcctggtcgctggtgctgattccatttgaaggatagtgattttaggcaggcattgagggagatccgcagc

SEQ ID NO: 30739 - DNA, 153 bp, Chlorella protothecoides
aggagtgaggggttcgacagcgacgggatgtgcagggaacccttgtgacggcacgtgcccgaccgccacttgtgtcagccggccccatcacgagagactgtcacctccccgtacctgcagtaccggacacccatgcccagcatgacggcctcg

SEQ ID NO: 30740 - DNA, 130 bp, Chlorella protothecoides
aattttccctggtcatacttgctgaacctacctttgccgagcttcgggtgcaagctgcatgatgatgtccgtacaatacctaccgcgactagggatgtgatgacgaggtatcacacgcatgggcaaaaga

SEQ ID NO: 30741 - DNA, 61 bp, Chlorella protothecoides
gctgctgcagtacataaacttccgtgagtccctcggctcatcaccagccccggtggtggtg

SEQ ID NO: 30742 - DNA, 132 bp, Chlorella protothecoides
tggcggcgaccgccacagccctccaccatgtcagccgtgacgctcactatcttcaccccgctgcctcagcatggcaaaactactccttgccacacccccgaaagacctgcagtccagactcggtgctgtgga

SEQ ID NO: 30743 - DNA, 94 bp, Chlorella protothecoides
gtgcggctgcgacatctgccccggcgccctgccccactcgcaggtgctggcgcgcatgcgcgcctcccgctactgcctggtgctggccggggac

SEQ ID NO: 30744 - DNA, 25720 bp, Chlorella protothecoides
  modified_base (1328)..(1337): a, c, t, g, unknown or other
  modified_base (1602)..(1611): a, c, t, g, unknown or other
  modified_base (2429)..(2438): a, c, t, g, unknown or other
  modified_base (3283)..(3292): a, c, t, g, unknown or other
  modified_base (4096)..(4105): a, c, t, g, unknown or other
  modified_base (4795)..(4804): a, c, t, g, unknown or other
  modified_base (5031)..(5040): a, c, t, g, unknown or other
  modified_base (5164)..(5208): a, c, t, g, unknown or other
  modified_base (6261)..(6270): a, c, t, g, unknown or other
  modified_base (7021)..(7030): a, c, t, g, unknown or other
  modified_base (7112)..(7121): a, c, t, g, unknown or other
  modified_base (7498)..(7507): a, c, t, g, unknown or other
  modified_base (7909)..(7918): a, c, t, g, unknown or other
  modified_base (8140)..(8149): a, c, t, g, unknown or other
  modified_base (8388)..(8397): a, c, t, g, unknown or other
  modified_base (9113)..(9122): a, c, t, g, unknown or other
  modified_base (9213)..(9300): a, c, t, g, unknown or other
  modified_base (10236)..(10245): a, c, t, g, unknown or other
  modified_base (10440)..(10449): a, c, t, g, unknown or other
  modified_base (10520)..(10529): a, c, t, g, unknown or other
  modified_base (10894)..(10903): a, c, t, g, unknown or other
  modified_base (11942)..(11951): a, c, t, g, unknown or other
  modified_base (13364)..(13373): a, c, t, g, unknown or other
  modified_base (13638)..(13647): a, c, t, g, unknown or other
  modified_base (14162)..(14171): a, c, t, g, unknown or other
  modified_base (14838)..(14847): a, c, t, g, unknown or other
  modified_base (15175)..(15184): a, c, t, g, unknown or other
  modified_base (15929)..(15938): a, c, t, g, unknown or other
  modified_base (16993)..(17002): a, c, t, g, unknown or other
  modified_base (18158)..(18167): a, c, t, g, unknown or other
  modified_base (18569)..(18578): a, c, t, g, unknown or other
  modified_base (18998)..(19007): a, c, t, g, unknown or other
  modified_base (19540)..(19549): a, c, t, g, unknown or other
  modified_base (20081)..(20090): a, c, t, g, unknown or other
  modified_base (20874)..(20883): a, c, t, g, unknown or other
  modified_base (21121)..(21130): a, c, t, g, unknown or other
  modified_base (23055)..(23064): a, c, t, g, unknown or other
  modified_base (23742)..(23751): a, c, t, g, unknown or other
  modified_base (24008)..(24017): a, c, t, g, unknown or other
  modified_base (25258)..(25295): a, c, t, g, unknown or other
  modified_base (25446)..(25455): a, c, t, g, unknown or other
ggcgcgggtgccggcgctggtgcggcggccgccggcccagaggcgctgggcacccacccgctgctgaacgcagcagggaacgcggtgttcttcggcggcgtggccgccgcctccttcttcggctactactactggcgctatgaggtggacgagctggaggcgctggtggagtccacctcccgccccgagaacgccttccccggctccggcgcctgggcggcagtcatgggctggtatgtggagcggcggcgcgcgctggagggggaggtgaagaagtacgccgacccgcccagcgacaagctgctgcccgacctgccccccgccgcgcggcacatcaagaccctggtcctggacctggaccacctgctggtacactcccactggacgcgggagcggggctggcgctgctacaagcgccccggggccgaggagttcatcgccggcatggcgcagtactacgagctggtggtgtacaccgacaagctgtgcacctacgtggaccccatcctggacaggctggacccgcagcgtctcatccagtaccgcctgtaccgcgactccaaccagtgggagaacaacgagcacgtgcgcgacctgaccaagctcaaccgcgacctggcccaggtcctcttcctcacagccgaccctgaggcgcgcttcaaccccccggagaacggcatccgggtgagagagaagaggggggggaggggattgggggcgggaaggctatcaccatgtcaagggagcgtgatgcagaacattccacattgaagtgcaccgtgccctggcagcctgtcaaccatgtacgctgcacgtccatacccacccgcctgccctcacccaacccaccctcccacaaaaccccagctgaagccgtggaggaaggagccgggggacacgggactggtggacatgctgcccttcctggaggcggtggtggccacccatgtgcccgacgtgcgtcgcaccgtggccgcctatgccgaggaggaggacatcccccaggccttcaaggcgcgcatggcagccgtgacagagcagcgcgcgcagcggcagggggtgggccgcggcctgctctctggcctggccggcggcaggtgagggcctgcccgggccggcgcacgcagaggcattgtaggacggcagccgccgagggctgccgctgaggatccagcgcggacagacggccagcgagatgccaacctctgcgctacccctcgagacatgcagagatgtgccgccctgcaatggtgctcgacgccctcgtgtcatccccccgcagccttccccctgagtggcagcctgaaaagcgatcctcttgtaaggcnnnnnnnnnnggccctgcaatggcgctcaacgccctcgtgtcatccccctgcagccttccccctgagtagcagcctgaaaagcgatcctcttgtaaggcgagaatacagcatttagatgcagggtgcaggaactggcttgccttcagcggtggccgcccggcatgtcaacccttgatgagtctcagtacaacaggtcgcacacccaggaactggaaagaaacgcacaccatcagccctccttaacacgttgctttgatttcttcttgctcttggnnnnnnnnnnaaagatgcagggtgagggaactggcttgccttcagcggttgccgcccggcatgtcaacccttgatgagtctcagtataacaggtcgcacacccaggaactggaaagagacacaccatcagccctccttagcacgttgctttgatttcttcttgctcttgggcttgccctctcctgtagcagacggtgccggcacaggttgaaggtcggtcgccgacgccgagactggagtatcaggcagcgcagcgtcgctgtgcttcctcttcttcttctcggccttcgcccctcctgtctggtgggctgctgcaccctcctgaacggaggctgtcgtgttgggaggtgtgggtagggtggtgggcaccgccccggccgctgtcgcaggggtgcgaggctcggcagccgcctgggatgcgccgggggacagcgccacagcggccactgcaggacgaatgcccctcccatgcagctcatccagggccagggcagcgcgctctaggttgttcacgtccgtgtgtgagaggcccttgttctgggagatggtttatgagcatgttgatgaactgggtgggcaacactgagcaggctcaaacgccagtgcaaaagcaatgtcgccctcatgcacggccccctggcatgccaccacctcgaccatctcaccttctccagcatggccttaatcatggcagctgcctggtttggcgtgcatgccgccgagcgcaggacttgcgccctcacgaatcggcgctgcatcccccaagcgcgaaccccgatggtgcaagcaaagaccacggccgacaggcaaatcctacttcagtttctnnnnnnnnnngccccgatggtgcaggcaaaaaccaaggccgacaggcaaatcctacttcagtttctgttcatatgtcgaccctttattcgagcaatgtgcggtcatgaatattccagcgcgagtgcactcctaacatcgagtactccccagccttcccgcgctggctgagagcagccccccatcccacccctgcaccgacgattcgttgccagtttgcctcctcgacacccacccgggcccacattccccatgccaggcgcaggctgtgattattagcattccctgtactgagagtctgcatccacacaatggcatcctgcaccgccagcagcgtgaggggcgtgcctagcgcccggaaccagggaaccaccgtgccgcgcctgcagccgtgccgggtccctggcctctgccccaccccctccctcgcccagaacggacgattgtccgcccagacccttcgtagcgtgcctcgacggtgagattacgacccgggtgttggtgtcgagtgccagctttgggttgcctggtgcacctccggtgctgcacccagcggacagattgcgagggtcagcacccccggccgaccctcccatgcacccgcaccagatccctgaccgtgctggcctcatccaagaatggaaactcggctgcccacacctccacgcccaccaagtttgactatgatcttgtgatcatcggggccggagtgggggggcatggagcggccctgcacgccgtctcccgggcaagtgctgcagatgcagggggtcaccggcctagtctgagtgatgtggataagcttatggccatgtgaaggttgaagttttcatgttctgcgccgcttggactgggtnnnnnnnnnntcggcctagtctgagtgatttggacaagcttatggccatgtgaaggttgaaattttcatgttctgcgccgcttggactgggtttgttgtggatggttgcccttttggtgatgctgcggcgcacatccacccaacatggccatccacttggccggccgcaccatgcaccgctcctggggcattcctggtgcctcgaccatccaccgaccgccatcatccaaacccctctcccacaccatcgcctccccgcagggtttgcgcgtggccatcatcgagggccacgacatcggcggcacctgcgtcaaccgcggctgcgtcccctccaaggccctgctggcggcggcggggcaggtgcgcaagctgaaggacgcgcaccacatgaaagcgctgggcatccagatcgagggcctgacctacgaccgcgcaaccattgcggggcacgcccagaacctggcccagaccatccagggcaacctcaagcgctccctcgtcgccctaggcgtggtgaggaggaagggtcaggggggatctcggtgttgttgactggggcagggggtgtggggggtggcttactgcgtcgcatgcggaccacccccaaaccgtctgcccaccaggcttcctccggcctcaccccaaccaagcatcctcaccccccctcacccctcacaaataacaaaggatatcttggtgggccagggcaagttttcggggccgcacaccatcaagtacagcctgcctgggcgagtggacgtgggcggcagcgtgacggggcgtgacatcatcatcgccaccggctccgtgcccnnnnnnnnnngcgggcccgcacaccatcaagtacagcctgcccgggcgcgtggacgtgggcggcagcgtgacggggcgcgacatcatcatcgccaccggctccgtgccctttgtccccccgggcatcgccatcgacggcaagacggtgttcaccagcgaccacgcgctgcgcctggactgggtccccgactggctggccatcatcgggtcggggtacatcggcctagagttctccgacgtctacaccgcgctggggtcggaggtcagcttcatcgaggccctgcccagcatcatgcccggcttcgacaaggagatcgcgcgcaccgcacagcgcgcgctcatctccgcgcgcgccatcgacttcaggacgggggtcatcgcctcgcgcgtgaccccgggcgtgcccggcgtcaagcccgtgtccatcgagctcatggacttcaagaccaaggaggtggtggacgagctggaggtggacgcctgcctggtggccacgggccgctcgccctacaccaacggcctcaatctgggggcggtgggggcggccacagaccgccgcggatttgttccggtcaacgacaagatgcaggtgcgtgtgaggggggtgtggggaggggtggagggggagggaggaggcagacaggggccgagcgtgggagaaggagaggcgaagacggcttgcatgctggggcgacggtgnnnnnnnnnntggtggggaggggtggcgggggagggaggaggcagacaggggccgagggtgggagaaggagaggagaagacggcttgcatgctggggcgacggtgctctggtgcctgcctgccgctgcagaggccagccctggtgatgcttgccctgggccgacttccacaccatgagtcgtggctgcaactcccttcccctcgcgaataatacactggcatctccaaagcggtcgnnnnnnnnnnctccacaccatgaatcgtgtctgcaactcccttcccctcgcaaataatacactggcatctccaaagcggtcggcgcccccaaccgcgcccaacccccaccctcaacccgcccaccacccaccannnnnnnnnnnnnnnnnnnnnnnnnnnnnnnnnnnnnnnnnnnnnggcaagcccgtgccccacgtctactgcatcggggatgccaacggtaagtacatgctggcccacgccgcctcggcccagggcatcagcgcggtggagaacatcgtggggcggccccatgtgctcaaccaccgctcggtccccgccgcctgcttcacccaccccgaggtggcgttcgtgggcctgacggaggaagcggcgcgtgaggaggcggccgccggcggctgggccgaggccgtggccgtggccaagacctactttaagggtaactccaaggcgctggcggagggcgagtcggacggcctgggcaagctgatctaccgccgggacacgggcgagatcctgggggtgcacctgtacggcctgcacgccgccgacctcatccacgagttctccaacgcgctggcccagcgccagagcgtgcaggacctctacttcaacgtccacgcccaccccaccgtctcagaggtgggtgttgtggggtgttattactcgggaaggggggttgggggtgagaaggggatgaggtgtgttgggtgggcggaggaaaggggtcattgagcccctggcatgaagctgggcaatggtgacggcgcatgactggagggcggagctggggggccccccctcaccaccgctcacatacacgcacacacacatggtccccaccctttcatccctgcttcgcaggtggtggaggagctgatccgccatgccaaggtggatggcgtgaccgaccccaagctggcgggccagaagaaggacgggaaggtggccgccaccgcttcggcctgatgagcgacggcccttttgcctggaccggtttgcccccccctggcccgtgctttggtggcaggggaagcttgccccacccctgcccggtgtgagaggggggaggcgcgctgccacgtcgcctgcgctgcgaatgcctgtggccacgcctcaccccccgtgcatcccttgcggagaccaagggcacaggcacgagccatgcacccttccccctcctccacacatctcttttcccctaccactgttctgagattctaacacacnnnnnnnnnnatcgcctgcggtgcgaatgcccttggccacgcctcgccccccgtgcatcccttgcggagaccaagggcacaggcacatgccatgccacccaccccctcctccacacatctctttttccctaccactgttctgagattctaacacacaccctgcatggacttcagaaaggtgccccgtcagggggcagggacgatgggggcagggagagggagtgccccgctgcgcaagggcagggggaaggacagggcggggagcgtcccgcgtcacatcctgagatcccttcacccatcagcgtggtgccccgccgcgcgttcctcggccgcggccgcccagcgctcctcccggtcgggccgaccctgcagcaccgccatctccttcttcaccgtcacccgccccttggccgcaccccgcggcttgctcacgtcccgggcccacgcgacggtcacgtccacggcggtgctcccccgcgcgctgctgaaccaggctgccaggtcggcgcagaaacccaggtcctcattcggcggcgactgaccccggttcaggcgcaggaggaggtgcgcgccgggggccccgcgcgcgtgcatccacacgtcccacgccgccgccgtgcgcgtgctcagcgtctcgttctgggcgctggtgcgccccaccaggaccgcaaggccggagggggagcggaagcggcgcggcgacgaggcgggggccgcgccgggcttcttgttggccctcttgccggtggtggagggtactnnnnnnnnnntgggttcaggacctcgccatggcagcatccagtgcatgggaaagacctggatgtgctgcatcctcgcacgcaaggcacctcnnnnnnnnnncaggccagagggggagcagaagcggcgcggcgacgaggcaggggccgcgctgggcttcttattggccctcttgccggtggtggagggtacttttgccgaccgcaggaggccagcctctgccagctccgcctgcaaaacatgaggttggggtggcggattcaggacctcgccatggcagcatccagcgcatgggaaagacctgggtgtgctgcatcctcgcacgcaaggcacctcattcaacctgggcttggaggtacccctcccttcaacacacgatccagccatgaagtctccctcccatcccgacattcctcagccagagcctcttaccggctctccaatcctacaggtccccacccgcacctgcacctccttgnnnnnnnnnntccgacattcctcagccagaacctcccaccggctctcaaatcctgcaggtccccacccgcacctgcacctccttgagcaccccggcatctgcaggcacctccagctgttccagcagcacccgcgtctcccgcagctgctggatctgggagcgcgcggcctcgagcaaaggctgcaccgtggccgccccccgctgcaccttgcgcgcccgggcatacagcttctccgcggcttccacggcgctctccttggcgtccaggggcagcgtcaccgtcgtccccggctgatcccagtcctccacctccagcgacgtggcccccggcgaccacctgcagcgagcgagggtggtgagtgcatgggtcatcagaacgcaactctgccactgtgtgctacctgccctcccnnnnnnnnnnagtgagtgcatgagtcatcagaatgcgactctgccactgtgtgctacctgccctccccccaaccccccaccccgcagcctaacaggtgagcgtgtgccatgaggaggtcggccttcttccgcgtggcgtccgcgccctgccccgcggcggctgcctgtgccagggacacctccttcctttccaggcgagtcagggccgcagccagggccttcatgaggggcnnnnnnnnnnctcttccgcgtggtgtccgcgccctgtcccgcggcggctgcctgtgccagggacaactccttcctttccaggcgagtgagggccgcagccagggccttcatgaggggctgacgcacctgtgagcagattgagggactggctggagggaatggcgtcgcaggtaagaaccccgcatgcacgctggatgacggcgcgggacagtgccctaggcctcgagctctgagtgcagggaaaccacnnnnnnnnnncgatgacagcgcggggcagtgccctgggcctcgagctctgagtgcagggaaaccactctcaatcagccaagcccgccatcccactgccccaccttctcgaaggccgcctcctccagctgagtggtctgcgcagcgtgcacagcgtgcagcacgtcgcaggtgccctccgatccggtgtgctgcacatctgcgccggcccccagccagcgccaggagccgtcgggaagctgggcgccccgcagctcccccacgcgcacggctgagacccagcggagccaggcggcgtgggcggcggcccactgatcccgggacgggccctggggcccgacctccccagcggcctcccagacctcgccggcgacgccggagcccacgccccggaaggtcttggccagcgccgccgcgcaggagcagggggcctgctgcacgtccagcgtcccctgcaccgcggcctgccactctgccaggccggggcactgctcggggtccaggccgcgagcggcggggggcggcaagtagcgcgcccccacctggaggggccgtgctgccgactgcgcaggcccgacctgacggaggggggggcggggaatggctcagcgcgagagccgtgtcagcctgcccgattggggcgggcagcccgcggcagggagcctctcccgtgtgaatttattgcccctccagccatgccatgccacgctcccgtgccatgggccccnnnnnnnnnnggtagcgcgcccccacctggaggggccgcgctgccgactgcgcaggcccgacctgatggagggggggggggggggggggcgggggcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagggagcccctcccgtgtgaattcactgcccctccagccaggccatgccacgctcccgtgccatgggccccacagcgcacctggtgcccggccgccaggatgacgtcgtctgaatcagtcaccgccaggttggcgtgccggcccgtcagctccaggtagatgcgtcggcgcgagtcggagcccccctgcggcgcctccaggtccagccgcaccagcctctcccaggccagcaccagcgccgcgcgcgtcagcaccaggcccgccagctgcgccttcaacacggcgcccagagcgtgggagtccaggagggggtccccacggcgcgggggcggcgggcccagccccaggtggccgtgccgcgggtgccagctgaggtggagccaggtgtgggcctccgcggtgcgcagggccagggccagggaggtgccgctgacctggaccacggtgtccacccgggagggggtccatccagcctccagagccctcacgcaagcggagaggagggtgtagtcggtggcaggggcagggggggctggggggtggggggccgccctgcaggccaagcgggagccgtgccactccctcaagctcgtgaagccatggggcaggatgcgcgtggcacgggccagcatggccatggccctgccaggcactggtcgacttggactttgcaagccgacctcaatccaagttcatgcacgaagtcatgaaagcagggatgggttccaccctcatcgtgatgcgttttataataagaatcatcttttttctgtcatgtaatgctcgtaatgttccagcctgtgtgatcggtgaggcgctatccccatgcaagtttcgagcgcggcatgcctcaggcgtttcaggactcagcctccacaacttgctgagatcattttggaaatcccggtacgaactcaaaatgcagaccccatnnnnnnnnnntccggtacgaactcaaatgcaggacctgttcagcagcagcacacgcaagtccgatggggtctgcattttgagtttgtaccggggttttcgaaatgatcttagcgagatgtggaggctgagtcctgagacgcctcaggacagatgacacgtcagtctgacggcctctccacatgggcacatgcaacgacaggccgnnnnnnnnnnagcacggtctaccgagatccagcggctgcagcctaccggtgaggtccgggagatgtccatcaagacgggcnnnnnnnnnnacagcattaccgggtcattcgtcatctgagtcaagcaccatgattcgcctcttggacggggcatctgcggacgccttggccttcttcgctggcacaacagtgggcgtgggagctttcccaccagcgacattgctgttcttgttctcttctgagctttcagactcctcatcctcagacgtgctcatctcttctgcgaaaatgtcaaagaggagggggccggtctcaagtcagggcgcagcttcctgacatgtgctgtctggttggcttgctgctctcaccacatctcgcctgccctctccggagttcatttcacaaaacatagggagacatccaccccttctcacccgactcgctgctttcgtcannnnnnnnnnaaaaacatagagaggcatcttatcccttctcacccgactcgctgctttcgtcaccagaggaggcggcgtccgagctcgacgatgggtcagctgcagtcgctttgttctgggctggcatgaccctgcgttgcttgccggctggctccttagcgctcgcggatgccggcgctttcacagcatcctctgccggctctacctcagacacgctgctctctgcggcatgatgcagggcaactcaggttggggtcccaaaatcctgccctggcttgggactgatgcgcaggtgtgtcttatttgcaggtttcccctgtgtcaccgctggcccagtgttgcagccacaccacgtatccatgctcaaatgcatagcagaaggcagcccctgcacaccatcgctgtcagactcagggtcctcctcggagctcgagctgtcctcgctgtcagaggccgccctgcatagcagcggacgctggagggggaacaggcgtgctcctggataattgcaaacctcgagccccagcagtgccagcgaccatgccttccaatcaagtgctgaggcaacaacgcacttgtaggtcctaggggcctgcaccggttgccggcgcctgccacccgacacgatgttggaggtgtcgatgccatccaggtccctctccttagccaggcgccgggccacagcctccacagcatcgctgcctggattgcaggggatgcagaccgaggatttcagtggtgctttgcgctctgccacagccaccggctccaacagccgggctttggcagtgaaagaggcattgcaactcaggtagagcaaggacacagaacccaaagatccagggaggtgcctcttcgttcacaaatgcgaccctgaactgttcagtacctgaggatttggagagcccgtgcttggtcagaaggtttaccagcgcttcctgcagccctgcatccgtcttgttctgcacatagacgctgggtgcgatgccgatggtcgccctcttgcacatctcccggaggcggagggtggcacttgagagctggcgcnnnnnnnnnntgctgggtgcaatgccgatggtcgccctcttgcacatctctcgaaggcggagggtggcacttgagagctggcgcctggcacctccgctctgcgagccctgatctgtgagggctggagtcttaacaacgggcttaggctctggggccttgccaccctcatcagcccgcttcttctccggcttggcacgcttggcagggggctgtatgggcggctctttcttggcaacggcaaccggctcagattcctgagaggctggggtggccactgcttgagatgcaatgagctgtgcagggatgggaggtgtggagatcagcattgggtcacttacgtgatgtgtagtataccatcctgcttgacgcccaacctcaaggcacctttccccatcctccacctgagcccaccttgtcaatgaggtctgaaacgaaagccttttttactttaagactgtctacttcgaggcccaagtccgcctcgagcctcctccgaaccgatttcaaggtcaagctcctgggggagcaggggaggagcacaggctcgaacttgcaggcccgcctggacgtggcttcgagcatcaggagccctgcgtaacacaacataaaaccagatcttactccaaattattgattatgtcttgtcgacaggcgttgaaggcttctataatggcagcgtctgtcatttgagctcgtggctcacaacgcgggctgaacaggctgcaacgttcttgatccttctcgcgagggtaatagcgcgtaatgcaatctaacaaggaatattcaatgcctgcattcagggccatgagcacctgtgcagcattccccctccgatatcagtctcggcaaagctcgacccagcgctgtctgttcgcacctggcgcccgaggtaacttttggcgcggaggattctgccaagtagcgccctcgacacataaccctgaggctcgctcccccaaatgcatgcaaaggacaaacacctgccctctctatcccaggaaactctgctccgcctgcttgtcacccagggatccctcgtcgctctgggtttgtgtgagggctggagagcgtccaccactactgcctgccgctagaccatgcagttcctggcgcgtgcgagtgctgcctcgctgcggcggtcgcaggtgaattttgcagttgggagcatcgacataagctggcaaggctgcgcttgtctgctgcacttcccgcgagacgccagtgctccaaaccccccgacctccgcaaaaccccgcaggcagccaccgaggcctttcagcgccttggagcctgtggctatgccacgacacaggtgagcctgttgagttgtaggggacagaatgcctcgctcgatatgtaagagtcgctcctcagcccaccccccgaccgcggtgcctctgcagctcacggtgcgggatgcccnnnnnnnnnnaatatgtaagagtcgctcctcactccatccccgaccgcgttgcctctgcagctcacggtgcgggatgccctaaactcggcactagatgaggagatggagcgcgacgataaggtgaattggtagcagtggtgcctcgggtttgcacctcgtaggacgcgggtcggtgcatgcccagtgttttcatggtgcttgtctttgcctggctatacttgttgcattgcgctcgtcacatgtgccttctgtgcaatcgcaccgcgtctcccannnnnnnnnncagcagtggtgcctcgggtttgcacctcgtgggacgcgggttggtgcatgcccagtgtttccatggtagtgcttgtctttgcctggctacacttgttgcattgcactcgtcacatgcgccttctgtgcaatcgcaccgcgtctcccaaccccttcctcccaaccccaaggtcttcatcattggggaggaggtcggtgagtaccagggcgcctacaagatcacgcgcggcctgctccagaagtatggcgccaagcgtgtcaaggacacccccatcacagaggcaagctcctggtgggagggatggcttgggtgcttgagatgtggtggggatgcctggaagtcatccatgtcgttgacatacaatggtatgccaaaattccatgcaatcaagcgtagcgctgtattcccctcctaggcagaaacaacccttgaaagcacttccactccccccatctgactcccttctcccctccccctcccacttcaggccggcttcactggcattgcggtgggcnnnnnnnnnntttcatgtcgttgacatacaatggtatgccaactttccatgcaatcaagcgtagcgctgtattccctcctaggcagaaccaacccttgaaagcatttccactccccccatctgactcccctcttcccctccccctcccactccaggccggcttcactggcattgcggtgggctccgccttccagggtctgaagcccgtggtggagttcatgaccttcaacttctccatgcaggccattgaccagatcgtcaactccgcggccaagcatcactacatgtcggcagggcagatcacctgcccaatcgtcttccgcggccccaacggccccgccgccggtgtggcggcgcagcactcccaggactttgcgccatggtacgcctcggtccccggactgaaggttatcgtgccctacgatgccgaggacaaccggggcctgctcaaggccgccattcgcgaccccgacccggtggtcttcctggagaatgagatcatgtatggcgagagctttgaggtgtcggaggaggtgctggacaaggattttgtgctgcccatcggcaaggccaaggtgtgttcctttttgggggggaggggggtggggaggggggctggagttgatgaatggtggtgatagcttctggcgatagtgggtgactggatgctgctgatnnnnnnnnnncctggacaaggattttgtgctgcccattggcaaggccaaggtgtgttccaatttgggggaggggggtggggaggggggctcgagttgatgaatggtggtgatagctttaggcgatagtgggtgactggatgctgctgattgctcagggattctgaggggagatgccagccgcagatgcccggcccatgcaaagggggagattgaggttctgattgcacggcattacgtgggcctcatgcatctgcagtgtcccacccatccttcaaccccagtccccaaaccccaaaccccaaaccccgcgcccacagatccagagggaaggcaccgnnnnnnnnnnatgaggggagatgccagccgcagatgccctgcccatgcaaagggcgcgattgagattctgattgcacggcattacatgggcctcatgcatctgcagtgtccaacccatccttcaaacccactccccaaaccccaaaaccccaacccccaaaaccccaaaccgcgcgcccacagatccagagggaaggcaccgacctgaccattgtggcctccggcaagctggtcggctttgcgctgcaggccgccgctgagctggacaaggacggcgtctccgtggaggtggtcaacctgcgctccattaagccgctggatcgcgagacgattgcggcgagcgtgaagaaaacccaccggctgctcaccgtggaggagggctggccgcagcacggcctgggctccgagatcattgcggtggtggtggaggaggccttcgacgacctggacgcaccgccggagagggtgtgcggcgtggagatccccatgccatacgccacgccgctggaggacgccgcgctgccgcacgtctccgacatcgtgcgcgtcgcgcgccgcatgttcaacctggagtgaccaagactccggatggcagcggcggtggtgggaaggcggcggctgctgctgctgctgcaatgttggggggggaggggaccatccaccctgagattcaaggcatggcccccccatcaccctgtgtccgtgtgaacccagtgacattggcgagagtgatgggaggttgttggtgtgacgcnnnnnnnnnnggcagcggtggtgggaaggcggctgctgctgctgccgctgcaatgttgggggaggggaccatccaccctgagattcaaggcatggccctccatcaccctgtgtccgtgtgtgaacccagtgacgttgaggagagtgatgggaggttgttggtgtgacgccgaggaggttgcgagtgcatcaggtttgcgaaattgaagctgcgaatgcacgctcaagaccccgccccctgcagcccatcgaccatactacgatgacctgcgaccagagctccaacctaaatatttaatatggcaagcacgtgggggggcgtgtgacggccatggacatgtcgaaggagggaccttcgaccgaggtcaccgtctccttccatgccctgtgcgtgcgtggcggatggggtgtgcgacaaggcgcctgcactgactcaatggtataaatatgttcaacaaatcaaccttcgccgcagtctgaatcaactccccatttcgccaagaccatccctgttcaggcaccgcgctcgacacacgatccaggacttcgtgctgagctacctgccctaccatgggctgagtctcgtcgacttcctgaagtggtgggatgtcctggtgtgggtggagggcaccatctacgccatggacgaggggaatgaggagctgacggctgacatgctgggcagtgagccgggaaacggcggcgtggtgcaggtggacccatcacatcaaggtaaaaagggggataacctgaccatttgtgagccaccagacccaccttggatatattatgggatgcagtgctacgtgaaaccttggactcctcccagtctgcttctccagttgagcgcagctcctcctctttcctcggtatgactgcaggctttgccaccatcgggagtgtgctggaggggctggggttgtactcagcccatgtggccgacgagttgaaaaaggtcaatgccaaggagcgcaatgtagctgacaggaccctgccttgttctgtgggcaccatcgcatgtgcgctggctctagatctcctcctcgtcaccagtgctgggcccagnnnnnnnnnntggtatgactgcaggctttgccaccattaggggtgtgctggaggggctggggctgtactcagcccatgtggccgacgagttgaaaaaggtcgatgccaaggagcgcaatgcagctggcaggaccctgctttgttctgtgggcaccattgcatgtgcgctggttctaggtctcctcctcgtcaccagtgctgggcccagctcgctgccccatcccccacaccccaccattcccttctggaccctcacagggcttggagtactgggagggcgagcgtcggctctgcgccgcgatggccgcgcagccctgcatccccaaaggaggatcagctatgctttccaccggccagctgcatgccgtctccgcaaagaagagctttgactaccgagtgctccaccacctgctctgcgggctgtgtggcattgagcgcaacaatgtggcccccctcttcgagttccttgcgctggacgagtggttggtggacataggggacgaccttgtggattacgaggatgatgttctgaggtcagtgggtgggagtattttaggagcatggaccggagtcagtcacttggtgtccttgtaggttctgtcacctttagagcttgactgtgcctttaacgcgagaattgccgctgctgtcatataacacgcacatcttttgatgcaagtaccaaccaatttatgatcaggaactcgttcaacatctaccgcgggtatgtgcacatctttggcgccacagcaccgctggagcttgcacgccacattggcgaactggagggactgcacgcccaggcgctcgccctcctgacgcacgcccagcgcagagccttcttgaagcgcaaggatgcggcggcggaggggccgggagccctgcgctgggtgatgccgacacccattctcgatgaggcagcgtacaggagtcagtagtctgacgggcgaaactagctccttcctccctccctagaccaaagagatcccggtggctactctgcaaggggttcacggcgttccatgtctgattgtggtgatatcagaaagcaccaagggcggcgctccaagatgaggaggacaacgtccccccacagacagtagcacatcgcaccaacgccctatgattaattaccaccatcccttctgagtcttcatcctcctgtnnnnnnnnnntctctgcaaggggttcatggcgttacatgtctgattgtggtgatatcagaaaacaccaagggcggcgctccaagacgaggaggacaacgtcccccccacagacagcagctcatcgcaccaatgccctatgattaattattaccatcccttctgagtcttcatcctcctgtctatttggtgaggcttgcccagacgatcttgggttgagttggttcactgatccacgtacccttcaccaagactgatgtttgtactcccaccaaacataacctgagctcttacactggcaacctgcccatgctgcaagaagttgtattagatacctgtggttcaattgctgaaacttcttgtgctgcaacatatgggccttgaagttacttggagtgctcgacttaaccctgnnnnnnnnnnatacccttcaccaagactgacatttggactcccaccaaacataatctgagcttttacactggcaacctgcccctgctgcaagaacttgtattaggtacctgtggtttaattgctgaaacctcttgttctgcaacatatgggcctcaaagttacttggagtgctcgacttaaccctgctcgagaaacagagagcccccagctttcttccgtgaagcctcaccgcgcattgcacagcgatggaggtgtaggccgagcatccttcaagcacagcgtcgctctatatgtcagagacaaacagatcaactttctgataaaatctggcgaacgatatctgcctcgcaataacttcagggacactttagcccgcaagcaagcctttcggctcttccctcgttcttctcgttccacattgaagaaggnnnnnnnnnntgctctatatgtcagagacaaacagatcaacattctgataaaatcaggcgaactatatctgcctcgcaataacttcagggacactttaatccacaagcaagcctttcggctcttctctcgttcttctcgttccacattgaagaagggctcatctggcgcacataccgcttggtgtgacaaattaaagatgattgaggtcgttctcaacgatcgtctggggaagaaggtgggtcattgtccaggctgctgatcctgcctgctgtattactcatgaagtgatgtgtgccattcgcgcgaccatccgcacaggttcgagtcaagtgcaacgaggatgacaccatcggcgatctcaagaaactagtagccgcacagactggtgggaacagcctcatcgcatgacagacgggaagtggcatggaagttgagcaaggggtgtagcacccaggattgaaatgtagtgcccgtgtcaacatcactttctcaacctatcccatcccctgagtaggtacgcgaccagagaagctgcgcattcnnnnnnnnnncgacaccatcggcgatctcaagaagctagtagccgcacagactggtgggaacagtcttaccgcatgacagacgggaagtggcacggaagttgaacaaggggtgtagcactcaggattgaaatgtagtgcccgtatcaacatcactttctcaacctgacccatcccctgaataggtacgcgaccagagaagctgcgcattcagaaatggtacaccgtgtataaggaccacatcacactggcagactatgaggtgaaggatggtatgaaccttgagctgtactacaactgatcggcaatcgtgctttgcgcagagcgtgtcaaggcaattaaagtcatcattcttcgcgccattatacccattgggagcgcctggtcatcttgtggttttccaagtcgcaagatttcctgctctacacctaaacaatgccaacctgaaatcccgtcgagcatctaatcctcttgcaatacctggaatgcctggattgtgacggaatcaatcgttatggctctgtgttctgctgaacgcgcagannnnnnnnnncaaaccctgtcgagcatctagtcctcttgcaatacctggaatgcctggcttgtgacggaatcaatcgctatggctctgtgttctgctgaacgcgcagaggcaggaaacacacatcattgaacaagtactgatacataatggtcgaaggggaccatgtcagtggaaagcgcgacataaggtaaggagcagggaactgcgcggctgtggccccaatgcacagattacaaggtagagtcgcattgcaaattgcgattgttactggaacatccattatccgagaggctgatatcactcccctaggcccccgcccttgcccgtgttggaccccttgccatcaggtggctgcggcctgctctggcatccgagcttgggttccccgcgcagcctgcggctgacagacttggcaacgcctgataaagggcgccgtctttcaggatggcgaccaaaggccgagggctgagggagcaggtgaagccggcgacctcgctggggtggggaggggtggcaggggctgggcggccggtcgtgcatgccaccggtccgttctccgatcgtcctctttttcctcatcccaggatctcagcacattggatgtgaccaagctaacccccctgtcccccgaggtcatttcccggcaagccaccatcaacatcggtgagggggaggggttgatacaggagacacattacaaggcccagggcccagcgtatgtgcggtgtgtcgattgcacacacgggaatgggcgccgagcctagcctgatgtggagagtcaggctcactgggnnnnnnnnnncggtgtgtctattgcatacacgggaatgggcgccgagccgagcctgatgtggagagtcaggctcactgggttggacatctttgaagtggcaaggcagtcccctgcatgctgtccagccagccaagcaccctttctccagcagccatcaccatctcatccccctctctccaccacctcacttcacccgcaaatccaccaggcaccatcggtcacgtggcgcacggcaagtccacggtgnnnnnnnnnncggcagtcccctgcatgctgtccatccagccaagcaccctttccccatcagccatcaccatctcatccccctctacccaccacctcacctcacccccaaatccaccaggcaccattggtcacgtggcgcacggcaagtccacggtggtcaaggccatctccggcgtgcagacggtgcgcttcaagaacgagctggagcgcaacatcaccatcaagctggggtatgccaacgccaagatctacgcctgcagcgacccggcgtgcccccgccccgccacctaccgcgcctacggctccggcaaggaggacgcgccgccctgcgaggtccccggcttcgagggcgttcccatgcagctcctgcgccacgtctccttcgtcgactgccccgggcacgacatcctcatggccaccatgctcaacggcgcggcggtgatggacggcgcgctgctcctggtggcggccaacgagccctgcccccagccccagaccagcgagcacctggccgcggtggagatcatgcgcctgcgccacatcctcatcctgcagaacaaggtggacctggtgacggagagcgcggcggtgaaccaggcggaggccatcgctcgctttgtgcagggcaccatcgcggaacctgcgcccgtggtccccgtctccgcccagctcaagtacaacgtggacgccgtctgcgagtatctggtgaagaagatcccggtccccgtcagggactttgtgtccccgccgcaggcgagctggaggtttgaggggtttgcggggggattctttggggcggggagcttgctggaggagatgaatagaagaagtgtgaaggggggaagatgggaggtatcgggaggagggcaggcgccacggtgatgctcaggcgagggatgcatgcgaaggagagtgcgaccggcgcggccgtcggcaacggtgacgcttgacctgcctgccgatgagccccgcaaacccttgcgcgcgccccccccacaccacacacacacacacacacaattgcagatgatcgtcatccgatcctttgacgtgaacaagcccgggtcggaggtggacgagctcaagggtggcgtggcggggggcagtatcctgcaggttggtgtgtgtggagagggggggggctcagacaaccttgtgagtgcattgtgtgggtgtgggtggatggatggtggatggtccgtgggtcgattgccatgtgggtgcggaccggttctcaatggaggcgtttttcctgggaaagctccaggcagcggggcctttcacgtcctgcaatgctgcgccttcttaccgccgaccctcagattgtcctcctctttcccgctttttgtattgctccgctcctccctccttgctcctccttccctcctcccgcctccctttcatgttcccggacccctgcggcgaacgcacggggcgcctgacaaaaagcagagaccgcagataatggcatgactcggcctctcgtccagctcaggcacatcaaaactccatcctttcactgcaagtgggcgtggtgacgacacacgtcctgatcctcgactcaatccacagtgacacaacctcaaccttttgtacatgtcctttcacattcgcatcccctcttgctggcggcactgtgtgatgtccttggcggccttgggtggccacctccccgcccggtctataccatggcgcctcgcgcgcagacccagcacccttgtgcttttccatctacttcgagtccccccttggcccgccagccttttcttggcgtgcctcttactacaacaccatcatccttcccatcccgttgcacatccacatgccggcgtacgcccatcaaacctcacaccaacagcacaccctcactcccacacacacacacacaccagggcgtgctgcgcatgggtcaggagatcgaggtgcggccgggcnnnnnnnnnnccttggcgtgcctcttcctacaacaccaccatcctccccatcccgttgcacactcacatgccggcgtacgcccatgaacctcacaccaacagcacaccctcactcccccccacacaaacaccagggcgtgctgcgtatgggtcaggagatcgaggtgcggccgggcatcgtgaccaaggacgccagcggcgccatccgctgcacccccatctactcgcgcatcgtgtcgctttttgcggagcagaacccgctccagtttgcggtgccgggcggactcattggtgtgggcaccaccgtggaccccacgctgacgcgcgcggaccgcctggtcgggcaggtgctgggcgaggtgggtgcgctgccggacgtcttcaccgagctggagatcaacttcttcctcctgcgccgtctgctgggcgtgcggacctcggtgcgtggcctggcggggtttggagggggcctttccatgtgggaggggacggggatgtgcagcggcgggggctggcgacgggggcccagggggccaagcttggtggtgtcggagggagtcggattggaccagggcgaaatggatgcatggttcctcgccaggcatcggatgcactgatgccgagggaccaggtgcccgccctgttggtgcgacgaggtgaccctttccctgggtcatatcgtgacccnnnnnnnnnnacaagggggccaagcttggtggtgtaggagggaattggattggaccagggcgaaatggatgcatggtcccttgccaggcatcagatgtactgatgccgagggaccatatgcccgccctgttggtgcgacgagatgaccctttccctgggtcatatcgtgacccctgtgggccatgactaacatgtaacacccgcacccccccaaccccacccctcctccgcggccaaacagggagaggagaagcagggcaaggtgannnnnnnnnnttgacacgtaacaccgcaccccccccaacccacccctcctccgcggcttaacagggagaggagaagcagggcaaggtgagcaagctgtccaagaacgaggtgctcatgctcaacattgggtccatgtgcacgggagcacgagtcatcgcggtgagtgggcgtgctgggtaacaacgcttgttatgcgtcgatgaggcgacggcagagcctgcagtggcggggtgcccagccacctcccggcaatcaccttctcctcaatcatgatgtcgcgttcatgagcagcagtgcctgtctgaaggcatgcacaccgaccggtcatctcacccaggattgcctgcccggtgacaccatgcagccttctccacactctccacctcgcatgcatgcaggtcaagcacgatctggccaagctgcagctgacctcgccggtgtgcacaaaggagggcgagaagatcgccctgagccggcgggtggagaagcactggcgcctgattgggtggggtcagatccagagggggctgcaaatggacatccccgcccggacctgacacctgacagctgtccaccgggccccctctgtacccttgccccccgttttcacgaatgtacattggttcccgggcttgcccactcgcacggaaagcgctcagacgtccaggcctcgtgatcccaggcagatcaccatcggcatcggcggcgaaaatggcgccggggctcacgatccagggcagcacctccgaggccctcgcgcaggcgctcgcggtgggcatcgtggcccgacgccggcgcgatgttgccatgcaggcccttgaatcgcgatgtaatgagctcgaccaggagctgaaacggcgatcgggcaagcatggggcgggaggccccgaggacgtctggtggcagctgggagccgaggacgggcgggggagccccggcgccctcgaccggctggccggccaggtcacctgcgctgcgctgtggcatgccgcggcgcagcgcctcccccccgctcccgctgcgaccctggcgggggtgcaggcgtacctttccgccaaggagtgtgcgcggtggagagcgggcaacgcggcgcccctggcctgcgccgccagcgtgctggagcgctccccagtgactgccgtcctggaggtaatgcaggacggtctggagctggaggagcgaggcgaggcggggtgcggcgaggagttcattgcagcggccccccccgccgagggctgggagggcgacgnnnnnnnnnnnnnnnnnnnnnnnnnnnnnnnnnnnnnntgcgtgtcctgcctgtgcgccctgctcgaatttggtcccggggccgaggatgagggggaggaacgacacgacaccgcttgcgtccaggcctttgcgcgctggctggcggagcgcgtctgcgagcaggggccggaaggccgggcgagcaccnnnnnnnnnngccaacacgacaccgcctgcgtccaggcctttgcgcgctggctggccgagcgcgtctgtgaacaggggccggcgggccgggcgagcgcccgcctgctagactgcatgaccggcgcggcgtctgcgctgctgccgtgctgcgccgtggcgctggccgaggcgctggcgggcgcggtggaggccctggtggcggtcgagatgggcccggcgccggggcgggacggcgggccggccgacgacccggcggcacggtgcgtcgcgctgag

SEQ ID NO: 30745 - DNA, 101 bp, Chlorella protothecoides
tgcaagtgccatcctgagacacaagcactccgacatcgtcctcacaaagcagtaaacaacggtggactggacccaccctacgaaaccctgcagccagatca

SEQ ID NO: 30746 - DNA, 79 bp, Chlorella protothecoides
agaagccctgggagttgtaggcgcagatgctggcggcatcaaacaccccacttcccgcgctctgcagcgtcagggtgga

SEQ ID NO: 30747 - DNA, 158 bp, Chlorella protothecoides
aattccaccctggggtatcctttgggcgccccccccccccccccccccgacttccccaccgaacctttctcttatcacctccctccaggctgtcccgcctcttcgtgtatggcacctgcctgcaaacgcggaacaacgaaggctccggctgctccagc

SEQ ID NO: 30748 - DNA, 61 bp, Chlorella protothecoides
ccaaagctgggagttccaacatcggcggggggcattagacgacggagtctcaacataatat

SEQ ID NO: 30749 - DNA, 112 bp, Chlorella protothecoides
gactcgggggagaacgatgacgcgcatgcttcgccaggaccctgcggtgcactcacccggcctcggcagcactgcgcaccctgcgcgaaccaaatccgtcccccgcagcttg

SEQ ID NO: 30750 - DNA, 61 bp, Chlorella protothecoides
ctgattctatacgctgcaggagctgttctcaacctgcggcgaggtgatccggcacagaatc

SEQ ID NO: 30751 - DNA, 183 bp, Chlorella protothecoides
cgtgcatgcaagcccaatgtatatgcaaaattcaatatgagtttgaaagataatatttggcttcggccacaggcctcatggtctgtgaatggtgcaaatgtgcccatgtccctgtggggcgcgcgcgcgactccacccttcccgttgtgtcactcgtacctacccacctatggggcggctgcc

SEQ ID NO: 30752 - DNA, 80 bp, Chlorella protothecoides
caacgcctcttgtaatgcaaaaatataacatctccatgctgtcatctaaggcatgctacgctcaatctcgcttgcaagca

SEQ ID NO: 30753 - DNA, 129 bp, Chlorella protothecoides
gaagtaggtctggacctgcacgggcttttggaggtcgattctcaacatgaattcggatgtgtgtgtgtatatgtgtgtgtgacaacagaaggtggggcgcggcgcttctgaagatgcaacattccatgt

SEQ ID NO: 30754 - DNA, 61 bp, Chlorella protothecoides
cggcatacagtgtcgtctgcatggtcggtggtaagggccggtgcgggggggtgctcctgga

SEQ ID NO: 30755 - DNA, 117 bp, Chlorella protothecoides
cagggcaaggaggggttgaggctgtacaggcgcacagggtggcaacaaggaggctgcaaatggcgacgcccacagcctgacgccacgcacagcccaggatcgtgatgccccactggg

SEQ ID NO: 30756 - DNA, 103 bp, Chlorella protothecoides
atgcagacggcggtggggacgccatctcgtgtgcagatgtgcggataacgagccccattgcatagccctacgcccgccacaggcgcccccgaacattcaacgg

SEQ ID NO: 30757 - DNA, 8351 bp, Chlorella protothecoides
  modified_base (348)..(357): a, c, t, g, unknown or other
  modified_base (602)..(611): a, c, t, g, unknown or other
  modified_base (1925)..(1934): a, c, t, g, unknown or other
  modified_base (2211)..(2220): a, c, t, g, unknown or other
  modified_base (2581)..(2590): a, c, t, g, unknown or other
  modified_base (2929)..(2938): a, c, t, g, unknown or other
  modified_base (3385)..(3394): a, c, t, g, unknown or other
  modified_base (5377)..(5386): a, c, t, g, unknown or other
  modified_base (5744)..(5753): a, c, t, g, unknown or other
  modified_base (6240)..(6249): a, c, t, g, unknown or other
ggaggggggggggggctgccagccacgaacgaagttgacgcatcgacgaatgttacatcgacctccacatagggcacccacacccatccacacctgtgatggagtactccatggaggcgtagcctcgggaccgcgacttcagcgcgtcaaacaggtccatcaccacctccgcgagcggcatgtcgtacaccacggtggtccgggcctcggtcatgaactgcatctcgatgtgcctggcggttgttgggagggggttttgggggggggcctcagatggaagggcgttgggttcaccgtgccgcgctgcccacgggacaagcgagggagagatgagggcaaacgcacagnnnnnnnnnnaaccagggtgtgcagaggctggatgtgcctgcattgctccccgcccctgcatctggactgcatcagtggccatgtcccccttctccaatcccaaggcctggacccctgcaaagcgtgccgcgcctctgtcctgccatggcatgtccatcccaccgtgccagctccttgtgccaccccaccccatcccccactgggggtgatctccgccccggggccccacacctcccatacacttccatgcctgnnnnnnnnnnggcctcccacccggggatgtgagcgcaacagccccaccccaccatccgcacgacaggcccccaaaagggcgcgctcactctccgcgccgggtctggagcaggtccaggatgggccccacatactccttgggcgtgatgacctccagtctgcttggtgtgaaggattgaaaatggcgggtcaacggggatagggatgtgagctcggcgaggtcgagtggcgatctcccgacgaggatgtgcagaggctggatgtgcctgcattggtccccacccctgcatctggactgcatcagtggccatttcccccttctccaatcccaatgcctggacccctgcaaagcgtgccgcgcttctgtcctgccatggcatgtccatcccaccatgccagctccttatgccaccccaccccatccccacttggggtgatctccgccccggccccccacacctcccatacacttccatgcctgccctcacctgacgtagggctccagcacagccgacagcgtggcggcgggcggcagcttgctggggcagtccacgacgtgctccgcgccatcgctggtgcgcgcgcggaagaccacagtgggcgcggtggtgatgaggtccaggccgtactcccgctccagccgctcctgcacgatctccaggtgtagcaggcccaggaagccgcagcggaagccgaagcccatggcggaggacacctcgggctcgaaggacagcgcggcgtcgctcagctgcagcttggtcagcgcctcgcgcaagcccccgtactggtcggcgtctgttgacgcatggggatttcaaggatggggggagacgacgtcagcgggacgcaaggacaggtcggtgggaagctcggcagcggggcacaggggagaaacatggaaactcagaggcatcagcacgctccctgcagcattgtgccaagtgtgtgacgccacagacccgatgcagcgccggcagtcgaggcgagcccctggcccagagggcaggcgccgccaccctcagcctcgccgagcactcccaggaaccgcctttgctaccccgcaccgatggtgaacatgccgcagaagaccatgggcttgacctccgtgtatcccggcagcgcctcggtcgcgggctcgcgcttcagcgtcaccgtgtcgcccacgcgagcgtcggccaccgacttgatggcagccgccaggtagcccacctccccagcatgcaggctctccacctgcaaatggttgagtgggtggggtgtggtgtggtgatgatggtggagaggcgggggcccaatccacaggggtacatgtgccgcccaggagnnnnnnnnnntttgagtgggtgtggtgtggtgtggtgatgattgtggagaggcgggggccccatccacaggggtacatgtgccgcccaggaggcttgcagaagaaagggcggcgctgcctgcccccccccgatccccgctgcccatcctcacacccaccgcagacccctcccaagcaccgagatgatcccaactgccccctgctcgcaacacgccccttcaaatacccccccccaccccacatgccacacacccaggggacccacctcgacggccttgggcgccagnnnnnnnnnnacccccccccacccacatgccaaacacccaagggacccacctcgacggccttgggcgccagcacccccagctcggccacgggatgctcgcaccgcgtgttcatgaagcgcacgacgtcgcccctccgcaactcgccgtccatcacccggaactgggccaccacgccctgtagtgagggaagggggagaacgtccagcctccagttagaggagggggccaaggcttgtcgaggtgggatgaccggacggtcgccccgctcggcgacccacgcccacgccccttgctcatccctggcgacaggcacggggacgtggggtactcaaccctcgaacaccttgtacgggtcgtagtaggagtcgannnnnnnnnncgacgtggtgggacgaccggacggtcgccccgctcggcgacccccgctcacgccccttgctcattcctggcgacaggcacggggacatggggcactcgaacctcgcacaccttgtacgggtcgtagtaggagtcgaagatgagcgcccgtagcgggtccccccgcgtgtccctgggtggcgggatgcgctgcaccactgcacgaggggggcgcggtgggggatgggacgtcgccatgtctccagcatgcgcacgagcgcacaaccatacacgtggcgttccatgccgccacaccatttcctgaacaacctgctcctcctttccaatatatgcccagccnnnnnnnnnncgcgcggtgggggatggggcgtcgccaggtctccagcatgcgcacgagcgcacaaccctgcacgtggcgttccatgccgcaactccatttcctgaaaaaactgctcctcctttccaatatatgcccagccctttcacacccctcaccggcctccaggacctccgcgatgccgatgccctgcttggcagacacgaggagggcgtcggaggcgtccagcccgaccacgtcggtgatctcctggcgcacccgctccacgtcagcacctgcatcaccgcgagaaggtaggatggcgggtggggggatgggtcgtggcgccaaggcccagcgccaagggtctccagagtggggcgagcacgtcggtcaagctattcaatcggcccgcttccttacatcctcagcctcccacctcctgcgctccaacccccaacatcaccccccccccccggnnnnnnnnnnatcagcacctgcatcaccgcggggaggtaggacggcgggtggggggatgggtcgcggcgccaaggcccagcgccaagggtctccagagtggggcaagcacgtcggtcaagctattcaatcagcccgcttccttacatcctcagcctcccagctcctgcgctccaacccccaacatcaaccaacccccctctctctctccccggacccccaacacaacacacacgccgcgccatcccccttaccgggcaggtctatcttgttcagcacggggatgatggtgaggtcggactccagcgcaaggtagacgttggccagggtctgggcctccacgccctggctggcgtccaccaccaggaggcagccctcgcaggcggccagcgagcgcgacacctcgtacgcaaagtcgacgtgccccggggtgtctatcaggttgagcgcgtactgctggccgtcggccgcgccgcggtagcgcatgcgcgccgcacacagcttgatggtgatgccccgctcccgctcgaggtccatgccgtccaggtactgggcctgcatgtcacgctgggccacgctgtgcgtggccagcagcagctggtcggccagtgtggacttgccgtggtcgatatgggcaatgatgcagaagttgcggatgtgggagggggggacctgcaggtgggggtggggtgggggagatggggccctgatgggtgagcgcgcatgcagggcatgagcatgcatgggatagaaggtggccccccttccctccctggactcatgccggcgacggtgtccatgccatccaacggccccaccttggcaacgttattggcatgggcgaggtcgtcttgcacggactggtccccaagcagggcgccgaccgccacgcgggggtgccggggggcggataatcggtgtgtggagggggcatgcggggaggctggagcacccgaggcccgatggcgagtgatgagggggtggagctctgggggttgggctgaacatgtgaaaggaacatgggatttccagccccggccacgccatgccacagagctggcgcgcatggtctgcaccgagcaaggcattgctccagaggtttcgcaggcgcggcacgcttagccgggggagggtgtggtgatggagcagcgcatcatgaaaactcaacttgttgatgagtaccagggtcgcaactgttcatggggtgtgatgcagcagaacctccgtcggaggggcgatccataactgtgtgatacctgtgtgcggcgcgtgctgcggggttaatgatggggaagctcctcatggagtcccgcccaacaaccaagcatcgtacacaaaagccagggaatcacaaacagagcgggtcagtctcatgggatcgatcaagcggcgaggggggggacgtagaaggactgctgcatccgtcgcagccgaggtgctgccctgcgccactgccgcccgttggcagtgatggtgagcaggaacacgcggttccccaccgcagtcgccgacaccaggacgtggggcttgacgtccctgcacacatttgggggtggttgaggcctcaggggtcgtcgagccgggagcaggtgggcctgcacagcgtgggagggacgcccacggcccgcctcctcaccattggtagtaagggatgccgtccttggtttcggtcgccgcccggatcacatcctcctcggagatggggctgcccgtgatctcgggggcgaagcctgcagggcggtgtcgaggggggcaggatgaggagggcagcaagtctgtggcgctgggctctgtcgcagccaggcgcggcctcacctcacgcatcacacccagtcaaaggtgtggggaggcagggtgcgccgggagggacccagcggaggaagcgccgtgcagggttaccaggccacgcacgagtgtcccccccaccctctgccctccccgcatcacctgtgaggaccttctcagggctcccgatgtcgctcagcgtgacgttgnnnnnnnnnnggcacgactgtccccccaccctctgccctccaagcagcacctgtgaggaccttctcggggctcccgatgtcgctcagcgtgacgttggcattgaagcccacgtcgaggaagcgcaggatgggggccaccaccacagacagcgccccctcatccgggctggagtagcgcatgtcgatctcggtgcccccaaggtcggcgatggacacgggctgctcctcccagcccgaggggatgaccagggagtagcggggcatctcgctccagcccacaccatggccgcctggggggggaggggaaggggtctacgtggggggtgcaccatgcacaagggcacggatcatggcaccccgtggtgtgnnnnnnnnnntggggggtggggaggggtcgacgtgggggtgcaccatgcacgagggcacggatcatggcaccccgtggtgtgagcaagcagcgccaagagggtttctcgggacaggtgagccatgcactcaccggactttccctctggccgggtgtagtgcaggaatccttcgtcgtcaggctcgcctgccccggggaggcgcccagcgatagagccctggaccgccccagcatcattcgggaggcccgtgagcaggcctgtcgacagaccgagcgaggtcatgacccgcctcctgtccatgcgaagcccctctgacatcggggcaggagttgcggggcggttcctgtccagtggccccggatgggcgcagcaaacatggagggctcgacgccacacaacggcccgcgatgccattgcaggggcgtcagcagttttcattcttcctgatatcgacaacatgtgtgcgaaggcgactgccttggctcacatggaagannnnnnnnnnccagcagttctcattcttcctgagatcgacaacatgtgagagaaggcgactgccttggctcacatggaagacattgtagtccgtgacccatgtgctagggattccggtttccaccccacttcggcctttcattaccgccatcagagcccaaaatcaagcttgatcgaccgccaaaatggctgaaacacggcataatacatcgcagccggcaagcaagtgtgcgtgttctatccacaggaacgtccaagaggcgcgaattttgccgcttgcgtttattgcctagttatggtggtgccccccaaacccgaagtcaccgcccggctgctgtgggatgtcgtgcttgcctcctgctcatgcctctcctcatctcttcggagtgtttgcgtgacgcacaaacgaggggcctatcacacatcatagtaaaggcttatgccatcggatgcagacgacgctcagcagttctcagcattctgtgtagaccttccagctcacagtgttgcaaggagaacaaagcctgcatgaaaaaggttgagcgcaggcattgcttcgcagcagtgcagggacgatgactgacgaataaaatacctttgaacctgcagagattttctttagtcggagtgggtctgaatcgctgcttgatatgtcggcgcgggtccttacagcgctttatgctaccggcaggattctccaggagggcagccttaccccttgaatgcgcatccccggactggagcggcgtgggaggaaaagagatacaagagcgacctcagcatacatagcactgttcagtttctctttgggtatttctgcttccacaaagtatctctctggtcggcacagaagtttgcaagggttcgtacggcacgatgacgtcgctgggcggaccccgtgtatttagcctggcgcttatcgtgctgagccttgttgtctgctcgaaggcaagaatcaagaaaccccgtgatgaggacaaacatatcgctggacgggatggtggttatcaccatccatttccgaagtgcgacgcccgcaagcctctcctcctcactccaacggcgcatgcacctccaagttcttctcactcccggcagccacgtgagttgtggctggcgtactcggtttcttggtttagcggtcatcttttaccgagtttgcgaatctctttctggatgcccggacctcgcagcgtaaacaggccgcggcgtccgggcactgcttgttgaccgctcagcctcacccccgccgtccccttcaacaggtatggaccacacgtctacatgctggatctcaacagcgcggagaccttctgcaagtatgtggttggatctggcatgtatatcgcttgattgcgcatgtctgtgcaaatgggtgacacttgctgtaaatctccctccggttgttgtgctgacttcttctcctcaaccctcaaaggtcacaagggtacagcaaggccggcactgtcaaagagaccactctcaacatcttgggtctcctagtcagtgccatgaggatgagtcctttcaaggttctgaagaggtggtctaccgagatcatagtcagcggtgaacgcctctaggcgggacggaagcgtgcacggttgacgcagatggcaacattggaactggaaacaagggtaagaacaacctttgtgactataaggacggcaacaataacattggtgagcgggattagggaggcaatgtgtgggtctgcttgagagtggctgccagagcctgaaaggaaggaagggtgcatgacgaatgctccacttgcccactcccctgcacgctctctgtgtgcagggagccacaacaagggcaacagcaactggggagacaacaaaaagggcaccaatcttcggtgcaacaatgcaatgggaacttgaaaggttgtcaacacatgtatcctcaagcaactccgcacttctgtgcgtgtgaactgcgatcccccgccgcctccgcctaagaaagtgatgcctccaccgcctcccaagaaggcttccccaccgcctcccaacaaggcttccccaccgcctcccaaaaaggcatctccaccaccccctccagtcaggtcaccacctccaccaataactccaagcccccccc

SEQ ID NO: 30758 - DNA, 70 bp, Chlorella protothecoides
gggttgtatgttggggttgaaaggtgcctccaaggtgggattgggaggtcaagtggggtcctgtgatagg

SEQ ID NO: 30759 - DNA, 112 bp, Chlorella protothecoides
tgtcaactactccaaggcaagcctgctcggcgtacttgtgccactcccgcagaaccaccattccacactgaagtacttccaagtcaccttcttcgctcatcatccctgcgac

SEQ ID NO: 30760 - DNA, 68 bp, Chlorella protothecoides
cccccaacaatgaggggcagagccatccccggtactcactcaccgtggcctttgtgctgtcgctggcg

SEQ ID NO: 30761 - DNA, 132 bp, Chlorella protothecoides
aacctgggcatgctctcgatgccaagcccccggcccgaagcatgctgctgtgcgcccatgaacgggcaattttatccactttggagccgaagactcatcatcgagccgaaagtggcaagatgcatgcgcatt

SEQ ID NO: 30762 - DNA, 61 bp, Chlorella protothecoides
cgttcttccggagttggggttggggggggggggaacccgtcgggtttctgggtgttcagtg

SEQ ID NO: 30763 - DNA, 9663 bp, Chlorella protothecoides
  modified_base (819)..(828): a, c, t, g, unknown or other
  modified_base (5088)..(5097): a, c, t, g, unknown or other
  modified_base (5283)..(5292): a, c, t, g, unknown or other
  modified_base (6270)..(6459): a, c, t, g, unknown or other
  modified_base (6519)..(6528): a, c, t, g, unknown or other
  modified_base (6588)..(6597): a, c, t, g, unknown or other
  modified_base (6826)..(6835): a, c, t, g, unknown or other
  modified_base (7505)..(7514): a, c, t, g, unknown or other
  modified_base (7833)..(7842): a, c, t, g, unknown or other
  modified_base (8269)..(8278): a, c, t, g, unknown or other
  modified_base (8739)..(8748): a, c, t, g, unknown or other
  modified_base (9087)..(9123): a, c, t, g, unknown or other
gggcgccgagcgcatggtcggcagggccggcggcaggcccgcgtccgagctcgaccccgcctcgccgggcgcgggtccggagggtggcgaccccgcctcctctggcccggccgcctcgggccccggctccgaacccccccctgcctcgccaccgggcttccgccccggtcgccctttcctggggcgcgccagcgcggcggagtgccgcagcgtggacctgtacgagaagctgaaccacatcagcgaggggacctatggcgtggtgtaccgagcgcgcaacagcgagacgggcgagatctgcgcgctgaagcgcgtgaagctggacaaggagcgcgacggcttcccgctgaccgcgctgcgggagatcaacatcctgctgtccctgcgccaccccaacatcgtcaacgtgtcggaggtggtggtggggtccagcctggactcggtgttcatggtcatggagtacggcgaccacgacctggcgggggtcatgcgccggcgcctgcgccagcccttctcccccgccgaggccaagacgctgatgaccgcgctgctggcgggcgtggcctacctgcacgacaactgggtgctgcaccgcgacctcaagacctccaacatcctgtacaccaatcagggcgtgctcaaggtctgcgactttgggctggcgcgccagtacggctcccccctcaaaccctacacccacatggtggtcaccctgtggtaccgcgccccagagctcctcctaggtgtgtgtcggggcgggttgtttgtgtgtgtgtgtcagggagggtgggggagtagacgtcccagctgtgagtggannnnnnnnnnttgggggcgagttatttgtgtgtgtatcagggcggggggggagtagacgtcccagctgtgagtggaagatgagggaggatggaggagcgcgaagcaggtagattgaccgggacaggttcacgcccctggctccaaagagccccgctttcaagccagcctgtcgactgccaccatgctgtcgacattcacacgtgccccaccccctccgccccttcaccgtgacctcatccctcctcccccgaccgaaatacccaaacaggtgccaagcactactcgacggcggtggatgtatggagcgtgggctgcatcatggccgagctgctcacgcgggagccgctgttccctggcaagggcgagatcgaccagctgggcaagatctttggcctgctgggcacgcccaccgaggagacctggccggggctggaccgcctgcccaacttccgcaagttcaacttcaggcaggagaggaagaacacgctgcgagccgccttcccgcccccgggtccggtgtttgatgggcggcccacgctgagcgaagcagggttcgacctcctctcctccctgctctccctgtgcccggtgagccaaggggttttgtttggggtcccgattcatgcatgcacattatgtatgcgttcgcaggggtgagcgtccgtttggctgaagatttgcatgcgccatggcccagtctctgcgagcatggctgagtcgggtggcttcccattgccactgcaccgagccctttcaccatcgattcccaccaccaccaccacccccgcaggagaggcggatatctgccgccgaggcgctgcagcatccctggttcaaggagcatcccctgcccaaggacacggcgctcatgcccaccttcccatccaccgcggccgcccccagcagccggcgctgaccctgacggcactgccttgcctgaccctggaatgctcggccccctcaccgcagcccagcttgaaatgacggcgtgatgcccacgccatgttatacgcggcagcactatcgccccagggctgcacggagaaagctggcgcgctttccaatctccggaacgcgcgagtggatagaaattgcatgccgtgggtggagtggtgcgcatctgcatggattttgggccatcgagaagtgattgatattagaagtttgaatatgtgcaccgcctgaatatccgtcctcgcaaacggtgtcgtgctcggaatgtttgcaaagacggtatcttcgcccgtcggaacgtggggccggggctcggaaaccttgccgcacgggacgaatgtcggtcgggcatttcgcgcaggcactcacaagcccatgcaaagatccacatgcctccgagtcgtggcggttctggctgagccctccaaggcggaggtgtatcaaccggcaaaaccccatgccccagcgccctaccatcgcaaggtgcgtggggcacgaggccgcccgcctgagctctgggtgtccggtgccaagcttggtcatgccccacatcgcatgtgtgcatgcgcctgcaggctgcacccaggaacaacaagggcgagaggcggccaaccgacctggagctctacaacgggctgtggctgggacagacggtcctggggcgagtggtggtatctaccaggaagggggccagggttgagattctcgaggcccacaacacccccacggacaacctgcgccacaggcatgggtgcgctgagcgtttgggagtgcttggatggggcgacgaggttgatgccggcggcctggggtagatgcatggaggtggggagcagtgggcgtggctttgcagcagtccagcacgtgtcaaattaatgggctgctgtcctgttcttgcagatggatgccaataaccgacgggccgcttgccgtcagggataccgcagaggtgcgggagtgccaggtgaggaggctgtgttgctgggattggcccagagagtgactccgggattacatttggcatggcactggggatcagctggtcccggggtcttgcccttgctcggctttgtatgcaatatagctgactgctttcctggggcctttgcggactgtcacttcacatcctatgcttgcaaggaatttgaacgtgtcatctttccttgcctgcagggtctatcgcggcccctggtcccggttggattgatccgtcccttccaggtcaaggccctgcccacgcccgaggccgtgaccggcaacccaaacaacactgcgggccccttgctgtcagccttcctccacgatcggaggaccatgtggcaccggggctggcagctgcagagctgcaaccgtgaggtgcggagaaggtgtggagtcacactccccagtgtggcccaggaggtgctgctttggcaggtcatgccccgtgccagtcataactccatggatttgggagcgtctcactcctcagtcctcctccgtgacgcctcccatgcatcctcctttgcaggaccgggagaacgtgatgatgcgtgtcgagggcgtgaatggcggcggcctcgtcagcagggtctgcggcctgcccatctttgtcccctactcccaactgcacaaggacagggacctgcgatatagtgaagaggtgtggaccagtgcagaggggagaagggaacaggtgtctgagagtaatcgtatggaggagccagcagcgtccaaagctctggctgcagcctcacggggcgtgtagaactggcaagagggcgcatgtctccctgtatgttttgctccctgccgggaccctcctccaagcttggatcccagagctgatcacatccaccaacaccacaaccttacaggagctccgggagagatatctgggcaaggacatcgaggtggctgtgattgaggtggacatgcgtagccagaaactggtagcctctgtgtcgcgaggcctgagcaactccatcatgcgtaaattccatgtgagcgatgcgtctcctttgctttgcttcgctgatagaacagtgtgttggggaccaaggggggcatgctctaatctatgcgtggctggggctggatgtgaaggtggccgtgcagaaagagtctctagattacgcctattgaagacttcatagcattgcgaggtccatctacctttgacccccgactgatcaccccctgctcaggtcggacacctggtggaggggatggtgcgccgcatagaccggaatggggtcttcattggcatcaaggacaccatggagacggggctgctccacatcagcaacgtgtctcgcaagcatgtcccagacgtgtcggtgagtgcatgcagtggtctctcgtggtggttaaacctggccacaatcaggagggggtggctcatggtaggcaatggagcgctggcccttgacagacaatgttctgacccacaggatcccttcccatttcatacacaaatccctgccctatcatcgggtgtgcaggaggtgttttccgtgggagagatggtctgggtgatggtcatgggattcgagcctggattcggcaaggtgtccttctccacagcggagttggaggtagaggacggagacatcatgaccaacaaggagttgtgctgggagaacaggggtgagtggctgggttgggagatgatgagcatggagtgatcgatgaaatgccactgcttggggaggcagagcagctggagtcgtgacagagtgcccaatctgcaaccatggtccgaacaacgtgctggaaggtgcaaagaatgacatagctgtccaccaacttccagatataatcccccaatcatgcagaagcgcagcagaagaagttcttggaccatctggcgagtctacaggagggcgatttcaactttgagctggtgagttggtggtcggggtggaggccatgcctggccgagccgttgccgtgcctgacttcagttgcctgtgtgctacatgtagcctgcggccctgcacaccataagatcgtgcctcgggaggctacatttttgtaccaacagatgagcagcagcgctgacaattctgcatctctatctccccacccccaaagttttacgagtccaagaggaattgagataggggaaggatgctcctacaaagtgttcattgcctggtgaatgctttactcaaaacttcttccctcttgatacaccatttcatgaacatctatgcttctccaggcatgacgccggctcatgcgtgtttttctagatcgtattggcttggtcaactctgtaacatcgagaaaaagcgtctcctgagggagtcgcagtcaggggtgaagaagcannnnnnnnnntccggctcatgcatgtttttctagattgtattggcttggtcaactctgttacatcgagaaaaagcgtctccggagggagtcgcagtcaggggtgaagaagcaaacattgcttgccaagcgcagctctgccgagccacattagctgcttcagggaggggctgcaatggcctacacctttgagccacnnnnnnnnnnttgcagctctgccgagccacatcagctgcttcagggacgggctgcaatggcctacacctttgagccaccgaatggtccaccatcagtccccagggcagtcgcaaatggcatgaatgcgcttgcaactgatagggtgtgcaagcgacctccacaggggtcactcatacacacacagaacctcatttggtgtgtggccgtacttttgccttctctgcctcaaggatggcctgtatgtgcgccaccgtcctctccatcgccccatcggcgttaaccaccactgcgagttgtacagtggggacacaaacttgaacgaggcctcagagtcgcaaagactctgtgcatacaggcccaccctacagctttcccaagcaatcttaccataatcgaactcttgtgcacgctcgagctcggccttggcagtctggactcgcttgacgagactctcctgcagagaggttggatttgtgggatgtgtggggagaaagggcaactgaaaagaaggccctggtctctgtggaaattacaaaatagcacaaaaccagtgcttcatcaacatccagacatagcactgcgcaccagcttatcagtcttcctcgcaatgagtcgttgtactagactcttttctgtctcagcaacctgaagttgggtagtgagcacgtgggacaagggggtgctggtcagatagtcgaaatgagcccacaaattgcaggaccatcgagccacaaagcaagcaatcccctatcccccaatcatattcagaagcatctgggaggctgatccccatgtaaccccctgctcacaaggaagacggagaccactcccggcagcatggagcgaacagtggctgcgccttggacatcaattctgaggatgacatcctttccagcagcaattgcggcttccacctgacaatagagagcaattttcacattgtatgtagattttaccctgagatcggccccagggcatctgctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcgaggcttcctgaggaggggaggagacttgtttgtgcacagggtgacaccttacannnnnnnnnnggggcgaggtttcctgaggagggagggatacttgtttgtgcacagggtgacaccttacannnnnnnnnntgcttccacctgacattgaagagcaattctcgcattgtatgtaaatttcatcctgagatcggccccagggcatctgctgaacaaccgcccagagggtcttgcctggggtcgagggattcctttgtaatcgccatagacgagcgcatgttccagcagttggccctccttgatccaggtctcaaactgcgcctcggacacaaagtgatagtccacaccgtccacctcgccnnnnnnnnnntggcattgctcacatgttcagcccctatatacatacaatttccagaccattcgcccttctgcacagcctctagccaaggcatctgacctcgtggtggctgtgacaatgaaatggaggtctgggttggccttttggaatgtgttgagcactgcatccttgccgaccccactgggtccactaacgacgagcaccaatggtctaggggcaggcacctgtgatgtgaaggtgtcattgtgcagtccaggagaggatgaggcacaccgaccttctcgtgcatggactatggaggacaatgttgcattccgagaccccgttcctgttcccgacagcgccgcaccaatggcctgctgctgaagttgccgatgcgggcctccaggcgctgcaggacatcttgggtagaattcatgacgagtgtgcaactcacaggccgaaccgtgccatgcctacatgcctcggagatccgtgacgagcttctgactatgctgcgatgctgacccgtgcgtatccaaggcacgctcaggatgcatcgcaaggcggcagctgacattctaggccgatgtaaaagtcatggcttctcgcgtttgttgctctggaagcatacatggcgtgagagtcttgcgatccgctatggggctcagggcgcgagcacgtgcatggtggggtcgaccgnnnnnnnnnnccatggcttctcgcgtttgttgcactggaagcatacatggcgtgggagaattgcgatccgctatggggctcagggcgcgcgagcacgtgcatggtggggtcgaccgatgcctagcagcagcactgccagggtttgtgacccagctggtgcagccgcgcctcaggatcccatggccacttcaatcgtgttgtcaccttgatctccatccagcgcctcctgtgcatcaagagtgaggaagttggctaaggatccctgccaacaacaagcttgaccaagcacacccattgttcacgccgacagccacgccttgcaccgtccnnnnnnnnnnaaggttggctgaggatccctgccaacaacaagctcaaccaagcacacctattggtcacgccgacagccacgccttgcaccgtccaggcccaggtctgttgacctcctcaccccttacctggcagtgcacgccctgaatcgtcagccgcggtgcagcaaagctgcccgggaggaggggcacccagccggcctccactgtcgcaatcgacccggggcggccgcccaggcgcacgctcccgctccgcgctgaccctggcgaccagcctgggccctgattttgcgtgtgcgggggagcaaagcaatgtgtgaagaaggtccatgttggagtcgggcaagcagcagattggtatcagcatggactctgaatttctgtggcgtcggcacacgagagcacagacagctgcaggctgccgtgactggagcaatgnnnnnnnnnncttttgtgtgtgcgggggagcaaagcagtgtgtgaagagggtccatgttggagtcgggcaagcagcagattggtatcggcatggactctggcattctgtggcgtgggcacacgagagcacaggcagctgcaggctgccgtgactggagcaatggccatgacggcgccccgcactgcctcgtgcttctaccccctgttccgagtaggaaattctccgacccacctgcgcggcgacctcgtagtgcagcacggagtctttgccgtctgcagccccggggccccgctccagccgccagcacagggtgaggggctggccgacgcaggccgacatcgggcccagcagccgcgactggatcgtggtgcctgcgggatgccggtcggggtgcaatatttcgtactcacaggacggctggctgggacggcgcatgagcagcgcagcggtccatgtaccagggcggcccnnnnnnnnnncgcctgcgggatgccggtcggggtgcactatttcgcgctcgcaggacggctggctgggacggcgcatgagtagcgcagcggtccatgtaccagggcggcccctggaggtgccacgggacctccccatgacgcatgccactcccactccatccccagccctgcattcacgcacgcacccgggctggcatgctcggagggggccagctccagcgtgcaggcgtgacggaaggtgcacgcctgcacctccccgtcgccggcgtccagcgccacacacgcctcaccatcgtctcccggcagcagagcccgcaccgcctcgtcccagccgcgggcggcggccgnnnnnnnnnnnnnnnnnnnnnnnnnnnnnnnnnnnnnccgcggcgggcggcgcggcgcgcatctcgtacgccacggccagctcgcagggccgggcacgcgcggcctggcgcaggcgtgccgccaaccccgcgcgcccgccctcgccggggtccagccgcagcagccagctgcagtgcagggtctgcccgtgctccagccgcgcccggacccctgctcggtcaccctgcgcctccctgtctcccgtcgccaggtcccccgcctcttcctcgcacccctcctccaggcgcgcccccggctgggggctcagcgccaggccggtgacctccacggcgttccctgcggcacagcgcagcgcggcgccgagcagcaggcggccgccctcctcccgtcgcccggggacctcgcgcgcgctccattccacctcgaagggcggcgccacgcgcagcgcacagctcgccacggcgctccgcgcgcagtcctctgcctcccactccaggcccaggtccagcgccagcggcgcggcgcccgcggcgcccggaggaccccgccccggcgcgccctggttgggcgccgggg

SEQ ID NO: 30764 - DNA, 79 bp, Chlorella protothecoides
gaagaagcatcgccgccagaaggggggcgcacagcagtacgccgctggtgggggaggggaaggcatgcgcactccatgc

SEQ ID NO: 30765 - DNA, 88 bp, Chlorella protothecoides
agcactctcgtcgcccttgtaacctgtgcgtttggaagatggggttccagtgatcgacttgtttccagggtgaggttgaagtacaacg

SEQ ID NO: 30766 - DNA, 78 bp, Chlorella protothecoides
ctgcacaggcaaccccgccccgcttcccttcccccctcggccccctagcacctccccactcttccaccagcactcact

SEQ ID NO: 30767 - DNA, 73 bp, Chlorella protothecoides
tgcgctgtcatggtgtgcgtcatcagggtgggttgatctgcatggcactgagtggtggctagtgctgtttcgg

SEQ ID NO: 30768 - DNA, 105 bp, Chlorella protothecoides
cccccccccggcaccgatacgtcgcatcgacccggcattctgagccgagggtttccttttcttacaggagctcatctcaagccagatgggtccccccgtgacgga

SEQ ID NO: 30769 - DNA, 66 bp, Chlorella protothecoides
ctgtgcggatggcggccgcgtccagctcgacgttccgggcctccagctccttccacagctcgaatg

SEQ ID NO: 30770 - DNA, 61 bp, Chlorella protothecoides
aagagaccccagcttcaagtcttggtcctgaagccctgtgccacatgcgcagtgcctctgc

SEQ ID NO: 30771 - DNA, 66 bp, Chlorella protothecoides
ttggtggcgtggtggtggaagggcagggcaggacagcggcgtgcaagggtcttcctctgcacaagg

SEQ ID NO: 30772 - DNA, 79 bp, Chlorella protothecoides
cctaattatcattgccctgcccaacatctctcttgtgagcgaccggtttcagtccgacggatcacttaccgggagtagg

SEQ ID NO: 30773 - DNA, 106 bp, Chlorella protothecoides
gcagaagacgatgacgcggcggccgtccatttcgcgctccagcaggcgcagcaggcgcggcaacttctcgtgctccgacacgaagtcgaaggcctgctcgatcttg

SEQ ID NO: 30774 - DNA, 80 bp, Chlorella protothecoides
agtgaggggcgggatgagtggccattcctccgcatgagttggcgcggtccgtgcatgccacaccagcagcgccgctgcat

SEQ ID NO: 30775 - DNA, 123 bp, Chlorella protothecoides
caggtccttctcgctgcagagcggagagaggtgtaagggggcaaatcgacgacggtaacggaggaaggatagaggggcgatggggatcttgctacactcctgtacgcacaagtgggcgacgcc

SEQ ID NO: 30776 - DNA, 176 bp, Chlorella protothecoides
ggcaggcaggaggggcggcggtgagccaccaactccagtgggattatgctcctcgcaccagcgtggcacagtggacgccagcaccgcaaaggccctgtgcatccccccgggtctcacaggggcccgcccccatcatcagcaagtgaacgatgggggcgggcaacactcagagttgt

SEQ ID NO: 30777 - DNA, 68 bp, Chlorella protothecoides
tctcccgcccccagggcgaccccgttacacccccccaccctcttctggaccgccgcccccacgtctac

SEQ ID NO: 30778 - DNA, 103 bp, Chlorella protothecoides
gtgctgttacagaggccccctggtcttttggggggccgggggggggctgagagatcagaaggattgctcagttgatgcaatacctgactggctgtgagcacct

SEQ ID NO: 30779 - DNA, 98 bp, Chlorella protothecoides
cgttcctccctgcacctgctcaggggaaaagaatgggcgctgggaaagcggaccatgcagcactgcggccatcatctccaaagacccaaccttttctg

SEQ ID NO: 30780 - DNA, 64 bp, Chlorella protothecoides
cgacaggaacagcccccccttcccctcagcccgccctctcacgcgcaccggaggcatcgctgcg

SEQ ID NO: 30781 - DNA, 61 bp, Chlorella protothecoides
ggagcagcagaccatctccatcgccaaggcaggcatccaggccacgctgaacgcgcggacc

SEQ ID NO: 30782 - DNA, 92 bp, Chlorella protothecoides
gaacagccaagcgtggcggcccggctcaaaaacccccatcttcctccccttcccccctggagcaatctccagcgcacaggacattgacgccg

SEQ ID NO: 30783 - DNA, 75 bp, Chlorella protothecoides
gcccgaggcctccgatgccgatgtgatgataggacccctcacgttccataccttggtggagtagtgagagacctt

SEQ ID NO: 30784 - DNA, 3076 bp, Chlorella protothecoides
  modified_base (104)..(113): a, c, t, g, unknown or other
  modified_base (322)..(331): a, c, t, g, unknown or other
  modified_base (545)..(554): a, c, t, g, unknown or other
  modified_base (1584)..(1593): a, c, t, g, unknown or other
  modified_base (2197)..(2206): a, c, t, g, unknown or other
  modified_base (2563)..(2572): a, c, t, g, unknown or other
gccttccggggcggcagccacggtgcggtgatcgtgtgtgcggggctgggcttggggctgcgcagtgctgtgtcgggagtatctgcgaggggcctggcgggggnnnnnnnnnnaccgcggagggaggggccacggggcgcgccgacccgaccgccacgcccgcgggcaaccccgaggcgggaccccaggccctggcggccgccgggcacgttctgggcgccttccggggcggcagccacggtgcggtggtcgtgtgcgcggggctgggctcggggctgcgcagtgctgtcccgggagtatctgcgaggggcctggcgggggnnnnnnnnnntgcgtgcgtgagggaggggggttgcgcagagctttctcccgcgcttcaggctggtcgcgcgttggagatgggcatggcggtgtgacattggcggcgagggagcgtttgctcgtcggcagaatcgatgtacactctcatgcagggctgcagcgaacttcccgcccacgttccaagccacccattacgcaggtggccggagggagggagccgcctnnnnnnnnnnggccgtgcgtgagggagggggcttgcgcagggctttctcccgcgcttcagggctcgttgcgcgtccgggatgggcacggcggtgtgacattggcggcgagggagcgtttgcccgtcggcaggatcgacgtacactctcatgcagggctgcagcgaactccccgcccacgttccaagccacccatcacgcaggtggccggagggagggagccgccttcctggctgcggaggagtatgagtcggaggtgggtgctcttggaggggggtgctggaatcacggcctgcgtcacaggcaggggcttgggccgtgcggtgggggccgctgtcgcccatcgtgagcgggctggctcactgctcaggactcgtgtctggatgccgccagcgcgcgcccaccccgccgctgtaggctccttcgaaacaaagccattcccttttcccctgacccctgacatgcctaccacacgcagtcgggctctgggtcggagggagacatggacgagtacgactctggcgagtctggctcggggagcggctcggagggtgaggtgctgcggtggggagaaaggggctgggcgggcgggcgcaggtcgacggcgcccggcgcctgcccgacgggccgcgacgctcacattccagtggcacactttgactcgaggatcccaagcaccctcctcgccaggtgacgacggcgacgagtccatgagcgactcgcagggatccacgagcgactcggaggatgccggcatgggggcttcagaggacgaggagggctccagcatggcctcttccgagagcgaggggtccgaggagaggacggagctggtgctccgcgccgtctccaccggccacagcggcagcgacggcgagggggacgacgcggaggacagcgagagcggggatcaggaggaagaggaagaggacgacatggatgccgtcgaggcagagatggatgccgcagaggaggaggtgggtgggtgtgcaagctggctggttgtgccgtcttgctgtgtcgagggcagcgcgcgaggttnnnnnnnnnntgacatggacgccgtcgaggcagagatggatgccgcggaggaggaggtgggtgggtgtatgggctggctggttgtgccgacttgctgtgtcgagggcagcgcgcgaggttcagactgtgttggctggctgcgaggtgaactgcgcgtggtgtcgcgtcgcatggagcaccgctctgcagtgcagccctcgtcggcggcgccatgaccaatcctttccctcctccctcccagatgggcctggcgtacgacgacgaggagggcagcgacagcgaggcggaggacgaggcccgggaggatgcggaggaggaggccgagctggacgccatcgagcgccggtacctggaggaggcggaggcggacgctgactatgaggtgaggggggtcagacagagggtgggcgctgggggtgctgacaggggagttggaaatggcgtgaagcggtagggggctggcaaggcgtagggagagacccagcatgtgcctgcctcctggattggtgaccctcgaggtgcagtccacgattcccatatcaaggctacttcagcaaccccgcccgccgcgctttcccaggatgacttcatggaggaggccgaggaggatctgnnnnnnnnnntctcgagatgcagtccacgattcccacatcaaggctacttcagcgaccccgcccgccgcgctttcccaggacgacttcatggaggaggccgaggaggatctggaggacgaggatgccttcttggatggtgagtgcatggaggaaagtgtttggggggcagaagggggagaaactcccgcgtggaagggggttgtgagggcaatggagtcgagccatgcgccactacgggcgggcaccatctgcctcgacccttgccggtgttttccctgcgactcaactcatcggccgccccccccccggccaccgaattctgcctccccttccccgtcaccccttccctctcaaactcctctcagnnnnnnnnnnggtgcatggaggaaagtgtttggggggcaggagggggaggactcccgcgtggaaggggtttgtgagggcaatggagtcgagccttgctctactacagtcgggcaacatctgcctcgacccttgccggtgttctccctgcgagtcaatccatcggccgcaccccccgttgccaccgaattctacctccccttccctgtcaccccttccctctcaaactcctctcaggcactgccgtggacaccgagttcgacgaggagtcggagaccctgcgcgagacggtggacttcagcggcagcggcggcagcggcgtgggcgtgtctggtgccggctcgtcgggccggcgcgggcgcgcgtttggcacgggcgtcggcggcgaccgcagctggggcgacatggtcgtcctggaccaccggcgtcgcggtctggtgcccgggtcctctggcggcagggggagggtgaggcgcacgatggtggatgggggccggcggcggtgtgtgtgtgtgt

SEQ ID NO: 30785 - DNA, 121 bp, Chlorella protothecoides
cgggcaagggtcacttggccccagtccgtcttccttatgacacacaaccgcgcccagccaatgcagttcaaccatcatgccgctcaataccgaccagcgctgctcgggcgtgaccgaagag

SEQ ID NO: 30786 - DNA, 90 bp, Chlorella protothecoides
actcaggcattttcagccccgcatcctgtgtttccagccacccccgccgactcggcaagcccccacctccttcatggggttgtcggcgtc

SEQ ID NO: 30787 - DNA, 66 bp, Chlorella protothecoides
gtggagctcaaacgcagctacttgcgccctccactccgtgcatctggtgatctggacccagcataa

SEQ ID NO: 30788 - DNA, 124 bp, Chlorella protothecoides
tcgaccatcatggtgcgcgacacctgcggggatggcgcgacatcgctctcattacctgttgccggggcccgaaggggtggagcaataccacccgcccgtcatctactcccaaagcatgagtcca

SEQ ID NO: 30789 - DNA, 68 bp, Chlorella protothecoides
ggcagttgtatgccaggtcggagaaggggttgccgagggtggacagctcccagtccaggactgccagc

SEQ ID NO: 30790 - DNA, 71 bp, Chlorella protothecoides
acacaacatatagcgagcaattagatggtatgtatgatgattttgtgtgatggcgcgataaacacctcgag

SEQ ID NO: 30791 - DNA, 61 bp, Chlorella protothecoides
aggccacatcccgctgctcgctctccaaggcgggagtcgcggtggccatgcttcgcatgca

SEQ ID NO: 30792 - DNA, 61 bp, Chlorella protothecoides
gaatgcattggattaggaaggcttttagcggtgaaagatcggccctagggcgcagctcatg

SEQ ID NO: 30793 - DNA, 61 bp, Chlorella protothecoides
cagctaccaccaggaacgctgcaagtggagggcagtggtgacgtcagcacagtgttaacac

SEQ ID NO: 30794 - DNA, 91 bp, Chlorella protothecoides
gtcggggagtgaagacagaccaccaaaggtaagtggaatgtagagtgatggctgccccgtccgctgtaactctgcggctctcaggcgctgc

SEQ ID NO: 30795 - DNA, 444 bp, Chlorella protothecoides
ccccccccccatcctccgcttccccacctcccactccctgcaagacaactcacttgtcatggagcaggcgtggttgtcgtcgacgacatcggtgttgcagttgccgttgacggccctggccgccgggtggcccgaccaggtggaagactggcgggcgggctggccgcgggcgagcgtggtgccgcacgtgggcaccgtgatggggtgcacagccgccacggggggcacggcggagctctgtcgtgaggtttggtgggggaggaggatgacagtcgagggcagagggtctgggaagacagaccagcaggagaaaaggcgaggggttgggtttgtggggtgtgctttgatggacagagacactcccttttcaggggtgggtgcgtttatttcttggggggtgggggtgacttcttcttggcgggtgggggtgacttcttcttgggg

SEQ ID NO: 30796 - DNA, 82 bp, Chlorella protothecoides
ccaggtcgagacagctgcccaagctgggcagccggctgcagcctcgggactaggtgcccacggccgaggctgcgatccggcg

SEQ ID NO: 30797 - DNA, 61 bp, Chlorella protothecoides
cctctgcagcttcgaacccatgcacatacctaactgcatgcatgcatgcccgtcgactcga

SEQ ID NO: 30798 - DNA, 65 bp, Chlorella protothecoides
gttccctcggcgcgtcggcggcccgcagcgcgtccgcggcccaggcgcgcgccctgggccggacc

SEQ ID NO: 30799 - DNA, 121 bp, Chlorella protothecoides
gccagtcacgggcgagcgcgcggcggacggttgcggtccattccttggccggcgaagaaggctgcgtgacagggcccccgccgctgggcggtaagaccggtgcagccaggtgtgagggagc

SEQ ID NO: 30800 - DNA, 72 bp, Chlorella protothecoides
cacccatgttggcagagtatgcctcggcagagatgtccctgagggctgcatggaatgatgaacagatttgat

SEQ ID NO: 30801 - DNA, 170 bp, Chlorella protothecoides
tggctttgccgtgtgggacggtcctgcccaggccagccaacccaaggaggtgcgacactccctggccctgccatggccgccccgccacgcccaccttccagaatccgcgccggcaccactccatggaggtcagccagagtgcgaggccgaagaaccaggagatggagcca

SEQ ID NO: 30802 - DNA, 73 bp, Chlorella protothecoides
cacccgcttctgtacggtgggatctcccaaggagagctttttgatcacgacgggaagcaacctgacgaggagc

SEQ ID NO: 30803 - DNA, 73 bp, Chlorella protothecoides
tcccttacgcttggtcgccatgacgtctaaatttgtggaatcacctgtggggagtgaggtggcaggccctgct

SEQ ID NO: 30804 - DNA, 179 bp, Chlorella protothecoides
aacgtgcgaggagcagcgtgagttgcacttttctttttgccatgcaaccagggtcccgtctgtgtccccatgtgactgttatggagggtccatttctcgcgtgcaagtcccccgacgcacaccatgcgacgcgcgaatacaagaattattcacccatttagcgaaatagtcctcgttgc

SEQ ID NO: 30805 - DNA, 61 bp, Chlorella protothecoides
tcaatgatctcttcttctcatcctacacaagtttaagaagaacacctctggcctcctccac

SEQ ID NO: 30806 - DNA, 94 bp, Chlorella protothecoides
caaccttggaccaagggacacttgccccccctgggtataactacccaccgacttacgttgtaacggccttattcttgacagtctgtaggttacg

SEQ ID NO: 30807 - DNA, 61 bp, Chlorella protothecoides
tgagcagaccaaggtgggtgtgctcgaggcgattgttgcttgcctggcatggagcgaaggg

SEQ ID NO: 30808 - DNA, 68 bp, Chlorella protothecoides
cctgccatattgatcgcctggcatgcttcggtgctgcgtcaaggtactgcctcggcacgataggtcac

SEQ ID NO: 30809 - DNA, 74 bp, Chlorella protothecoides
cttggcccggctgggagtattggaacctggagatgcggcgggcttagtcctcgcagtcttcccggcgtacctgg

SEQ ID NO: 30810 - DNA, 61 bp, Chlorella protothecoides
cggaaggatgtccgccatgctgccggcgaaattcctgactgtacaggcacggcagtgcttt

SEQ ID NO: 30811 - DNA, 61 bp, Chlorella protothecoides
agaagggtgagatgagaaggtttgtcgtacgtgccaaccccccacagcaatctgttgccgc

SEQ ID NO: 30812 - DNA, 78 bp, Chlorella protothecoides
gcagtgcctcaatttctactcctgctggtaaaggtgatagatcgaggtccacctcatccctgtgcgcaccggttgcgc

SEQ ID NO: 30813 - DNA, 61 bp, Chlorella protothecoides
gtgggtgggtcgaaagggtggctggttatttggcccctgctctgcggcgcatgccgctgca

SEQ ID NO: 30814 - DNA, 157 bp, Chlorella protothecoides
gcaggtgccacgctggcgtgaggtgcccggcatccaccagctctcaccagatgccgtcggcgacccttgagaaccgcacggccagcactgctctcccctgcgttgctcctgcagcttgcgcaggtggtgtcatcttgataaacacattgccaagcgc

SEQ ID NO: 30815 - DNA, 115 bp, Chlorella protothecoides
tggatctgcaggacggggggtccctgtgtggggggagtgcgggtggcactgtgaggcaggcggtgtgcagcgtggggaatgatgcatggggcgcaggacacagatcccacttgcc

SEQ ID NO: 30816 - DNA, 72 bp, Chlorella protothecoides
ttagatccttcagtgtaccaggtgcacccatgtcaactcaatacgaatgattccaggcagtgccctcactcc

SEQ ID NO: 30817 - DNA, 67 bp, Chlorella protothecoides
agaaggggggggtggaacatgcggccctcgccgtgcgggaagtcatccgcgcgctccgtaggaatgg

SEQ ID NO: 30818 - DNA, 92 bp, Chlorella protothecoides
caactttgcaatgaaggtaccggtgcactatgctcttttggggcactctagctcatgagcggcacgaaccttcgtgctgacagactccagcc

SEQ ID NO: 30819 - DNA, 156 bp, Chlorella protothecoides
tcgcggtggcggcgctcaggcccagcgcgccgcgatccagcagcggcagcgtcggcgccacggtgccctccacgcccccctccaagggccaggcggggggaaagagggcccgcgcgatgctgccctcaccggcggcctccagcttggccagggtcg

SEQ ID NO: 30820 - DNA, 640 bp, Chlorella protothecoides
  modified_base (402)..(412): a, c, t, g, unknown or other
gatgcaagcaggtcggttttcttgggaggagaggctgcttgagcaggatctctgcgtcatgagctacgcaggagtgcgcgacaccttgcgtcgcagcgtccggtgggggcgggaggtcagggccttgggatgtgcgaggccggtctcttcacctggcacacacacgctgacagcccttccgaccccttccttgcacaccagggagggtgcccgcgagatgggggcagcccacgcccaggagactcaggggttgcaggcccggctggagagggagacacgggagctggtggccacccaggcgctgctcatggcaagggcggggggcgagtcgggggccagcgccacctcctccccacccggggcccggctcggccacctgcgcgcgagcggcgaggtgcggcnnnnnnnnnnncgaaggggaaaggcggggggggtggggaaggcaggtgtctgcccaagcctgtggtctctgtgcaggccccacagtagtgtgtgctttcagaactgggaccactgatgtgtctcggggcccacccaggccaggacagggcacgacggctgaccagagcgctgacacgcggatccacatcaggctcccctcaccctcccacaggacatgtcgtcgaacagtggcagcggc

SEQ ID NO: 30821 - DNA, 87 bp, Chlorella protothecoides
gtagaggggcatcgagatgcttgccacctgtgtcgagttgaatgtcacgaattttagggaggtgcaacattgtacagcacgagcgca

SEQ ID NO: 30822 - DNA, 76 bp, Chlorella protothecoides
catctcaccgcttcggtgctctcctcgaagtttgagtgccctgtggcttcgcctgtaggggaccactgacgcaagc

SEQ ID NO: 30823 - DNA, 93 bp, Chlorella protothecoides
cagggcgcctgagaaggcctgcgccacggggtgccctgcagagggtgtgttgtgatttggctgagtgccctggctgccatattcctggcggcc

SEQ ID NO: 30824 - DNA, 61 bp, Chlorella protothecoides
ctggggaatcaggggtgttgggtgtccatggggctgcctgagggcatatcttgctgtggtt

SEQ ID NO: 30825 - DNA, 122 bp, Chlorella protothecoides
cagtctcaagtccccggtgtatcgaaatctagagtcagtgcaggattgtactgacaatgggaaagtggactagtggctgttgaggagctggaactgggatcaagaatccaacatcaggtgtc

SEQ ID NO: 30826 - DNA, 105 bp, Chlorella protothecoides
ttgtggctgatggacagaattcatgccctcgatcctgactggatccctaccaaccatccccccctccccaaatcactcacagcggcgccacctacgacgacgtga

SEQ ID NO: 30827 - DNA, 555 bp, Chlorella protothecoides
  modified_base (133)..(370): a, c, t, g, unknown or other
catgggtttgaggggcgtccctgggtgcttcaggaaatcaatggcctgcaaggggtgcccggggggtgctggctacacgagcacgaccacacgcctgcctttgcagtgggtcaagctgggaagggcactggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcctggagaatcgttgccaaggtttgcatggcatttcagcgtcgccatcactcagctacagcgtcacatttgactgtggtatgcagcacacattgcgcccacctaatgatcatactcacccccctgaaccctcccctcaatgctctgcacgacacaggacgctgaggagtacctgggctac

SEQ ID NO: 30828 - DNA, 110 bp, Chlorella protothecoides
catacacttcttcagcaaaacaggccaccctacccagatctaccactgcacccaccgcgcgccccacaatcaggctatgtcgcttcttggcatgtgtgtatgtttcccac

SEQ ID NO: 30829 - DNA, 69 bp, Chlorella protothecoides
cttccggagcacgggtgcgctgcatgagcgagatcgggggacggcaacccaccatcagattgcccggat

SEQ ID NO: 30830 - DNA, 78 bp, Chlorella protothecoides
gttccgtgcaagagtgtgtgcacggcgcatttaaagcctgctgagctgatgcgtggcaatgggtcaccgcagctgccc

SEQ ID NO: 30831 - DNA, 63 bp, Chlorella protothecoides
caactgtggtttgtgccctccagcgcacatgagcagtgtggtgctgagggatgcccccccccc

SEQ ID NO: 30832 - DNA, 64 bp, Chlorella protothecoides
tcggaccacttggacaccagatactccaggacgggggcggtgagcatgccggccacgtttgggg

SEQ ID NO: 30833 - DNA, 75 bp, Chlorella protothecoides
gtgatgggaggagggagcgcggtgcggcctctgtagtagcttctgttgagcgactttggccagtttctgaacgcc

SEQ ID NO: 30834 - DNA, 103 bp, Chlorella protothecoides
tcttatggccgtctccaggatggtgagcctatggaggggggcgcgtaatacgatgggactgtttggaaaaaggaccctcaaacagtcaagcagcggcagcctg

SEQ ID NO: 30835 - DNA, 61 bp, Chlorella protothecoides
accccccgttaacaagcatggctgcgaggggctgccttcacccgagcaggtgcacatctcc

SEQ ID NO: 30836 - DNA, 64 bp, Chlorella protothecoides
ccatccttgtctgccgagcaagccttctgttccaccttgaggcactccacggccacgataatct

SEQ ID NO: 30837 - DNA, 96 bp, Chlorella protothecoides
cttccaggttaggaaaggatcttgcagtcatgagggcagggctgaggttggacagactgtccttgcttgtgcatggggttgggatgcccacggagt

SEQ ID NO: 30838 - DNA, 2309 bp, Chlorella protothecoides
  modified_base (369)..(378): a, c, t, g, unknown or other
  modified_base (573)..(582): a, c, t, g, unknown or other
  modified_base (1129)..(1138): a, c, t, g, unknown or other
  modified_base (1912)..(1921): a, c, t, g, unknown or other
gctgctcgtctcggggctgttggtcaccagccagctggcgcgcgccagcgcgcgtcacttccaggcgctggccgccgcgcgcgtcgtgcgccgcgccgcgccgctgctggccagcgccgaggcccccgtgcgtgcgcgtgcctgcaacctgctgggcaacctgtgccggcacagttcgctgttctacccggagctgcgcgaggcgggggtggtgccaggcctcatcgccctctgctccgaccgcgacagggccgtgcgcaagtttgcctgcttcgccgtgggcaacgcgggtgcgaggcgtgtgtgtggtgggcggggcagcaggcggaggggcggcaatgtcggccgctccccggtgccgacggagcnnnnnnnnnntggcgcgtgtgtggtgggcgggtcagcagacggaggggcggcgatgtcggccgctccccggtgccgacggagcggcgtgcaggtggtcgtcaccctcggtcctggcttggtccctgcagcgaccccctcacctctcacacacgcacgctctgcccatcagagagaccggttctcccctgccccccgcccctctgnnnnnnnnnntgtttggtccccgcagcgactccctcacctctcacacacgcacgctctccccatcagagaaaccggttctcccctgccccccgcccctctgcggcatacccccccggtcctccagttccgccctcgacgacacacatcctccccaacttccctcgcgatcccaggcttccacgacgccagcctgtacccgctgctgcgcccggccctggatccgctggtgcagctgctgcgggaccccgaggaccgcacgcgcgccaacgcggcgggggcgctgggcaacctcgtgcgcaactcgcccgagctctgcggcgggctggtggcggcgggggcgctggagggcctgctcagcatcgtggcgcggaccgacgtggagacggcagagccgcactcctccctccagatcgcgctgttcagcctgggtgagcaggggaggagggaggtggggggaggggtcaccctgcgtgcaaagggatgggggcgttcagcatggccaagcagcatgcagcgcgaagggggccagcagggccgatcatgcttccctggttgnnnnnnnnnnggtcaccctgcgtacaaaggcatggggcgttcagcaaggccaggcagcatgcagcgcaaaggggcccagcagggccgatcatgcttccctggttgactcggcaccggtcagaagttttgggactggaggctgggatgggacacggcctcctcatggcaatcagggcatgtacatagacgccgccatcccagaatcctacgccctcacgcctcggaccccctccgcacccgcacaccattcaggcaacatgtgcgcgcacgccgcctgcgcggtggcgctggggcggctggacttgggggccgtgctggggcgcatgctggaggcgaggggcggcgacgcggtgctgcagcgctacgtcgcgcgcatccatgccaagctggcggcgcacgggccactgccggggcagacaggggagcgggggtagctggtcggtgccggatgagcaagcttctggcgtcctgcgctcccaccacctggacccgtccgtgctgttgcaaaggggggtgggctgcctgtttgcgttccctccccagcttgcgtcgtgcagcagatgaggtccaggccgagaacattctggccccatacccctccaactctgctggcctttctggcgctggcccccgcatcccccccttcttggaccctccacgacctgctgcaagccccttccctttggtcggcccaaccccgtctcctatccaccccgtccccaacgcatcccgccatgctgtcgatcgagttggcgtgaccggacagtctcattcccagcacatnnnnnnnnnncggtcggccaaaccccgtctcctatccaccccggccccaatgcatcccgccgtgctgtcgatcgagttgacgtgaccggacagtctcattcccagcacattgcatcgaaggggggggggaaggggaacacgggaagacgtgcacacccggggcagcacagctcccgcccgcgctcacgtgaagaagaagtgtgcgacgtcgccctggccaaaggcggtgccgcagccggggcacttgcggtggcgcgactctaggttgcgcttgatgcactgtgcgcagaacatgtggtagcacttggtgatgatgacgtccttctggcgctggtggcagacggagcagttgaccatcttgcgcagcgccgccgcctccgcggtcagcgccgccagcg

SEQ ID NO: 30839 - DNA, 628 bp, Chlorella protothecoides
atgcatgaaggaccaggcttggaagaaggaatttggtcacatgcttcttggagatgaaacgaaaacactggagaaagtggtacaccactcatcctcatctcatgcagcgtaccagtcgccagtgcataggtacaaagcgtctctagcagcacagatgtgaagcttgggaagggcttatcttcgttgtggtgcattgccatagacgctcacttcaccttcctatgctgttcaccccttcccccatgttcactctcattcctgcagtgcacgctccgcttttgcctcaagcatgaggtcagatgcagagaacgtccaggatatggctagccttgacactgcctgcaggcaccgtgcaatgtctaaggtacgccgccagctgcttgacctcttgatgcttgttccgtttgctgatctatactgggccctaactttagttcgcaagttgacatggttgcacacacatcgtttcaacacaaccctaatgggctttaatcacaccctttacagccacagtatgcagttcagcagccaccggctcctcctcgccacccgatggtttacgtgccatcccatgtgactcagacagcagaagcaccaactggcgtgctcaccaggtaggcagcatgta

SEQ ID NO: 30840 - DNA, 101 bp, Chlorella protothecoides
gctggacgaactaagagtctgcaccgacaacatcctcttgtaccaagcaatcttgcacgaaatctcttctgtttacaggcacaatcttgatcacaagcttg

SEQ ID NO: 30841 - DNA, 441 bp, Chlorella protothecoides
  modified_base (196)..(345): a, c, t, g, unknown or other
aaggtttgtcaaggaggccgctcctgcaccgttcccatgagtgtccagagcaccccatactccctgcggtcctatccagtgtacccttcaggccaaacttgcgccttccacatggaggcacctgagacacttcttccccatcgaagaccgatgttagacgtcccttcgccacatgatgcttgtccagacgcactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttccgctcccatgtcacgaaatgcacagcataccaacgagcaaaggactcccctgcaccaaggaaacactccacatgaaggatgcttacaggcc

SEQ ID NO: 30842 - DNA, 143 bp, Chlorella protothecoides
ggggtttccctgttgcagggtgcccaaggaaacagtgctctcgccgacctgcagtgtgcggggcgtgcgcccctcttaggttccaatctacaatgtagaagctcagagttttcatgagggactgtcctaaatgtatactacga

SEQ ID NO: 30843 - DNA, 117 bp, Chlorella protothecoides
gcagctggatccctacatgctcaaatgaaattgtcagagcgttcatagatatcaataattgcaacatcatattgtggtgttgacaaaaatgtcgaaaacgcagccccctgtgttaga

SEQ ID NO: 30844 - DNA, 511 bp, Chlorella protothecoides
  modified_base (179)..(391): a, c, t, g, unknown or other
ccagcttgtgggaaaaacctgattgtggatggatgcccggtgcgtcgaggaaacagtactccattgattcagcaggtgcctgcctgcagcaggtcaaaagggtgggacagtagtgcactgacaagaactatcgtgtcacgttccctccccaaaccccctttgacccttcttgcgagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggtggccggggggggctcgcagggggctgtgggatgcacaacgcttgaatgacagggcggcccctcccctgacacggtggaggcgccgtcacagcccttacgtgtgtatggcgctc

SEQ ID NO: 30845 - DNA, 77 bp, Chlorella protothecoides
gaggacaagggcacggccgccggcgggtcgggcccagccgccgacaacgcccagccagctccggggagcataaggtg

SEQ ID NO: 30846 - DNA, 119 bp, Chlorella protothecoides
aagcacgccgacctccacctttgtgtatgatttcattggggggggaggttgggggtgagtataaagtaagggcgcgacagggacagattacggcgatgtcatggggttcactgccagga

SEQ ID NO: 30847 - DNA, 79 bp, Chlorella protothecoides
ctggggggagtgatttgagggtgcttgactccgggtgggccagtggatgggaggagggaggggcgacgggaccgggagc

SEQ ID NO: 30848 - DNA, 61 bp, Chlorella protothecoides
acgacgaggacgaggagctgaagggcggggtgggggccgtggaggcctacggtgaggaggg

SEQ ID NO: 30849 - DNA, 106 bp, Chlorella protothecoides
tgtcctgatgaaggggttttgggggcggggatacgagcaggtgtggtgcaaatatgtcaggaggtgggaagtgagccgactggactctgttgacacagggaggggc

SEQ ID NO: 30850 - DNA, 80 bp, Chlorella protothecoides
cactcttggagtgccatcccttccccggcattcatgccgtgcacccaccttgcagacctgctcaagctcatgcggcaaca

SEQ ID NO: 30851 - DNA, 71 bp, Chlorella protothecoides
gtagggatgactacatcaggagaagtgcatccatcgagggttatatcgtggaaggagttgtgatactctct

SEQ ID NO: 30852 - DNA, 61 bp, Chlorella protothecoides
ttcaggtcgtcgagctgcccgtcagcccactcccgccatgatttgctggatgtctgagccg

SEQ ID NO: 30853 - DNA, 79 bp, Chlorella protothecoides
ttggatgggcgtcgccctgcttgccttccggtcttggtagcctagattgtatattcatcccaggcctgaagtgcccatc

SEQ ID NO: 30854 - DNA, 77 bp, Chlorella protothecoides
gctgggcccccgcaggcgctgcttcccccagcctgtagtacctccttgttggagtcccccccacctcaccgctgcgg

SEQ ID NO: 30855 - DNA, 78 bp, Chlorella protothecoides
aggtgcagctcgcgccctcggggccgctgcaggggaccgcaggtgccctgtcctgcgccgtggcgcgcgtctgatgcg

SEQ ID NO: 30856 - DNA, 189 bp, Chlorella protothecoides
tgtcctgcgccgtggcgcgcgtctgatgcgaggccctgcacgttttgcgaggccgaagcctcgacgcgcgcgccgtcgccgaccccttcgtccccatgcgcgggtgcgccgctcgcgctcgtgaccctgaaggaacaccctcggacccactcatgtgtagacccctcgctcccccggacagaccgagac

SEQ ID NO: 30857 - DNA, 6760 bp, Chlorella protothecoides
  modified_base (470)..(479): a, c, t, g, unknown or other
  modified_base (1730)..(1824): a, c, t, g, unknown or other
  modified_base (2616)..(2625): a, c, t, g, unknown or other
gcgccccgccggcgcagccgccgcgggctggcgcgtgggcgtgtaccgccccgccgagcgccgctttgccgcgggcgaggtcacggcggtggacgagggtggcggcggcatccgcgtcacgctggacgacggccagtgcctggacctcgaccccaacgagcctgggatcaagtggacctttgccccgggcatcacactggacgcggagaagctgggccgcaggcggggcccggcgcccgccgccggcgatgccggtgcctgggatgccgtgagtctgtggggggctttgtggggcggatggggtggggcagacggtgccgggggggtccgacctgtcgcggtgcaagcccatggctgggctgtgtccactgctgttgacccgtgctctcctccagccttttggcctgagttgctcggggatcctcctgacatgcgatcgcagcaactttgcagaccagccagaacacccnnnnnnnnnnctgagtcgctcggggatcctcccgacatgcgatctcagcaactttgcagaccagccagaacacccctttcctcgtccttctccaccgcatcccccctcacccccgccatgcaggcctcgcccagggcataccagcgcagcaggtacaccctggcccgcccctcggccttcagccggcgccagcagtcactgagcaggctggcggtgggaaggggcactggttgtgcgtccccggcgtcccccccgtggcccctctcccccgccgcggaggcgggcgccgcggcccgctggggccccgccgagggctccgggcccccccgcgtcgtacgctgcgtgcaggccggctcggtcgccgcgctgggcacgctgggccggctgtgctccaccgccgtgggagggggggccggcacgggaaccccgcgcgccaccgacctccccgtccgcatctacctctccgcctcctcctgcagcggggacgagggagcgcaggccacgctgcgtgctctctgcggcctcgccccggcagggtctggcggcgccacgcatggccgaggagggagcgacagcccgagctcgccggagcgcggcgtctcgctgggagccagccccggcgactcggcaggcggccagccggcgcagcgcccctccccctttgcatcgcctggacagcccgcactggcgggctctgacacggaggaggaggaggaggatgccctggatcagctgagggtggcaggcctcgttaaggaggaggagcagctgccgcaggtcctcccccagatccctgtgggtgcacgttctaccgccgtcgcgtcctgaaggtggccacctgctgtattgcattgtagtctggaaaacgttgaaacgttgagggatggtaaatgaatcattttgaggcagcggtcatgcctactgatcacctgccagaaggggctcgcgcgcgcgcgcgttccggggaatcctgctctatgcctatgaggcttggcgctcgggagtggatccctcctctcacactcacaaggcaagaccaagcgtacttatggcaaccgagtaacagtctgttgccaaccgctggatcggggtggagggcatggcggaggaggccacgtccacctccggacgtcccgatgcctgcatcgcataccaccaggtgcgcatgcgaatgaagtgacgtaagttgcgtgtccaaaggtgccgcctgccgaatcaacattgcctaacggcgctccccccccccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccctggcgctgcctgggaccccacctcagcaataatcaccaccaatgtcgcaggtcatgggcctggtggacgcggaattgagcgagccctattccatcttcacctaccgctacttcctacgctcctggccccagctctgtttcctggcccgcgatggcgaccgttgcttcggcgccatcgtggccaagctggagcgccaccgtgacgccctgtaccgcggctacattgccatgctggtggtggagaagccgtaccgcgtgctgggcgtgggtgagatgacgagttttggtgcagggggtgggacttgaacgaatagttggagcccagctgttcccacggtccctctgcggcggcgcctttcgtggccaccactgcatcggacgctgtcagccttccaaaacaatcgcagggagccagctggtgcgctgcgtcatccagaccctgcagggaatggggtgcgaggaggtggcgctggaggcagaggtcaccaatgtgggcgccctccgcctctacgagcgtcttggctttgtacgcgacaagcggctcaagcggtgggcgcgcggtgacccggcgggtcgatagctgggatcagggagagggaatcactgtgtttgctggagattggtccctgcgacctgcacacagcgtgccgcaatgaagagcaggcaggcctgtgccccactgggatcttgggggcccaagagggtcgagtggtgtgcatgcctgaggacacatgcgggccgccccccctccccccccccaagacagcgatgctgcagcagcgtcacannnnnnnnnnatggtgtgcatgcctgaggacacatgtgggccgggcccccccccgccaagacagcgatgctgcagcagcgtcacaccgtgtgcctgccctcattcacttgcaggtactacttgaatggcagcgatgccttccgcctgaagctgttgctcccccttgcctcagaggatgcagcagcggcgcagcagttggatgccctctcgcttactcaggcgccatacacaccgtgaggaggcgagttgtctcgatcccaagccatcagccctgcctgaaccttggagggtatacccattcctgtcatgttacagtgacctgccagggtggcagttgttgtggtgatcaggggaaacagacaggggcatcacgcggctttcttgtcagagtagacccacaacaacagggcagcggtgatgggaggcacggtgacgaaggagagtgccagacccgtgttgggatgcatcagggtgtcactgaggaggctcccatacttgacgaccgcgccacctgggggtagagtgaccacgatggaggcactgctctgaagctgaagggtcagccaggcgacatgcacggcagggcaagcgagtcctccagggatacctgcaaccgcgccactcaggaagcgtgtgaccaggccccgttcgtcgggggtgagggcccttgccccgtcttgtaatgattgccccacactctggccgccctcctcccgacgtgcgcgcacgcaccccgatgccgcccgggatcgaggatgctgtctcaaagcttgcaatggatttttatagccaggcgtgaacgccggtccagagtggcatgcttgcatggtcccgaagctgacggtaatgtctcggggttgtgctatcggaggatttttgtatcgcctagggtcgattctgactgcagccaggtctcacccaaggcgcccatgccaacttgcacatccgccatgtttattacatccactatactgtacacatcatgtttaagctcgactatccgtgcgacgaggccgagaaaagggaccggtcaactctccatactccgggcctcacgggggtctgtggagacttggcgtctgagtatcctcccctgaacggtccgtcgccccataacagcccagcccacagaggtctgtgcccggatcttcttgactctgcatatgaaaagacacttgatggtacaacaccggcacgttggtcaaaaccagaggtgagggcatgttggtatgcgtggggcagtggttgattccgggagggcgggggcatgacatgggatgaacctggctgcttgcccatgtgggttgggattcgtggcagtcgccaggtcagttggtcagtcaggcgggtcaggcttgtgtcagcatggggcaagagctgcggagttcaggggaaaacaattccaggaggggtcggaagcaagctactactggggcagaggaattcgtccgcgcccagtcaccagcatgggtcagagggttagtggggaggggcttgagatgccgcgacaaaggaacagaggggtgaaaccagccagcactggcactggcttccaaaacatccatataggcaaggttggcgctcagcatagtggtattttggggggagggagggggggaaagagaacagaacatggtacaggaggtgggggtgagcgtcaggcctccccccagagcttggggcagttggaagagccaagcgcctttattttcggtgcacccgggggaacacagtacacccgagtggggatgagctggtgctgtggtgtgcgtgggctctccgcgccgtcgggctcctgaaacagcccaccaggagctacccaatttttcactcgaacttttgggagaagtgagagtcccgccaaccctccgtcacctcgtttctcgaccatcatgccctgcgagggtacgggcgcgctgggttgtcagccccccgtaaagtcagctcgacacgccggcccagtcgcgcctaggcaaaggcaagtcccaggagtcacaccgccgtctcgttcggtctgggcaattgcaaccccgaaagccagggcgactgcagtgccgaaacacacctgagttgtcgcaagttgtcccgggtcggaagggcagtcgtgtcgcacactttagaatccctccacggggcatatacgcatccagcctccaagatccagcggtgtgcagtcctaactgggttgttcccgacttgagaggcagggagatacacccgagcccggggtcaaatacaacggcttccggggggaaatatctcggcaagcgtggggagcaggccgttcccgatgcccctcgctgccattcgctgcccctgtacgtccactctggctgtgggaccatggtacattcaaaacggtgccaggaaaagagcatcgctgcgcagtgggattccatcccggtccgctccggttgtcgtaaagcatcattcagagcagctcctcgggtccgatgccccgctggcacaccggacaggcccctcgcgagcgcagccagcgatcgatgcagcgggtgtggaatgcatgcccacagggcagccgcttcagcctagtgcccgggcttacatcctccagacagaccacgcaccttcccacctcggcggcggcctcacgcgagagccgctccaccggcaaggcacgtatgctggccgcgtcggcccctcgccgatcctccaggccctcgtccagcgctctcagggcctcgtaatcgtccgcagtgaagtcgcgatcgctgcagcatgggtggatgtgtggggggcggtcgggcagcgatgaactgactggctatgacagcatcgcagcgacggtgctgcagctggtgccgctcccgcgaggaagtgtgggaggcatcctggccaggcagtgcacccacctaaccccctcacctcagcaggaggtgggcagggagtcccccccccctgcccctgccgccgcccgccgatcccatgcgctgggccatcatcaacagggccaggggtccggcggcgggggcggccgcaccggcccaccgacctccgcccgccatctcctcggacagcaggctcagcacccgttctagccagtcgtagcgcacggaggcctgctggacctgctcggcgccggggctccaccactccggcgccggcgggaagatgctgggggcgtgccctgtcgtccccagctcctcctgctccgccagcgcatccatgcgcgcaaagagaagctcgtcgcggaccagagcacaggcctcctcctcctcctggaatgggtggggttggggggtggggcggcgaggtgggcacccgggggagcaagccatcgctggagagacaggcaccaccggcctgagtggcaccctcgaggttgcctgccctcacagcaactgcacctggaagctgcgggcgagcgccgcatcctgcgcctgttgggcgctggagacgttgcgtgggcgcgtcgggttggaggagcgcggctgggtgggcggccgggcccgctggcgcctgggaggggtggtcaggtccaggctctcctcctccagctcgccccagagcggggctcgaggagccgggacctcggccagcaccgtcacctcggatggacctgcacaggattgggtaataggatcaatgccagtccaatgcattggtggcggtagcgcaggtgtaaaagctcctgggtcgctcactccgaggggagggtgccgcgaggtccacgctcccggcatcgccgacccggcttcgacgacgcttgcgtgcagtgcccgtcccgctcgtgctggcgcccgaactgggcccagcgctcctaccctccccctccattcacagggggggtgcgaatcctgcgaccccttccgccgaggtggggagcccctcgtcgccctggcgagaggagacagccggcgatgctgcagagaccagggagatggagatgaatgacaggccttatgtttgaaggcgtgaagttgccccctgaaaccttggaagggacccgctcctcctccattacgatgggcgatccagagcggtctttctccctagctgccacgagggagcctgtcacgctctggagccggacagaaaggtacacacgggtatggctatgcacatggagagcgtgcatcttggtacaggagacaaagcggcgattgggaaaagaatgttcgcgg

SEQ ID NO: 30858 - DNA, 60103 bp, Chlorella protothecoides
  modified_base (400)..(409): a, c, t, g, unknown or other
  modified_base (715)..(724): a, c, t, g, unknown or other
  modified_base (1025)..(1190): a, c, t, g, unknown or other
  modified_base (1267)..(1276): a, c, t, g, unknown or other
  modified_base (1695)..(1704): a, c, t, g, unknown or other
  modified_base (2172)..(2181): a, c, t, g, unknown or other
  modified_base (2424)..(2433): a, c, t, g, unknown or other
  modified_base (3239)..(3248): a, c, t, g, unknown or other
  modified_base (4581)..(4590): a, c, t, g, unknown or other
  modified_base (6837)..(6846): a, c, t, g, unknown or other
  modified_base (7030)..(7039): a, c, t, g, unknown or other
  modified_base (7097)..(7106): a, c, t, g, unknown or other
  modified_base (7170)..(7179): a, c, t, g, unknown or other
  modified_base (10570)..(10579): a, c, t, g, unknown or other
  modified_base (11942)..(11951): a, c, t, g, unknown or other
  modified_base (13042)..(13051): a, c, t, g, unknown or other
  modified_base (13552)..(13561): a, c, t, g, unknown or other
  modified_base (13808)..(13817): a, c, t, g, unknown or other
  modified_base (13949)..(13958): a, c, t, g, unknown or other
  modified_base (14582)..(14591): a, c, t, g, unknown or other
  modified_base (14995)..(15004): a, c, t, g, unknown or other
  modified_base (15769)..(15778): a, c, t, g, unknown or other
  modified_base (16062)..(16071): a, c, t, g, unknown or other
  modified_base (16278)..(16287): a, c, t, g, unknown or other
  modified_base (16702)..(16711): a, c, t, g, unknown or other
  modified_base (17589)..(17598): a, c, t, g, unknown or other
  modified_base (19547)..(19556): a, c, t, g, unknown or other
  modified_base (19967)..(19976): a, c, t, g, unknown or other
  modified_base (20515)..(20524): a, c, t, g, unknown or other
  modified_base (20759)..(20768): a, c, t, g, unknown or other
  modified_base (21140)..(21149): a, c, t, g, unknown or other
  modified_base (22091)..(22100): a, c, t, g, unknown or other
  modified_base (24928)..(24937): a, c, t, g, unknown or other
  modified_base (25179)..(25188): a, c, t, g, unknown or other
  modified_base (25832)..(25841): a, c, t, g, unknown or other
  modified_base (26089)..(26098): a, c, t, g, unknown or other
  modified_base (26238)..(26247): a, c, t, g, unknown or other
  modified_base (26878)..(26887): a, c, t, g, unknown or other
  modified_base (27544)..(27642): a, c, t, g, unknown or other
  modified_base (28453)..(28462): a, c, t, g, unknown or other
  modified_base (30545)..(30554): a, c, t, g, unknown or other
  modified_base (31027)..(31036): a, c, t, g, unknown or other
  modified_base (31942)..(31951): a, c, t, g, unknown or other
  modified_base (32414)..(32423): a, c, t, g, unknown or other
  modified_base (32915)..(32924): a, c, t, g, unknown or other
  modified_base (34790)..(34799): a, c, t, g, unknown or other
  modified_base (34918)..(34927): a, c, t, g, unknown or other
  modified_base (35330)..(35339): a, c, t, g, unknown or other
  modified_base (36691)..(36700): a, c, t, g, unknown or other
  modified_base (37215)..(37224): a, c, t, g, unknown or other
  modified_base (44370)..(44379): a, c, t, g, unknown or other
  modified_base (44989)..(44998): a, c, t, g, unknown or other
  modified_base (45531)..(45540): a, c, t, g, unknown or other
  modified_base (47940)..(47980): a, c, t, g, unknown or other
  modified_base (48172)..(48181): a, c, t, g, unknown or other
  modified_base (48249)..(48258): a, c, t, g, unknown or other
  modified_base (48343)..(48463): a, c, t, g, unknown or other
  modified_base (48667)..(48699): a, c, t, g, unknown or other
  modified_base (49265)..(49274): a, c, t, g, unknown or other
  modified_base (49573)..(49632): a, c, t, g, unknown or other
  modified_base (50627)..(50636): a, c, t, g, unknown or other
  modified_base (51357)..(51366): a, c, t, g, unknown or other
  modified_base (51592)..(51601): a, c, t, g, unknown or other
  modified_base (52302)..(52470): a, c, t, g, unknown or other
  modified_base (52607)..(52616): a, c, t, g, unknown or other
  modified_base (53068)..(53077): a, c, t, g, unknown or other
  modified_base (53305)..(53314): a, c, t, g, unknown or other
  modified_base (53865)..(53874): a, c, t, g, unknown or other
  modified_base (54806)..(54815): a, c, t, g, unknown or other
  modified_base (55213)..(55222): a, c, t, g, unknown or other
  modified_base (55542)..(55551): a, c, t, g, unknown or other
  modified_base (58285)..(58294): a, c, t, g, unknown or other
  modified_base (58753)..(58762): a, c, t, g, unknown or other
  modified_base (59257)..(59314): a, c, t, g, unknown or other
  modified_base (59480)..(59489): a, c, t, g, unknown or other
  modified_base (59584)..(59593): a, c, t, g, unknown or other
ggccgccgcgcacggcgccatcggcgacggtccgggcgccttgctgctgggccgcggcggcgacggcagccccaccacgcccttcaccctgtcccccacctccatgacctcgccctcgggccaggcggggctggacgacctgtttgagcccatgcacatccactctcacgttgcagaccgtgagtggtggcggtggtggtgttgggggggtgaggggcaggaggggggaggagcgcgcttcgggggatgcgtgtgtgcagggggtgtacaggagtgaaagggctggggggcagggagtcggtggcggctcgacgggcccttctgcgcttcggccgaggcctctgcgagccgagcgggtccgaggccgggtcgtgccggtcaccgacgcgctggcggctgnnnnnnnnnnggggaggaacgtgctttggggaatgcgtgtgtgcagggggtgtacaggggtgaaagggctggggggcagggagtcggtggcggctcgacgggcccttctgcggttcggccgaggcctctgcaagccgagcgggtacgaggccggatcgtgccggtcaccgacgcgctggcggctgtcggacgggcttccgtcagcacgatgctcgtgtccatgcaccccctctcccctcccgcacggcccacgcccctcctccaaccccttccccgccctacataccatccccgcagtggccggcgtgccggggcnnnnnnnnnnctccgccagcgcgatgctcgtgcccatgcattctcccccccctcccgcacggcccgcgcccctcctccaaccccttccccgccccacacgccatccccgcagtggccggcgtgccggggctggaccgcctgatggagagcatcatgcccgacagcccctactccgcggccgggatgctggacctggtggggaggcccttccagtacctatgacgcccggcgcggggggagtgggtgcgcccgtccgcccccggccgtcacgcggagcgatgacgcccggcgccgggctctgcgccgccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccgactcccagccccgggcaaggggggtgtgatgccgaccccggttccggcggcgaggggacccctgattttgnnnnnnnnnnacgccgtccgcccccggccgtcgcgcggagcgaggacgcccggcgccgggctctgcgccgccgccacccaaactgaccctgctccctctaggggagcagcacacacgcgaccacttctctctcgctgccgcccagcgacccggctcagattgggccctcgctccggctgctgcaccgctgctgcatgcttcccgactcccagccccgggcaaggggggtgataccgaccccagttccggcggcgaggggacccctgattttgtgacgacccccgcctccaccgcaccccagccagcccgctccgccgcgcccccgcccgctccaccgcacgcccactcgccccaccccatccgttggcgccgctagccagccacccagccgccgcgacagcgtcccagccgcccgtgcagcagcccctnnnnnnnnnntgcaccccggccagcctgctccgccgcgccccggcccgctccactgcaccccagccagcccgccccaccccatccgttggcgccgctcgcccgccacccagccgccgcgatagcgtcccagccgcccgtgcagcagcccctcttcattggaaactcccaaccctgcagtgaacatgtaccatgcacctcagacctgacctgtgcaccaccccacccccctttccctctcgatcataatgctgtcgcacggcgccctcccaccggctcccacccctgcgcctcgaccggggtggagcagggggcacgccgctgcatgccctctcagcatcgcaacgtgtaacatgacccacatgcagcagggttaccagagctcccgcgcgcgcatgagaatgtgcgggcagggtgccggctgaggagttgttctggtccctcagcgtgggtgtcacgacgccaggctgacatgtgcannnnnnnnnntaacatgacccacatgcagcagcgttcccagagctccgtgtgcgcatgagaatgcgcgggcagggtgtcggctgaggagttgttctggcccctcagcgcgggtgtcacgacgccaggctgacatgtgcaggtgtgagcaggagtggagggagtgctgggtatccatagaggcatgatcatacaggtgtgttacatggatctggtactgaggatcatcaaggagtcttgcaggtcggtatggtnnnnnnnnnngagaggcatgatcatacaggtgtgttacatcgatcgggtactgagggtcatcaaggagtcttgcaggtcggtatggtatgtcatcattcagccagagtggcgcatttcaatcttgtacactgcgtttcaaagtgctggaaagtgggtgcaggggtttcgtcatgcagcaggcagtgggaggggttgccgggaacactggccatgtcgccctttgacacacctccccttccaggcaggagtccaggacatcagggccagcggggcatccccaggccccgccagctcctcaacccgaggcggcggggggctttccgtcggtcccctcgccgggctcccccgctgcaggcacaaggatgggggccggcccagcgcagtgctctgccgccacgccgctcctgcaggggcgctgctccccaccatcaaacgcgtcatgctgggcacgctgggcgcgctccaccgctgccgcgatgtcggggctcatggtggcggagatgccgtggtcctccatcaccccggcggtgcaggcgcgcgccaccgcactgtccaggatgatcatctggtggagtggggatggaggtggagggaggaggctagctgggctttttgagttctggggaatgcggggcggggcaggggtgccggggggtccctgcactttcccgccgccggacccataccacggtcatggctgcgcatgagcatggccgcgctagagaaagcgatcaggaggagatccagggggtcctccccccccccgctgcacgccgctgcatacatccctcgctgcccgcgacaagaacaacatnnnnnnnnnnttgagcatggccgcgctagagaaagcgattaggaggagatcaagggggtcctccccccccgctgcacgccgctgcataaatccctcgctgcccgcgacaagaacaacatgtgtccacacgtacacccaccttcccgccggcttccatgtcgaagcgcatgctgggctcgttgcaggcggccaccaggctcgccagctgggccaggcagtcgacgggcgtgccgttgaaggccacgagcggggagtcgcgcaagccgcccgcgccttcgtaccccagtgtggcggggcaggcgagcacggtgctgaggacaacggtctgctcccccgcccgcgcgcggacgcccaggaagctgcggtgcagcaggcgcacgggcgcggcggcgacagagccgtagcgctgggcgaggaaggggtccgagagggcggtgaacaccaggccgcccaccaggaggtagggcgggcgcccctcgtccatgtgcggcggcaccaggtactggtagggcgacaggcgcacggcgacggccagctccgcgcgcgcgcgcagcaggcttagcgtgacggtgtcgcccacgaagcgcgaggtcaccgcgtacttgaggtccacgcgctcgccgtgccggaaggggaccgtgccgtcgttgcccacctaaggcggggtcggtgtgggcattgggagcgggggtggaggcggggctgcgagggcggggcgggcatgcacctgtcagactccaccacgagcaccaagcactcgtagcccgcgggagagcttgaggcggccacgtggcacccacccccccctcctgccatccccccaacctcgagcccacacacctcgacgccatcgatggccatgatgacgtcatcctgacgcaggacctcggcctcgtgggcggccgcgctgacagagcgcaccagcacgcctgccggggtgagcaggggaagcatgtgtgtggagactttggcccgcgctgggcgcatcgcggcggcagccgggccgtgcttctacaggccggtgccgtctgcatcctcgctccatggcccacaaacacacacacctttgtgctggggccccatgccgcaggcgagcctcagggtcctgctttccagttcctgccagaccacgttcagcgaggggaagccggtgtaggtgcccgtcctgtgtgcggggaatgtgcgagaggtgctgaaatcaagaggatgcaagcggcgtgggcccagactcccgtccacggctccattcgatggggctcctcgacctcgagctccagcatgcagacctgtgcgaccccacctcccctttgggcctctcacctcatgtagtcgtgcagaaagtnnnnnnnnnncagctccagcatgcacacctgtgcgaccccgcctcccccctgaccctctcacctcatgtagtcgtgcagaaagtggcggacgaccgaggtggggatgacgtagccaatgttggctgcggatggaaggggtgaggggcgggggggggtgcgggtgggaggacatcaccagatgatccaatatgcctgggtgccctgcccggcaacagcaccctggcgcctcactgtgggggacctggacccgtgtcgctctgcggcaattgcagcgcatcactgcccgagcatggccccgccatccctattccagtccctcccaggtctcccctccagtgccaacgactctgtgccatggccgcaccccttccccactcttccccaccccttttagtcccttcaaccacccaacccccccgccccacccctccccaccagtgttgccggtgaggctctggaaggcgatgcccacgcactccccaccctgcgcgctcatcaccggcccgccgctgttcccgctgttgatggcggcgtcggtctgcaccgccagcaggctcatacagccatggctgtagtgcgtcatctgcaccctggacaccacccccgcgctgatggccagcgaatcgccgccaatggggtagcccagcaccgccaccgcggcctgcagcgcgggcgtgtcggccgacagctccacggggtgcaggtcgcgccagaaggcctcgtcgtccacggtgagcagagccacatcgcacccggtgccgacggccagcacgcgcgcggcgtgcttctcgtcgtcgccgcgccgcttgagctggacctgcgtggcatacgacacgctgtgcgcgttggtcaggatccagcgttggccgccgggaaacgccaccgcgaagccggtgctcttgctgtgcgtctgctgcttgcgctgtcaggtgatgggcgttggggggtgggtgaggggaatgcagggagcgagtggaaactgggtggcatgatgcgcgggagactcgtgcggtgggagggaggaagggagcactgggtggtgaggcagcacagtggcccagagggggccagtggccggccttaacaaacactctgaccaaccccagctcggcaccagtgcaccagaccccaaccccaatggtccaccaccccatctctccaccgacccacctgccagggcagctcatggttggggtagctgtgcgtggcaaacaccttgagcacggcgtccatgtgacgcttgagcacgcgcgcccccgctcccgtggtcagctccgcctctgccgcgtggtgtttggccgtggccggggtggccgggtccagcaccaagtggtggtcctggatcagatcggtgctggagtccagggaatgcaggtggcgggcgctggggacaggacccgtgccggcctcctccctggggcccccctgcgcgccgggggcggagaaggcggagcagcgcaggtccatgcggggtggggacgggggcttgccgcgcagggggtaggccttctcgctgcacgggatggagctcgacatcctgggcgccggaatggtgtggccgggggtgggtgtaagtttggattcagaggcaggacccgcttttgtggatcgacagggagcccaccgctgtacctcaggaagctgtacgccggcggtgtcgggggggatgtacagcgacacggaagcccgcaaggcgtctgcggcaatgcccggactggacctatgattcgttacctgcgttgaaagcatctgggggtgctggcgcacgctcggagagctctggcaggtgttcctgcctcagcccggtggtggtcgacgggaaaccctaaccctcgtccttcagcgcagaggggccctgatgccacagagcacgcgacatgcaccgtactactcaaagtgcgcaccaataggccaggcctcacctttggctcggcacccgtcgagtggacggcttcgaactactcgagttgacggtcggggtcggacggagacccggcgagaggcttatttaaaaaattcagtacagacggacgtcaacaacgtattgattgtagagagagcgaagaggtaatatttgaaatgagagtctccttgaacaaatgcctcttgcgctgatacacccctcctcctcacggaagtgccctgcagcagcagggggcagatcgcgcgcctaaagactgggccactgaacgtctggtccaacctcacagtgtaccctttgttgggcgatcactcttgttgaaacgtacaaaatcnnnnnnnnnnatctagtccaacctcacagtgtacactttgttctgcgatcactcttgttgaaacgtacaaaatcaagctactgatctataagacaatccataagatggtggagcgtgcagtccacggaccagatgggagcgaggcaggtttcatcgagcacatggatacagtgcaggtgagaagccacaaagcnnnnnnnnnncaaaattcaatacagacggacgtcaataacgtattgattgtagagagagcgaagaggnnnnnnnnnnttacgcatctggattcgttagagtaacagattattatttcaagggacagatgagggaaggaacnnnnnnnnnnctacgcatctggagtcgttagagtgacagattcttatttcaagggacagatgagggaaggaacccctcctggaccttcaggagtaccttgagctccagaggtccctcgaggagtcgctggaggccgggttcctcagcatggcccgggctcggtaccagacgaacgccacggagatcagcacgattcggatacccagtcacatatcggccagcacgggtgtctcacggagcggtgagcccctgcttagatccaggagtgtgtgagctggcaaatgtccctgatgcagccacggcctctttcctgcgccttcatccatgccattccccctgcagatgcgagtggggagctgcagttggtgaggtctgaaaacttcaggccgctgaccctgcctgcacgctctcacggcctgggtgaggctggctgccatgcgggcagcggccaggacaaagtccccagctcagacaacgcagcccgccaaatgcccgcctctggaagcccgccagccccaagcatcgtagaccagattgcggagcggtttgcgtgccagcgcttggaagatgctcccaaggcgcaggatgctgatggcgccgctggcaccgcacccaagggagcagacccgctgcgctggtatggaggcctcgtaccgcatgacatgaggagggcagagaagcactttcagagtgccctgcagctgatgatgcgagcggcaacgttgcggaccaagctggccatgacctttgagacaaggtggtatgagccatctcagtgaatgtcttagccctgttgaaatgtgagcaacagtcgccacacagttatagtgaagaatgacaattaaagggctcattgtttgggttgtggaaacatcggacgaggggtggacctaaaagtggagctacgctccactcaaccgtccttcaccaccccacgacgagagttgcacagattcgggacttacgcgagtcacatgagctctcaccactcaccgctggcagcattgcatggataattggaacaagtcactacagccttgacatgccctccgccggtcccctcccaggagcggcgttgagcggtcgtgtcgagctcgccacccacctctgtcatccgcggcgaaccacaaacagacactttgctccattcctgactgattcgaggcctcgtgatgcgtactcctcaacatttaccccctcagagggccgatctggccagagaggtgcagcgggccgggtgtcggcctcaactccccctactgccctcgttgctgcgccccgcacccccgccctcctccgctcccagctgatggacaaagaggtggtcacccgaacctctggacgccgactggggtatgtgcaccaactgacggtggacccagccaggctggaggtggcagcgctgtacctgcgcaccagccccacggggttgggcgcccaggccacggaccatgtgctgctgtacagcctgcgccagataggcgacgtcatcttggtccatgacgagtcggccctgctggatccacccgccgacgaggccgccggctactgcaagctggtgggagcggagcttgtgtcagagagtggcgtcaagcttgggaaggtgaggggagcgtgtgtctgttgaaggagggagggggggagttatccccacatgcctcccaagagactaatgggatgcagacgggcggggagcaaagggcattgagagcgcctgatgaagccttctctagggctttcatcatggtctgccttgttaagtgcgcggaccggcgaccgtgggtggcctgctgacaggctgggttttcaagatgggcaggcaggcgtgcttggtcttgctcagagccatgcaaggctgctctatgtctgtgaacatgagggactcccgggcccagcagccgagacacattaccacctgaacaatcactcgcccctgaatccccaggtgcgagactatgcgtttgacccagactccggggccatctccagcctgaagttcgacgtgctgggcctgccatccattccccaggccctgctcccctgcagcgccctgcgctgggaggaggtcgtggccgttgcgccacagcgcatcgtcgtgcgcaggtgagccccgacggtggttcctcgaggattaacagcgcatccgcatgaacctttcagcgagattgcttgtgtagggacagcttgtgtaccattcccaacacacttctgcaggggggcggaggcgcgggcggtgcaggagaacgatggctggctggcagaggggatggggatgctgctgggcatcctgggaggcctgggtgaagaggcggaggcggggccgggcgagcggagggctggggaggcagacgcgtaccgctcggaccccgcctaccgggagtggtacgcgcggcacgggcgggactactcccgctattacgggctggacctgcctgtgccgctggaggcggcgcagcgcccgctgccacggcgggatgccgcgccgcgccgcgcggtgccgccgcagcgagccctgcccgcgccgcagacccccagctatgcagaggctttggtgccagggcgtcggactgccgcgcctgcggctgcaacggaaacccagggcgatttgctggaggtcatgcagcagcgcactcgcctggcaaacacccgcggactgccgctccgcgaggcgccgcctgcaagacggagtgccccgaggcaggcacagcaggcacagaggcagcgctgatgtggaggggttgtatgcggaagtgcgacatgtgacagcatggcttggcagggctggagagagatacatgccagaattcctatggaattctcccctgggcaacttcttgttaacaataagtctttgcgcgcatgcaagtgcaccatccacatgagttttcaagtaggtttctttttgctcaacacattgtattgtgttgttccctggtagtcatcactagtgcctattgatgccgggttcacctctgttggaatcctggcaagccttctccgggcttgtgcaacccccgggcgggcgcgatgttcacccgacaggaaaggattcgtaacaagagcacgcctcccctttacattcgctgctcatgtactgcaatcaactactcgtcttgagggtatgaaggcatgactttgtgcgatggatgacatcgaagcgtcctcgactctgcctttcgggacaaacgttggggagtacaccatcaaagatcggatctggaggggggagcgaaccgaggtctaccacgtggaagacgccgatggcgaggtcagaggacgggggggtaaatcctttgcgcaggaggtctggtcggcacagttacccctgggtccgtcgcgaaaaatacctggccttacaacggcacccgctcgcgttccctgcgcagtcctacgcgctgaannnnnnnnnnataaatcctttgcgcaggagctctggtcggcacagttacccctgggcccgtcgcgaaaaatacctggcctcacaacggcacccgcccgcgttccctgcgcagtcctacgcgctgaaaatcgagcttgagccggggtgctcccgcctcaagtctgagataaaggtcctgctcgtctgctccggagtacccaccttcagggatgccggagatgtggatgggcgtgcatatattgtgcaggagctgctgggaccctccctacacacggccagcatggagcatgaaggcggaatatggccatttatggaagtcaaggtgagacctagggggaatctgtgcattgggttgctcagctggcttgccctggcagtgcctcccggtgctcctgcaatgggcagcttatgctgatccccacctgcccgccctacccctggatccacagagggtggcctgccacctcctggaagccatccgcggagtgcacgagggcggtcacctgcactgcgcactcagcccccgcgctttctacaggcgcggccagggcgccgaccacccaggcatgctctggcgcctgtcgggcctcggctccgcccagctgcagtccaaacggcagtgcatgcccagggccgatggggcagggcccggcgcgtacaccgccccaaacctgcacaacccccttgctctgccggaggagcgtgacgaccttatctcctggctgttcattgtggcggagatgctcaccgggaggctgccctggaaggggtctggcgatgagccggggtgcagtgagcaagccatgctgaagctgaagatggaggcggaggcggatcccaaggagttattccccagcgagggggggatggtcatgccgagggtgggtggggccgccggggcatcgtgttggattggtgtggcagtaggagctgtgggtttggtggtcctgtgtttgtagtcctgccctggaggcctgatcccaccaccactgccttgtgccaacctctcccagccctggcgttgacacagggtttctacgccttgcacgagactgtggttcgtggggagccggacgacgggccagactatgccaggatcgagctgctggtggacaggtgcgagggtgcggccaggggctgcctcgcttggaggctgggtgggtgtctctaagggcgtgtcgacaacctgcggtgctgttggagggagtgaggggtcagtggtgtttggcaagggggccatggggtccttatgatgcccatcgtcgcccaacacgtttaacgaatgacgagctttgagtacagcaaaagcaagtgcacctgtcgataagcccttggctttgcagagcctgcccgcatgcgccgtgccgtcagannnnnnnnnngggaggctgggtgggtgtccctaagggcgtgtcgacaacctgctgtgctgttggagggagtgaggggcccgtggtgttggcaggggggccatggggtccttatgatgcccatcgtcgcccaacacattcaacgaatgacgagcttttgagtacagcgaaagcacatgcacctgtcgatgagcccttggctttgcggagcctgcccgcatgcgccgtgccgtcagatgcgaccctcgcctttcaacccccctcgggtcttccaatctaggctgaccgaggggccagccagcgcgccgagggaggcgaggaagcaggcgcccacgcccgtccttgcctcggaccgaggcaccccggcgggcagccccttcccccgtctctcagccggccgcgcccccatctacgtcaatccccgccccgtgcccgggtcctccggcccctcccagcccgggcccagccgcggcgcgccggcggcccgcggcgtgcgggaggcgggtgttgagccggcgccggcggattccaggcagcgggcggatcccggcagggccaccccggaccgcgacgcggcggagcggggacgggagccggagccgaagcgggccgctcggcccgcggcgtggcggcgcgacgaggacggcgcccgggtcaagcgccgccggccctcccccgagcccctgtcgaggtcgaggtcgaggtcgccgcgtcagcggcccccgacgccggtctgggaccggccccccgcagaccgggaccggccctctgcagactgggaccgagcccctccagccggggaccggcccccgccgcccgggaggggggacggtgccccggcctggggtcctgccccggcgggggaccgcgccgcctggggtggctacggcggcccgcccccgccggacagggacgccgacagggggtgggacgccgggcaccccgcgcctgtggaaagccgccgccccgtgcagaggtgggcaggggcgtcccggggtgcggtgttgtggccctgatggcgtgcggagggtcctgggagggggagcatgcccgctccccacgtcgccccctttgccactcctcccgtcctcgccgccccgccnnnnnnnnnncgcggagggtgctgggagggggggcatgcccgctccccacgtccccccctctgccactcctcccgtcctcgccgccccgccccgccccgccaccgagaaagcgcgcacggccccctcacgtgtgcttgcactgcaggtcgccggcgcccggcggccctcgggaggatggcggctggacgcagcgcggcggccggcggccggcaccctactccccggggatggactcgcctggcggtctggtggatgtgcagcgcgggaggccccatgcgcccgagggcatgccgccgtacgacatgggccgctacgagcatcccgggaggtgaggtggaaggagcagcgtgcgcgaccggctgtccctcccgcggcaggctgtgtggtgtggccgtgcagggacgcgtggacctgcccccaatccctgccccagtccccccagcagtccatgcatgcaagcctggatacctcggcagagctccctggcacccactgccgccgtgcacatgnnnnnnnnnntccccagcagtccatacatgcaagccttgatacctcggcagagttccctggcacccactgccgccgtgcacatgcctcgcaggccgatgcaccccgcccacgcgccaccgatgccgcccatgccgccggtgccgccgccgcacttccagagctccccgcatggcatgcagatggtgcatccgccgccgccgccgctgccgccgccgccaacgacctggccgtccgcagtgggggcctcgtatgacgnnnnnnnnnntgacatgggccgctacgagcataccgggaggtgaggtggaaggagcagcgtgtgcgaccggctgtccctcccgcagcaggctgtgtggtatggccgcgcaaggacgcgtggacctgcccccaatccctgccnnnnnnnnnncggcatgcagatggcgcatccgccgccgccgccgccgccgccgccgccgccaacgacccggccgtccgcagtgggggcctcgtatgacgagaagacgcacgagaagtacaaggcgtgcctgaagtacgtccacgccctgcgccaggtgtggagccctcctgggcctgggtcgagtggacgactgcccccgggaagggatggcacctggctcgcagcgccatgtgcatcggacacccaattccctcaggagtgcgggatgccgcatgtccctggtgccacctcaccatcctgctctcctctcctccacgtagggagcgctcagcagggaggcggaggaggcctgcgacacactggcgagactctcgcccatcgacgccctgtcggtcatctgctggacggcggacgaggtggccacaggtggggagctgtgctggtgaggctggtggttgggaggaggtggaaggagtgcttctgctgctgctgccggcacgtcgtctgacgtgagctggagccttggggcgggcgcttccaggatcgctcacatctaggatccttgccgcttggcatgtccaccgccccgccccgcctgcccacaggtgtggatatggaggctcaccccctggnnnnnnnnnngggagtgctgctgctgctgctgccggcacgtcgtccaacgtgagctggagccttggggcggacgcttccaggatcgctcacatccaggatcctcgccgcttggcatgtccaccgcaccgccccgcctgcccgcaggtgtggatatggaggctcaccccctggtggcagagtggctggaggagctgtcagccttcgccgcgggactggccagacgatgtcgccagaaggcgggggcgctgcccggtcactgaggcgcatgcagctactggggaggcaggggcgctcggtctggtcaccccgagtctacgactgcggtgctggtctaaaaaatcaagtatcagggggagtcgtcacggggcaggcaggggcaggccttgcccatggggcaggtctcgggcaggtannnnnnnnnngctggggaggcgggggcgctcggtctggtcacccctgagtctacgactgtggtgctggtctaaaaactcgagtatcagggggagttgtcacggggcaggcaggggcaggacttgcccatggggcaggtctcgggcaggtacacgccgccacactcctcacacaggcccagggaacgcctctgggcccgagccacgagcttgtccacggcgccggccgagaagtagaggacgatgaggaagccggcgaagaccaggcctgctatttggtcgagggtccatggtggggaggagtccatggctgcaaggaccagcgactgggcgcgcatgcgccccggcagatgaagaagggactcgactactggtccctgtcgtgcatggtggccaggctgccgctctggccggccaaacttccatcgcatgggggccatggggctcggcagccggtgagacaaccccccccgtgacggggaattgacgagggccaaactcatcctcgggcgccgatgatgacccttcttatcatgagaacataggagtttccagatatttttgcagaaaaggccgagtgcagatttttgcaaacgacaagtcggcacatggtgcatgctcgctcgaggtcctcgatcctcatgggtggaaaacttgaaactcgtgttttgcaccccttcgcatcccttggtgatcccatccccatttctcgccacaaccctattcaagctatgtccatctaaataaatctctgggtcgtgagccaggttgataaannnnnnnnnngcctcgatcctcatgggtggaaaacgtgaaactcatgtcttgcactccttcgcctcccttggtgatcccatccccaattctcgccacaatcctattcaagctatgtccatctcaatgaatctctgggtcgtgagccaggttgataaaatcataagctgggaagcctggcaggattgccatcaagattttatcgtttgagagtggggtccgacaagcaagtgtcggtgcattgtgcatggagtgatgcagacgatcctcacttgccttcaagggtacgatcccannnnnnnnnngagcaagtgtcggtgcattgcgcatggggtgctgcagacggtcctcacttgccttcaagggtacgatcccacagcactggagctcactggagcaagacgcctacctgcatgatggatgcgatgacatgatgttttgaatcagggcagccaagaaaagggtgtcaagttgccacagaaccatagcacagcccagccagtggccactannnnnnnnnnctgagtggagacagcattgccatggcaagattcccaggcattcaaggaagaggcagtcctggcactctcaccgagtcggcaactaacccctcagctctgtacctgccctccaccccacaccggctcacctcatggccacccacaccccactgcttgagcatggccatgaagcctgcctggtcacccactgcctgatagaccccttgcaacatggccttccccgctgccctctgctcggagtgtgcatcccgctgcagctgcagcgcagcctgcgccgtcctctgcagcaggagggtgtcgtgggccagcgcggacccgtgtcggcgctgcagctcgcagcagagacgtgcgaggtacgcgcgggcggcagccaccttggcgcctgccagggcggacagcagggcgttcatcatcnnnnnnnnnnggggccagcgcggacccgtgtcggcgctgcaactcgcagcagagacgtgcgaggtacgtgcgggcggcagccaccttggcgcccgccagggcggacagcagggcgttcatcatcggcgccgcctgcgccgcctgcgccgtcgcgctcagcactgccctggcggctgccgcgaggaacccggcacgcccgacggggaatgccaggggtaggaggacgggcagcatggtctccagcagcctatcgagcttggagcagtgggctttcaccaggacctgtgcacggaggtttgaggggaatgggtgtgggagagccggacgcagggtcatggctccggccaaacaatctaatgagattatgtgagtcccaagggcagcacagaaggcattccagagggagctcgagcccggcatgccgtatcatcacaagtggggcagctgacctcgagggtgctcagcgcagcccgcgccacctggctgcgcggagactgcgtcaaggaaagcacggccagggcgctgtccaggaggtgggccctggtgtagcggggatggcacgagcccagcagggctgggagggaggcgaggtctgctgtctgagtctcccacttggcatccgtggcttgcagtctctgcgcaaggatgttcagtgcgtgggggctgggctcgaggggctgggggaaaaagaccccagatacttgtggatgcatggaaaggaccaggtagacctctgcctgcatacctctatgagagtgcggagtgcctgagtttggtcggaaggtgccccacttgagtgcttggtgcctattgcaccaaaaggaggctgagctgaggcctgatgaccttcgttgtgcctcggggacgcccgagcaggggagaagcggnnnnnnnnnntggtgccccacttgggtgcttggtgccgattgcaccaaaaggagtttgagctgaggcctgatgaccttcgttgtgactcggggacgcccgagcaggggagaagcgggcaggccccaccacaacttgtcgtgccttgctgattgattgcagagttgggacagtgggagattggagctgggtagctggttcctccccgaatacctctacgcgcccaactcgagctagcccgttttgcaggcctgtctctgcgcccacaggcaggcctactgatgactcagcgactattccagctattgcagtcttgctacccaggcccagcttccgcagccccgccgccagctgcgagtgtttcaggtgtgccagggcactgccgtctggatcctgaatggagaccaggctggagtgcgtttccagccatcctggcactggcgcttggccctctactgcggccccaatgctccagggcacctccacagccgtctctgtcaggcgggcagcgtttacatcgctctgctgtcccgcgtcatcttccacactttgtgtggctgtatggtgaagtacttctccgttcatggatcgcacagtcatttagcggtacagacgagcaatggagacgaataaatctagctcttaatggttcatcagctattgacgcagtattttctcaacttcggaggcagtgcgagagggtgacatgtctcccgacatgttgcgggcggggagagacagagggactgaggtgcgatccagaattgtcagcgtgggttctaatttgagaataaatgcttcagtggagatggacctggagacggtataccgtcgaagtgggcatgtccgtgcatgggcccggtttccactcccgatgcccgatgcgttgatcctgagcctccgacccgcagggaatggagtacacattggaactgcactgcacttcgcattaccatgctggtgtgaaaataaagtcacaatccatgtgtgcaaggatgaatggcaagggatctgcgtgtcggcacggtcgcttggcatcgcctgctgtgcgtgctgcctcttacctcaattcaccactcgctagctctgattgagatgcatttacaagggataggcaggtgcgacgctgcagaggctatgaaggcagatcgcttccaaaagtacacggttacattcaacatgccatgcttcagggatgaccgaccatctggaagccaccccccaccgcccctcccgctggctccccgcccgcccgtatccaggtcatgatctggtcccaggcgctctgcatggagatgagcgggcggtgcgcccccaccaggcccactctttctacagcatcgaagccgtcggccatcgcggactcggtgggcacggtgccgtccccgtccacgtaggtgtaagaggcattggcgtggggcagtgccttgagctcagacacggggaaccaccagctgcctgcgagagggggaaaggaagggcagggaggtggcagccagcccatccatgggtatggccgggtgcgagtgcaaaatcctgctcaggaggccacagaccagtctcatgccacgcgcaccgtactgcaggctatacggcgtggggtaccccttgccatacagattgtagaacctggaggtgcgtgggaaggtgcatgccgaccaagcgctgtgtgagtcgacggcgcgctgccacacctgggttgacagtgcgatcgggggttgatgggttctgattctccaaggcgctaccttcttcagcctactcaagactctctcccatggcaacagccatgtgcgctgctgcacgcctcacgcctgccatccataccagctgcagacgtgcaatcaatgctgtccaggctcgaacacccaccagcagcacccccctcccgagccctcggccccaggacacgccccagggccctgtccctctgcacccactcacatccggattgaagggcnnnnnnnnnncgccccagggcacaccccagggccctgctccactgcacccactcacatccggattgaagggcatggccactgcctggcctccgatgctcacgctgttgccctccagcaccccctgcagcaccccccccagctggtccagtgcaaacttgtactcgtgcgcctcgtgccagctggcgagcggggcctcctcgggcccgagggtcctcaccccagccgccgcttccgcagccgccgcctccggaccgggtcggtgcatggaagggtggatcgcagagggtaccgccaccctgcgcaccgagcgcgggcgggccggggggtgctccgaggcacactgccgcgccggcgtgcggggctgcgcggcggcccccaaaggcagggcggcggctccttcgcccccgccgggcaggggtnnnnnnnnnnaggcccgagggtcctcaccccagccgccgcctccgcagccgccgcctcggggccgggtcggtgcatggaagggtgggtcgcagagggtaccgccaccctgcgcaccaagcgtgggcgtgcccggggatgctccgaggcgcactgccgtgccggcgtgccgggctgcgcggcggcccccgatgccagggcagcggctccttcgcccccgccgggcaggggtgtggtgagccacagggtcagctccggggcgggggcagcgtacgggaagtgcggtgggggcagcaactcgtacacagcgggcgactggacgcaggcctggcggaacgtgccgcggtcgacgaagaagtacgcgcccaacgaccccgcaaactgcaccccggtcaggagcgcgtcgctgccgaatccgggggcgccgccgaatggcgccgccactgcaatccaggtctcgacctaaaggtaagggggggaggggggggaggtcataatctggggtgaggtgaagtagcgggagggaaacccggggcaggggccaagcgacnnnnnnnnnnagggggggggagggcataatctggggtgaggtgaagcagcgagagggaaacccggggcaggggccaagcgactggctcttccagcaacagtggcacattgtcattggagcgcgagacctagccaatgcgtcaggggatctgtattgaggccgatccgatgttccccacccatcacatcccaggccgcactcagcccctgctgacccccacccagcccacagcgcaccagcttctnnnnnnnnnncacccaatgcgtcaggagatcggtattgaggccgatccgatgttccccgcccatcacatcccaggtcgcactcagcccctgctgaccccacccagcccacagcgcaccagcttctcaaactccgcggcgtgatcgatgagcagactcctgacgaccagggctcccatgctgtggctcaggatgtcggcgcggcgccccgtcagcgcgtgcatgctgcggagccggtccagcagagccggcacatgcgcggaattggactgtcggaaatcgtatccgaagccaaacaggtcagtgccgcaggtgtagccctgtttgctctgcaggaggtgttagtgggacaactggggttgaggtgaggaaactcgtaggtgnnnnnnnnnncgtgtagccctgcttgctctgcaggaggtgttggtgggagacctggggttgaggtgaggaaactcgtaggtgcaagcgagtgcccactgggcaaacgctttggggccgagagattggacccgaggagcctgagggaaaccgcaaaggctcccctttgaccgcagctgccatttgctgcaagggttcccctccctccacccacttgagcttcccgcgtcaatgagctcaccgtcagatactccacaaatgtgtcaaagtagtggaccacaggcagtccatactgcacatcggggtccaggatgctaatggggtagagtccgcttgcatcgccgttggtgggcaccagcacctcctcagagtcagaactgaggccctccacgcgtccactgctcctatcatatgttccccacagcttctggtaccgcaggtcagccccactgaggctgacccaggccctctccccctcccctttggccccggcggcgcgagtgttcaggatggtcccacacacccctgcgcatgtgcgatggcgcgcacaaagggttgatctggggttggaattgtctcagctcccacgagacaatgcgcggtattccctctgcacgcgcacctgggatgagaaggagaggacgggccggttcctctgctgcagacatgggcagccagcggggaccatcacctgctccccgaagagatgactttacgtacgccgtggtattgatcacagagcttgatgtcggtcaagctcgccagctccacctgctctctgctggtcatgtagatgctccccagatcccggaaccagaaaacagcgcgcgctgtgctgcggagctcctcaaactcccgtcagcatcctttcgaaaactaaaacctcagtccgcgcaggcagtggcaagacgaagctatcgttgggacattgagccgattaggatctgaagaaannnnnnnnnnccgtcagcatcctttcgaactaaaaccttagtccgcgcagggagtggcacgacgaagctatcgtttggacattgagccgattaggatctgaagaaacagcatcgtgggcgtgcgcgtcatctgcacgggtgtcagaacccataccgctggcggagctagcagccggaaggctggagcgaaggtcaccacctcggcgccagcgctctatgacgggaggggccatgagccccaagggatcgccacatggagaagaagagcgattggtgttggaagaggtggagatgcagaagaggtcttccgtacctcggtccacgagcacccagcaggtaggccgatgaagctggcctgccccgagcccaacggtccctcacaacgccagaaaccagtggtttcagaggccagtacaccataaggacgtggaatgccctcatccttggcatgcaggcggcgcaatccttgttcaacacctacttctcacggcgattcatgagcggctggtgaggtgttctggagggaagcggcgggggcggggcgcatgcgctgccctgctttttgagcccacatggggtatcagcttacatgtcaaggcttgtgtcaagccggggctcctttacagaagattgcagtgccaaggatgtgctggggtttatcacacagtattgtccctgctcagtagctccgcaagcgctgctgctcccgagctgccgctttccctcacccctcctcattgcccaaatctcgcagtgccattctcttccctgtggtggtgacggcctacctgacctggtggttcctggagttttttgacaacttcttctcgcccctgtacacttacctcttcggctttcatgtctttggcctgggcttccttacctccatgctcttcatctttgccacgggcgtcttcacgtcgtcgtggatgggggccaccctcttcaagctctccgattacatcattcggaaggtgcccctcgtaaagcacatttactcagcagccaagcaggtctccgcagccgtctctccggacaacgaagcaactcacagcttcaggtgcggcagcctttgttgtggaagtggctcaggggcatggatgcatgctagaggggctgcgatgccgtgcatgccagcaagccagggtgtggtgccatgcatgcctgcagaggagggggtctggcatgtccgggacaagtcgtccacaatgtgtaaatcacaaacgcctgactcccgcagggagtgcgtcctgatacgccacccccggcacggggagtacgcctttgggttcatcacgggacagaccaagatgaccactccggagggcgagctggagctattctcggtgtatgttcccaccaaccatgtctatgtgggcgacattttcctcctggccgcccccgacatcatcaggcacaacctctctgtccgagaaggaataggtgggtgtttgtttttgagggggggtgccctatgttggcccaagcaggccacctagctcatcgcagagttccaggcagccatgcatgctcacgtcaccaagctgggccttggtgctcaccagctggtctgttacaattttgtggtgctgcagcaataccttttccttgcccctacgcgccccgcagaggttgtggtgtctgtaggaatggcgttgccaggccacttgcaagccactgggaggtagcactgcacccatgcatcaccatgctccgcggacctttaactatcaagtttagtggggcagtgtgagcaactgcgagtcagattgacggttgcaagagtccgtttgccagatcctacgctgtcacggtgctgaacctcggtggtgctagggtttcatgcaacccagagaagataaagaaaagaaactcttctgggccagtggtcgaattaccacgtgacgcgcggccaccacccgacgctgttccggtggtgcagtgcccaacgtaaggaatgtgcaatgacccacaccagcaacatcggtacagtgtattgattctgagcctgacgacctcgagatgacggagaccaagcagcatggaaccttcgccgtcaaggtgggacgcggtggtccgagtggggggatgcctgggacccgcgtggccatacccagcacaccattaccaccagcaggtcaaacaacatatacccttgcgcctgcatgcggctcggcgtccttcccacgttcagactggggaatcctctgtgggctgtggcgaaacccaccacccaccagtcatcacgcccctgttcgccccgcagagtggtctggcccagatgttgaagggtggcgtgatcatggatgtggtgaccgccgaggaggcccgcatcgccgaggaggccggtgccgtggcggtgatggccctggagcgtgtgcccgcggacatccgcaaggatggtggcgtggcccgcatgagcgacccggacatgatcaggtccattaaggccgcggtgaccatccccgtcatggccaaggcccgcatcgggcacttcgtggaggcccagatcctggaggccctgggcgtggactacatcgacgagtccgaggtgctcacccctgccgacgacatccaccacatctccaagcacaacttcaaggtgccctttgtgtgtggctgccgcgacctgggcgaggccctgcgccgcatcgccgagggcgcagccatgatccgcaccaaggtgggagggggtcgcactggtggctggtgggaaggttgggaggggttgcgcatcgacagtcctgttgaggcttgtcatgagagctgggtacctgaagggtcgcggggctcaggctgacggtgacggagcagctgcccagctgtgagcttggagtnnnnnnnnnnccagtcctgttgaggcttgtcatgagacctgggtacctgaagggtcgcgggactcaggctgacggtgatggagcagctgcccagctgtgagcttggagtgactcactgggactcgtgcgcacaggctccctgttactcaaagcatagcacggatggacgaccggtgtccctctgggcacgcagagtccaccccgtcctcgcgcctgcgccccgccccgtcctctctcatgccaaatccacannnnnnnnnnatgcgcacaggctccctgttggtcaaagcatagcacggatggatgaccggtgtccctctgggcactctgagtccacccgtcctcgcgcctgcgcctcgccccgtcctctctcatgccaaatccacacacacactcacactcacacacagggcgaggccgggaccggcaacgtggtggaggcagtgcgccacgcccgcgccgtccagggcgccatccgccagctggcgaccctcgacgaggacgagctgtacgtgtacgccaaggagattcgcgcgcctgtggagctggtgcggcagaccaaggcgctgggccgcctgcccgtggtcaactttgccgcgggcggcgtggccacccccgcggacgccgcgctgatgatgcagctcggcatggacggcgtcttcgtcggctctggcatcttcaagtcgggcgatcccgccaagcgcgcgcgcgccatcgtgcaggccgtcacccattacagcgatgccaagatcctggcggaggtgtcgggcggcctgggcgacgccatggtcgggatcgacgtgcgggagaacggcttcacttcctacgctgcgcgttccgagtgagcgactcggtgggcaagagaacatttgtggggggggggggccggggggggggccgggggnnnnnnnnnnggagtgagcgacgcgctgggcaagagaacatttgtggggggggcccggggtggaggccggggtgcgagggcgcccgtgcctgggcgccccagcccgagagctgccatggactgcccgcttgcgcgatgccctggccctcgctgttgcacgccggcaccaccccatggctgcctggttgtgggggaagtgtcctaccgccccaccctgcactgatcccctgctctgaagacgtgccccacctcctcccnnnnnnnnnntcacgctggcggaccgcaaatgacacaggaacctacatgagacactcaccatgggtcagggatcaagtgcccattttccgcgcccatctgcactgacggccgccgtcaggccgccagcctggtcatgtcgccaggctggnnnnnnnnnntccactcttgggagaggtgggacgtgcacctgtgttctggccactgattgctgtgctctgtgacagactccgtgctgctcaggcagggctcggtgcatttaatatctgaggtgctgaccaggagtttgggaattgacacgccggcggaccgcagatgacacaggaacctacatgaggcattcaccatgggtcagggatcaagtgcccactttccgcgcccatctgcactgacggccgccatcacgccgccagcctggtcatgtcgccaggctggtcaccaggcgcagcacgtcggtgagggtgatcacagcacacaccctgggccgctccagcgactccaccacatacacgcggtgcacatggcgctccacaaactgtgaggagggaggtaggaaggaggactgagagggcctcagaagagatgtgtgagagaacgcaaatgcaggcaggcggcggaaaaacacattccagcccagcagagaaagagaagaacgccagcatcttggacaagcatggactaagcgtccagtgcaggaacgcatggctttccgtgggcagagcaatcaaggccccggccacacactaccttggccaatagacccttgaaggttgtcgctggcacgaccgtgannnnnnnnnngacgcaaatgcaggcaagcgggaaaaaacatcccagcccagcagagaaagagaagaatgccagcatcttggaagagcatggactgagagtccggtgcaggaacgcatggctttccatgggcagagcaatcaaggccccggccccccacacccagtaccctaccttggccaatagatccttgaaggttgtcgctggcacgaccgtgaacagggcgatgtcgttcttgccggggcctatctggcggtgcgcggcattgaagtaagcgtgttgggccagggaggaggtatgcacgctgtacccaatgtctgcttggtaggaagggaatggatgggagtcagggggagagggacggaggcagtacaggtgtgagagggaatggggtagtctggcctgcggggagacggtagactgcaagggcgcagcacctcatggacccccccggagtttgccattccggagcacatcatcctcacaactcacacgtcgtatcatgccgcagcgccaggaactctgcgaccggcagcgcgagcacccccagatgctcgccggtcagcgtcctgccagggtagtcgtgctcgaggagcttctaagtgggaggaggtccatcaggctggaggccctccccagcactgcgatcagtccgccacgccttccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaccctcgcatggccgcttctcacctgagatcgctgatcgacaggttggcgatcaggtctccggtgtcggcgacgacgggcgcgcccgccagctgtcgtgaggccagcatggcaaaggcagccagggtgggggtgagggggtccaccgaaaccacctcccgggcggagtccagcacccccagctggcccagcgtcgcgtcggccagtggacccagggcctcgggccgggccgcgaggaacttgatcacgtccatctggctgtgggccgtgtgcaatcgtgatgggtggagtgggggggggggggccttttgatgcttggggtggtgacaaacacctgcacctccttgaacagaaacagccagtacaagcccaaaatgcatacactgtccagggcactgcatgaccgcacatccttgcagagcagtcagcccatgcaccccccacgccgcgccacctgacgatgttagtgatgtcgccgtggggcccaaacagggcgatgcgatggaccacggcgctcatccccccctcagaggggcgcaggaacaggtctcggatggtgctgctgaggggcgtggtcccggcctccgaggcgtacagcaggttccggtcctcgatgcctgtggtgcgggggcggcggggtgaggccatgatcactgtgtgtggacatgggacaaggttttgcgatgccggggccgagaacccacaggagagcagggctgggcgcagcgccggtcccccaggcgtgcatcccgctcagcacgggtgcagggcatggcaccgccgcagcatgtcatgtgtgctgcctgacnnnnnnnnnnggtgcgccgcgccggtccctcaggcgtgcatgccgctcagcacgggtgcagggcatggcagcgccgcagcatgtcatgtgtgctgcctgaccccatgctgccctggtcagcacccactgggaatggtgatcagcatgcgcgagatgaagctgggtgctgctttctcaatcgccgacatgagagccagcatcttggagggcaccaggtctccgccacgcttaagatctgtgtgatgtgtgtggggggtcctctgatggacggggagggaacagccttgactgtgttcgcatgccaccttggccttccctggctcggggcagcaggccatcaccagatcaggagccagggacacaggcatggccctgaatgcaatcgccttgtggtacatcacactccatccaacccaaactctcacgatcgaggaaggctctcagaatgtctgagacatcaagccaccccagcagctgcggggagagctctctctcctcaggaagaccacccatctcctccaagtccggctcaagaacgatgggggcactcaggatgccccgtttcgccaggatctgcaggtgccataggtggacgaatcgcctcagagcatgatttgggaacgaggccttaattcgctaccgagcaccaccgaacaccgtgctcttaacccatggcctccgcctccgaacacgcacggtgcatggaggtattcactcgtcctacctgcattgcatcgcctatggagaggttctgtcgtagtgtgacgatgtcctgcttgggtttgcatagcgcactggttggcgtcttctgcagcagctcgtgcacgggtgccaggacctcctgggcgttcgctttgatgtcggatgtcgacatctgagcaaacttatgccttgatagattctgcgtctgtgaggatgtaaacaatagctgagtggtcgatcggtggggttgctcaacacgctccgaaaccaggctacgtaaccttccactggcctctcgactggagaagtcaagacagtggcgcgcgggcccactggcattctgagtatattgtatttcccagtctcattcgctctttttgtttattatagagaatcccagtggccatgcccctgcctgggagaggtggcgtgcacgcagcgcgcggaagaggccgtggcagggggtccaagttggacggtttcgctcgagggaagcagagtacctacgacccggtagcacgaagggagaaggagcgtgcgctgaacgccaagaccgtgaacaagtatcgcaagctccagaagcgcctggcagcggccggggagcacgaggcagggcaccgtcatgaggtgagtacagcttggtgtggctgtggaagatgcgaacatcattcaacaccagtacagctgatgtccccgattcggcatgcacagggcgtggacggctctgctggcactctgagtggggcgccttcagcaggcgcactctttcccccagccactgatgcccttggttcccacgggcacggccgccctcgcgtatcggatgatggaaaggaagaaggggaggatgtcaatagtgccgccagatttcctgcagagggacggaagtcgcatggttcacagctgctgcgcctcgctgagaaggtcggtgccacgaaggaggctgctcatcaggaggcagagaccagaagggcggaggcggtggaaaggaaacgcaagctcgcgcaggacaagaaacggcgggcagcaaaacatcagacattaatgaaaaggactggacgaggccagccggtcatgaaacaccgcatcgagatgctcttggacaagctccagtcttgaagcgtgctccttgcttacctccctgttactctagataaattcgctgggagatctgaccaggatcagatgtgcagccatccagcgcatgagcgtgggaaagggatgcatattcaccacagagcgctccactgtttcagagtccagagagcagatacatgcacctattggcaagtcccatctccaagtggtaccgtcagcacgctccctgctccacggccacggcagctgttgaacgtccataccagcaagaaagggccgccactcagaccccnnnnnnnnnnaccacggcaactgttgaacgtccatgcccagcaagaaagggccgccactcagaccccggcagacggaacttttgcagggcccgacctggcgctcccaaacactctgcgcaatttgcagtgattttctagctcagtgtggtcagtttgataaagatcacccgattttcagcgagccgtttgggccgggacagggggtccccgcatggcactggctcttcggtgtcggggaagactcggcctcgggcgattggtgaacagcggcttcgagcatgttaccggcacctcgggctcaaagactgctgtagagcgcaatgcgaatagccctgtcccatcagcagcccttttgggtacagagccgtcgaccagcgctcgcacgcaggtgcctgggaatcctgatctggccactgcagtgagcttgagtttcattgtgctcgaaacggttgtcaaacatgccaatccatcccaggtaccgnnnnnnnnnnatggacactgcggtgaccttgagtttcactgtgctcgaaacggtagtcaaacatgccaatccatcccaggtaccgttcgcatgccgcgggtttgcgtcctcgacacctgccgctgccgaggctggccggccaggaccctcgcgaccgcaagctgcccccagcgggggccccagccgggcagtcgcacagggcagacctacacggcccatgccccaggccaggggcccccaggcagcagcgcaggggcgtgcgcctccgtctcgccagggcgaccagcagcagagggggcctcggattggcggccgcggcgcacaggatggcggctcccagctcctgcgggacgacctcctgaaggccaactgggtgatcagcggtcccgaccccgagaatccggagaagacggtgcagcatgatgcactgagtgtgctggacccctcgcacttcacccaggcgctgaacctggacgcactccccctgctcaagcatctggtgcccgaaagggactggcgccgctttgcgtctggcgacctgtccccggaggagcaggagaacctggtcgaccgcctcagcctcgtgctcttccgctcatcgcagggggaggcacggcagctcagccggcgggctgacgtgagttcagagggggggcggggccttctgagctgagggtatcgcacctcttgtggttttagatgtgtgttgttgcagcccaacctctgctgccagtgctctagtttttgggacccggcaccgccagcctggctgcaaactagcggggacctgtgcaacacccatctgagcaaagcccctgccttgtcatgtgacacctccgcaaccccctcccctaaccccgcagatgacgtccaaccccgacttttgcatcggggagtcgctgggcaccatgccaannnnnnnnnngacccatctgagcaaagcccctgccttgttatgtgacacctccgcaacccccgcccctaaccccgcagatgacatccaaccccgactttcgcatcggggagtcgctgggcaccatgccaagcacggaccccacacagccaccgcccagcgctctggatgtgctgaccgagcagcgggactacttcctgcaggagctgggagtggtgagtggcggggtttgtgtttggacttgcgtatgtgcatcttcaggtgttggaactgctgcatcaagggtagcagcctctgcgacaaccagtcagtgacgacggttgctcagtgtcaggggggtgcaggaaaccctggggtgacagcagggccccaggtccgaccttccccctgaccctcgtccagcctcaagcctggcccccaatcccaatgcccggtgctgccccgtagagcgaggaggagtacgagtcgatcaagnnnnnnnnnnccccccaatcccaatgcccggtgctgccccatagagcgaggaggagtacgagtcgatcaaggccgatgtggccgcggacttcgaggccacggtgcgccctctcctggacgctcgcagcgattccggcgaggcccaggcccaggccctggaaagcgtggcgcaggccagcgtgcccgaggaccatgtgcacgccgccgccatcaaggacaagctgggggtgctggagaggaacgcgttctggccccaggcgtccaaactgacctttgcccagaggctggtgaaggccctgagctgacaggcttggtcaggatgtgcagtgcgtaacccctcccactcaggctttctagccctggtgtcggtgcattcgcgatgagcatgctcactgcgtgtagagctgttgcccaccccggcttgctgatgatcggaaagtgactgcctgcccctggcccccatgcggtggtgtcggccttccagggtgtggggtaatatcannnnnnnnnngacgtgactgcctgcccctggttcccatgcggtggcgtcggccttccagggtgtggggtaatatcagggtggcatccttgtgccaggctgtgccaggcaagcgaaggcgtgtatccggcatgtctcagttctctccaggcagcatcgtatcctccgtaatcatgcactgcgccacggtggcgttgggcagaaggtggcccacgcagtcccgctccttcagcagctcgtcctcgctcgcctggggagcgagaaagaggacggggtgggcgaatggtgtgcatgcgcactgcatgctcctgccacaattggagcgcattgctgcatggaacacttggagcaggccagcatgttaccctcccatatacatacaatcactctcaccttgcacttttcgatgagccagtcattcatgtggaagcccgggatgatctcgtagtcaccatcacccttggaccgcgcaggcatggagtacaccagcccctctgtgaaaagacgagggcggggcggctgagctatgccggccctgagggggccaccacccagcagcggcagacaggcatgacaaacagatcctgatcgagccatttctcaggcagcatatgctcgcaccagctagcccgtaggggttgccatcggtgatgacggcggtggagaaacagtccccctccttggtgggctgggtgagtgaccggatgtggtcggcgatggagactgcagtggatgcggcagaggacctcccccacttcttgatcaggactcctccgcggtttgcaaccttgcaatgaggagaatgtgggaggaacctacagctcacgacttctcccttgcgaaaatgtgagccactgaagccgctccaagagactttttattgtctctggtcaaccaagaggagaggcaatccacacacatgctctgcaaccacgctctcaatccgcctcaccgtgggagtaaactcctccttcagccacttgtcatcgtgtatgtactcgcgagcaggcacacctgcgcattatcggcagtgcttgacataatgatgaaaatacagtctcctggggcggtcaagaagccagaaatgcaggctgcactacaaagtgacattcaacaaacagccttccctgtaacctcaatccttgccacaccttcaatcttggcgttgacaaaatcagggacctgtgtggtcgagtggttgccccagatgcacatgttggtgacggaggtgtagaactttccggccttcaacgccagctggcactgtggggttttgcagagggcgatggaactttgaggatccagaagagaggaacgaggcggactgcactccaggtaaccaacttcaagcactccattcaagagctccggaaggcgccaagtgcttttccgctcctttgcacagtgggatgatgacatgactctcccatactgatgatgatgcgcacaaaccttggccctgttctcatccaggcgggtcagcgcatgccagttgcggcgcggaaggtcaggggcattctccagaccgatcagggcgttggtgttgcaggggttccccacgaccagcatcttgcagttccgggaggccacctcgttcagtgcctgcccctgctccttgtagatctggccattcaggtcgagcaggtcccgtcgctccatgccagggcctcggggtttggccccgatgagtagcgcccagtcagcgtccctgaacaccttgcgagggtcaatgcccagtcgcacctgcggagagacacgtgttcaaaaattggtctgaggagctggccgatgaaaattttggttcacagtgtctggatccggagaatgggggtcattggtcagccaacggcatggcaaggacaagatttggaaccatannnnnnnnnntcattcaagagctccggaaggcgcccagtgcttttccgctcctttgcacagtgggctgatgaaatgaccctcccataccgatgatgacgcgcacaaaccttggccctgttctcatccannnnnnnnnnatcaaaaattagtctgaggagctggccaatgaaaattttggttcacggtgtctggatccggagaatgggggccattggtcagccactggcatggcaaggacaagatttggaaccatacgtctgctcgccaccaggacacccccccaatacccacctcccggagcagggggcagagcgagtcttccagctccatcgccacgccctccagggcagtgcgggaccgctctgaccccagcaggctcagcgagacgggctgatctttcccaaaaacatccccgcttgcaatctggggtggatggcagggggggagaattgtgttgtcagaagcaggcacgagaggagaggcaaaaccctcctgacgagtaagttcggacctttccatcagaacaggtcatcgtagcannnnnnnnnncgtcagaagctggcacgagagaagaggcagaaccctcctgacgagtaagttcgaacctttccatcagaacaggtcatcgtagcacccagcctcaccatgaagacgaggtggttggagatcatgcctgcggcaccagtgacggccacattgatgaccttcttccatgttttcgtctcagaagggtttctctgtaaaagggaaacctccggcttcacttcggtggggacaaacgtgatgacatactcgcaaacctgcaatcagccacccagaatatcatccaaacatcaaaccctgtgtacccctcatgcatgcagcaagctccttcccatacaagccacagctcaatttcatgcagagctcatcctcaccgcatccaggtcatactccagcctgaacacgccataggcgccatcatcgtcggtgcgaggaaggtccttggtggcaatcgcctgcagtggctggcaagggtacctcccagccgagcccgagctgagcgtgcccttgggtgcagggtgccgcaaagcccatcccgagccattgacagagcacagaggactgcgagaggcccgcctcgagtgtgctgagctggccatgcgggttgcatgggcccgggtcggttctctaccgttcgcgggtctgcatgagagcgccggtgggcggtgggccgtgagctccatgatcgcacaatgcgatgagcacaggtgaggagtttcgaggtccaggtgggttacgcaactcacagaaaggtcggttctcagtgtgattgcgcgcgtcgagcgtgtttaagggatcgctccgcgctccatgcggaagttctcgagttttcccgcgtgatcatgagttgggttgcgtccaatcgacccctctttgaaaccgtgtacatgacgcccccagtggttggtcgcgcaaccacagaacccaaccctttatgaaaggggcgtcttgacatgacttcctctctgtacttgggataggtagcaatagccacgttgcaagggtcaaggtggtccagagtgcaagggcttcagaactttccgctgcgatccctctcccgctttgcaaacagtttctccagcgccctgcgtgcctccccggccagaaagttggagaggtcgtagtagtgcggcgctaagtccactagccactcgcccttgatctcggtgacggtccggatgtagttcttggtggtgagcacaaattcttggtacaggaccctgcgggggaaaggggggacatcggtcaccggttggatgctggacaatcacaacgccactgccagacatcagcgttgcaacggcaagatgagtgatgcaccgccatgcaggaccaagcaaggattcctcatgcccaannnnnnnnnnaatcggtcactgtttggatgctggacaatcgcaacgacactgccagacatcagcgtcgcaacggcaagatgagtgatgcaccgccatacaggaccaagcaaggattcctcatgcccaatgggcgtcaaccatcccagcatgcagtattctccaagacacctgcgcgctccccgccccttcctcccaccccagtaaagcctcaagcacgcaccattcgggtttggtttggaggcaggtggaggggtgcaggtacacgttctggttgtccttgaccgtgaggtagtgccctgtccgctccacgtgggctacctgcatgaagtcccccgccagcatagccttccggatgttggtgtagtaatctcgcgaattaaagtctgtagacaccatgttcacgcccagcctctggcagatgcggagctgtgggttagagggggtgatgagggaggtggggcaagtgaggatcaagatttaggacttcaggcacgcaccaggattgcccatttgcacagcccacnnnnnnnnnnacaagtgaggttcaaggtttagaacttcaggcatgcaccaggattgcccatttgcacagcccacagcacatgcatttccccaaggacatctggcaaggcccgtcggaaacatgccgcatcttctactgaaggcccgccacagacacccctcgccccatccccccgtccgccatcgcaccagctgcccccggacattgtccgcagacttgagggcccgtgcgttgaggaagttctggtagcaccagtcggcgtcgccgttgtgctgcttgtaggcgtggtaggcgttgagcagggtgaggtggtccccatcgacatgcgcaaacctggccttggcctcgtcggcggcgcgcgcggcctcgcgcggccgcacgaacacctgtggcacgctcagcgtggcggcgatgctcaggatctcgttggagcagttgaagcggggggaggccaccaccatcttagacagctgggggtccagggggaactcggccatgatggtgccgatgggggtgaggttgccgtcgtcgtccagcgcgcccaggtaattgagcagctccagggcccgcatgagcgtctccggcgcgggggggtccatgaagtcaaaatgcacctgcgagggggggttgggtggggaggaggtggggaggtatggagctgagccccggtttcagagttggcgtgagtccagtagccgcaaacaggctgctgctagatgacgagcctcagagggggagattgctgagcggtggaaagaccagagtgtgctcctgtcaaagtgaaagtagatcgcacgcatggcaaaagagaatccaaaaaggttcctggcctcatcaacaagaaagttgtacccaagcagcccacgaaggggccacattcgtataatgtagataaggaatagttgtaatttagcatcatcggccatggaggaaccatttgagatcgaggtcagcaagataaagataccaatgtcgcggtgaatggatcgcaagaaggcccaccgaggcagggtcgtggggtgtggcatgagggcccttttcaatcactgacacagtccttccaaacgatggatgtcaaccagctctcccaatcctcccactcctgaatcgtagccctcctgccctccaagcccaccactcaccaggtcatcaatgcccagcttcttgagctgcagcacgactgaccccagattgctgcgcaggatctcagggtaggtctgctcctgcaggtccttgccaaaggacgcctccgtgtacagccggaagcacttgccgggcttggtccgccccgcacggccggcgcgctggtgggccgaggcccggctgatgggcgagaccagcagggactcgacacggatgcgcgggttgtacaccttttgcttggcgaagcccgggtcaatcacgtacacgatgccgtcgatggtcagtgacgtctcggcgatgttggtggagacgatgatcttgcgcccggggatgccgcccggcttcagcgggcccggcgcctgggaacagggcagggcagggacgggtgcgtcaggggtgaggaaggtggcggggcgcggcgacaatggaggctgggggattgaacgctcgaggtgatggtgccggcatgcgggcacttgcacagagaagggatcttcgtgtgcccacgctcgtgctgcgctgcaagctcatgagcatgcaggaacggagcagcaggcctgccagacagacctgatttcaggcctcccttgcccacttcatcttcatttagtgacgttgctcttccaaacagtgcccctgtggaggatcccactcagatcacaacacacccccctctgacctggtcgaagatcttttgctgctgctgcggcgggagggtggagtacagggggtacaccttgatgggccccaccttggagcccagctgctcgatctcgctggtgatcttccggcaggcgtcctcgatctcctcctctcccgtcaggaagacaagcacgtcgcccggggcctcgtactgatgtatttgcaccacggtacggatggaggcctccaaatagtcccgctccggctcctgggcaggggcaaggaggagttcaacgggatttgtttccccatctttacaactggcaggaccagttgtcccttgcagcgaatctccttcagattcttgccgtccaccccccacacacacaaaccagccccccaccacccaaaacacacacactctctgcgcacctgggtgtaaaagatctccaccgggtgcaggcgcccgggcaccttgatcagcggcgcatccaggaagtaggactggaacttttccgcctccagcgtggcgctcatgaccaccagcttcaggtcggtgcgcttgaccaggacctcctttatcaggccgaagaggacgtctgtggccagggtgcgctcatgcgcctcatccaggatgatgacggagtacttctccagcagcgggtcagtcatggcctcgcgcagtagcatgccgtcggtggcaaacttgaccagagtgcgagggcccgtgcactcctcaaagcggatggagtagcccacctcctcccccagcgtcacatccatctcgtccgccacgcggcgcgcgaccgacatggcggccacgcgccgcggctgggtgcaggccaccttgaggccagcggtgcagtaccccgcctccgcgatgaactgcgcgatctgggtggtcttgccggacccggtctcgcccaccaggatgatggtctggtgggagcccagcatgtccacgaagtccttccgggcctgccacaccggcaggcctgcaatgggaggtggtgggaaggaagggtggcagtcaggcaggggagagagggcagggagggagaggcaaaggcaagcgctgagcgaggtggagggatgcgagaaggtcatggcgcactcctgctgcaagaccttgtacccaccaaaagatctcccagcaccaagagggatggatgcatgcaccctccataccacccaccctgacggccggctaggatctcatggtatcgctgggagtaggggcgcccggtaaaggggttcacaccaccggactgcaccgcgggcgtgccgttgggcgccgcgggtgtgtcatacagctcgagcttgcgttttcgttctgccatgcctagcccacactccggctgtgcggccactgggggagcaacaggcagggcgagcagtagggggccaccagacgcgtcccctgaaatgctctgcacaacggcaagccggtgtgaggtcctatgggctccctagagtatgccaccgcctcggtgtgatggcgaatcgcagcaagcaccaggccaaacaggactggttcccagcacgggtttctcaatcaagggtcaggacacgctttttggatgtttgcaccacgctgttacttgcttgggctcaaaaatcatctcctgcgtctgatgcttcgtacgctggaagaaaggttgaccctgtcggagagtaccgcaaaaggagaacaagtgatcggatcccaactcgtctccaatcgaggactgctgataaatagtaatccagtcttacatctgaaactaccaggcgtcaacatcgacccttcctgcactcagttcgagcttcttgcattgcgtagctggggggacgcggggccatgcgcgtgctcgtggcagtgaagcgagtcatcgattacaatgcccgggtcagggtaaaatcagacaaggtaattatgttggatcaataacctatgatgcgggtgagcggtatgtcgtgggtgcaggatgcatgctgtcggatgtcgccatgctgtgcttcttactggtgtgatttgtcgggtcatgctcccccattctgcgtccgagcagtctggcgtggatctcaagaatgttaagatgggtaaggctgggtgctggatgtccaatgggaatctggaggtgcaagactgtgactgctgctttgagtgtacatttccagttggctgtcagctagctaggagggatgtatgccaggatacagcctactcatcagtgccttcctccgcctccgcacccttccatccccaccctttgcaggcatgaaccccttctgcgagattgcggtggaagaggcggtgaagctgaaggagggcggctccgccagcgaggtcgtggcggtgaccatcgggcccaaggcggcgggggacacgctccgtaccgcgctggccatgggcgctgaccgcggcgtgcacgtgctggaggacggcgaggtgcagcccctggccgttgccaagctgctggcggcgctgacgaggcgtgaggaggccacgctgtgcatgctgggcaagcaggccattgacgacgactccaaccagaccggccagggcctggcggggctgctcggctggccgcaggcgacctttgcctccaaggtggttatggacagggaggcaggcagggccagcgtcacgcgggaggtgaggcctgggaagcagttgggagtggaaagggcacagagtatggatcccgcctgcctgcatcccaaggtataccgtctccccggccacactcccatctgtcaagtgctgatacaggtggacggcggcctggagacgctatcgctcaagctgccagccgtgatcacggccgacctgcgcttgaacgagcctcggtacgccacgctgccaaacataatgaaggccaagaagaaaaaggtcgacacggtgactgcacaggtagcgcgggcggcagatgttcaccgggtgtgctttgttggtgtgtggggggggacctccaccttggtcgcgtaaatctatgaaccagggagtggcaacaggaactgcccattgttgtgctcaatctctgcgctgatcatgccgcccaccctcacggcacgcaaccctctgtctcaggagctgggagtagacatcacaccgcggctgaagctggtgaaggtggaggagcctgccaagcgccaggcaggcgtcatgctgtcctccgtcaaggagctggtggaccggctcaggaacgaggccaaggtcatctgagcagatcctcgctcggttgttttccggctggtcatcgtgctagtgcccagtggcaccctgacccggtctgtgccctgcagttgtcaccacccttctcacaaagcaggtctgctggctttgctgactgccatcgacccccgaatgcatctgacaagcagccccagcctgagagagtgacctgcctgaacctggaggggttcatgtacgcactgtacacaagaaacaggatacaaacagaagggcctgctgaagctgctctggggccaaggcagacaggaaggaagtgtaccatgcgagtatctagcatggcaccatggcctcaggaagagcacatcggcgctcacttgtccccatccatggagagctcgtagggcgccaccaggatgccgtcccggtcggcgtacagccagtcccccggcgtgaccagggtccccgccacgaccacgggtacgtcccgcaggccagggtcgcgcttggagctcttcagcgggtgggtgttcagggccttgacgccaatctccatgccggcgatgtcctcgctgtcgcgaatgcagccgttgaccaccacgcccgcccagccattgcgcgcgcccatggcggccaggttgtcgcccagcacggcgcagcgctgggacccgccggcgtccaccaccagcacgcggccctgcccctcctcctccagcgcggcgcgcacgcgggggttgctctcgtggcacttcactgtcgatacctggccgctgaagcgggtgcgcttcccatagtccctgcaagggagggcggagtttaatgtgggagtgtgtcgacagttggcacgagagagtgggagcggtgcaggctgcaggcaagggctatgtttcacatgccccgggcacagacctccctcaaccgggcacctgaagatcgattgcattatttggacgccactgccctctacgatggtgtccaccggttccttgatgtgaatgtcacagagatcggcggtcgcccccctccctggcgggggaggtgggtaagggttggtggccatggcacgaacacccgtgaaggcagggcaacgaagcctgacaacgcgcagcatattgccgaggtaagcggtgcaggcactttcgacaggcatcgcccctgctcccgctggcgtcatctgatgaagggccggggctgacgaggccaccgggcgcgtcgggaacccaccgcgcacctccgattccaatccggctgatcgggacgaacccagggatcacgccagtcagcaagcccatgggagtacggcacgccatgacatcctatgtctcattgagtatctgatacgaagactcgaaggctcaaaggcagccgtgcaggaacatcagtgtggggcttaggtggcagcaatgtcgacgctgaagccaaagggaaaggaggcaagctcagcgcccccaaagaaactgagcttcttcaaaaacagtatcgccgggacatgcggtacgtggccacagctgtgaacacagtcttgcgatgaacttggtgacctccgtaattgactgcccacaccctcccaccaccccctgcagccggcttcaatgtggtcttggtcggccacccctttggtaatcgttcagacctggatcttgattagcactcaaccatgtccaattgtcatcagctgaagcgtgtctcagcaccacaaccatgagccctgagcctgacgtgctatgcctcaagcagacccctctcccacccctgcctgcagacactgtcaaggtccggctgcagacccagtccaacaccaagcccatttacagcggcgccctggactgcttcaagaagactctgcagtgggagggcgtcaagggcctgtacaagggcatgtcttccccgatggcgggccagatgttcttccgcgccaccttcttcgccgcctttgccgagtccaaggcattactctccaggcagcccgatggcagcatgaaggtcctgacagacatggacctgttcaaggtgattggggtctgaatggggcagggtgggattgtcacttctgcgtactttctggacagggaagggtgtcatgcataaggtttggcgtggcgtgcacgcctgtgccccggtgcatgcgtggtctatgccaagcctcgaccccaccccgatcccacccacggccgcaggcaggggccctgacggggnnnnnnnnnnttggacagggaagggtatcgtgcataaggtttggcgaggcgcgcacgcctgtgccctggtgcatgcgtggtctatgccaagccttgaccccaccccgatcccatccacggccgcaggcaggggccctgacggggctggtggcctccctaaccgaggcgcccatcgacttttacaaatcgcagctccaggtgcagaccatccggatgaggtccgaccccaactacaagccccccttcaccaacctgctgcaatgcgtgcgcgcctccctggcccacaacggggtcaagggccccttccagggcttgggcatcaccgtgctgcggaatgtccccgccaacgccgtctacctgggctccttcgacgcgctcaagcgcaagtttgccgagcgccaggggtgaggcgcagagggacagctgcccgacggcgctctcgggctgtctgcgtgatcgaacgagggacctggtgtccgtgcaggccaggcatgctgcgcctcaggcggcctcgtcccgacccgttgccacctccctagcgcctctgtcgatcctctcaccccccccctccccgcctcccttgctgctcaggatcgaggtgcgggacctgagcatgccgnnnnnnnnnnaacccgttgccacctccctcgcgcctctgtcgatcctcccacccccccctccccgcctcccttgctgcttaggatcgaggtgcgggacctgagcatgccgcacaccatggcggcggggggtgtggccggcacgctctactggctggccatctacccgctggacgtgatcaagagcgccatgatgaccgactccatggtgaagggcgagcggcggtaccccaccatggccgccaccgcccgcgcgctctgggccgagggcggggcgggccgcttcctgcgcggcctgtcgctgtgcctcatgcgcgccgtgcccgcaaacgcggtcatgctgggcactgtcagcagggtgcaggtcatgctgggggcgtgaattttgacggccgctggagccccgacctgcacgatcggcttcctgaagcctgcgccgcatctcgagggcagttgcgccctccgaccccagttgaacggcccagccaggccgggtaactggccatttatatcaaatttttatgtccctgctgccctgcataagnnnnnnnnnntagcccagccaggccggataactggccatttatatcgaatttttatgtccctgctgccctgcataaggaggcgagccctgcctgtctgcctcccctcccagtctctgaaattttctggcaccgattcacacccggggtcgatcgctccggcggcgccattgatatcagtccacatgcactgccacaaaagaatatcaggacgggggggggagggaagggggattgtaggcgggccagggcccgggggcggggctcgtctgcccccccctcacttcttggcccagccctgggcggccaagccgtccctgaaggcggccagcaccagctcaatgttggcgggcttggcgttgtagcccatgatgccgacgcgccagatcttgccggcggtgggccccagcccgcccgcgatctccaccgcgtagcgctccatggcaaacttgcacagcgcggcccagtccacgccctccggcaccttgatggtgttcacggtgaccaggcggtcctcaggcgccggcacaaagtgctccagccccagctcggtcaggcccgcccagagctggtcatgcgcggcggcgtgccgcgcccaccccgcctccagcccctcctcagccacgatggccagcgcctcccgcatggcgtaccacatgctgaccatgccggtgtggtggtaggagcgggagccgtaccagccccagtagtcacccaccaggttgagatcgaagtagtaggaggcgacgggggtcttgcgcccgcgcaccttggccagcgcgcgctcggagaggaagaggggcgccgcgcccgggggcgcggacaggcacttctgggagccggagtagatggcgtccacgccccaggcgtcggcaaacataggcacaccgcccagcgagcagaccgtgtccaccaggagcagcgcgccgtgctccgcgcacatcgggcccacgcccgccaggctctggtgcacgccggtggaggagtcgccctgaaccaggaacaccacagcagggcggtgctccttcaccgccgccgtcagctcctccagggagaaggtgcgccccgcctccttcttcaggtccaccacgttcacgcccatgcgccgcgccatgtccaccacgcgcgcgccccagatgcccttgttccccaccagcagcgtctcgcccggctccagcaggtttaccagcgtcgactccatgcccgcgtggcccgtgccagacacgcagagcgtgtagttgctctcggtctggaacacatacttcagcccctgccgcacctcatccatgatcttcaagaagggcgggtgcctgggggggatgtttgagggggtggggtgggtgggtgaaggggcaggacgggtcaaggttgtgcaaacgggggggacaatggtcgagagggcaaaccgatcggggtgatgatccaaggagcatgcggccctggggttgggcagactctaccgtagggcgtgctgtgacacccttggaccccccttcctcccggctcacatgtggcccagcaggggcaggctctgagtggccaggaccctggggtcggagttgccgggcccgggccccatgaggaagcgctgggggatctgcagggcagggttagggtcgggagtgggcggccaaaccctcgggcccggcgacgcacggccgaggccccacacccctcggaatgccatatcgggtcatgagacgggcgaccccacagggagggggggggaagggggggggcgggcgcacctggatgacgccagtgggaccgcgggactcatcgctcacgggcaccaccttctcctggaggcagacgggcgcgggcgtgcttgagcatgagactgagctacacaacaggagagctactgcagacagtactgaggccagcgccctggaacgcaggccgcttaccccaggtcgggcagaagtcatcgtgctggcggaggaggagaggaagcgagcgcgacacaggagctgcgaggtccgatccaaggtctttcgtagcagtccagccgacattatccagaaacagggaatcgatcagtgccccgctgggtgaacttttcacacggatggaatcgggcctccggagatggtaaccacgaggctccgatcagacggcaattatgcaacaggtcgctaagctaagccctcgacaattagtcattacatggacgccgcttggacctccctcccccacgttcccgacaaccctggggagaaaatcccgcgccagtgcatggagtggataggtgtggccccccttctgggtcacgccgagagtactatcttgatcgatgcgaatgggacccacctgacaccaacagaccatgctgtaggtagctggagaacctcggtattcatacatggggaaggtcccatgttccacacatgtttctgctgtgcaagtaannnnnnnnnnnnnnnnnnnnnnnnnnnnnnnnnnnnnnnnncactggaacgccaagcagacaggcttgttggggatcttgagatggcattcactcatttgattggtcagatggctaatctccaagatgggcttgctggcaagggtggtcatggcattcagttgcaatgcgttgacaatctggcgaaaactccttgtgagcgatttcacttcgctctgggtgagtaacaataannnnnnnnnncggtgtggcaccccgtcacatcgctcctccctacactcatgtcacccccaaggcgccgatgtttacannnnnnnnnnttatactctgaagcggtgtggcacctagtcacacatcgctcctccctacacccccatgtcacccccaaggcgccgatgtttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggtggtcatggcattcagttgcattgcgggtgatagtctggcgaaaactccttgtgagcggtttcacttcgctctgggtgagtaacaataaacttgaggaatcatgtattcacaattggtgttccttgagttctatgtgactggcgcagaacggctctgatggacaaatggacaaatccaccctctctacggcccaccccnnnnnnnnnnnnnnnnnnnnnnnnnnnnnnnnncaattcgccaataagtaatcctgacagccagaaagtgattgctgcccctgaaccctatcacattgcattgtgttggtcacctgcagcattcctacagcatgtctgtcctcgcgtgctcctccactcggccagctgccacgccgtgcgtggctgggggccacccccgtgcaaagcccagccgggcgggtcccattaccgctagcctgcgcgtggtcacccccgcattccgccgtgccgacaatgtgcagctgcgatcagtgcgatccagcgccgcgccccaggggcgcacccttggggccactgtggaggccaagaacgtcgccctgctgggagcggccggcggcatcggacagcccctggccctcctgctcaagctgaacccccagatcaccgagctgcgtctttacgatattgccaatgtcaagggagtggcggcggacctttcccacatcaacaccagcgtcaaggtggtgaccatggggtggcagagcggggtgtacctgctcgtgccaggccctggccgcatgcacaggcgaccctcattctgcaagatgtgacccacatgnnnnnnnnnnctacttgctcgtggcaggccctagccgcatgcacaggcaaccctcattctgcaagatgtgacccacatgtctgccttctccaccctccctcccaaacattggggcctggcattggcatacacactctcatcacagcctcccctccacccccccttcccctccaccccgcccccctcacgcgctataggtgtctggtcacacgggccctgacgagctgggcgctgccctgaccggcgcggacctggtcatcatccccgccggcgtgccacgcaagcccggcatgacccgcgacgacctgnnnnnnnnnnnnnnnnnnnnnnnnnnnnnnnnnnnnnnnnnnnnnnnnnnnnnnnnnnnncaagacgctggcgaagggcgtggcccagcacgcccctggcgccatcctgaacatcatctccaacccggtgaactccaccgtgcccatcgcggccgagacgctgaaggccgccggcgtgtacgacaagcgcaaggtgctgggcgtgaccacgctggatgtggtccgcgcggagacctttgtcgcggaggccaagggcctggacgtcgttgacgtccaggtgcccgtcatcggtgggcacgccggcgagaccatcctgcccctgctgtcccaggtgctgtgaggggagggggtggttgtgagtgggagcgtcgggcaaggacagcggcacctggggcctcatgaccgtcacaggatggtgggcttggccaggttgattggcgtgtcagagcagcgcgccgccaccctgtacattcatgagtgaatctcgccctgctcggtctgcggacgctcaccagcccagcaccactgctccgcaggccaccccctctgtcgcgttctcgaaggcggaggcggcagccctcacgcagcggatacagaatgcgggcaccgaggtggtggaggccaaggctggagccgggtcagccaccctttccatggtgagtgaaagggtggagatgggcgtggttgagtttcagctgcgctggagtaatgccgcaccggggagtgccgccgggacagcaggctgtgtggattagggcgagagtatctgtgcttttctacgtgatgcccagagctcccctccaacgtgcaccaggcatatgccgctgcacgctttgcggagtctgtgctgctggcgctgaacggcgaaaaggatgttgttgagtgcacatttgtggagtctgacgtccaccctgacttcaagttttttgccagcaaggtgagggatggtgcagctgtgggcaacagctgtttgtgagcatctcttgccaagggcaatgccaggtgcctacccctctttgatgcgtgccatgggtgccgaaagggtgcagcaccannnnnnnnnnttgtttgtgagcatctcttgccaggggcaatgccaggtgcctacccctctttaatgcatgccatgggtgccgaaagggtgcagcaccactctgaggcttcctttggtcatgtggtgaggaagatatggtcatcctcaactgccctactcgaatgttccaggtcgtgctgggccccaatggcgtcgaggacttcctgccgctcggcgagctctcacctgctgagcaggccggtctggacggcatgaacgagctgctgaccaagaacatcaagactggcatcgagtttgcgaacaaggcttgattgtctgccaggacgtcgtgccctggggtcgcctgctctgattaaaagaggggtaggctaacaacacgcgccgggatgcatgatcgggaagccccctgcgaccccgggtcacaggaggcgtttgaatcatggagcggcacccattccttcattagttcccaccacaaagcaacaaaatatagcgaaaagctagcattgtaaacatattgcccgccgaggtggtcaaggcaaaagaggcaccgttgtcgttgggcgtgagtaacatcccgctgtgaggccaagtgcagtgcatgtcttcattctgcttcggaagcaaccattcatgctcccagtcttcatgaaggcctctaataatcattacagactcacgcaggcggggaaccgggcacaagggcggcatgttttattcgcagcatctcnnnnnnnnnnccggaagcaaccattcatgctctcagtcttcatgaaagcctctaataatcattacaaactcacgcaggcggggaaccgggcataagggcggcatgttttattcgcagcatctcctgggcaccaagtccgccctcggagcagtgtggtgaggagcggccgaagagcggagtgggggtgtgagcttttgcgagaagccttgatttttgcaaaatttatacttgaaccnnnnnnnnnnatagagcggagtgggggtgtgagctttgcgagaagccttgacttttgcaagatttatacttgaaccactcgctgccgctcctccttgccacaggatcgcggctcatggcaagaaattgaacaagggcaaggtgctgcaggtccatgttggcgagacatggtacgtggtgtgggcatcgactcgtgcaatgcatcgtcgattccaatgcgttcttcgcaagactacgacccccatgacgccgcaagcttctgtacccatccgcagcgaggtgctcatgaatcccgaggtgccccaggccctgcgcctgcaagccgtccttgccgggggtgtggtggtcattcagcaccggcaagtgacctacctcctggatgactgcaatgacgctctggtgagtctctcaaaaaattggaggaccgaatgaatcgtggggaatttacatacgcatccttgccgctgtgttccatcacaatcgcctaagtcactactgtgtggacctcaacaaaagataagatcagccacttgctctttttccagcggcgactgagagggttggggcgcgaggagactcccacaagtgcgcatcaatctactggaaagcgcttggcaaggtgagatgcattgcagggcccaggatctgtctcaagggataatgtggagatgcacctacctgtactcatcaccattgactcctctttcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaccgtcaaggagggtctgcgagacatgcatgtcctcctggtaccctggacatgtcccctttcatcccaatccccgcattctgatcccacctccatttgaacccatttcctcccccagcctgatgatgactacttnnnnnnnnnngtgaggagatgcacctacccatactcatcaccattgactcctctttcttttccaaggattgaggccatcactttgacagccctggatcaggatgcaatgggcctaagttcagccctgccaatggagcaagccgttttccgtaagctggactatggacaggtaaggacatggcctctgggtgaggaagaatgtgacaaaagcagggaccgcctataccgttaaggagggtctgcgagacacgcaatgtcctcctggtaccctggacatgtcccctttgatcccaattcccgcattgtgatcccacctccatttgaacccttttcctcccccagcctgatgatgactacttcctcatgcccgccgtccctacggagtctgagcacctccgcagcgcccattccgcccggcttgaggccaaggcctcgacactggacagtcctgacctcggcatnnnnnnnnnnagagcacctccgcagcgcccattcagcccggctcgaggccaaggtctcgacactggacagtcctgacctcggcatgcagggcggtcgccgcccacatggcctcctgctggaggaggagagtcccgacgcttggtgagcaggggcttgcagccgtcgtgcgtctgctgcggagcacttcagtgcagtgccggcatctctacatgccaggcacctgtgcagcacactgtnnnnnnnnnntcggagcacttcactgcagtgccgacatttgtacatgccaggcacctgtgcagcacactgtcaaatccggggcaggatgccagtcctctcccatgactctatgcctgtgctgcggctgacacatgcatacctcactctcacaaataccctcaccctgtgcagccagtctcagccagagatgtttgaggtccctgacgtgcagatgcccgacttccccgggctggactggcaggagtacggcggggaggcttgtgtggacccaacgcccgagaacgctccacaggtgggccccgccaagggcatgctcgcccaaggaaagcagcggagagtgcggaagagggctgcgactgtggacaatccatgtgacatccagatctcagtgcaggtatgcaggccatttaggttcctgtctcaggtcctatagatggcagggattgttgggaagtctttcctaatggcagcagtaattttgactgctctgcaatgtgcttacaatatctgccccgtgaccatgcctgtgttcaaggtgtgcacccctcattgagccactnnnnnnnnnnctcctaacggcagcagtcattttattgactgctctgcaaggtgcttacaatgtctgccccgtgaccatgcctgtcttcaaggtgtgcacccctcattgagccactcctcctagagacattgcaggagtatcgggagtggatggccgatgtgggcgacactctcgcgccccgcactctttttgagagggaacagggcaacccactgaccgtcaagtccctggaggctcccaaaggtgaggcatagcggtgggaacagctcagacaaggcaggctggatgtgccttcagctcaaacccaacatccaccccccccgcacaggcctggaggccaccttccagcacgctctggacccctcatccttgcctggggtggtgctgcatggcaccagctgggtcgtcaccccttccccgggcaggaagtctgtgccccaggacgaggctgtcatggaggcagggcctgagcagcatgacctggcacaggagtatggacgtggaggtgagcagcgcgggagctactgttcttgacatcccccgccctgcacctggattggtaggacagggaatcaacggaacctcaaagcaacatcgtgacagaagggccttttcaatttcacagatggctggatgcccgcttggggagacgaagctcctccgcttggcggtccagagccagaatatgatgctgagctgctggcaggcccacgcagttcgttactgaaacgtgtgctgagcagcagccccggcagcgacatcgagactgagaggtgcgggtgggcttcccacagcgggtgctgctgtgtctactcggaggacagacaccaaggtttaaggatgtgcttgaactttctctgaagatgtaaggtggactctggtcttccaagtgggctgcagtgctcctgcacacatccctgtgcccacacagtggtcaagacnnnnnnnnnnttacacagaggacagacaccaaggtttgaggatgtgcttaaactttctctaaagatgtgacgtggactctggtcttcaagtgggctgcagtgctcctgcatacatccctgtgcccacacagtggtcaagaccactcttgctacaatcctcacacccacgcccccttgaatatccttcacataagcacaggctgcgcgcagcactgagcgcaagccccggcagcgcctaccagacagccatgctcctgggccaggtgagctgaaggcgaagaggatctccttaggtgatgctgcttctgtcaggcagattggcagacaaaatagatggcagatggctcactccctctggtctctctctcccgcagaatatgtacactccagcttccatggcaaagcgtnnnnnnnnnngggcagattgacagacaaagtaaatggcagatggctcactcccctctggtctctctctcccgcagaacatgtacactccagcttccatggcaaagcgtcagcgcctgtctggtctgcggcccgggagcaatggaacgctgatctcggaagggtgaggtgcctgatagggagagtacacgtcagcgggttgatggtgggggcgtgcattttccagaggccacaaggtaacctggggtttgccagaattcggtccacaaccatgcttcgtccaagcaccacagacatgaggattaccttgtgcatagataaagcaactcacnnnnnnnnnncacctggagttcgccagaattcggtccagaaccatgattcgtccaagcactacagacatgagaattaccttgtgcatagataaagcaactcaccaccacgtctgcacccatctcttctccaggtcctctggtacagcacctggtgggccagtggacgatgccatgtttgcaggtccgtaccagggtttgacaatgattgattggatgtctctgcaatcactgctgctccctctatgtgtcctttgccacacggtgtttcatgaggtcctgtcgagtccactccgcaggtgaccttgcctccatgctgcccgcggtggaggaagaggaggagggtattcacacagccgcatcctccagccaggtggaggctggctctggtccttgggagagcaggctgctgcagatcttggtgcagccaaatgacctgaagtaggaaggtgatgcaacactccccatctccctttcagggaggaaggcggaccatggcaaacctcacccagttcagcctgctggaggagagtgcggccggcacacagaaacccggttggaataggtcacccagcgatacactgaatcctgcttcagccgccctcctagggtaggtggacttggcaagttggggcgtgaatgtgcggcttttgagggagtgccggagcaatctctgaagcagaagcttatgcagcttgacacaccaagatctccctcccttatcatgcagggtacttgaaaaccagtttcatgacaggcagactggtgtgctctccttccaggccttatctggcagactgaaccgccgggaagcggccaagctgtttgctcagcttctgggtgagtggtcgggaagatgcttgccctgctcgactgtacgcacgggcccactgcggccacaacctttgtcatgcacttgcattctcaccttgaaccgccccacctcctcccctctttgtagtgatccacacaaagcagttcgtgagggcggagcagaccgctccttaccaagacatcatgattcgtccagggagatgcctccttgcatcagggtgactgaatttcacatatccattggagactcaaattcccactgaacttggaccttgtatgcgcaatcccccacgtgagcgcggcggcgttaacccccacagacagcacatgcgtgaaggtttcccttttctgcaagccatatcgtgcattccaggactcctgctcttttcccgtgcctacccaccggcgactgcatcgctctcaatgtcttctggcccctagcggcaccgtccagccccaacccccgtccagtccttcatgtttggcgtgacgcccttccagatcccaagcccgtgtctgtataagaaggacaaatgcagaacttcatggggctcccatgcagcagctgagacctcaccccgagaaggtggagcaaggcgattgtagcaggcttgcacctgcttcaccgtcccatcgtccctggttcgctggctcggcctggggagatccgctcacttagagcctcacagctagaaagtgagcaccgtacgcaggctcttgccggagtggagcaggtcaaaggcctcgttgatcttgtcaaagtcgaaggcgtgggtgacgtacttgtccagcttggtctcacccttgaggtacagctcgacaagcccagggacctacgggtagggtgtgttgcggatttcggcatgttccggcacaaacttttgcatggaaaagtactaggctgagtctactccccacagcagcaaaagcaggtcctcagccgccctcacctgctcccgcgacttgtaccctccaaaggcggtgcccttccattgccgcccggtgaccagctggaaagggcgggtgtgcaactcctggccggcggctgccacgccgatgacgacggactggccccagccgcgatgggccgcctccagcgccgccttcatcacctccacgtgcccgatgcactcgaaggtcgcgtcgtacccccagccatcgggggagctctcgatcaggacctgctggatgggcttgtcatggtccttggggttgatgcactttgtcgctccccactccttggcgagcttgaacttgtctgcggcaggcggatgacgaggagagcgaggaggtcgtaccatcacagcgccggggtcaggaaagccggtgcatgggtcaccagcgatgaccagcggtgtggtcctgttcgcacatgcatgcggcctggcgcgagccggcccagagttcacgcccaccatcctcaccgacatcccaccccacccctcagctgccacccatcgcacagagggatacgcttgcggacccccaccccccgcacccacccgggttcgtgtcgatggccacgatctccgtggcaccagcgcgctgcgcggcctcgatgacggccagacccacggagcccaagccaaacaccgcgacagactggccgggcttgacctcggcggtgttgtacaccgccccccacccggtggccacaccgcatccgagcaggcaaaccttctccaggggcgcctcggggttgatcttggccaccgacacttcgtgcaccacagtgtactctggagtggggggtcgggagtgagaggtgtgtgtgagggggccccgccagcatcgcctcgcggagaatgtgaacaattctcgcttgctgcatgcggtctgcccaggaagatgtgctggcaggcttccgggggcgttgccttcccccacctgagaaagtggaggtgcccatgannnnnnnnnnggggagtgagagttgtgggtgaggggggccccccagcatcgcctcacggaaaatgtgaacaattctcgcttgctgcatgcggtctgctcaggaagatgtgctggctggggtgtgcaaaaggatagtgctgccaggtttccggggggcattgccttaccccacctgagaaagtggaggtgcccatgaagtggtagatgtcctttcccctgcagtggaacctggtcttcccatctgccttcatcacacccttcccggtgtactggcggacggctgtgcacagattggacttggggtgcttgcagaagatgcagctgccacagttggcttggtagcaggggatgaccgaatcgcctgtgcaaggtcagggccatacttttggcagttggtcaaaaggtggatgcctagtaccccgcatccaagccctgaggtcagtccatgcctcttcagcagctgcaggcnnnnnnnnnnaaaattttcggcaattggtcaaaatgtggatgcctagtaccccgtatccaagccctgagatcagtccatgcctcttcagcagctgcaggccccgcagccccatacacacctacggcgaggtaggtcacaccctctcccacactctccacgatgccggcagcttcgtgtcccaggatgcaagggaatagaccctctgggtcatgaccatccagggtgtaggagtcggtgtggcagagagcggtggccatgatgcggatccggacctcgcctgcctggggagggtccacgctcacggtggccacctccaggggctgcttcgcatcccacgcgatggcggccttgcattcaatcaccttgccgactgttgattcctgtggcgatgcaggtacgagggtaagaatccggaagtctgcgtaccgggttcttcccagcgctcggtccgaaacatccactacccggagaactcaccaccattgcctcgacgcactatgagcnnnnnnnnnnnnnnnnnnnnnnnnnnnnnnnnnnnnnnnnnnnnnnnnnnnnnnnnnntccttcatgtttgatgacgtaatcaagtgaatgcacactgcaccacttggcagacaccatgaagctcctcagcacgttgctcttgaggttcgcgggagtaatagttgatgaatttttgggtttaacttcaccctcagtgaagcatggtgcccgtcttcggatcagnnnnnnnnnngaccacagatgcagtaagtctctgggaaatttatatttactgcactcggcgaaggccacaccagttcattgcatcgttttggagtttgtcctcgnnnnnnnnnncagttgatgaatctttgggtttaccgtcacccttagtgaagcatggtgcccgtcttcggatcagcacccatgtgcatgggcgatgacagtaacttgtagaccgccaggtaattactgcgttggcttgagctcagaacacatgaacagaacgctaaaaatgcacatagacgaccaattggccaaattcatgagaagaagtgctatcttccaggtaaatgctgtgaaaatactgcagctcattcagattcctcggaatgacatgtagctggacttttttggaggaatcgaatgatatatttaggcctggacaaaccctctagggcgtacgttgcttggggatggaagtcaggctcccctgagatcaacatgtggagctgtgcgcctgtacagctgtccatatcctcttggctgtacatctctgtccttgacaatgcacgttgatccagaggtcaattcacagactatactagtgttacgagctgcttgcaagcgagattgagcgtagcatgc

SEQ ID NO: 30859 - DNA, 87 bp, Chlorella protothecoides
aaggaggagggaggccccggcgaggacagggatggggaggggtcgcgggggggggactcacccagctcgcccatggaggtggacctg

SEQ ID NO: 30860 - DNA, 61 bp, Chlorella protothecoides
tgtgtccaccatgtcgacaggagtgaccagcgactcggtggggaccttgcctcccatgatg

SEQ ID NO: 30861 - DNA, 5855 bp, Chlorella protothecoides
  modified_base (389)..(398): a, c, t, g, unknown or other
  modified_base (757)..(766): a, c, t, g, unknown or other
  modified_base (1853)..(1862): a, c, t, g, unknown or other
  modified_base (2566)..(2575): a, c, t, g, unknown or other
  modified_base (3382)..(3391): a, c, t, g, unknown or other
  modified_base (4022)..(4031): a, c, t, g, unknown or other
  modified_base (4842)..(4851): a, c, t, g, unknown or other
gcgccacgcctgcgaatgcgccggcggcggccgcgctttccagggcgtcggcgtcgcgcgcgcccacgccgtaccagaccttggccgcgccggcgtgcgcgtagttgatggagtacaggtgctggtcctccacgtgccaggcgaaggcggagaagaggcgcccgacgtacagcatggggctggtgacgccagggacatgggcgtggcagtggcgcagcaccgaagcaggctcatgcggcagcacctgggggtagaagggaatgggggagggctgggtggaagggggagcgtagaggaaagggttcaagggtgtgggtcgcgctaggtaccgcccagcatgcgcctgagaagcagacatgggccgggcaggcagtgtgcacgatacaacnnnnnnnnnntagggtgtgggtcacgctaggtgccgcccagcgtgcgccagagaagcagacacgggccgggcaggcagtgtgcacgatacaacggccccgccaaccccaggatcaaacccacgttcaggttccactttgtggcgcccaacgggtcacatgggtggaaggccgtgccctccacgtcattgccgtactctacgattttcccagagttgggcgagctctgcagggcccagtactcgcactgcagggcagggcgtgactgggtggggtggagtgcaggtctcgccagcaaacacccccagggcagggcttgtgcgtgcaatgctcacagagcacagcctgctgccgcatagcacgcccagcgnnnnnnnnnntgtgtggtggagtgcaggtctcgccggcaaacacccccatggcagggcttgtgcgtgcaatgctcacaaagtacagcctgctgccgcatagcacgcccagcgtgggcctccaagcgtccggagtgctcatatgcagcctgagcagccccatgcatcgccagccgccacaacaatcggggatcctctcacccccattcccaccctgtcctggtacccctcaacccctcacctcagcggtgcggggtggcagcggccccgccaggccgccgtaccacgcggcctctgccgcggcggcctcggcggcaaactcctccagcgtgtactcgcggtctccctcctcgaaacgcaccgagtcccaggccgtccagcgttgtcgacccagggcctggatgcgggtggtgaaacggaagcccgggacgtctgccaggacccggccgggagccagggcgggggccacgggggcgtggatgagggctatgccggccaggctggcctcgggctggatggagcggatgtaggctagggggtcgccccactcctccgcgctgggccggtacgtgggggcatcaggcagcgtcgacagccaggcctcctgctcctggtgcctctgaattgctacatccagctgtggtggtcgcgatgcgtggggggggtggggagcatgccccctcggggagcacaggtctgggcccgacaggtcccgcgcattcccatgtggttggggcaggctctgctcaccagcgctgcacataccttatgctgacgcctgcttctgtgcccagagccctccatcggtgcctgcgcctcgcgtgcaggggcgtctggcgaggctttcgggccccgctggggcccggggtgggcccgcatatttcgccaacaagctggcgtggtgaaccggcacaggaacactcctatcaagtattatatcattcctgcagcggcccatgcataaacactcgacgtttgcgggggatgtcgtgtgctgcattcctggaacccccttcccgtcaacattggacatcgaccatgatatccgacagtgctgcgatcgccggcgatccacggcttccgacggcgatcctctcannnnnnnnnncgatgtcgtgtgctgcattcctggaacccccctcccgtcgacattggacagcgaccatgatttccgacagtgctgcgatcgccggtgatccacggcttccgacggcgatcctctcatatttacactcgggagcttcgttaaggtgttgggtcttgatcgtctttctggcgcattggaagacagcatcggagcaaggaggttgcaggtctacacccgtgcaccctcaaaccaatgcccatcgcactccagcagggaatacatcacgaacatatacagttatatagtgttctgaaatggaaatactctctgtatgtaaggacgccttcgtttgtcatttgcaagggccaccgccgttacatcccgtgtatctgttccgtccgggttgatcctcagcgcgcgcgctgcaacagacgtgttcggactcagctcatcagcagcgagtgccgacatggagggcattccttgcggtcaggcctgatgtacagcatttagagcaaatacaagggccagcgccagccacttgcccgcgtaggtgcccgcctactggcctcccgatgctgccggggaccggaggtggcgtggggacgaggagacgggatgccggcttctggcagggctctatgcgtggcagacgcggcacagtgctggtatgcggccatgtatgatcctgggcgcgtggggcctgactggcacgggattcaggnnnnnnnnnnaacgcggcacagtgctggtatggggccatatacgatcctgggggcgtggggcctgactggcacgggattcaggggtgtggactcttgagtctctgacttctgacgagtccttcccctaagcaggccatagccaccctggtgctcctgggtgggggctggagcctgtttctgtacagcaacctggtggatgccgaggagtccagcgacctgcacctgcacgtcgaggagggccggaggtccaccggcgagggtggcctgcgccagcgcctcgccctcctggaggagggcatccgtggcctggccagcgcgcatctcgaggaggcagcggacctggaggccagggcagagaccggtagcgcgggggaggggctgacgctgcgccagaaggtgtttgtggagggcgaggaggtggcggaggggtcggcgcagagcccacctcccccggtggtccagaccgcacaggaggtcgtcgcccaggctgtggaggcttcccggcaggcgcaggggacggggggggagccgggcaggccggacctggccctggaggtgcagaaggccgccgacgcaatgcgacggcggcgcggggccgaggccgcagagaagcgccgtcagcgcatggaggagcggctggcagagcgcgcgcgggccgcagtcccactgcgaccccggcgggacccacccaacggcaccgtgctcacgcccgccgagctcacagcgtgagcctcaagggtggaaggggcgccaggggctggcgcatctgtttgattcattcccaagcggtgcgcctctcggctgccgcggcacgcnnnnnnnnnnggtcccactgcgaccccggcgggacccgcccaacggcaccgtgcttacgcccgccgagctcacagcgtgagcctcaggggtggatggggcgccaggggcttgcgcatctgtttgattcattcccatgcggtgcgcctctcggctgccgcggcacgctgcggccctgggatgacggccagctccgctggcatgcaatgccacgccacagggaagtcctctcagtcccccccgccccctcccccctgtcatcctccaaagtcgccgcaaggaggtggaggatgccatgctgcacgcttggcagggctacgtgaccttcgcctggggccacgacgagctctgtcctatcagccagacggggaaggatgactttgggggcctgggcgccaccatcgtggactccctggacaccctgcgcatgatgggtgagcgggggtgggatggcattggggtcgatgcctgggaccccgaggtccgagtccgagatccactcttctcatcgcttgggaccagccccagcgcaagtggagggcggttactgtcctgtccctctgaatctgatccaaaattcaaacccctctcccaactgccccccccacaaaacaaactcatcaaggcttcactgaggagtatnnnnnnnnnntcctctgaatctgatccaaaatcaaatccctctcccaagtgcccccccccaaactcatcaaggcttcactgaggagtatgagcgcgcgctgggctgggtgcgcaccgggctgaacctgaccgtggacttcaacgcctcggtgttcgagaccacgatccgggtggtgggcggcttcctggccgcctacgagctgactggggacgaggtcctgctcaagcgctcgctgcaggtggcagagcgcctgctgccggcctacgacacgccaacaggcatcccatacggcaccatcaacctcaagacgatggcgccgcgcaaccccaagtgggcctccaaggcctccagcctggccgagttcggcacgcaccagctggagtggtacaagctcagcgcgctgagcggggaccggcgcttcgccgacctggcggagcacagcatccgctacctgaacgagcagttcccggggcagggcctgatgcccctgttcctcagcccctccacgggcaagttcacctcccgccgcatctcgctcggcgccctaggcgactcctactacgagtacctgctcaagatgtggctactcaagggcaagacagatgacatgtaccgcgccatgtgggagcaggtgggcttacttgagggggaggagtgaggaagcatggggccccttggttggtggcgcgacgcccctgcgctatgcaggctgtcagcgctcttagacacaacactcatgtcccttaggtgtcttgagaggtgcatcgacgtcgtggtgcccgctccgtaccctattcagtatacatgcccttgacattcnnnnnnnnnntttgagagggaggagtgaggaagcatggggtcccttgggttggaggcgtgacgcccctgcgctatgcaagctgtcagcgctcttagacacaacactcacgtcgcttgggtgtcttgagaggtgcagcgaacgtcgtggtgcccgctccgtacccctattcagtatacatgcccttgacattccccctctccaccaccacaacgacaaccaggccatggatgagatgctggagaagctggtgctcaacagcacggaggggcacatgtacatcgccgagctggataggtaggggtgagggtcgggggagagccggcaggcgaatatcattgtgcaggttcaggaaagtaatcaacggcagtcaaggggcccctgctctgctatcatggcgcaacccttccgtcgctgcccttcagcaccgatttgtaccatgtccacccttctgccccgccacctccacaccttcaaaccaggacacacacactcaagcgcccccctcttttctctccccactcccctcatacaggaagacggtgcggcacaagatggaccacctggtgtgctttgtccccggcatgctggccctaggagtgcactccggagcagtgggcggcgagaagggggagcgctacatggcggtggcggcgggggtcaccgagacctgctggcacatgtatgatcgccaggcgtcgggcctgagccccgagatcgtgaccttccgggcagggggcgcgatgcgtgacggcggggcctacaacctactgcgcccggaggcggtggaggccttctggtacatgtggcgtgtgacgcgggactggaagtaccgggactggggctgggccgtcttccagaccatgcagcggcatgggaggaaggaggcagggttctccggggtcaaggacgtgcgcgaggcggagcccacgccggacgatacgcagcagagctttgtgctggcggagaccttcaagtacctctggctgctcttcaggtgtctttgaggggggggg

SEQ ID NO: 30862 - DNA, 79 bp, Chlorella protothecoides
ccccgggccgccccactcctcttccacagtgtgcaccttcttctgcaaatctgtggtctcgtaccgctcctggccatac

SEQ ID NO: 30863 - DNA, 76 bp, Chlorella protothecoides
ggggcgtgccctctgcgccgccctgcccttctgcacgtcggggctgtgctcgcagaccagagccacccccccttcc

SEQ ID NO: 30864 - DNA, 61 bp, Chlorella protothecoides
cggcgcggccaccgtggagtacctgtacctggtggagagcggggagtacgccttcctggag

SEQ ID NO: 30865 - DNA, 155 bp, Chlorella protothecoides
cccatccgcgagagcagcccgataaaaatgcattcccggggtgccttttcatttaaaccagtaatgtcatatgataaaaaattgctgactattgggtatagactgtacgtcggactcctcatcgtgcaaacaagacgtcatcgaatccacaggac

SEQ ID NO: 30866 - DNA, 165 bp, Chlorella protothecoides
ggcttactctgactgcccaacctgtgtgtgtgcaggcatgtcgctgtgtgaattcatgcagccggttgccaaagtgtgagcaccctatcttggggtggaccctccgaaactacccatcctccgacatcaaaggctcgaccggcgaaacatgtacaactcggtcaa

SEQ ID NO: 30867 - DNA, 73 bp, Chlorella protothecoides
agcctgaagatcccgtgtgcggtggtgggatcgccgccgcctcgtggtcacaggcctttggcggcatgaccgg

SEQ ID NO: 30868 - DNA, 70 bp, Chlorella protothecoides
gtgggcccaggcccgaatgatgctctttttgatcagagtgccccccccgccacccatattcagatgacca

SEQ ID NO: 30869 - DNA, 61 bp, Chlorella protothecoides
agcggtccgaagatgccgttctcggaggtattttcggaccgatccgtgccggcgttctcga

SEQ ID NO: 30870 - DNA, 100 bp, Chlorella protothecoides
gtcggtgaactccccagcctcaacctatgatcaagccaggaggggtggggatgctgaggtggctcatgccgtgcaggggcttccctgcctcctccacctc

SEQ ID NO: 30871 - DNA, 2290 bp, Chlorella protothecoides
  modified_base (1050)..(1059): a, c, t, g, unknown or other
  modified_base (1124)..(1133): a, c, t, g, unknown or other
  modified_base (1260)..(1269): a, c, t, g, unknown or other
ccccccctccccccagggccccccccctttaaaagaaccaacaaacggcaccccacctgctccctgactttcacaaaggcctcctggacctccatggcggtgaagccgtacatggtgttgatgatggcgcagcaggcgtcgggctgggagtgcaggcgagccaccaggcccaggcggttcacgctccaggccttgtcgcggtaccccatctggtgcaggttggcggcaatggcctgcgggttgttcagctgggtgatggaggtgtcgtggatctggttgcgccaggtcagcaggtccgaccaccagcgcacgggctcccactcgttgggcgtgcgcagcttccaagtctcgcagatgtccttcagctcctgatactgctgggaggggccgcccttgcgcacaaactccatcatgatgcgccagctctccggcagctccaccgcgcgctggaaagcgtggagcacaggggccagcgcccaggggctggcctccggcatctgccaccaccgcgccacgcactgcgccagcgcctgcttgcacagccggtccacctcctgcatcggctccgtcagcgccacctgcgcgcgcaccatggacacctccgcgctctcctccaactgcgcgcggggcagcaccgcggcacgcaggtgcgcccaatcgtgcagatgcgcgccggcctccagcgacagcgcgctgttctccgtggcctttggtgtgttggtaagaggggggggggggtgagtgtggtactgtggggtgtgctttggatacagctcccttggcagtaccgacacagatgcatgggtggggcggggcaacacacgccgggccccgcatcccatcagtctccggagctcctccttctaatcccccatcctcccaacctaaaaccaacactcccaatgcaccttggcgtactcccccactacgtcccactggttgagctccgcgcagcagtccaggtagcgccgctgccagagcaccatctcggacttggtggcgcccggcacgccggtgctcaccccgcgcgacatcagctccaggaacttnnnnnnnnnnacccccatcctcccaaccttaaaacaatactccaaatgcaccttggcgtactcccccactacgtnnnnnnnnnntgaggtgatggggtggtgggcatgattgaggaggtatatgagtcaatatcagtgtaatcgacacgtcaagggcccgagaatttgtgctgaaccacttcctcagctcctccctctgctccaggagagnnnnnnnnnntgcagggccagggccagccgcgtgtcctcgcacgccgcgcggcgctgtgtgggtggggatagagagcgaggtgatggggtggtgggcatgactgaggaggtgtaggagtcaatatcagtgcaaccgacacgtcaagggcccgagaacttgtgctgaaccacgtcctcagctcctccctctgctccaggagagtgagtgcaaatccccagacacccccgcccatcccttcacaccccccccaccccccaaaaaggaaaacaataactctacctgccagagtcccgcgaccatgtcatcttcgcccaccgcgcggtacagctcgcagacggcgtcgaagcagcgcatgtcctgggggaacagcgtgacgtgcgactccagcatggagatggcggtctgccaggcgtggaagtggcgacccatgtacttgatcatctccgccgggatcttgggctggggctgggacatggagatgccctccagcagcgtctggcccacggtgggcctcagcgccacctggcgcacgtggtgctccttggacagcagctggatgatgggcttggccagcgccgtctgctgctccttggccaggctggtccagacgatggggaacagcaggccccacaggtggttggccgccgcgggcaccccctgcaccacctcgcacaggcaggagaccagcaggtcggactgcaccgcgccgcgcgcgcccaggaactccaggtgctccgtcagcagctcacgcaggtcctccggcagggccacgtccatctcgggcgggctgggcgcacgcgcggaggcggcggcggcatcggcaggtgtggcacgtgcagtcggcgccgccgcatccccggattgtgcaccggggactgcgccgtcgcctgcagggaccacgacgccgacgatctcgctggcgccaatcgcggtcgacgggccggagcccgggccgactggggaggccgggtcggccgcgaggctggcggggccctcgcccgaccgcgtcccgaccgcggcatcctgctcg

SEQ ID NO: 30872 - DNA, 908 bp, Chlorella protothecoides
  modified_base (336)..(345): a, c, t, g, unknown or other
cgtccaagtccaagcagggctccttcgtgcccaccagcctggtcagcttctcctggcccaccgaggtgtgggacctggtctccggcgcgcccttcctggcgtcgtgcaacgtggcgctgacgcgcttcccccgccccgacggcgtgggccagctccacttctcctccaccgccctggccgcgaccttcaacgcgcccaacttctgcgccatcatggactttgtgggcgggaacctggaggacctgctaaacccgccccacgccccccccgcgccgctgggccccgcgccagccctgcgcttcaatccggcgatgaagttcggcccgcgcccgggcnnnnnnnnnncaacccgccccacgccccccccgcgccgccgggccccgcgccggccctgcgcttcaacccggcgatgaagttcggcccgcgcccgggccagcgcgcctccaccgccctcaccctggccgtgccgcgcctgacgctgtgcctggaggcgcacccgcgcgagtggtgcgcgcccgctcccggcccgcgccccgtcagcgcgctggacgcgccggagctgcgccccttcctgcgcctggcgctgagcaacgtgctgctggatttcggcagcatgtgcgacggcgacaagttcctcaaagtctgcgccaccagcctggacgcgcatgacctgcgcctggcctaccgcctggaggaggtggcggcgctggaccccggcggcggcggggacaccggctccgacgccggcgctggctccgacggcgccggcgggcactcggacgtggcttcgccagggccctcgggccggcgcagcatggacgcggccctggcctgcacctacccggagctgcccaacccgctgggcctggcgcccagggtgggcggcctcgaggtgcccggcgcggcgc

SEQ ID NO: 30873 - DNA, 75 bp, Chlorella protothecoides
gaggaacttgtcgccgtcgcacatgctgccaaaatccagcagcaagttgctcagcgccaggcgcaggaaggggcg

SEQ ID NO: 30874 - DNA, 66 bp, Chlorella protothecoides
ccgcccgatggcctgctgtcgccggcaaggccggtcctgacgagccggagtccagacccctctccc

SEQ ID NO: 30875 - DNA, 113 bp, Chlorella protothecoides
ctgacgagccggagtccagacccctctcccacgcatggggtcctccccggcctagggcctgagggctcgctgttcgagggggcgggttccccgggatcgctgacgcgggcgct

SEQ ID NO: 30876 - DNA, 152 bp, Chlorella protothecoides
aatccgaagcatcagctataggcacccagggctcccttagcgctccccatcaaccgagtcaccacggcacaatcggcgacatctcgaccacgccggtcaaggtaaataccaacccactacttcagatagctgtgactcctagaaagctcaaa

SEQ ID NO: 30877 - DNA, 68 bp, Chlorella protothecoides
atgcggtccctcgaccccctgccctcacctccgggcagacctacccacccgacatggcggagcgcatc

SEQ ID NO: 30878 - DNA, 75 bp, Chlorella protothecoides
ccagctgacagagcagttccgcgcccccccgggcatgatgcccctcagtcctgggccgaccagttgcccacgccg

SEQ ID NO: 30879 - DNA, 74 bp, Chlorella protothecoides
cccgcctccaggctgaccaggtgattgtgcgggggggcggtaccttgtgtgatgggaaagaccatctctctgcc

SEQ ID NO: 30880 - DNA, 113 bp, Chlorella protothecoides
gtcaccgaggggttgttcctgctcctcagccgctcagcacgccattggctggtacccctgcacaggtgcacctgtctttgacaggagacgcgagtgagatcctcgtttcctgg

SEQ ID NO: 30881 - DNA, 78 bp, Chlorella protothecoides
tataagcggacgtgcatgtattgttgtttcgtcagattcaacttgaagcgacctgtcatggctcacaggagcactggt

SEQ ID NO: 30882 - DNA, 169 bp, Chlorella protothecoides
catgtccacggcacctgaaggccatgtactttgtaagcatccatgagaaactcatgcatcgcacaattcacttggtggcgttgatagatgacgaattctgagcgtgactgggcctgttgaaaatgggaacaccatgtcctccatctcagccgagttgtgccgaaaccgt

SEQ ID NO: 30883 - DNA, 72 bp, Chlorella protothecoides
tcgtgacttgtatcagaagaatgatgaataggaacacgaacaaagcttgttagaggcccatcgggtctatgg

SEQ ID NO: 30884 - DNA, 162 bp, Chlorella protothecoides
acaggagatgccgtgggcttgctgcatggaccagcactgcaaccgcacgccctgcacaaatccttcactggcatggacagaggcagcgcggcaacgacacatgaacagcagttcgaggcggccccaatgccaccctctccaaacacctcccgcacctctgcg

SEQ ID NO: 30885 - DNA, 91 bp, Chlorella protothecoides
gcacatgggtaggggtgatgtagcatcagcgtagatcctttagccgttcgggttcagcgctgtgtaagattggattagaaattggtatgta

SEQ ID NO: 30886 - DNA, 98 bp, Chlorella protothecoides
cgggtaggggtgattgcaattggtgaggtcaaactaaagacggattccacgcttgcaactgctgcagacccaaaggtccatgtatatactccaatgca

SEQ ID NO: 30887 - DNA, 79 bp, Chlorella protothecoides
ggtcctgggccgaccagttgcccacgccgatgatggtagtcatgcctgtgggggcgcggaactgctccgccagccggtt

SEQ ID NO: 30888 - DNA, 121 bp, Chlorella protothecoides
tctggtgggggtgtgctgtgcctggcacccgatgggacatggtggatcggacctgatcatggtgtgcgaggacgagaaacctgaaagggcttcaagacgtcctcctccttttgggaaggag

SEQ ID NO: 30889 - DNA, 365 bp, Chlorella protothecoides
catgctgtgtagtagatagttcggctggcatctcaaccttgactgggacctttgcaaggagggccacatatcccagacgcgtcaatgcccgacgggacccgtgtcccgtgccatgcagccaccagtcaccttcacaatggcgttctggtcggtaactctcttcagtgcagagtcctgtaacaaggaggccgcattgaggcgaggctgtaaagagatatattgtaggagcttgctcgtgaaaggaggtttgtatgtgtggtggtggtggtggtggtggtggtgggtgacctaccagtctgtcggtgagttttggaatgccggcatatcgtatggtaaagatcctgttcaggtctgccagtgcggcg

SEQ ID NO: 30890 - DNA, 79 bp, Chlorella protothecoides
aagtagcagctgcagggagtgaggttttccgtgtattctttgtgctcagccatgtcctcccaacatcctacatcctgta

SEQ ID NO: 30891 - DNA, 79 bp, Chlorella protothecoides
gtgggcatctgccaaccctttctctgcccttagcccttgcctggccataatctcctcccccctgctggcatggcaggca

SEQ ID NO: 30892 - DNA, 146 bp, Chlorella protothecoides
ttccactcctcgtcgtcagactgcagggtgcgggcgttggcaacggcacctgcgcgatgtatgcggcggggcgattatgaggtccccgggcttatatttcgtagtttaatgacccctcatgtcgtttgacattgactcactgatgg

SEQ ID NO: 30893 - DNA, 113 bp, Chlorella protothecoides
cgggccccgccccctcacccttgtacatggtcagcggatcttcggagatctggcccagctcataagccggggttggggccgcgggggagaggagcacgtcacagcgccgcagg

SEQ ID NO: 30894 - DNA, 135 bp, Chlorella protothecoides
gtggcatgtcttagacaccttaccctccttcaatacctctgcaggaaggccgcacacagggcgtatgcatgcaagggacgagcgatgggggccccagacctcattgaccagctgggcccagtcgtggatgacctt

SEQ ID NO: 30895 - DNA, 75 bp, Chlorella protothecoides
aagggagggtgaacaagctgtattgcttggaagcttctgcaactatcccccttggggcttccatgtacatgtatt

SEQ ID NO: 30896 - DNA, 95 bp, Chlorella protothecoides
gggtttcaagcacggtgccaggcggcgtagacacgtcgcagggcacggatgcagatggaaagggtggaagactccggagagggggcccccacaac

SEQ ID NO: 30897 - DNA, 78 bp, Chlorella protothecoides
gccgcagagggtgcagcagcccgccacccgcgccccccggcagcctcccagctcggagcacgacggcccgccgggcat

SEQ ID NO: 30898 - DNA, 66 bp, Chlorella protothecoides
caaagtaggatctggcagggcgggctgcggggggctcacccgccgcgccttgaatgaaaggggcag

SEQ ID NO: 30899 - DNA, 61 bp, Chlorella protothecoides
ggctggccagcaggagggccccggaggcgcaccccgccacgctcgcccgcagcgcgcggta

SEQ ID NO: 30900 - DNA, 67 bp, Chlorella protothecoides
ctgccctgtacatttcccactcaaccctcatccagcaaccccccctttctccctcccccgcagagct

SEQ ID NO: 30901 - DNA, 964 bp, Chlorella protothecoides
  modified_base (337)..(346): a, c, t, g, unknown or other
  modified_base (441)..(450): a, c, t, g, unknown or other
  modified_base (737)..(746): a, c, t, g, unknown or other
cccgcgctggggcccgccgtcagcgtgcacgtcgcgcgcggcctggtgacgggcgcgggggagttgatcccggccgccgagctggagcggcgggacgtggcgcgcggcgcggcggaggcggcggaggtggaggcctccctgctacggcagcaggtcgtcaccctggcgcaaggtctgtgggtgtggtggggggtgtgtttctgtgggatgggcgtccctggggcaagaatgtcgaggtggcccggcacaccagggctgcgtgggtgaggtgagccgtgcgtggcccatccctttgccctcctcgacatgagtctgtcatctctcctgccctgtacannnnnnnnnntggcacaccagggctgcatgggtgaggtgagccgtgcgtggcccgtccctttgccctcctcgaaatgagtctgtcatctctcctgccctgtacannnnnnnnnnggcgcagcgtgagaacctcctggccagcgtgcggaacctggggactgtgcgggggaccactagcgtgggcgaggacgatgtaaccatgcaggcaggctttgggtggatcgggtggaaagcagggggtgtggtgtgtacatggtcacgaggccacgccagagtgtgctcggcagctgcttgtgatccggcgtggtgtcatggcctgttgccgagcagagccttcggcgctggacctgaccgcggcctgtttgcggcacaagaagccatgcaagccctgccgacccacnnnnnnnnnncgtaaccatgcaggtaggctttgggtggatcgggtggaaagcaaggggtgtggtgtatgaatggtgacaaggccgcgccagagtgtgctcggcagctgcttgagatccggcgtggtgtcatggggttgcatagcctgttgccgagcagagtcttcgtcgctggacctgattgcggcctgtttgcggcccaagaagccatgcaagccctgccgacccac

SEQ ID NO: 30902 - DNA, 166 bp, Chlorella protothecoides
gcccggtaggcatgcgtctctgggcttgggaaggactttcgcgaggaggggaggggggtcgtggaatgggaagtggagccgatgcgcgtggcgccttgaatcaagaaaagggaaggaggggcggcgccgcaccggacgccctcagcagcccctggacaatcagtat

SEQ ID NO: 30903 - DNA, 154 bp, Chlorella protothecoides
ggcgttctactttcccagccagccgcttcatgtcttccacattgggtcgccttcaccccgacccccgtccacactacccccaccaccccaagatttctttcctgtcaccgaccaaatccccctccccccctctacatcacgctccagggtgacc

SEQ ID NO: 30904 - DNA, 79 bp, Chlorella protothecoides
ccttgcatgcggcgatggagggggcaggcattagggttcaggtgtgttcgccctccgtcggcccctcccaacgcggcgt

SEQ ID NO: 30905 - DNA, 427 bp, Chlorella protothecoides
ggggaccatgatagcaagcactcgtcagtacatgttgaagacgaccgtccgcacctgggaggacgacctggggggttactacacctcgcacttcagcagggctgtcgccacgggcgagacgggcactcttgacccgggaccactgccatgggacctggtgcagctgtttaaccccccgccgccgctgtcgccacccccgccgcccttcgtggacccctccgggacggtgctggtcggggtcaccaccttcaccatctccgtcgacacgggcagctacaaggcgctgagcgtggtggtgacgtactacgacgcccagggggtgcgcattgggctgacgcgccaggcgatgctggggaccactgtccgcacctggaacgacatcctggggagctacataacctccgccttcgccaccgccaccgcctac

SEQ ID NO: 30906 - DNA, 78 bp, Chlorella protothecoides
cgctgccccggcagacctggcattaggggtggggtgggtgggtggggggtttaaagaggaatgcgcagagcagcacac

SEQ ID NO: 30907 - DNA, 2272 bp, Chlorella protothecoides
  modified_base (476)..(485): a, c, t, g, unknown or other
  modified_base (1622)..(1631): a, c, t, g, unknown or other
cggcgggtgtgcagggtgggagtgatcgacgagcacaggacttttaaactgtgctgcggttgtcacaccaccctacatgcccaccagtacgtgcgggtctgcgatggcgaggagacgtggacggagttgtgggacacgaagcggtgcgtcaacaaggcctgcaaggtcaacattgtcaatcgcgacgtgaatggagctgccaacctgctcatgctggtcaagtgcttttgtgagaatgcaccacgtccaacagcttttggtggccccctgcttccccttccattcccctcgccccccccttggttcgccatttgaggcaacaaagtgcgccagcgaaatcccgttgcgggaagaagctgctagcaacgggcgcaagcccggtagggaaacaagaatattccaatgcattctttgctgacaagtcacggcccctcgccctctcgttatcgatccggcacagcgggacacgagcgtannnnnnnnnntggcgcaagcccggtagggaaacaagagtattccagtgcattctttgctgacaggtcacggcccctcgccctctcgtgatcgatccggcacagcgggacacgagcgtacggccctggcatcgccctgtcaacatgatgaggtgcacgtactgatctggcaatgaaactgggacctcatggagtggcgcccaggcgcaccgccagcggacctcatgccgagccagggccatgcatgagatggtgatgagcggcctgggatggaggaggacgacggcatcgacttcgatgacgccttcttttcgaccatcgatcgcttggtggaggcgcaccatcactccagggtgagcaggggcaggaggtggggtcgggtggccctgtgactcgccgggcggcagtgctctctgttgtggtctaagaaaggtcagtcctccgatccggagggggcagccgtactcctgaatcactcatgatccgccttcccaaccctcagagccaggtctctcaggcagtgagtccctcaggggctcgcgccgagctccccctggtgaggagcccgcctcccaagccccggcaccccgcccgtgaagactcgcccacagcccagtcgcatgcagcggcacatgcagtccccgacccgctccaaggccggctgcaggcggccgaggaggctgcccgccgcctgcaggctgacctcgagagggcccagtgggagcgcgacgacctggggtgagtacttatgcttgaatgcatgcacctgccctgctttcaagccctgcacaagatggccgcgcctggcatccatgcaatcctgcacaccgatccgggctcgccaataagcccacaacacacacacatgctcacacagtcgcaagctggctgcgcagcagtctgcgctggcggcggcggctgcacaggcccccgccgttcccgcgggccacgtggcgacagccgcagcctccatggagctccagcgccagatagatgccctgcggcagcagctggccttcaagtcgcaggaggtggggctgctgcgacttgagcgagggggggttgaagggcatacagagggatgccgcagcattgatcggtgtggtgcatacctgatgcgacgcccgggtggggccgtagcatgtaagnnnnnnnnnnttttaagggcatacagagggatgccgcagcattggtcggtctagtgcatacctgatacgacgcccgggtggggccgtagcatgtaagaaattgtcaggtctccgccaccctccctccctccccaagcaggcggaggagctgcagagggtccaggcgcagcgcgcggagcgcgtgcgcgtcgccgaggccgccgccgccgaggcggggcgggccgagttatccctgcgcctgcagctggaggccgcgcgcgaggagctggcctctgcggcgcgccggccgcgcggcagccctggcggcggcggcgagcggccagcgggtgacaccgaacggcgcggtgaggttgaaggtggcctgaggaaggccaacagtctccccgacccacccctgcacacctcctgggcagcggaggacggcgaggggtgcgtagatccagagtcttccttaccccaggcaggccaggtccccggcctgctgtggacgctgtgccccaccgccatgcagctgctggtctccgggggcggcgccgcggcctcaccgccgccccctgggctccccgcgctcgtgcgccgtgcgcgcacggtggacgcggccgaatacgcgccgctggctgcggcgctgacgcgcgcggtggcgctggcccg

SEQ ID NO: 30908 - DNA, 115 bp, Chlorella protothecoides
ctcgcccggcaactgcaaaccacggtgcgtcgatattggaaattctagattgattgcctgggagggatggtgcctgtgactgatgagaagagtgcgtgtgggggaaacggtcccc

SEQ ID NO: 30909 - DNA, 61 bp, Chlorella protothecoides
agcgccggcgtgcccctggccgcgccctgcacggccacgacgaaggtcgtccacgccggtg

SEQ ID NO: 30910 - DNA, 145 bp, Chlorella protothecoides
tgagatggatggtggtctggagcctgggaaccaaagcacgctggagaggtacgtggcaactcaacagataatgcacggtggtcaagtctctgggcagggaacctttccccaagcgccctgttggatttgcgcaggtggtgccggc

SEQ ID NO: 30911 - DNA, 77 bp, Chlorella protothecoides
cccccatgccagagggtttgctcttccgccgctcagctatgtgcaaacccctggagtctgtctccaccatcccagtg

SEQ ID NO: 30912 - DNA, 67 bp, Chlorella protothecoides
ccagccactcagcggtccacactgccctgattccatccgcaggccgaatgctggcgagctggtacgg

SEQ ID NO: 30913 - DNA, 145 bp, Chlorella protothecoides
gccaggagctatcgaccctgggatcaaagctcctgggctcaacttgcagggtgtccaaggcaaggtcagtgcgaagggggtccagttcccgagacgcagcctcggcttcatccgtcgccgcccctccaaagaggtcctcaggaag

SEQ ID NO: 30914 - DNA, 229 bp, Chlorella protothecoides
tcgcagccagacatgatgcacagctgcatgacaggagggaggggggtaacggtttgctaccaggaaaagtcgggaaagggcaggcctggtttccttctgaatccccatgcacagcgccatgccgtcctctgcacggccccgcaagagcaccatgctgcgcattcacgtcctccagccacccctgccctctcccaacccctcccacctggaggaagaggtcgtgtggcca

SEQ ID NO: 30915 - DNA, 68 bp, Chlorella protothecoides
gccgggaacactccttgtgcttgatactgtgtaatgcctttatttatctggcagccagctgcccaagg

SEQ ID NO: 30916 - DNA, 92 bp, Chlorella protothecoides
agctcgtgcttgctggccagcatgctgggttttgcagagcagagacgaatgtcgcatgatcattccattctctttcactgacaggacctctc

SEQ ID NO: 30917 - DNA, 61 bp, Chlorella protothecoides
atgagtggtcggttcatcgcatttttgtgaaccccccccccacaaaagaaacttccaatac

SEQ ID NO: 30918 - DNA, 61 bp, Chlorella protothecoides
atcaatgtttgagtgtctgagtaccctgtgggatgtcatgatgtgattagaacccccacct

SEQ ID NO: 30919 - DNA, 61 bp, Chlorella protothecoides
tcatgatgtgattagaacccccacctgtaattggtatttgaagcgaggccatccccgtgtg

SEQ ID NO: 30920 - DNA, 61 bp, Chlorella protothecoides
gatggcaatcgtaagatacctgccctgcgcacccccctccaacggcaaccgctgttacaca

SEQ ID NO: 30921 - DNA, 61 bp, Chlorella protothecoides
gggatgccagggaccggcgcgagcggcaggggccgggcgcaggggttgagggactggaggg

SEQ ID NO: 30922 - DNA, 138 bp, Chlorella protothecoides
cgccactgctgcgcgagggtcgaactgccaagcccactcttgtttacgtctgtctcagctcaccagtgcgggtagaacgatggattgggccgcccagatcctggattgcggcgtacgagggaccgcatacggcattcg

SEQ ID NO: 30923 - DNA, 113 bp, Chlorella protothecoides
caactaccccaccatcgaacaaactgcgtcggtacgccccccctgcgttccatagccagaggctgtctgggagtggcctgttcaaaactccgacacggcagcgcaccgtgaga

SEQ ID NO: 30924 - DNA, 72 bp, Chlorella protothecoides
gcgtccccgcctccacccaagaaggcgtccccgcctccacctcccaagaaggcgtccccgcctccacccaag

SEQ ID NO: 30925 - DNA, 67 bp, Chlorella protothecoides
gcgctgcgcgctcctgacgagtgtgtccttccttcaacccccccgcgaatcagggacctgctcatgc

SEQ ID NO: 30926 - DNA, 6401 bp, Chlorella protothecoides
  modified_base (768)..(777): a, c, t, g, unknown or other
  modified_base (1118)..(1127): a, c, t, g, unknown or other
  modified_base (1275)..(1284): a, c, t, g, unknown or other
  modified_base (1343)..(1352): a, c, t, g, unknown or other
  modified_base (1555)..(1578): a, c, t, g, unknown or other
  modified_base (2007)..(2016): a, c, t, g, unknown or other
  modified_base (2592)..(2601): a, c, t, g, unknown or other
  modified_base (2668)..(2749): a, c, t, g, unknown or other
  modified_base (3310)..(3319): a, c, t, g, unknown or other
  modified_base (3564)..(3573): a, c, t, g, unknown or other
  modified_base (3924)..(3933): a, c, t, g, unknown or other
  modified_base (4348)..(4357): a, c, t, g, unknown or other
  modified_base (5316)..(5325): a, c, t, g, unknown or other
  modified_base (5412)..(5421): a, c, t, g, unknown or other
  modified_base (5493)..(5502): a, c, t, g, unknown or other
  modified_base (5785)..(5794): a, c, t, g, unknown or other
cacccccccccaccccggcctgcgactcaggtgcacgccatcgactggcctcgatccgttcgcatcgcgtcctttggcttcctcctgtacggcccgtaccagtactggtggtacggggccctggccaggtccttccccacacgcagcctgccgcacttcctctccaaagtggccgccaaccagttgatcctggggcccatcgtcgtcagcgccatctttgcctggaacctgggcctccagggccagctgagcaacctgccctccaagctgtccaacgactttgccaccacggtcgtgaacggtgcggggggcccagaacgctttccatggaaggtccggggctgcagataccggtggcaggggcatggtcgtggcagcagggccgtgtcctggagcaatgactcagcggcccggggagcctgctgtcctcgaccccatccctcaacctcacgccctccccccaggctggaagttctgggtgcccgcggccagcatcaacttcttcgccataccgctgcagcaccaagtatggtacatgtcggcgtgtggcctgctctgggtcacctacctctcctactctgcaactcacaagcagtcgcctctggcgcccaagacggcgtgatcgtgacgtaccctggcatgatgaccctgccgccagggtccccgcaacctgactcatcatgtgcacacattcccaacgcgctccacaggggagaggccccccagcctcgtccccctcaccccacccacaagaataaaagtgaccannnnnnnnnntgcgcgctccactggggggagggcccccagccgcgtccccatcaccccacccacaagaataaaagtgaccaccgctatcatttgcccacatgccgtggaccctgtgctgccgtggctgtaccagacatgtgccgcagggactgacacgcaggggtcccaggcagaacaggagctgagaagtatttggcagctgcgccaatgggcgcggcctttgttcgggatcccaaaccccatccacgcacgccgaccatgtcaggctcgagcctgagccctgaggtcctcagagcccgctccgcagcagttcttgcacatcgccaccccccgcggcgatggcatacagnnnnnnnnnngatgtaagtgtttttgaggagtttgtttatgaggggaagggaggggagggtgaaaagggcgaggggcccgaggtgagcccgcgaaggggctcaggcagggcactcgggtgcctcgcacggcaggcagtaccacgcgggtgatgcgtcnnnnnnnnnnttcaggcaggggacttgggtgcctcgcgcggcaggcagtaccacgcgggtgatgcgtcnnnnnnnnnnagcacgccgccgttccaggcaccatggatcaggatgggggtgaggaggttgcgcgtccgtacataggtgaagcccatgaggatgcccagcgccgtcagctgtgggcgttggagggcaggtgtgtgtgtgtttttgagaagtttgtttgcgaggggaagggaggggagggtgcaaagggcgaggggcccgaggtgagcccgcgnnnnnnnnnnnnnnnnnnnnnnnncgggcataccagcctgatcctcagagtaaacggaacagctgattcccgacgggcccctgctgccctgcaaagttcacccccgcccttcaagtcccttgcccacactcgttgcggggggaactcacctgggggaagtcgcgcggcgtgaggtggatgagcccaaaggccgcggaggaggccagcaccgccagtggcacgggcaacacccgtgtgagggagggcaggaggaaaccacggaagacggactcctccagcacgggcgccaggatggctgtgaaggtggttattggaggtcgaggggaaggaagcggattctttacatgccatgcttgcgaggcttgcagcatcgccagagcttgggcagcttggtgtcacgaggccctgaccaagaaccacagggagcaggcgcgattcgctcgctgcatgccnnnnnnnnnncggtgtcgcgaggccctcaccaagaaccacaaggagcaggcgcgattcgctcgctgcatgcccagccggctcagcctcaagcagggacaagcaggcgccctccgttccccagctcacacacacgcgatcgcggagattgccactcagcatacagactcacctgtcgtggtcaacagtgcggcgcgcgtcgaaccatcgacgttgatcagctggctgatgctgtccaccgtgccgcgagcatcggagggcgcgctgccccagatggccgccgcggcggtggcggaggcgatgaccacaagcggggagagcgcgatgcccaccagggcccagagcagccacccatccgagggccggaagggagccctggcggtagtgtgagggggaagaggggaatggtcgggacagattgcgtacacaggttttgtgtgtgtgggtgggtgggggcgggggggttcgaagtatgtgcgggagggagtgactatggccagccccctttctggaagtttaaagctcaaggcaccccaccctgcggcgagtcctttccctcgacaccgggctcgcctggggtcgatggannnnnnnnnngagaggggtatggtcgggacagattgcgaacagaggttttgtgtgtgtgtggggggggggggggggnnnnnnnnnnnnnnnnnnnnnnnnnnnnnnnnnnnnnnnnnnnnnnnnnnnnnnnnnnnnnnnnnnnnnnnnnnnnnnnnnntcccctttctggaagtttaaagctcatggcaccctaccccgcggcgattcctctccttcgacaccgggctcgcctggggtcgatggagaagagatcggcgggcaggggtgtgtggcggcgcgtgaagagccagagcaggcccagcgtgacgccggtgcccagcatctggtttaaaaggatgaacagcgccttcacgtccatgggcagggagccgacggagctgcccagcgtccagcgcaggagggtgacggagaagagtccggtggcggcaaaggtcaggctccatgaaaccaggcccagggcggtctccccaaggccccagggcacctgcgccatggcacaattttgagggttgagggagacagagggcggaggatgggttcgtgtggggtgtcatgatcaggctctgggacagggtacggtcctgagatgacactcatgtgtggggcctggcctcagacatgaccttcacatggggaacgcctgcggtcgtgtggagcatccttgctgtgcccatgccacacaacttgatacaaggccacacactcacgtcccagggtnnnnnnnnnngcatgaccttcacatggggaatgcttgcggtcgcgtggagcatcctcgcggtgcccatgccacccaacttaatacaaggccacacactcacgtcccagggttgaaggtacgcccggaggtccaggggcccatatgtgccctgggccgaggaggaaagtgggccaggggctggcatcttctggggagggaggccatggcatgctctgccatcaaaagcatccagcaaccttctcagaccagctgtnnnnnnnnnncggggctggcatcttctggggagggagaccatggcatgttctgccatcaggagcatccagcaaccttctcagaccagctgtaagcccccacagatcctcaccggctccttctcgggcggcggtggcggcggcgacggcctcctgcctggcgcactctgctgccgcttaccctgaaggctggacttgagttggtcctgtagggtggccactggcgacttggagcctgggctcctgtcttgcctctcatctgttcaattgagaaggggcatgcgtgatatcttacactccctagatcatgtgagtgcatagcacatcccgcttcttgaccggctgcaacatccgatgattgcnnnnnnnnnngcattgagaaggggcatgcgtaatatcttacactccctagatcatgtgattgcatagcacatcccgctgcttcaccggctgcaacatccgatgattgcaccccagccatgcgcatggcgcatgcacagcgccccatgcgcactctgtgctcggagcaacgagacgccgcatcttcgccgccatgagacaggaccaaatgctggacgtagatgctgagaggacagggagggcattggcagctggtgcgccgctgggcatgcccgtgcgctcggcattactgctgccacaggcatagggtcggcgatggggcactcgcgactgcgtgacggatccgtcaaacgcgatgatatcaatgctttctgcgctcatcatgccgagtgcgcgtcatgccatgcatgcatcgctccatccctgnnnnnnnnnnggagggcagggagggcatggccagctggtgcgccgctgggcatgcccgtacgctcggcattcctgctgccacaggcatcgggtcggcgatggggcactcgcgactgcgtgacggatccgtcgaccgcgatgatatcaatgctgtctgcgctcctcatgccgagtgcgcttcatgccatgcatgcatcgctccatccctggcctgggcttgccgcatgccgtcgtgtcactggacgcggtgcggtagttacccctcatggttgcggcgcgcccaccttgcagggcactcagtctcctgctcgagtgccaatccagaccatttcccaccttctggtaatgcaccgccatccaaacgtctttgcagcattcatcatatcgttttggagacaggtagagggatcatcgctgacgcattggtgtcgcaagcacaggcaaccggcacatgcccgccgtgctcgctggcccggggcctcgtcgccgtcagggcgcctgcgccgctccctctggcgcgctggccgtcagtgcctccggccgcaccatctccacgctgatgcaccgcagcacgtcccccggcctgaactgggagaaacccgtcagtgccacgccgcactcgccgcccttgcccaccgcctccaccaccagcttgacgcggcgcagagaggcgcaaggcccttcgtgcaccaactcccccgcccgcagcacgcggaaggtgtggctcgcgcgcaggctgccctcctgcacacggcaccccgccaccaccgccgcctcgcgacccctgcgatggttgttggggtgagttgtgtgggatgggtgagttgtgtggggcgagcggggtgtggggcgagcggggtgcggcgagcactccggggtgagcgcagtcgggcctcggcagctcggagccacgtgtccgaagcggggcgcataggccgctcatgtctctgtcatcctctctcattcccnnnnnnnnnncgagcggggtttggggcgagcggggtgtgcggcgagcgaggtgcggcgagcactctggggtgagcgcagtcgggcctcggcagctcnnnnnnnnnngggacgagggggggcgtcctccggcacagcaatgcaccgcctcgggcgtccagaaccgcatcgtggaagagnnnnnnnnnnaggacaagggggggcgtcctccggcacagcaaagcaccgcgtcgggcgtccagaaccgcatcgtggaagaggtgctccccccacagagcatgccgcccctggcgctgcatggcccctgttcttgcggaagacatgccaaccccccccccaactccctttgtcggagaccattctcccaccgcgcccaaagccactctgcacgcaccatgaatggcccctctccatcacacacaaacagcactcatcccccgaccacctggtggccttgacatcgaagacctgnnnnnnnnnncgctcccaccacagagcatgccgcccctgacggtgcatgggccctgttccttcagaagacatgccaaccccccaactccctctgtcggagaccattctcccaccgcgcccaaagccactttgcacgcgccatggatggcccccctccatcacacacaaaagccactcaccccccgcccacctggtggccttgacatcgaagacctgaagcacggcggcctcgcccgccaccacctcgcgctcgacgcgaggcgcctcgcccagcatcacctcccccagctcctccagcagcttgtagatgacgtcgtggcggtgtagggtcaggccgtggcggcgcagctccgcgtcgacggccgcgccggcggtgcgcacgccaaaggccacgacgcgcgcgcgcaggggcaccgccagctgcacgtcggaggccgacacggggcccaccccggcgtgcaccacgcgcagttccagctcacggcaggaaagcgcggcgagggcgtcgcacaccgcctccaccgacccagccacgtcggccttgacgatcagggggacgacggagcgcgcgggcggcggcgcggcggcggcctccgccgccgcggcggcggacacca

SEQ ID NO: 30927 - DNA, 80 bp, Chlorella protothecoides
tccttcacgttgcagaaattgaggatcgtcgtccgccttccgactgcgttgttgcaccgcagatttgtgcccttgttgtt

SEQ ID NO: 30928 - DNA, 61 bp, Chlorella protothecoides
ctgggtgagacaatggcttatggttaggggcgaaaggacttccatcatactgttgagagtg

SEQ ID NO: 30929 - DNA, 74 bp, Chlorella protothecoides
tgcgtcactttgccaatgcgcatgatacggcaagctgccgattctgccatggtgctcgatcgccatgcgttctc

SEQ ID NO: 30930 - DNA, 75 bp, Chlorella protothecoides
gcatacccgccttcaaatccttgtaatggtgaaggcaacctggcgtagcaccctggtcgtggcgagctgcgggaa

SEQ ID NO: 30931 - DNA, 61 bp, Chlorella protothecoides
ctgggacgcaaccaacgtgctgaacaactttacgtggacggatgtcgctcagccacatggg

SEQ ID NO: 30932 - DNA, 72 bp, Chlorella protothecoides
acgtggacggatgtcgctcagccacatggggactcgcaaaagattgccacaggcttgtgcgttgggagcaga

SEQ ID NO: 30933 - DNA, 95 bp, Chlorella protothecoides
tctcgattgggtctgcccctgtgcctcctggcttgcccaccatcgtgtcttgcagtaaccctccaagcaacagcgagccccatgcgtaagcactc

SEQ ID NO: 30934 - DNA, 124 bp, Chlorella protothecoides
ttcaccgtccggcagtcgcgaccctgacaccctttcaactacccatatcagaatcacctgccctttatattggcaggttcaatgcaaattttgtaacgagagacccagtggctccttcaaagct

SEQ ID NO: 30935 - DNA, 142 bp, Chlorella protothecoides
atgccggactgccacgtgcccacctcaatcaaatgacacagcagtgccgcagaccctgctaattgtgaagctggatccctgccgctcaacaggttggagacacctcctcccgccgcccgccctaaataactcttgcgtgcac

SEQ ID NO: 30936 - DNA, 17024 bp, Chlorella protothecoides
  modified_base (478)..(487): a, c, t, g, unknown or other
  modified_base (1113)..(1122): a, c, t, g, unknown or other
  modified_base (1347)..(1356): a, c, t, g, unknown or other
  modified_base (3482)..(3491): a, c, t, g, unknown or other
  modified_base (3864)..(3873): a, c, t, g, unknown or other
  modified_base (4074)..(4083): a, c, t, g, unknown or other
  modified_base (6510)..(6519): a, c, t, g, unknown or other
  modified_base (7023)..(7032): a, c, t, g, unknown or other
  modified_base (8456)..(8465): a, c, t, g, unknown or other
  modified_base (9055)..(9064): a, c, t, g, unknown or other
  modified_base (10740)..(10749): a, c, t, g, unknown or other
  modified_base (11351)..(11360): a, c, t, g, unknown or other
  modified_base (11621)..(11630): a, c, t, g, unknown or other
  modified_base (12602)..(12611): a, c, t, g, unknown or other
  modified_base (12687)..(12696): a, c, t, g, unknown or other
  modified_base (12772)..(12781): a, c, t, g, unknown or other
  modified_base (12970)..(13022): a, c, t, g, unknown or other
  modified_base (13721)..(13730): a, c, t, g, unknown or other
  modified_base (14031)..(14040): a, c, t, g, unknown or other
  modified_base (14428)..(14437): a, c, t, g, unknown or other
  modified_base (14996)..(15005): a, c, t, g, unknown or other
  modified_base (15102)..(15111): a, c, t, g, unknown or other
  modified_base (15182)..(15191): a, c, t, g, unknown or other
  modified_base (15290)..(15299): a, c, t, g, unknown or other
  modified_base (15588)..(15597): a, c, t, g, unknown or other
  modified_base (15971)..(15980): a, c, t, g, unknown or other
gccgccgcgcgccccgccgcccccgccggcgccgggatcgcgggcgccaggccccaggcgcgcgcccagtgcgtggcggccagcacggagcaggcctcgcacacgccctccgcaaactcctcgtcctcgccctcccagcccagcgaggcggaggggaagagcagggactgggcgcaggaggaaaggacgtcggccaccgcgcgggcggcggccgccaccgccgcctcgtcctcttgctccaccttccggcctgtggcatgtgtgtggtttttgtttggtggtggtggggggggggcacactggtggcgcaagcctttgtgcatggccaatggggcacagggcgggtggccgccccccgagggcatccaggggttgccacccagcccttgcgccctgcaggccggggggcctcgcaccgccgctgtgccgcgacgccccagcacccggccccacgcgcccgccgacctgccatgtgccnnnnnnnnnnccccttgcgccctgcaggccgtggggccacgcatcgcggctgtgccacgacgccacagcaccagcccccacgcgcccgccgacctgccatgtgccgcaggatgcccagcgcctcgtcgcggaactcctccctggtgaggaggaagccgcaggcgttcagcagtccggatgagagcagggagccctgcggcgcccagtccgccatggtggccgtcgcgcctggagtggagtcaggagagcgggtcggcggcgaggggccaagcggggcagcgaggccgcccaaacacacgcgtgcacccagagcgcccctgcgcccctgtgactgcaggtgagggtggatgcacacctctggtcgctgcccaacagccgaacagtgctctgagaggcatcgcatacctagggctgcatggacggcggcctcggcggctggcccgccccctcccccagccaaagcgctgtagttgccctccaggacgctttggaggaagcccagggtggtcggcagcgtcttggtcagtgcgttgaccagcagccgcttggcctcaccctgatggggggtcatgaggaggacataggatcagggccgcagaaatggtcatgagggttgggaatggggtccagggtgannnnnnnnnngtcatgaggaggacatgggatcagggtcgcagaaatgggcatgagggttgggaatggggtccagggtgagtgctgcgagggtgagggtgtggtgccagccgatgatgggtgcacactggcagccaaacgccgcaacccatgccaacacgcgcgtgcgagccccctgtccactccaagcacgctttcccaaagagatgggtggatctctttcccccttgacaccgnnnnnnnnnnagctccaaacatgctctcccaaagaaatgggtggatctctttcccccttgacaccggttcccatccccacactctccccaaaacaagtacacaaggtcgtcacacttaccccgatgtcgtcctgggaggcctgggtgatctcctccgccacgtacttgatgaccagcgccaccagaccctggtacaccggcccctcccctgccagggccagcaggcgctgtagggccgagtcccacacctccgcgcccatgcgccggatgaccaaggccagcagcagcgccgccttgctgcgcagcgcccagttctccccgctggcggctgcggggtagggggagagggaggggttacatcgcgtctggatgggacgaatctgccggcagaagctcgaggcacccggcaggacttgcaggggatccaggtgtgcccgggttccggggctgaaccagctcaccctgctgcagctgcgcaaacgtgactgctgcccactgctgctggtccgactcctggaactcggcccagcgcgccccgacctggcgagggaaggctcagaatgcggtcggcaggtgtgtgtgtgtggaggtaaatcagggctggtgggtggggcctccgaagcccgacatgtcatgcgagtcagcacacccctccacaacctccaaccctcctctctcaagcatcccagggcagagcctaccaggtgctggaggagcgtgaaacccagcaccctcacttccaggggcctgtgggcactgatgagatccgttgcgactgcagcgcctgctgctgcatcgccagatttcagctgcagcgggacgagtttggaggggaggggggggtctgatcatgcaggatgacgggcgcaggaacacttcccggccggcatttgaagcatgccataccatgcatgagccctgccattccgcgaatctatggagctggcactctcatgccccatcgtgcctgttcgaagatggctgtggcagctgctcgctgttcctggcttgcaccggcctgctgtgcgccctgcaggctggaaacaacctcctccacccctccaaacattttagaatagcgagtgtcacgcaggcatcgaaattgagtgtgccagtcttgaaatcgccggcaggtatcgtgtgcgctgtgagggtctccctccctgatctcaagccgacacagatgctttgaccgatgatacttttatccagagtatcgaagttgcatgcctgcagcgcagttggtgcattccgggaggcctcgtcacgtcccgccgatctgggtctttgggtatgagactcccgggggaacggtgagtcacgtgtgttcctccctcccacttttcgggggaccagccgatgatgaccccgcagccattcccctcgccagcatcttcaacaccgttctttctgagatctgggtcgaactcgtatcagaccagtgggtgtcttagggtgctgaaggtctcgggcagcagcgacatctgcctcccgggggccttcatgctcgcctgacggggaggttgtccatagatcgggcacaggaggcacaccgggcctctattcctgttccgcccagcatgcttgcaccctggcaggatgctgacgtactgcgtgctgtcttccggagtctcagtggcttgccgtcgggcgcagcctcggtgcgtgggtcgggccctcccgcatcggaaggaaatgctgggcgcatgctactccccatgtggtgtcgccccaccaatttgccgccatgtcccttacctgcggcatcggtgtccccgatcggccgtgcgatactgttgagcctcacagcctcccaccccccgacatctcgctgcacagctaaagtcagccagcggaacctgtcgcgcctggcgcgctgtcgcgaccgaggttgcgctgggggacaccgcgatctccagacggcgcgggtaggtcccatcgacagtgtgtcgggcgccaggggtaaaatgcattcgggggggcctatctcaggcggtacactttcattggctctggccacgttgacgtagctctgcaacctcgggaggagcccagccttagaatctgccttccacaaagttttcatcaaacctcatacctcattgatgcatggcagggacagcgctcatacgtctnnnnnnnnnncttcattggctctggccccgttaacgtagctctgcaacctcgggtggagcccagccttacaatctgccttccacaaagctttcagcaaacctcatacctcattaatgcatggcagggacagcgctcatacgtctggacatggccggcgtgcccaagaggtgcacccatcctctgtgcaggcatccctgcacaccaccacctccctgtgcctccttgaggcagacagcctagccccaggtgggttgtgatgaggggctcaggactgtcttccatcgctcccggggcagtctgtcttcttcagaccttgtggggtccagtgcatggcagcatggggaacggcccggctcccctgctagaccccagacggggccannnnnnnnnnaatggcagcatgagtaacggccaggctcccctgctagaccccagacggggccagtgcaagttagcaagcccactggggtcatgaaatgcatccttgcaggtggcgaggtcatgagccgcgggccccgggacgcccgcgcccccggacctgtcttccgcacggggaccgcatgtcccaggcagggcccgctggccgcgctgnnnnnnnnnntggacctgtctgccacacggggaccgcctgtcccaggcagggcccgctggccgcgctgcgctacgctttcctgcactccgtcctgctcccgctggaccaccccgtcggcttcccgctgctccacaagggcacactccagcgtctgcccgcccggccgcccgcactggggcatgaaggggccggtgagtccatccctcccccggccctgcgcgccagccggccctgcacggaggctgggccgcagctggcccagcaggtcaagggccgcaagcggcggcgggtggggcccagggaagagcccggggccgcccggtggactgctcccgtccagggctgacagctccccaaggtgtaacgagcaagggctgggcgccgcccggcactgccccgcacccgctgaaagggcctcgcccaacctgcctcgattcccactctgcgcaatcagggaccgacctggcgcgatcagccgtctcctggtcggccggtgcccgaccctcaacaccgcgctgcattccccattcccaacttacagggcgcgcactcgggccgccgccaggcgcgtgcagcccgccccccctcccccgccgagggcccctcggtcagacgagcatcacccgcctcatgctgattaaagctgcggcctctttctctgtcctttcatttgacattctgcgccatccggcccctcactgtccaccgcacacactgcaggctccgctgtccctcaccagcctcatccctgcccacttgctccttgcgccgttgtcgctgccactcggacataccctgcctgttccctcccctcccttcacgtgtgaggcattgctcccagctgtcccccctgtcgctggtccactgaatcgtaagaaggctgcaagcgctcttgtcttcccctggaggtgctcggcacagggtcaaaatcattaacagatggccagaggagggccgtgtggtgagtgcaaggcacgccgtgtggtgagtgcaaggcacgtcgtgtggcagtgccgagctgagccccctggaatgggaatggggcgcagggcacaggcaggcggtgcggtggcggaaatctctgcgcaccccagcatgtcagccagcatggcgcagagggcgggaaaaatgctggcggagcacctcagcccggcggtgggctcggcctcgctgctcgcccggggtcacggaatgtccgccccggggcgccccggcgtgggccagaggaggggccgcctcgcccccggctccccctccggccccggcagggtggggctggtggcccctggcctcctgacggaccgtggcagccgcatgggcgacgcctcaggtgtgccgggccgagactggggggtgtagtaccccgtggcggcttcgaggcgagggcgggcggggctggccccccgcccgccgccctcccaggccgagctccaggggtaccggtgccgggcctgggcgtgcgaggcagcggccgcgcccaggcacgagcccaggagctggagggcggccagggcaatgcccgcaacgcgcgcggcgtgggggtgcgcctccagccggtccagcagggccgccagggcgccggagccgtcatgccgcgccacgcgttccagccacgccagctgcgtgtggctcaccgccagccaggcagcctccaccgggatgagggccagggagaggcccgtcatctgcaaggtccgggggtgggtggacggggtggggcaggaaggggttcaagtaggtgggtagatctggcaatcaccgagaccatggctgccggtacaggcatgcacccctgcacgccccatgagacccctggcgcaccatgtgcaggagggcaggccagtcgaaggaggccccgaggacacccagcagaccatgcagcgtgatcagggctgcaaagccggccagcatgcccgggaaccaaaggctgccgatgtcagagagtgggccgggtgccctgtgggcctccagccccgtcatgctgagcagggagactcccacgagggtgaccagcccgcagacgatcctgagtacttcccgattaagggatacacagcaccccatgggcgttggtggcgctgacgccgatcacgacactccagcaggcaagaagaggcctgtgcgagctggtattcggttccaggcagcgcggtccgtcgcttccatatattttgggaggtgtaactcatacacattgtcggcatcttactatcaatgtatggttgtgcacttcatggtgtccccgacaccctcgccccgcgcgctccgtgaggcgagatcagtgatgcagcgagttcaaaaccgatacccgtgccccgcccctcccatatgcatatcagaaccccttcaccccttgcactccgtgaacaaggatacataaagtatgcattcttccggcaagttgacgcgagccaccgagaggccccgagtgagcannnnnnnnnnatccgtgaacaaggataaacaaagtatgcattcttccggcaacttaccgcgagccaccgagaggccccgagtgagcacgtcgcgttggggcacggcgccgaacccttgccaagggcacttgcaagcaccttcctcaacgatatctagctcccgcgcctcggtgatcctggtacctgcatcaatgcgacgatcaaaccggcgatcttccatccgatgccgctcctgcaccacatcaaggccgagccagcaggccctggcagcgggagggctggcgttggcgtcctgcgcgatgctcatctggtggtcccgacgaacggtggacttgccgtcgtcgacgaggaggcaggagagccaggattcgtcttccctgatcctccttgaagactgggatgcgcgattcctggcccggcatggcaaacccaggtgaattagctggcagggacaggtgggtcttatgaaaacgcaacgcaacgtatgcttcgcgcgagtcgaagatatgtcgcnnnnnnnnnnacttatgaaaacgcatggcggggatgctcacccactcacacctttgggggattactcgtaactcgatttcacatgcatcgccttctaccttcttcaacaggatcagctccctgcgggaaagtcatctcgttgagtacctacggacaggggtgtgtaccaggactctcctctcccatccttgatgcacttgacactctttctatttatcagtatgtcttgaagtccataccttccaattttatcaagtctcaaacttgattctacaccactttgtgatggcacgtagtagagatcgcttgccactgataccatgaacaggaacatgctgctgctcgtctctcatatacgaatacccgaagcatgatgttttcaacgatggttctgatgcatgtaaggaacatatgctatcgacggtccggatgtccaggctgtcatgaaaggaactgattcttcgccgagccgtgcagcgcgcgcgcatgagagatcagttgaatgtaacataataccatgcgtcgggaggggcccaccacatcagggtgtctccagggatcccatccctggctgggatccactgattgccagccaacaatcccgatggacataaaatttgatcttccggacccctccaaacggtccctgttggcggctgtgggggtggaggcacgcagcccgtacacccccctccgcatacatgcctgcgggcaaaatgtgaccctcctcatgctcgtcgctcgggttcactgcttgagcaaggtgtgcgagtcgagagtcggtcggcaggggccatcgacatcctggcacattgtgcggtgggacacccgaaacccccgaccacgcccggcgcacgctccccctgttcctcctctgcagatcgagtcctacttcctggagtccccacaggagctgcagtcaccgctgaacctgcgaaatgaggctgcggcggtgtccctgctcctctcctacctcccagggcctgggcaggaggagggttgtgaggaggtccgccaggccctcagacagcactgcgagggtctctggccctcctttgtccatggggatgcctcgatgcaggcggacagcgttagatacccggccgatgacagcccggcagcagattttcagaggtgaaggcagggtgtagggttttcagatggctgccggtgcctggtgcactaccacaaatgcgacgcttcaaagcgtgcaccatggcaaattggactcctgcaattcgccatccaaaggctcatcatggggatcatgcctggaaggctgacttctgtgaagcattgcgctgtgttttctcaaaagatgtgggccaggtgcggcccctccccgtcgcccgaaccccgcgcgtccgtccagactcgctcatccgccctgaaccagcacacacgcaggtgggctgctgatgtgggcatccagtnnnnnnnnnnccctgcaattcgctatccaaaggctcatcatggtgatcatggctggaaggctgactcctgtgaagcattgcgctgtgttttctcaaaagatatgggccaggtgcggcccctccccatcgcccgaacccctctcgtccgtccatactcgctcatccgccttgaaccagcacacaagcaggtgggctgctgatgtgggcatccagtccaacatccgcatcgccaagtttggggcgctccgggggtgttcggccggcagggacattgagcccggcgagaatctgctcagcatccccgcagcggccctgatctacgaggacaccgtgcgcaagaccgacgtggtgagcctgggacagggaatgggcggcttgtcaatccccgtccctggcagagggagagaggggggggccaatccggcccctcgccgaatgcgcttgcgagccgggtgccggccctcccctgctgcatgcctcccgcccccgccacgccagcctcccctcccccatccgtccccccacggcgtctcctgttgaaccccacacgcctccctcatcccaccctttcctcgccagggccgcatgctgagcgccatnnnnnnnnnngtgcctcccgcccccgtcacgccagcctcccctcacccacccgtccccaccggcgtctgctgttgacccccgcacgcctccctcatcccaccctctcctcgccagggccgcatgctgagcgccatccccgacctcaccgtggacaacctgctgatcctgttcaccatgatcgaccgccacgaccccgacagcacctgggcgcgctactgggcctccctccccgccgccttccacaccggcctcagcttcccgcccactctcgtgcaccgactggcggggacggctggcgcgctggagctgacgcgcgcgcagggccacctgaagcgccagtacgacgccacccggcccctgctggccatgctcctggcggcctaccccgccctcctctcccccgcctggttcgagttcgggcagtacacctgggccgcggagctgtggtacagctacgccttcgagatagagttcccgggcgcgggccgcgacccggcgcctggcgcaggggccggggcgcagggcaccggcgagccgcgccgggccagcggcgagagcatagcagtcccgccgggcccgccctgctccccggcagccgccgcctgcccctccgccggcgccacctccgcctccgccccagccccagccccctccacctccacgccggtcatggtgcccttcgcctgccacgtcaaccactcccccgcgccacatgtggtgaggtacgggcggctgagcgaggcgggcatgctcaacttccccgccttcaggccctgcaaggagggggagcaggtcttcatctcctacggcccggtgcccaacctgaagctgctgtgctactatgtaggcagaagagaggggtggggggaggtggggcgggggtttacgaggagggaaggacagggaattgaaaggggctggggagtgggttgactgaggcgttgggattgcaggacaaagtgcctggatgcacgctgtcttgtggataaccagatgcaccaggatccgtgcagcagcatgtgcgtgggcatgttaccctgccccagtcaacaccgccatcctcccggccatacccctgagcctatctggccccctcaaccccctccccaaacgctcccgcccccatgcagggctttgtcatcgccgacaacccgcatgatgtcgtccccctgaccctagagctcccggccgaggaggacgcggccctgcacgcccgccgcaccgccgtatgggagcggctgggcctcgccacggagcacaacctgagtgccgcccgcctgtcgccgcagctgctggccgccctgcgggtggccgtggccacggccgaggagttggccgggatggagaccggggacgatccggggcgcgccccgctgaacccggagaacgaggcgcaggcgctgcgcactctggacgtcgccctggcccagctgctggacccgctggaggcctgcccgctcctggcggggtcgccacgagctgcaaactccctggagtccaggcagggagtggccatggcgggcgcaggggggcaggacgcgtcaggtgtggatatggaagatgcaacgggcgcccaggactcggcgcccggtcttggcaatgaagtccatgcagcagggtctgttggaccggggccaaccacagccatcacgccggagctggacgagaatggcatggacgacggnnnnnnnnnncaaagtccaggcagcagggtctgttggaccggggccaagcacagccatcacgctggagctggacgagaatggcatggacgacggctgggtggccagctcggctgcgtgccggcagtacgtgctgggccagcaggccatcctgcgttgcgcgcagcgggagtgcctcgcccggctgcgggcggccgtcgccggggtctaatgcgcaccccatggaccctggcgagatcagccgggccagtgcaggacctaagcagtcagaccagtaagtacgcctgccaagcaggaacccactccttggctcacccttcacattctctccagacaataacgaaccggatttccttctcccgttgctgctctccctgctgctcctggatgctcgctcctcctgaactgctcaagcattgttgccaaccttcttgcctcagagtatggcaagagacagtgatcgccagagacagtgattgtcaaacttgtactggtgtctgccggtagtctgaccaaggtacggtcagaggggtacgagaagccatgtggggaagtttgaaatcgaaatatcggcaataccaagccttcctaccttgcacggggagatgccgctnnnnnnnnnnaacagtgagcgcaagagacagtgatcctcaaactcgtgctggtgtttgccggtagtctgaccaaggtccggctagaggggtacaagaaagccatgtggggaagtttgcaactgaaatatcggcaataccaaaccttcctaccttgcacggggagatgccgctgatgctggtggtccggggtatacaaccagattcagagatcctagaccccacgattcttgtttatttctttactttgagctttctgtcattacttgtcannnnnnnnnncatcctagaccccacgattcttgtatatttattactttgagctttctgtcattacttgtcagaatgttcagacttgtatcattactccctgcgcatctacaataaggtccggtatcgtcccagcatccaacacagtacccttcccacaccacctggctctcatccctctggcactcccgttgcattttggtttcgataagggtggtacggatcctttggcttgtttcctgatcccctgctgttgagttccacccaacgtgcatccgcagcctgtttctgcctcggccggatcccaccggatccggacctctcaaaactcccccacgggataagttggtgtcccgtctaggccccgacatgctaactctccgacttcgcctccagaatggcctcgagccccggctggatgtgcatcgcgttgagcgtggcccagtcataggggcccggtccgagtgttttgtggcgtagaagagtgttgcgggtggatctcagcagtatgcgagacaggagatcaggaaaactgcacagggaaacgcacaacccttcccctaaaccacatgtaacgggtctgccaagcgggtggggagtggtcgcgtgagtggggaaccgatggaaacctcgggagcatcctgaccctgtgcaggtgcgagggtgtatgcagtacacgcaggagatctagaatagagatgaagggggatccagttgtactggtcaatcggatcatcaagtggcaggaaaagaagggcgtctaagccgagcaccgggtgaggcggtcatcggcagagcctggcaccaagtactcaagcacatgcacgtatctagctcgccctcctgagctgcttgaaagtatctcgactcgatataggtcaagctttaccatatacgtatggcggaaggcagtatgcaacttgaggagggaggcgaccttccgggtctgctcccccatccgcgagagcagcccgataaaaatgnnnnnnnnnnatccatgtaggctcataaggtttaaatcaacgttgtatgacctgttgtcatggctggtggcccagctgctggcagnnnnnnnnnnctccatgtaggcttataaattttaaatcaacgttgtatgacctggtgtcatggctggtggcccagctgctggcagnnnnnnnnnntatccccggggtgccttttcatttcaaccagtaatgtcatatgacaaaaaattgctgactattgggtacagactgtacgtcggactcctcatcgcgcaaacaagacgtcatcgaatccacaggacgctgcatgacgtgctgtgggacatacaaatacgttcactgaaaagtgttaggagcactcagctnnnnnnnnnnnnnnnnnnnnnnnnnnnnnnnnnnnnnnnnnnnnnnnnnnnnngaagaggactgaacaatgattgggtgacgtaaacgacgacctgcgtgaaccgcgagtacgatctcttgcctattcagctcagaatagcacgatgtcggaataaacactttgaggaagagcatcaaatagagatcgtatgaaagaatgggaatcactccccatcttcctagtgcgtgaagggtgtccagaggatgccgtcggatgcatgcttcttcacacgcccagcgcggcagggaacctccacctcttctcccccgggcacctgctcaatctatgcgaccagactggcgtggtcccccgcggatcgcgccatcgcggctccagctctggtggaactggcagcggtgacccgtgagtgctgtcccaagagggtcatggcacgcgatgttgcgccatcacgagtcctcgtgtaatgctcttacctccttgacatcgtctgccgccatgccattgtgtcacaggcacgcagcaggcccccaacaagcccttcatcaggctggagtggcccacagggacactggtactagggtttaactctgtcagcgaccgcgatgaggctgtcgacctcatcaagaagctcagggtaggaagggttgggagagtgattggcctgttgctggatgggggggtggcctccctaggagctggctggttggaggcagtaccttaagggacagcattcaagcaatttgaaggggnnnnnnnnnntggcctccctaggagctggctgattggaggctgtacctcaagggacagcattcaagcaatttgaaggggtgttgcttgtccacagcccccctgatgccgttgacaagagtctgtcctgctaagcaatcgcaggcaaagctgttggcatcatcgaccccaccccctggagtgcccagtgccccgcagaaggccgcctactttgctcaggacaggtgaggtgtttttccagcagagctctgtgtctcatcctctgaggcttgcaatgccttgccgaccagcccaacctgattgcccaagaaannnnnnnnnntcagccgagctctgtgcctcatcctctgaggcttgcaatgcctttccgaccagcccaacctgattgcccaagaaactgctgctggcgccgcaaggatccagcaggtgctccttccaggaggatggacatcgatcattgccagacctgctgccgtcgcttctgtatccagcacatcgtgcaccacctctgcctccttcagggacctggaaaagctgtacctggaactggtggtgccaggcatcctgccagagcaggagttctgggcggcccgcgcttcgcacctggcgaggctggggagtggggctggggcgtctgcgtctggacaccgcacagcctcgagctcgcagcggaggggggtcccgaactccctgacctcagaggtcaggcnnnnnnnnnntccccgcgcagcctcgagctcgcagcggagggggctcccgaactccctgacctcagaggtcaggcctgcggcagacgggcaaaccgacactgtgcactttagcctcactccggagatcattgcacaggtgcggggttgatacctcgtgccaggaaccggagcctagagtgtttgaaggggggaggcacgggtggtgagagcaaacagtgcgtgccatgtgttgcctgtacttgatgccatgagaggccaacagcgctactgtccagtttcctgtcagctgacccttctgttaagtatccctcgttggaccccacccttcaaaccctgctagatcttcaatgaacggcctgaggtgcatcgcgccttccttgccaaggtcccgcatgaactcaacgaaaaggagttttggacagtctacttcaaggagcagtacaagcgtctagcaaggaggtgggcgggccttgcttgctggaacccttcccccccttgtacaccgcctgaacaaggtcaccacatttggcggccctgacagcgcctcctcaactccccacccaacacnnnnnnnnnnatgcttgttggaaccctccctcccttgtacaccgcctgagcaaggtcaccacatttggcggcccttacagcgcctcctcaactccccacccaacacnnnnnnnnnngtaagtatccctcgttgacccccacccttcaaaccccgccagatcttcaatgaacggcctgaggtgcatcnnnnnnnnnnggacgaagaggattttgaggacgaggtgtttggcccatttcgacgacggattgccttgcaggtccgaagatggtcaaggggtggcgcgcaggtgtccannnnnnnnnnagacgaggaagattttgaggacgaggtgtttggcccttttcgacgacagattgccttgcaggtccgaggatggtcaaggggtggcgcgcaggtgtccaggggttgggagccaccaaaccctcgttgatgacacagcctccaagctgccgcgcctgcatcgcgacaggccacgcggcaggagcgggtttctgaacctccgctcatgctgccctcgcagcggctgtgttggccaggatggcgtttcgatcattcaacaggttcccaacgcacctccgcaccaacccctccnnnnnnnnnntgggtgtctgaacctccgctaatgctgccctcgcagcggttgtgttggccagaatggcgtttcaattatccaacagtttcccaacgcacctccgcaccaacccctccatccacctcgccgcttccccacaggaggcagcacgggctcgcggcaggatgcaggaggtggaccccacgctgaacctggaggcggcccagggagagcagtacgccatgctccagcgctcggagggggccgaggccgggctgggcgccgcgggctacctggccaaggacctcaacaggtgggctcgggtgtgcctgctgagtttcaaggccaacctctgcgaacgtgtgcagtcaaccgcccctgcctggccccggccttgagcaaannnnnnnnnnaaacatccacgaatgtgcgcagtcaatcgcccctgcctggccccggccttgagcaaagaggtggcagtcaccccagcagcccgctggggtggctgccccgagatcccagcatcatccaaagccctctgcaaggggcatttgccgacatggtatttaccatgtcccaccttccattccttccaccccactgcattgatccaggcacgcggccctggtcctggagggcacccccgagggcgtgctggacctcgccggggacggggacggcccctcctcccatgacacggccgccatcgccacgcgtctggcggcctcccaggcgggggcgtcgcgcacggccgcgagggagcccaggggcgagccgctgcgccatcgcgaccacggccttgaagaccttcgagggcctgaacaggcacgtggcaggagttttttggggggggggagcaggccattccgctgctgccaggggcggggaagggggagggggggaggaagagaggagagggaggtgggacgttgccctatccaggctgcagggcatctccctggcccgccagcaccctccttacaaccaccccagcctgtgcgcagagcctgcctcccatacataactcgattctcttctgcgtcgtcctggcaggctcccggcatcccgctcaacatccgcgacccggcggcgtactaccgcgccggcgcgccggcggtcgacggggccgccactccggagtccgagcccatgagcaccctgcgcgatcccggcgaccacacccccaccccgctgtcggccgtgctacggtccattgaccccaccgcgctccccctctgcccctgcgaccccgcgctcgcccgcgctgtgctggaggagctgtccgccggcaccgacgcggggctggcggcgcgcttcggcgcactggcggctggtgtgcacggcgttcgcgccgacgcggcgctgccccccggcctgctgggcctgctgcgcgacgaggccctgcgcaccgacgagctgctgcgccacttctggggcgcgctgccctgggccgcgcc

SEQ ID NO: 30937 - DNA, 65 bp, Chlorella protothecoides
ccggctttccagaacctgtgcgacctgaaggggcgctctcattccgagtgggttcctgggatgta

SEQ ID NO: 30938 - DNA, 76 bp, Chlorella protothecoides
ggggggtgatgggtttggtacacgactgagctgctgggcagggaccatggagatgagaggggtcatcatgtttgac

SEQ ID NO: 30939 - DNA, 132 bp, Chlorella protothecoides
gcgcggcacctggcagcggcgctcccagtcgcatgaccgcacgctctcctggaagatgcctctgcaacaccccgtccctcccactcacccccctcaccaccacccccccgcgcaggtacggctacggcctgc

SEQ ID NO: 30940 - DNA, 178 bp, Chlorella protothecoides
gcaaggattacatggtggcaaagggggggcgggaaggaaattgcaagggtccgaggcatgcagctgggttagtgagcggttcattactgggttcctgaactcatgtcctggtgccaaacccgggcaacaggatcttgagccccgtgcacgctcaaccctcccgcggcagtagaaacca

SEQ ID NO: 30941 - DNA, 108 bp, Chlorella protothecoides
gcgtcagcgtcccctcctcatgtccactcattccatcccacggtgtgtgatttaacctgaaattcaaatctagtaaaattttctaaaaaccctttacggcgagcgtcg

SEQ ID NO: 30942 - DNA, 106 bp, Chlorella protothecoides
atcgacgatgggcctggaccggccatgtctgggggatcacttccgggctgacctgccgcgtgagggagggtacccgcaaccttcccaggaatacttgagggaacaa

SEQ ID NO: 30943 - DNA, 81 bp, Chlorella protothecoides
aggcggtggagacttcttggcgggaggcggtggaaagccaagcacccatgcacgcttgcggaatacgagcaggctgcagtc

SEQ ID NO: 30944 - DNA, 461 bp, Chlorella protothecoides
tgacaccctggtatacattgcacatttgtgcatcgcacaactagtgtgcattcagcgtggatgaattacggtgtaagtaatggcaacaagtatagttcattatgatgagtccatcactcgtttggctcaactgcatttcagacacggtactgggatctctatggtgtcgattactcgacggctgcataatattgggtgccttacaggacaaaggtatctctgctgcaccattaagcaagcatgatttcaaagggagatgagtatcagacaccgcatccataaattcgacataagcaagctcacttggaacgtcgaggcttaagcgaacagcaatgagtgtactagtgtgtagcagccgccttagagatccctgaccatcccaagcctgaattcctttccaatttgggcaatcacatgttttgcttggtgtttcctcctagctggtgcttttatggactcat

SEQ ID NO: 30945 - DNA, 73 bp, Chlorella protothecoides
gtggcatgtggtgccggtccttgggggccaaagatcctctcgtacccgcctcctgcacccctgtttgaaagaa

SEQ ID NO: 30946 - DNA, 72 bp, Chlorella protothecoides
tgacattctgctgctctgaaggtcgcgctcaccttctgccccatctccacaggccggcgaccagctcatgat

SEQ ID NO: 30947 - DNA, 77 bp, Chlorella protothecoides
gctctcgtcacccatgcccggggtgccatatgtagcttagactgtcgtggaaggaaaggaagcggtgagcacgcaag

SEQ ID NO: 30948 - DNA, 79 bp, Chlorella protothecoides
acctgggcttgctgggactgccattatctacccccccctgactgggagcccagcacatccaattcagccttgctacgca

SEQ ID NO: 30949 - DNA, 87 bp, Chlorella protothecoides
tccagccatcgacccactaaagtcccacttgtcgcaatcaagatccaaatcaacgttgcgccccaacctgcagccattccaaagact

SEQ ID NO: 30950 - DNA, 96 bp, Chlorella protothecoides
tcatctgggcatagagggaaagggggggggcggatggattattggctcggttgggaggggtgtttcgcaagtattgcttgtgttgactgctgctgt

SEQ ID NO: 30951 - DNA, 79 bp, Chlorella protothecoides
gtttcctgccgcgaggggagaggaccaactggataaaagcccacaacatgcgcggcggcctctctccaccacagcccga

SEQ ID NO: 30952 - DNA, 70 bp, Chlorella protothecoides
ctacgtgtggtagggggaccctctcaggagccttccacccattccacctgcatccctctacgccgcctgg

SEQ ID NO: 30953 - DNA, 73 bp, Chlorella protothecoides
cagtgtggggccctgtttgatgtgttgaatctggcggggggtgccaggacgagaggcatgtagctgcaatcca

SEQ ID NO: 30954 - DNA, 61 bp, Chlorella protothecoides
cgccgtggatgacgcgctggcctccctgctggaccacccggaccccgtgctccaggcgagg

SEQ ID NO: 30955 - DNA, 61 bp, Chlorella protothecoides
tgtggtgaggcatggacagagggacaagagcaggtctccctgccggcagccggtacaagct

SEQ ID NO: 30956 - DNA, 235 bp, Chlorella protothecoides
gcgctgaccaagatcgcggccgtaagaatcctggacaacattgtcaaggagctgaaagggtgagagttagcgtgcatggattcaacagtgggtggagaggggctggctggctggctgccggccgtggggagtgctggtacggcccttgaatctgcagtttcaaccacccccttgcaactcctgggcaatgcaacacctcgcatgactgcggccaggcctcatcccaagctctcgc

SEQ ID NO: 30957 - DNA, 77 bp, Chlorella protothecoides
cgtcaagcggtggcatgttcgaggcccccagtgccccattaccaaccccctcatgcccaccctgccctctgaccacc

SEQ ID NO: 30958 - DNA, 61 bp, Chlorella protothecoides
caccccctgcccgcccaggtcctccccgtcaccctccgtctcccactccatcgagctgctg

SEQ ID NO: 30959 - DNA, 75 bp, Chlorella protothecoides
agagggcgcccgcaaagccctcatcttgcacccactccagcgtcaccctcccaactcccaggcactcaccctgca

SEQ ID NO: 30960 - DNA, 1879 bp, Chlorella protothecoides
  modified_base (119)..(128): a, c, t, g, unknown or other
  modified_base (904)..(913): a, c, t, g, unknown or other
  modified_base (1652)..(1661): a, c, t, g, unknown or other
gacagggggactcattggttggggacagtgcacccccttgcacagaaggtccagccgcattcttggtggctctgagggcgagtttaaggactgtgtctgaagcggagatgcccatcttnnnnnnnnnngctggattacgtcgccatcactaaccagagcgactacctcattgacgtccctgtggagctggtgggcagggtgcccaaaggtgtgtgacagggggactcattggttggggacagtgtgcccccttgcacagaaggtccagcctcgttcttggtggctccgagggcgagtataatgactgtgtctgaagcggagatgcccatcttcacccaactccccctcaactcccctcaacatcccccctcctcccttgttcagactgggagcgggtttccagcgtgaagaagtcggtgcggtaccacccacccggagtcaaggcggcgatcaaggcgctggagctggcgcaggagcacctggcggccgcctgccaggaggcgtggcgcgactggctgcgcgccatcagcgtgaacctgcccctcttccgctccgcagccgacgcgctggcggagctcgactgcctcctgggcctggccacgttggcggggaacagcgggtgagaatgggggttgtgggtgtgaagggagggggggagtgcgatgcgcttggcgtgggactgccagcgcctggggtcggcagacctggctgggggcctccgggatggaagggccgccctgcatgggcgaggcccggagacacaccgccacacccactcctctgccgggccgcacagagcggcgtctcatcagcgtccacgcatcacactccgccaatgagccccccaccccacctcagcaccccctctctgcgactccccccctcgtgccaggtacgtccgccnnnnnnnnnntcccccaccccgcctccgcaccccctctctgcaactccccccctcgtgccaggtacgtccgccccgacatcctgcctgcctcgcccgagggcgggcggttggccatcacggcctgccggcaccccatgctggacgtccagctgggtccggactttgtgcccaacgacgtggcgttgggctccggccccggcggcgagccccgcgcgctggtgctcactggccccaacatgggcgggaagagctgctacatccgctccgcggccctggtggccatcatggcccagctggggtccttcgtccccgcccaggccgccagcctggcgccgtttgacgccgtgttcacgcgcatgggcgcctccgacaacctggccctgggtcggtccaccttcctggaggagctggggtgaggtgcagagagctttcgtttttggcggggaggggaggggggggaaggacaaggaaccggggagcggggtgcgtaatgttcgagtggctggggcagggcgggtgtgcatcggtgtgtggctccaacccccagcctcgtcagcccttcaggcctgcaccggagccttcctctcctcagcctccctccccaatcaatcaccccgcagggaggcgtcggccattctgagccaggccacgccggcctccctggtcatcctcgacgagctggtgtgatcaagggaaagggagtcatgtcgcagggtgcttgcaacacattgaagcgtccccccccccnnnnnnnnnnctcgtcagcccttcaggcccgcaccggagccttcctcacctcagcctccctccccaatcaatcaccccgcagggaggcgtcggccattttgagccaggccacgccggcctccctggtcatccttgacgagctggtgtgatcaagggaaggggagtcgtgttgcagggtgcttgcaacagattgaagcgacccccccacccaccccacccacccccccg

SEQ ID NO: 30961 - DNA, 69 bp, Chlorella protothecoides
agcagatgccgtccgcgacacctgtggggaccattctaaaaacatggtgccatttcagtgacgattgcc

SEQ ID NO: 30962 - DNA, 61 bp, Chlorella protothecoides
ctgacttccctctgagaatggctgctcgccaccctatctcccctggctcctgcactcaatt

SEQ ID NO: 30963 - DNA, 86 bp, Chlorella protothecoides
caaccatcgaattgagaactgattgcgttcccttcacaataatcgctccccttaaacccccccttcaactcatgcagtgggttggc

SEQ ID NO: 30964 - DNA, 65 bp, Chlorella protothecoides
gggtggaaagtgatggcctcagttgcttgccgtaattgacatgccgaacgcctccagccgctgca

SEQ ID NO: 30965 - DNA, 76 bp, Chlorella protothecoides
tggcggcggcggcagtgggccgggcggcgatgtgccatcccttgcaggagcgcttggactgccacgcgttggcgcc

SEQ ID NO: 30966 - DNA, 77 bp, Chlorella protothecoides
acgggtgttcaccgtgcgagccgagccgcctgagggtgggggcgggttgcggcccgtcagcctgaaccacgccgatt

SEQ ID NO: 30967 - DNA, 68 bp, Chlorella protothecoides
gtttcatggtcagcaaggccctgcagagtccacaatcgggtcctctacatgtgcgcacttggtcccga

SEQ ID NO: 30968 - DNA, 61 bp, Chlorella protothecoides
agcaagatgcctttgctccatgagttgttctccttcatcctcctttcctgccagtgtcgtc

SEQ ID NO: 30969 - DNA, 185 bp, Chlorella protothecoides
cccaaggtgtgcctgagtttggtgatggagtggaggaggggggttgtttgaacatgctgctttcatcccttgtctgtagggtgcatgctcgggcgccatgctggccttcccttgcttcccgctcgccctgtggtgcttgcggccctcgtcgcgatgcagcccccaaaccaagtccccccctcccc

SEQ ID NO: 30970 - DNA, 74 bp, Chlorella protothecoides
gctactggcgcagagtgggcctgactttgcgggccgacgggagcgcgggatgcagtgcatcctgcgtcgaccac

SEQ ID NO: 30971 - DNA, 80 bp, Chlorella protothecoides
ctttgtgcaagcatcatctgtgtaagtgaactggtggagatggtgcttgcagacaggcggcacagcttcatcgttgtctg

SEQ ID NO: 30972 - DNA, 61 bp, Chlorella protothecoides
ggacgacagcggcgacgaggcggtggcctttaccgaggccgaccttgtggaggacgaggct

SEQ ID NO: 30973 - DNA, 65 bp, Chlorella protothecoides
cgacgaacagttcatcaatttgtcgctggaattgtcggaggagaggcagtctcgcaaggtcttgg

SEQ ID NO: 30974 - DNA, 76 bp, Chlorella protothecoides
ttgctctgcgcatggatgtgcatgcagggtgaacgtgctgagcattgaggaataactctagtcccaatttctcagg

SEQ ID NO: 30975 - DNA, 61 bp, Chlorella protothecoides
cacccccttgtccaaccgtcatgccctcccacctcaccgccagtactgggcccagcggtgg

SEQ ID NO: 30976 - DNA, 69 bp, Chlorella protothecoides
gatgacagggaatgacatgatcaaggggggtggcgtattaggatgaagccaggcgacgccgtgatggcc

SEQ ID NO: 30977 - DNA, 414 bp, Chlorella protothecoides
  modified_base (117)..(334): a, c, t, g, unknown or other
tgagccaccggtgggtttgttgggggacgcgcctatggccagtatgctgtcggcccagtttcagggtgtcaggcgccagcaaagccgggctgggcccgtgttcttcggtgccctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggatcttgtctcagattttttgcggatgtttatgaggcagaggacgcttttactcccccacgtctctaactcatgcct

SEQ ID NO: 30978 - DNA, 72 bp, Chlorella protothecoides
tccaaaacacaccaatccacctcccaggaaaattttgccccttccccaaaggaaattctcgccgccacctcc

SEQ ID NO: 30979 - DNA, 111 bp, Chlorella protothecoides
cacggtggaagcttgcacagttcagatccctagtccaggcatactctcacctccccgttccgactgcttgccgtcgcggcgctcttcatggcttggttggccttggcgatg

SEQ ID NO: 30980 - DNA, 80 bp, Chlorella protothecoides
ccgccgcacgagggcagcatccggcacgtaattcaagatgatgagtgaattttcatgcactgtctaaaacatgtcagctg

SEQ ID NO: 30981 - DNA, 77 bp, Chlorella protothecoides
agtcctgcatagcggataatcacgcccgcacgacacaccgcccaccccccttggccagaatcacaccacggaccacc

SEQ ID NO: 30982 - DNA, 61 bp, Chlorella protothecoides
ttgtatctgcacgcgctcgtgtctgagtgaccagtgcatggaaagtccacttccgtaattg

SEQ ID NO: 30983 - DNA, 73 bp, Chlorella protothecoides
cctgcccccacccacctaccaggcgctgggtccggtgtacctgctgcgctggaaccagagcgcaggccacagc

SEQ ID NO: 30984 - DNA, 61 bp, Chlorella protothecoides
gctggcataccgggagaagcggcctgcgagaataggggggtggaggtgaggggggtggagg

SEQ ID NO: 30985 - DNA, 98 bp, Chlorella protothecoides
acgctgctcagcagctgtggggtgtgtggtggggaagggaggttgattcaggctgatgtcacatccaaaagtcgaaaggcctgcaaggccagggcagg

SEQ ID NO: 30986 - DNA, 137 bp, Chlorella protothecoides
gtgctttgagatgattgggattcatcggcgattctgcacagcggtgacttgcagattcatgtggcaggcggcttggggagcgggaggattagaccaatccccacaacaacaccctgtgctacctaatcaaccccgca

SEQ ID NO: 30987 - DNA, 141 bp, Chlorella protothecoides
cccctcaccccaaaccgcctcgctgcccaggcgctggccgcgtggtaccaggacgagaccgggggaggtgtgctgggtaacatggactgcgaggcgcctgcgccggccgccgctccgcgtgccgccaggtccagtcagcgt

SEQ ID NO: 30988 - DNA, 162 bp, Chlorella protothecoides
tcgtctggactgagaagagacaacacgaaacattggcacagtgttagcaggagggagcgctgcctttatgctgggaggaagagacaacggtttgtcagaaccaagtctggggagggagctcagatttcttcgcactgggatggtggagacagactccagggg

SEQ ID NO: 30989 - DNA, 78 bp, Chlorella protothecoides
ctgctttaccgaccccggcgacacacgatataaactcaatcccctggaattgcgacggccttgtgagtcacagtggat

SEQ ID NO: 30990 - DNA, 66 bp, Chlorella protothecoides
ccctccccggcccctccccctcgctcagggcatcatctcgcacgtgaagcgggtgctggcgcggta

SEQ ID NO: 30991 - DNA, 80 bp, Chlorella protothecoides
accagaggaggagaggaaggaggaggaggggaaggggggaagggggggggcatgaagtatggagttgcaagcaagcccgg

SEQ ID NO: 30992 - DNA, 157 bp, Chlorella protothecoides
tgtcgggctggtctcttcatccggaaaatcctccgcctctgaggagctcaggctcatcgccggggatcgaggagcatgggggatcacttccacaggggtgtcgggagtgcgtcagccagtcgcgccggatcgcactcttccaccaaaaggtttgtaa

SEQ ID NO: 30993 - DNA, 61 bp, Chlorella protothecoides
gagtaatcgacaaacgaacgcagtagcccttcactatgactgagatgtagcccaggcagtc

SEQ ID NO: 30994 - DNA, 1735 bp, Chlorella protothecoides
  modified_base (672)..(681): a, c, t, g, unknown or other
  modified_base (974)..(1021): a, c, t, g, unknown or other
  modified_base (1111)..(1120): a, c, t, g, unknown or other
cggcgcgcaggagcgcgtgcgcgtgcgcacgcgcgccgccctcctgtgcgagtcgggggcgcaagcgcgcggcgcgccggcccagcgtccacagcgcacccagcaggtacagcgcgtgggcgaggtcgtagcgcgacacgcccacgcagaactgcgcggcgcccacggcgccgaagccgaggtaccaggccccggccagcgcggcggcgcgggtggcgcgccagggggcgctcgcgcgcacgcgcacgggggagacggctgggggtggtgcaggcgcaggtgcagaggcgccttcggtcggcgcatgcgtcgccagcagcggcgcgctagcatcgtccccgcctgcccccgagcgatcgtatctctgcagcgcggcgcgccccgcgaccgcagccgcgccggcggccaggcagagcgtggcggccaggaccccggcagcgtgcccctccggggtcaaggggatcacgcccagcaggcgcaggatgcgacccacgtccaggagcgggaggagggaggtggcgacgtggcagatcgccgcccaggcctgcaggcccagcgcaagcgctgccagtggcccggggctggcctgtggcgcgtctgcaatcagtccgggcaggctgaccagcaggaaggctgtggatgggatttgtacatgagagaaggggcatcttnnnnnnnnnnccgccgcccaggcctgcaggcccagcgccagcgctgccagtggcccggggctggcgtgtggcgcgtctgcgatcagtccgggcaggctggccagcaggaaggctgtggatggggatttgtacatgagagaaggggcatcttgatggcataacgtacgatctcagggttggcgcgggtgaaggcacggaccacagtgatctgctcgattgcgatcaaaccaggcacacgtgcagactcatagggaggaatagcaacggccttccaaccccaaacgatgccacccatcgatcctnnnnnnnnnnnnnnnnnnnnnnnnnnnnnnnnnnnnnnnnnnnnnnnngcgagcgccgaggaaaggaccgcggggcgggtcacgagccccacaagtaggtgcgccagggcgacggaggtggtgggcaggacccggccnnnnnnnnnnacgagcgccgaggaaaggaccgcggggcgggccacgagccccacaagcaggtgcgccacggcgacggaggtggtgggcaggacccggcccagcgcgcgcagcacggtactgccccggcgctggcccccgtcgccgccatttccagacccacgctgcagcgccacggcacccgccgccgcaaagagcgcgagcagcgccaggcagcgcaggcgcgtcgcggcgcccagctccccccaggcgccgacgtcgacgacgcccaagagctgggccatgcttcccagggcggcgatgcggtgcaggcccagctgccaggcgtagtggagcaggaggatggcgccggcgtagagctgcagggccagggtcggggcgggggcgccgccgcccatgccgctgccccgccagctcagccaggccaggcccaggaggagaggcagggtgaggaggcagggggcggccgcggccgcggcggccaggcacagcaggcacagcgtgtcgctggtggtcaggctggtgcccggcgcccgctggcccgtccagagaccggcctgggtcagcgacagcagctcaaatccctcagacgactggcgggcctaggaagggggggagacggggggg

SEQ ID NO: 30995 - DNA, 97 bp, Chlorella protothecoides
aggtcctcgaatatgggatgcatggtggatggatagacctgcgatgacaataagtagtcgttgaggcgtggtacacggcattcctgcatccgtttgc

SEQ ID NO: 30996 - DNA, 129 bp, Chlorella protothecoides
atccatggcaacagccatgtcctcgtggacttcgcaccctggcctcaaagcttggttgagatgccgctgcgctcaatgtgtcagtccccacgtcgtggcgcctgtgcctcgtactccactcgatccctc

SEQ ID NO: 30997 - DNA, 157 bp, Chlorella protothecoides
agggtcttttgggagagtgacacaggctcgaggacattgcagctcatgtgaggagcggctaatcacgaaagatccggcccaccaacacagcttggatattgaactgccgtccgaaaagctgcagcatgccaggcacaccctcattcccctatcgaaa

SEQ ID NO: 30998 - DNA, 68 bp, Chlorella protothecoides
cgcggcgacggcagcaagccagtgggttggtaaatggctttaatggttggggagggctcgagacgtgg

SEQ ID NO: 30999 - DNA, 112 bp, Chlorella protothecoides
caatgtggtctatggcttcgtgagtccacgaatagacaactggtgggtctggatgggttgaagcattgctggttgggatattgggcgagggttgtagggagatcattcggca

SEQ ID NO: 31000 - DNA, 98 bp, Chlorella protothecoides
gccctggccctgcccaaccaccgagatgcactgcagagtgctgcttggggcaaagcctgaggaagcagcgagaagtagcaagaagaagagccaggggc

SEQ ID NO: 31001 - DNA, 61 bp, Chlorella protothecoides
catacgtgacaaggcatatgacgccgtggccgggagccggtatgccctgtttggacagcca

SEQ ID NO: 31002 - DNA, 582 bp, Chlorella protothecoides
gccctcggccgcgatgccgggcgcgccgccggcgcgcaccatggccgccacctcgtccacggggttgcccggcgcgcgcggcgcggcgctgaccatctccgacagctgctggagctgcaggaactggctgcgcatgatgcgcgcctgcatggcggccgtggactctgcgtcgccgccgcccgcgcccgcctcctcccccggcgcgcggccgggcatggccaggccggggggcagcagccccgccaggcccgggaaggagagcgggggcatggggatggtgagcgcgggcgcggccagagcctcgccgcccagcgcgggggcaggcagacctgggtcgccgccgccggcgccctcctcgccctcctggcccaggaaggggagcagggggggggcgcgtggaggtcgccggggcgccagccgtagacccactcgaaggcgggctggcgcttcttcacgtacacgcgctggatcaggcccacggagcagaggatggaggagatgtcgtacaggcggcgctccaccgtgatctgggtctggctgcgcgccgcgccgccgccgccgccggccgccgggtcgggggcg

SEQ ID NO: 31003 - DNA, 61 bp, Chlorella protothecoides
catgccggcgcagcaagctcagaggcagggggggcaaaggactccacaggaacaccgactg

SEQ ID NO: 31004 - DNA, 102 bp, Chlorella protothecoides
ctcactgttagcaaggcacacacgagcagatttgttcagagtcatggaaagactcccaaagcattccaacaaaatcattgctggtttgctctcgatgaaact

SEQ ID NO: 31005 - DNA, 117 bp, Chlorella protothecoides
tgtagatctcacgacctcgagtatggccggcaccagtacaccgtaccttcgccagttagctgacaaacacaagcattactgtcatgtcggtcgtgatgggctggccgtagatgtcga

SEQ ID NO: 31006 - DNA, 411 bp, Chlorella protothecoides
  modified_base (178)..(328): a, c, t, g, unknown or other
ccccccctgtacaggacccgcgaaacggccagaaccatccgctcagccccctctagcgtgtagatagtgctgaggaggtttctgtcacccatagaactcccgtggactccgtcttgtcgagtgagaagtcgcagcaggtgcccacttctcacaaccacatggcatttgcgtcgagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatgaagtataatataaccgtcgcaaaccggctcgagaggccctcccccccgcctccactcaccgcaggtccatggctctg

SEQ ID NO: 31007 - DNA, 61 bp, Chlorella protothecoides
ctgcgtctgaatcttctcgctcgtcaggggccccgcaaaaccggtctggtcgtccgggttt

SEQ ID NO: 31008 - DNA, 61 bp, Chlorella protothecoides
ggggcctcacagtgcacttgggatgggtgtgctgccaccaacaactcgattttgagagggt

SEQ ID NO: 31009 - DNA, 78 bp, Chlorella protothecoides
cccgttctctgcccaagccccccccccaaagaaaacaaaatctttgagaacaagatcgtgacgtacccaggggcgagc

SEQ ID NO: 31010 - DNA, 79 bp, Chlorella protothecoides
cccccagccacaccttgtgagcatgcgctggctgtgtgtggccgcttgctcatgtggtgctcgaggatctcaaaggggg

SEQ ID NO: 31011 - DNA, 167 bp, Chlorella protothecoides
cgaggcctgctggtccatggcgcggatgtgggcctgcaggtcctccacctgcagaggagggtgccgggtggcagcggcagggtgagcgggtgctgggaggctgggtggaggagccgcccatgccgatgctggccactcctggagggcgagcgggattgcaccaagca

SEQ ID NO: 31012 - DNA, 62 bp, Chlorella protothecoides
tgtcggcggcgctttaccatccttggtgccgtcctttccatcattgtcaccgtcgctggctg

SEQ ID NO: 31013 - DNA, 71 bp, Chlorella protothecoides
ggcttgggtttcaagcactgtgccaggcgttgtagagacgtcgcagggcccggatgcaggtggaaaggggg

SEQ ID NO: 31014 - DNA, 73 bp, Chlorella protothecoides
agcgctcgatgggcttggggctggactcggcgggggtgtgctcggtggagaaagggttggactcggtggagga

SEQ ID NO: 31015 - DNA, 111 bp, Chlorella protothecoides
ggctatgccctgcatgcatggcatggcccgtgctcgctccagacgctccattcctcctcacacaggccggcccccgtggtggaggaggccgggccccggccggatgctccc

SEQ ID NO: 31016 - DNA, 103 bp, Chlorella protothecoides
tgctttgcaacaccaccccatgcaataaaacttaccccgtcctatgctcaccgccccgcaggttggtctagatcatgttgggaaacttgaggatgtgcagagg

SEQ ID NO: 31017 - DNA, 61 bp, Chlorella protothecoides
ggagccggtgtgcctggacctgacggcgggtggggccggcagggccttgaccccggtcaag

SEQ ID NO: 31018 - DNA, 76 bp, Chlorella protothecoides
gcgcagcagctcgctatcactgactgtgaaaggaggaacgagccaagacctgcacggagagaggaccagcggcatg

SEQ ID NO: 31019 - DNA, 63 bp, Chlorella protothecoides
gggacaagggccgttgtggggtgtcttcatgcttttgttctgatcagggcagtgcacccttat

SEQ ID NO: 31020 - DNA, 133 bp, Chlorella protothecoides
tgaagagagaggcagcatcttatggcataggcttaagtgactgcgtctctatccgttcccatgaacatttgccactcacagcttccccaaccacacactttgtcctctgacatccctgtagaactgccctacg

SEQ ID NO: 31021 - DNA, 789 bp, Chlorella protothecoides
  modified_base (436)..(445): a, c, t, g, unknown or other
gcgcgcgcgcaggtccagcagcgaggacagcgcggcgacgtagcgctcgctcagccgcagctcggccgccgcggccagcaccgcgcgcgcgccgggcgacggtgacgctgccgtgccggggcgctccagcgtctggcgcagctccgccacgctcgccaggccctgctcgaggacgggggtcaggcgagcagccaccgacaccgcatttgccgcgccggactgtcggtgtgttgaggaggaaagggtgaggcgggagagaggggagagggtggaaaaactggcatgacgcaggatcgggccacgcatggcggactcgcgaaagatcatgcacgtcatggctaacccacagactctcaaacccaatttaatccccccatctctccaaagagagaaacacatccccacccccccacacacaccttgatcaggtccacgnnnnnnnnnngagagggtgggaaaccttgcatgacgcaggatcggggcacgcatggcggactcgcggaagatcatgcacgtcatgactaacccacggactctcaaacccaattcaatccctcaacctctccaaagagaaaaacacatcttaaccccccacacacaccttgatcaggtccacggtgcgggcgtgctgctggttgcccagcgcgcgccgtgacgccaggtcccgtgcctcgcgccgcgcctcggccagctcggcctccagccgcgcgacgcgcgcccccagcgcgccctcctcccgcgccagctccgcgtcgcgcgcggcctgcttggcgcaggcggccgccagct

SEQ ID NO: 31022 - DNA, 61 bp, Chlorella protothecoides
actgcacgtgccacacctgccgatgccgccgccgcctccgcgcgtgcgcccagcccgcccg

SEQ ID NO: 31023 - DNA, 148 bp, Chlorella protothecoides
cggattgcccagcgcctgcagacgggcatgtgacagaccagggagtcgatcaggaagcgacgtgagccaggcatccggcggagggcagacgctgcgatgcgcacgaccctgctcgtctccccccgccgcacccctcagagcccctgcc

SEQ ID NO: 31024 - DNA, 157 bp, Chlorella protothecoides
gctttgcgtgggcgcggctggccagccagccccgcctgggcctgcgcccccaccacccccaccgcacacgcccacacccacccactccccaggtggactggcgtgaccgcgccaactggaactgcaacaacaacgtgcaccccagccggcacggcac

SEQ ID NO: 31025 - DNA, 127 bp, Chlorella protothecoides
ctggacgatcagggagggcatgaccgcgcctcaggtgcgtttgcggtgtgcactggcgtcgtagggggtgccggtgggggtgctgttgttggggaaggggccgctggtgcacatgttcatgttcatg

SEQ ID NO: 31026 - DNA, 85 bp, Chlorella protothecoides
ttgagtgtgtttgggggggggagaggggggtggggggcctgatgggcattcaaaacatcaatgcatggggtcatggggctggctg

SEQ ID NO: 31027 - DNA, 104 bp, Chlorella protothecoides
atggtgaggcatgggagggcagaggtcagcgagccagttttggctgtgcagggacgggcatgccccatgcatgtaccatcctggctgacctccttccggacccc

SEQ ID NO: 31028 - DNA, 166 bp, Chlorella protothecoides
gaggatggggcagtagtacaaacgggtgtcaaggacaggcggcacacagcagacctagtgctgctagcaaattcccttccactccagccccctcattcggcttcagccaccaaaccctttgccttcctacccagtttcacctgcggcggcaaaggcggccgtggtc

SEQ ID NO: 31029 - DNA, 85 bp, Chlorella protothecoides
gtacctgtatagtatgtgcagtgactcatgctgactcatttgtgtgtggcgatgcgatcgggttgaagggggaaatgagcccagc

SEQ ID NO: 31030 - DNA, 92 bp, Chlorella protothecoides
accagggagctggccaggacctgtttggttgggggaggggagggagtcaggcagagcacagtgtggcatgccgtcagaaggcatagagtgcc

SEQ ID NO: 31031 - DNA, 132 bp, Chlorella protothecoides
ctggcatagcggtccctgctccggctgcgcggccgcgactcgcgccgcgcttcacggctccgactgcggtggcggcgcttccgcgcgggggagtcgtcatttcggctgcggctgcggtggcggcgcttcctc

SEQ ID NO: 31032 - DNA, 61 bp, Chlorella protothecoides
tcgacagcatcacgcttgtgcaccggcaggtaccagctcgcatccagcaccttgacatccg

SEQ ID NO: 31033 - DNA, 3030 bp, Chlorella protothecoides
  modified_base (90)..(99): a, c, t, g, unknown or other
  modified_base (1275)..(1284): a, c, t, g, unknown or other
  modified_base (1618)..(1627): a, c, t, g, unknown or other
ctccgccgccgcacgctcctccgccgccgccccgccccctgctgccaccccgtcctcaacccaccccgccccgggcactggggcgcacannnnnnnnnnccgcgcgccgcgcgttcttgcgcgccgcgcgggtcagcaccggcgcctgcgccgcacgctcctccgccgacgcacgatcctccgccgacgccccgccccctgctgccaccccgtcctccgcccaccccgccccgggcactggggcgcacagcggggagggggagcggctggggtcgtccagggagcaagggccgtcggcctcctcctcgtccggcctcagctcctcccactccccaggctgctcggcctccggtacttgccgggcatgggcggggaggggctcggccgccaggaccgcggccgggcgccgggcccagacgcccaacggcgcctcgactggtgccggcgtcgcgtcgggcccctgttgccgccttggctgcgccggggttgcgccatcccctgcgctgccgatgctggggaactcggcggagagcgggtgggcgcccgcgtcgtcgctgtccacccctgtgcagcgggcggcccccgcctcggacgggccctcgccgccgttcagccccaggccggcaagcggcaggctgcccgcgcgcgccgcccaggcgtttggcatgggcggggcgggggaggcggcgcgggtggaaccggccgcggcgccggcggcctggccgccgggcttcagcaccaggaactcctccagcaggaccatgctgcgcttacgctgcagaggcaccggggcgggggacgcggcgcgcacaggcggtgcgacgggcgccccggcacctgccccggctccccgctctaggtttagtttccggcgcagctccgccagggcctcggcctcggacaggatcgagggttttgcagcagcaggagccttcttctgcgcaactgccaccggtctgcatgccgagtgtggaaggggtggtggtgaggatgccgagcggagggacatgaaatgggcaacagcgaaggtgtgctcacgccaagcctaaggggtagggaacctagtgagcagacagccacggtgaccctgaaaaggcatgaccatgtgcttccggtgcgcactggccatctaatgcaacagccaccagtcactcccaatagcaatggaaaaccatcgagatttccagtaaaactggcatgtcatgaagccctgtgacaagcccacgcactcttgaggcttggggggtggcctaggcttggctttagtggcttcannnnnnnnnngtcccgatagcaatggaaaaccatcaagatttccagtacaactggcatgtcatgaagccctgtgacaggcccacgcactcttgaggcttgggtggtggcctaggcttggctttagtggcttcagcttctcgtctagcacccttgtccgcctcctgctgctgctttaataattggtcctgttgctcctgtaggacccagcagaggtggttgccttttgttggaatcgggcaagctccaagcatgccttgcaaggcacactgggttgcatgtcaactggccggccgcacgaccaggcgatcctcatgatcaggttgttacctccacgacaaacgcnnnnnnnnnnatgcaaggcacactggggtgcatgtcaaatggccggccgcacgaccaggcgagcctcctgatcaggttgttacctccacgacaaacgctcacctgtctccgttttttatttgcctcgccccgtatacacactgggtgggacttgaggatctgtgtgggaacggcaagaggtgaggaggggccaggagtggtgggggggcaccagaacacatgacgccagcaatgcctcgcgaagacgggaacagccaacatgcaggcgcgtgagcgggcctaccttgccgcgacacggttctgaatgtaccgtggcctttccatgccctcgcggacagggaaatccgatcttgcgattcctgcctcgcgggtgtgatggggctggaggtgggctacacttgcactctctgcggactcccggcaatgggatcacatcatgcaggactcaccgttcgcatttctgcgctttgaggaatttctccaggcacgcctgatggtatatggcggacatggcatcgcaattttggtacgagcagtccagcgcggtgacctcggacacctcgctgtcggccactttgccacaaaggtcgcaaacacagccggagacttcatggagtgttttgttgcccaccagcccgctggctcgaagggccatgtaggacggagggcagcagggcgcgaggacgccgggatgggaactactttacaggtgaaaaggtacaaaggctgggaagtcccttcgctttcatgactccccaggttcaggttgccgaggtgttaccaccgtggggcaggcaagagaggaagggcgctacatttcgtttcacgagcaaggcattcccgcgcggcgaggttcaaacacctgctctcgccaaatcctgggcgtcgtgcatgttcatcttggggagatatcccaacctcgaaagcactttgagtagtcgttgcgaggttgccaatggattacttgaacgttcatacccacgacggctaacaacgatgggagctacccctcgagggacacaccgcggcaatctataccggattccaccattctatccttgctctggatgtagggggacgaatccgataatttagcaggagaagagcttgtcggaaaatggatggagtgcaatcacagctcgcagggcagattgcaatcccatgctgccaactttgttccccgacatcacgccacgcgtggggcaagtgcctggagaagccggcgctcatgtgcgtgtagactgctgctgagccacgcaacctcctggcgcttggctgcgctccactcttggactggccagcgcccccgtttgctggaatccagcagggctgaggtcatgtgcgcatggggcgatgccgcttgtgttccggcactctgtccaacctgcaccgagcatgggcgggggggggcgg

SEQ ID NO: 31034 - DNA, 61 bp, Chlorella protothecoides
gacgatccctcggatcagtcactctcccggtaaaggtccctgttcgaggcgatgggcaccg

SEQ ID NO: 31035 - DNA, 187 bp, Chlorella protothecoides
gcttgggaggcggccccttgcttgcttccgtgggcgcggggactgcgtggggaagggagggtctgggcgtcagaaaaggaaaggactgcttgccagcattgtgggtgcccgtgagacctcctctatggcgactgcattctcccaattccgaactccacacccccacctgcggccctgtccagggttt

SEQ ID NO: 31036 - DNA, 61 bp, Chlorella protothecoides
accgccacgctcttcatcgtggtcgtgtccaccctggtcatggggtctgccacaggtagga

SEQ ID NO: 31037 - DNA, 104 bp, Chlorella protothecoides
ggctgccacgcgctccagtggggtctgactgcagcgcctcctcgaaacagaatgcactgggtggctaaccctgtcacagccagcagccaaggccatgcctcccc

SEQ ID NO: 31038 - DNA, 79 bp, Chlorella protothecoides
ggagcgcccatgggtgacacgctgcagggaagggggcaaggagggaattgaagcgtgtgggaagggacggcaggtcgca

SEQ ID NO: 31039 - DNA, 68 bp, Chlorella protothecoides
gcagcgcgacccgcaggaggtgggcgggcgtggggttggaatggtgatgacgagagctgctgaaggaa

SEQ ID NO: 31040 - DNA, 61 bp, Chlorella protothecoides
ggcggctgggaaaggccccgggaagaagagaccgaggcagccattgcgagtaacaccttca

SEQ ID NO: 31041 - DNA, 61 bp, Chlorella protothecoides
cggccgccgctcccccgcacaggggtgcgatgacggggatccagccgtaggtcaggaactc

SEQ ID NO: 31042 - DNA, 61 bp, Chlorella protothecoides
ttgccctgcagctgtcaccagtggcccacctgcagatatgcatcgcatgcatcgcgtccat

SEQ ID NO: 31043 - DNA, 179 bp, Chlorella protothecoides
gaccctccaggtctgcatgcgggcgcacgatggtccgtccacgggggacgagccgtgtgatgttcccctcccccatcagtaccaggctgaggtggcggtagcgatacaggcaccccaggttgctcaggatgtggtccagccgcccaccgtgcgcgcctggagggagggtggcgtggggg

SEQ ID NO: 31044 - DNA, 109 bp, Chlorella protothecoides
atgcaggccgttcctggatcgcctgtgagcatcgaccccagagccacaggttccccccccccagaaaacgtactccttgatctcctcgccggtctggtggcagacgtag

SEQ ID NO: 31045 - DNA, 105 bp, Chlorella protothecoides
ttgagaagattggtctgttaaagtagctcaaacatcccacgggtcaccgctcacaggtgcacttttacgctgactgtgcccatgtcaactattggaaacctgctg

SEQ ID NO: 31046 - DNA, 61 bp, Chlorella protothecoides
tggcgaattgaatgggaccagaacggctggtcaatgatgacgactcaagccagtccaaggg

SEQ ID NO: 31047 - DNA, 61 bp, Chlorella protothecoides
ccttgaaaacaatgcattctgcctaaagatacccgtagctgatgcaaacgttagcgaggag

SEQ ID NO: 31048 - DNA, 76 bp, Chlorella protothecoides
ggtccctgcagcatgcatgctctgctctggaggggtttcagcccacacatgcacaagcactgcctccgagggtccc

SEQ ID NO: 31049 - DNA, 743 bp, Chlorella protothecoides
  modified_base (276)..(389): a, c, t, g, unknown or other
agcagcccaccccactcacggatgagggccagcccaccacctgcactgcacaccccctgatgatgctcgcgagcctgcacgggcccgcccaggcacagggtcctggcgcctcggagtccagccgcccccgtgctccgccggtcctcgccagcaattccgtcctcgccggtcctgcatcccccgcaggctcccagacgcaccacaagacgaccgagaacgactggaagggggtgcacgggcggcccgggaacctctggcaggactgcttctccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcgatgaccaggtgggtttgtgtgggattgggtgtcgggtgtgtggaggttgccgtggcgcagcgggcgtgtgcaggtccagccctggctgcatccgagggctcgctgcgatctggcctggggcccccttgcacggcgcgcacagtggccgtgaggttcccggtgcagacctcagcggagtgccatccctggcatgcccggcggggaaacgggcctgtcacaagaacgcccggcagcagcactgcacacagacagctcccaccctgcttcatcgcaccgcctgccctgtacggcgggaaactccgagcggtctccctcccgagtgcgcgcaggtggtgtttgaggtcaacgc

SEQ ID NO: 31050 - DNA, 146 bp, Chlorella protothecoides
cgcgtgaggggggagggggatgcatgctgttggtgggtggcagtggctgcggagagatcaggcaagctcatcgatgcaaaccagaccttggctggtgcatgtgggctgagagaacacgcattcctgtgtcactacgcatccaagct

SEQ ID NO: 31051 - DNA, 61 bp, Chlorella protothecoides
atcctggggtgagggaagctcacatgcatgacttggccgcctgtgaaagtgtgtttggtgt

SEQ ID NO: 31052 - DNA, 9620 bp, Chlorella protothecoides
  modified_base (1559)..(1568): a, c, t, g, unknown or other
  modified_base (6213)..(6244): a, c, t, g, unknown or other
  modified_base (6302)..(6311): a, c, t, g, unknown or other
  modified_base (6765)..(6774): a, c, t, g, unknown or other
  modified_base (7579)..(7588): a, c, t, g, unknown or other
  modified_base (7926)..(7935): a, c, t, g, unknown or other
  modified_base (8390)..(8399): a, c, t, g, unknown or other
  modified_base (9044)..(9053): a, c, t, g, unknown or other
aggcgcggcgcgtgcaggagggtgggtggggccagggggtcgccgaggtctggggcgggcgcggcgcgcagggggcggggggcaccctggcgcaggatgcactgcgtgcgcagcacgccgtccgcgccgtgcatgaagagccaagggccgttcacctcgtgccgccgggtggggcaggcgggcccagggacgacggtgtcctgtggtggagggggggcgcatgggagggaggaggtgtccagagcagcggtggcgccgaggagcgcggggccaggctcccggcgcatggagaatgtcactgagcggggcaaggctttgcggtcgcacaccaggcagtagcattgaaaagcaggggtgaaagtcatgacagtgctccggcgatcccacgcatatgctgcagcggccggcctggcatcgagtaccgcaccattaccccgcgccccgcccctccctgccccacccacatgcatcgatgagccgtcgaccagggccagcagggtcagccgctgcgtcccgcccgccgggctcggcctgatgcacagcaccgcatcctccgaggcgaagacggcatccaccactccggcactggcaaacccgaagatcacgctgcgagaccccacgtcccagacgctatactgcctgcatgcaccggggtggggtgacggagtcttgccgcccggagaggtggatgagtggacgcttcctctggcctcctgatcgatgcagaggtaagcccccccctcgccagcgcaccccttggctgggtcaaagacaagggcgtgcacacccccatcagacagctcgatgaagccagggttgtgcaggggctcgttggtccacagcggcatccagtcgtgcggcgtccccctcgagacccctgccaggctgacgacacggcatctggtgagcacagggcgaggggggagggggaagcaggggatcagaagtcatcgctcagtacgcagagacactggctgccaggctccaggttggtatgcctgtgcactggaagactctcttaagatgtacatcgcgcaatcctcctcatgccatcacctcagcaaggcaggcaactaacctgagggactggcctccgtcactgaggaaagagctgatgacagtgatgctgggcctcccggagacggcagagatgccatgaatgtgctcatcggccgccagattcagcacgcagccctctttgctgcctggaaacggtgacggggttgcagtgcggaaaggaatggcaaacgtgagaccagtctcgggagtgcccgcctacatcagaccatgttctggctcagccttcccacacccaccctcagaaaatgccacagccactccattttggctggtggcgatcgtgaggctgcctgccaggaccacctcggctatcgcggctcgacggcggaggtggagagggggccactccgtatgggcagcatgcacatcccaggcatcctggacaggcgatggacaaagtgtggcttgacagctcatggctccgcattgtgctgccccaccccttcaatttcatgcacactcggcgtctgcgatacctnnnnnnnnnngtcccaggcatcctggacgggcaatggacaaagtgtggcttgtcagctcatggctccgcattgtgctgctcaaccccttcactttcatgcacactcggcgtctgcgatacctggggtgagagcttggcaatgctgagctcggccagccatcccgaatcgcccagtccaacttccctgccccgcacacattcagggagtggcaggcagcctgatgtcggtagcaggggagcgcatactctccttccacctgagcgcgaggcgagcgatgatgtgtaactcatgtgtgatgttggaggctgaaatgtcacgaaccccccaacttaccacctgattttgccagtctggcttgcactccgaagtgatccagcccacttcacttcaccaaggggtaggggacacagcagcgcaggacattgggaccatcgacagcgcactgtatttttctgccagcggtccagtgccgcaaaaaatccgccaatggtgacgcatgtagacgacgaagtatagctcagtgcctcggctgcagcgcatgctgcgcattaggtgggctcggtcgctatgggagcacgtcctccgcactcctgtcggttcccaaccaagatgtacattcaagtttgacgtgatactcacgcctttgctctacacccggtccggcatcgttgcaggcatctgcacgtgcacaaccccgcatcagtttcttgggggtgaatggaattccttcgcaagctgttccatcgttcggaggtagggtgcctggtgtcggccagccgaggactgtggatgtttggcttgaaattgaagtaccaatcctccatccctgatccccgtccgcaggaccaccagactcagagcgaggcaggacccaggtatcccgacccttctccacccagcgcgacacagaacaccaaccccaagcgggtgaagaggaggccacccaccccacagccccttctcgaagaagccgagcctggggcgcagggagaggtgcaggtgagcgcgccttgggtggcactgtgacccggtggcagggagccaccttggtgccggaaaggcgccgccccgcccaggcgtaccgagggaatctggtgcactgcctagaccaccacaccccatgcagggcctggactggtacaagtcttcgctgcggcgagatgcagagggcgacgtcgcccagcatttcctgggcgagggctctgccgcgggcgggccgccgaccgcgacgcagcgctcgcggcagctggggcgggcggcgggccagtccaggctggttatagagtcaggggacgtgagggtcctgccagcctcggctgggccggcacgatgacgggacgctggtcctgggcgccagcactgtcgctgcgagccggcacccccgatgcgaccacactgctgtcgcgacctgccactccgagaatcccagcatcgccgctgcaaccccccttcttgaggcaagatcttgtgcacctcttctcccggccggtattacctcgggcctttttggtttgccaccctgtctgcacggcctgtgctgactgtacactacatcgagcgtcacgctgtgggaaatctacatattatgccgctgcctggggttggccgccctggcgcagaggaacgtgctctgccggcgggccactccaggcggcctcgattccagggatcgacttccatcgcaagagcctgccgtccaagcgcgccgccctcttctcaaccatcacgcacggcccaatcagcccggtggcctgtcatcccccgccccttccccctcctccgcccctctgagctccagccagcgcaacgcggcggcaccgtagtacatggtggtgcccttgaggtagccgttgagcactacgcgctccgcgacgcacggccggccccccgcggaccgcgcgcactgcgccaggtcagcgttgcgaggcaggaaggccaccacgccccgagcgcccacgacctggaaggccaggtccagcaaccctgtcagggacaggcccagcccgcccatgcgctccacgtcatacacggcctgagcgctgtactcggggccgccccaaggcggggaaaggaagacgaagtccgcctgggggatgggcgacgaggggggaggagggtcgtcgggtggggagggaagggtagacggaccagggaggacatgcaagggaaggttgactcgcgccgtgccttgggaaggggcacggcgcgggcgcacaccgtcctgtgcattggcatgtcgcgagcagtctgggacactttggaccgtgactgtctcctagggcagacaaggagcatcagcaagggccagcccaccgtggtcaaccgcccaggtgccaccccatcccaaccatgaaaaacaatccgtcactcccagcctggggccaccttgagctcctcggcgagctggaagaagtcgccttgcaggcagcgtacccggtcctccaggccatacacagccacgttgtggcgcagcagctccaccctgcccgcgtcgatctccacggcgatcacggcggccgccacctcggccagggcaacaacgttgccgcccacccccgcaaaggggtccaacgcggttgaccccgggggaactacccgcgcctggtgctgggcgaccacctccggcgtcaccgagaaccagccctcctggtccaaacggatgccgtcgtcgaacctgcgtgggtgaagaggggtgcacatggtggttgacggggagcagtattgtgccgggtcgcgacagcagactgaggcaatactagggtcggccaggcctcttcactgagcatccaatgattgcagagctggagaagtctggaccgagacagccgggccaggcagggtcagggtcatcttggtcagtaaacaagcaggagcagaaacgccgggcatgtgcccaacaccaatgactcgagggtcaccaatcaatcacctggagaagaggctgtaccgctggagccagtacttgctggctgccagtgggacgtccttgggcagccaccagggccgctcggtcttgtctcgcccccgccggcggctggcctgccgctgctttgctggcctctttggggccggaggggatgctgcagcgctttccggctccacaggttcaatccctgatgcgcccactgcggcgctgccatcttcggcctcagcatcacatggagagctgtcaataagaggccgcaccatttccagatcctccagctgctgaatgatcggctccagagcccctgagccgccaaggtctggcagccagtggagggcagtcgttgcagcgtcagggtcctgacctgcctgccacaccgcgtctacatcatggcctggcgcatctggcgaagaagcctgcatggcctctgccccagggatggatggagctgttgtctggtcgtcagccgtactggacaaggtcgtgccggcttccaccgatccagatgctgccgcagactccccttgcccttcctgcgccccgcgtgagaaaggcgccccgctcagattcagcatgcagcccgccagcgcagggccagcatcgacagccgcggctccatgcactccgcttgccgaggccgggtccttgaatggccctgaccctgtctcaggtggcctcattgcatcaggaacacgcatgctgttactcaaactttgctgcatcgcttcggcgctgcctggcggcccgtccatggcctctggtgagtcctctgcgcacgcctctgtagcagcccctgcatctgcaggccctgccattttctcctctggggctacctccgtcggccacccatggtaggctttgtactgctgtatctctgccaggtacgagatctgcaccgcagcaggtgcctgtgcgggcgccgtctcctgcgtccatgcgcaggggaggaaaccctctggcggcgcctcccactgaacctcctgcagggtgaggttgggcgaaagggatcaggggcacacatcagtggagtgcaaggcgagctctcgggggccaaccgaccaggcacactccatcgcgatgcatgtgccgggacttgcatcccttccttgcaagatgtaatccaaaaaacaacatacaaacctgagtggcttcgctgtagtagtaaaagtgtccagtgtcaacatcgtatgcctgctgccactcagcacaggggccgccttctgactggacgtctgggtgcggctggagctccatgacaatgccgctctcatcctgtctgccaggtttggagccgaatgcctgcggaagcccggcatgtgccagctcctgggcgacaccttcctcaagaaccagccgtgaagcgtcaagggcgtccagtgggtccagtgggacagcctccttggattgtctggccggccttgtgggagggggcatgtggggcgcagtgaaactgctgccaatgtgctgaagcagatgccttggcatgcagtggctcttgggttttcctcacctcccaagatcacttaccagactaggcctgggccttccaagaatgttgtgtacattctgcagcccccgacttcatgcctcttggggtcggtgacgctcacgtctgcgcccgtgcgtattggtgcccgcgccacatccgatctcgtcatggtatccacctcagatacaatcaaggtggcggtccctgcgattgccgccgcgcatcctccgcacgatgcnnnnnnnnnnnnnnnnnnnnnnnnnnnnnnnnaggagatggcacatacgatgcagtcgcaccgtatgcggaatactgaccggtgcccagnnnnnnnnnnttgggaagatggcactgactccttgcatatttgcaatgaggtttgactatacaaaatatatcgcactgagcaccctgccttgagagatggcatatacgatgcactcgtaccgtatgcggaatactgaccggtgcccagatgtcatcgcgccctcgacacgatccccccccccaagctttttcccaaatttgttctcgtctgaactcagccccgtgtcggccaggctctgggtccataatgtgtctcactcacaatatgcagtactaccatttggcgaatagacgggccataacaagtgcttgcatgctgagattcaaggaagtaaactacacacgcttgaagaaggatgaaatttgagactgctttgtgccgtctgcgagggatggcacggctttgtggagggctgcaaggatctcgtctggagtcgctccttccaccctgactaccttttccnnnnnnnnnnggactgctttgtgccgtctacgagggatggcacggctttgcggagggctgcaaggatctcgtctggggtcgctccttccaccctgactaccttttccctcgacttggagcccaccatgaggctgacctgcgcctttcgcaaacccaggacctctgccatgtaccgggtgatggcggagttggcctcgccatcccgcggagccgcatggatggacacgttcagcttgccatctgcactgctgatggcagagtcctgtgtatggttcagggaggaggacgcttggaagtagacgagagcatgaggcccgaggcctcacttcgaaaccaatcaggctggcaatctattaagcattgttgctgttgcatttgccatcttcatactccatcggagatgctgcccacgcagcatgtcaatcagccacaaaacaagccgcaccttggcgttgggcttgacgtgcagtgccaaggtgcacacgcccggactgacgagtctcagatacggtggtaggtttggagtgtcatgatgtgcctctgtacagccagatttcgctttatgtacggccatggcccgccagtgcggcctgcatacccccgactcaatgccggagggggtcctgatgcatgagagcaggcgatgatgggacgccaaaccgttcagcatgtgcctagaatgtacgcttatcatatagcgatcaaagtggtcctgcagtttgatggcagtgatcgggggccccccagcagctagcgcgcagcacgtggatccaactcccctttacccgtctgagtactcacggaacgcgttttgnnnnnnnnnncgatgggacgtcaaaccgttcagcatgtgcctagaatgtatgcttatcatctagcgatcgaaggggtcctgcagtttgatggcaatgattggggggcccccccgcagctagcgcgcagcacgtggatctaactcccctttaccccgtctgagtactcacggaacgcgttttgcagccgagactctcaaggggcgttgcgcatctgcgtacacttcttatcattgaatataccagatcagggatcaaagtgcagctcagtcacttagtagaaggaggagcaagtaccctcagcgcactcgctgggacccactccgaagcacccaatcaaccctcggggnnnnnnnnnnatgtacacttcttatcactgaatataccagatcagcgattaacgtgcagctcagtcacttagtataaggaggagcaagttccctcggcgcactcgctgggactcactccgaagcacccaatcaaccctcggggcaatgctgaacaagtggctcttcaaccagaacaagctgtgagtgagggatgtgtgagggctgagtaccgagtggatattccctgctgcagctatgtcatggctgttgccctcttgacctctgtgctgaccagcaagctggtgtccctgtccaggaaaacgaactgcaagctgggcatcagcaggatcaagcttctacgtaacaagaaacagattgctgtgcgtttgggagacctggtgggatgctcaggttggcgcttggctctcggacaggcacccggcagcttccctcaaaatcctgatgttgggcttgtcaggctcgannnnnnnnnngcgtaacaagaaacatattgctgtgcgtttgggagacctgttggggtgctcaggttggcgcttggctctcgggcaggcacccggcagcttccctcgaaatcctgatgttgggcttgtcaggctcgacgggatcccctgagcactcaacgcacctcacggctcccccttcccgcagctgaagggcttccgtagggaggtggccgacttgcttcgcgccggaaagcagggcaatgcgcggattcgcgtggagtctgtcatccgggagacactcctgcttcaggcatttgacacgctggaggtctaccttgagctgttggcggtccgcgtggagctactggccaagaccaaggagatgccgccagacatgatggaggtgtgtgggtctgtgtgtggggggagtagtgttctgtcatctattttctttagaaggtgggtgccataaagatgcaggagcgagcccatgctccccagccctgctgggagcaggcagcctgctgctctgaggctttgggtgtgatcatagggggtgtatcctcttgggtacagcctcgccttttccaacctgccccagattacaatcccgcttgtaggccatctgcagcctgatctacgctgcggagcgcatcagcagcgacctgcccgagnnnnnnnnnnatgtgaccataggggtgtattctcttgggtacagcctccccttttacaacctgcccagcttacaaacccgctcgtaggccatctgcagcctgatctacgccgcggagcgcatcagcagcgacctgcccgagatcgcggtcatccgctccatgctggcctccaagtacggcggcctgtacaaggactttgcgcaggccgcggcttccgacgcgcactaccgcgagtggcaggtgaacgagggcttggtgagctgcctgtcggtggaggcgccgggcgcggagcagaagatcgcggtgctggagtccatctgcgaggagcacggcatcccctttgacgcggcagccacgaggcaggagatgggccagggccgactgtaccagccccccatcaggccgtcggggattgagggcggtgtgggaggtgagaagggggggggggtcgggagagggatgattgttgccgtttcggtggggtcacagcatgtgagataggaagctggagtcatcgctcgggcattggccaagcgaccagggtcttgctgtttggtttctcggggtcggcgggggg

SEQ ID NO: 31053 - DNA, 61 bp, Chlorella protothecoides
tgtgcatatcaatggccgtcgaggatgccgtggaagacggtgagggcggcggagagctctg

SEQ ID NO: 31054 - DNA, 87 bp, Chlorella protothecoides
tgggcaaagtgccacgatgcaggttgaagacgagtcgctcctcctgccacaagagaccaccttgtcgaggtacttgtacatggccgc

SEQ ID NO: 31055 - DNA, 79 bp, Chlorella protothecoides
gggtgtgggacatgtggatcgtctgtctgggaaacccagcggtaccattactccctcttactgaggctcccaaagactt

SEQ ID NO: 31056 - DNA, 131 bp, Chlorella protothecoides
gggtggagacgggggcggcgggaaaggcggagggttgggaggagggctggtagacagggtcggtggcgagggttgaggatgtcggggaggcgatgggttacgaggtgggctggacttctgatgaggtgggg

SEQ ID NO: 31057 - DNA, 8938 bp, Chlorella protothecoides
  modified_base (898)..(953): a, c, t, g, unknown or other
  modified_base (1217)..(1226): a, c, t, g, unknown or other
  modified_base (2647)..(2656): a, c, t, g, unknown or other
  modified_base (3451)..(3460): a, c, t, g, unknown or other
  modified_base (4226)..(4235): a, c, t, g, unknown or other
  modified_base (4949)..(4958): a, c, t, g, unknown or other
  modified_base (5601)..(5662): a, c, t, g, unknown or other
  modified_base (5821)..(5830): a, c, t, g, unknown or other
  modified_base (6358)..(6367): a, c, t, g, unknown or other
  modified_base (8072)..(8081): a, c, t, g, unknown or other
  modified_base (8608)..(8617): a, c, t, g, unknown or other
cgccgcggcctcgcgcgcgctgggccgccccgccttcccctcgctgctggtgtcggcacgcggcgtggccgcgcgcggcgcctacgcggaggcccaggccgcctacctggacccggccccggaggcggtccaggctctggccgacgcgctggccgcctcgcgcgtcggcgtggtggctcacttctacatggacccggaggtgcagggcgtgctggcggccgcggcgcgcgcctggccccatgtcgccatctccgactcgctggtcatggccgattgcgcggtggccatggcccgcgccggctgccgggccgtggcggtgctgggcgtcgacttcatggccgagaacgtgcgcgccatgctggacgaggccgggcaccaggatgtgcgcgttctgcgcatggacgccggcgccatcggctgctcgctggcagaggccgcggagggcgccgcctactccgccttcctggcgcgcgccgctgcacacccctcccccgcgctgcacgtggtctacatcaacaccagcctgcgcaccaaggcccgcgcacaggccgccgtgcccacgctcacctgcacctcctccaacgtcgtggcctcggtgctgggcgccttcgccgccgtccccggcgtgcacgtctggtacggccccgacgcctacatgggccgaaacgtgcgcgcgctgctggccgcgctggccgcgggcccggacgaggcggtgcgcgcggtgcatgcgcagcacagcgcgcgcagcgtggccgacgccctgccccgcttccactccttccaggacggcatgtgcgtcgtccaccacatgtttggcgcgggggtgtgccagcgcgtggcagccgactacggcgacgcctacctggccgcgcacttcgaggtgccgggagagatgttnnnnnnnnnnnnnnnnnnnnnnnnnnnnnnnnnnnnnnnnnnnnnnnnnnnnnnnntcctcgacttcatcgttgccaagtaggctggggctgggacctgggggcttcaggggggaggaaggacccgggtcagggcgtggcagctcggacccggcgccggagtgcgcacgccagtgggctgcaccgggcaggaatccggtggcctcgggcgccttccacacgctcaaagctgaggctgccttgcttctttgtggagcctggagccccacccacgagggacccccccctgttctgcatgtacacaaacaaaccttccactcnnnnnnnnnnggtgcgcacgccagtgggctgcaccgggcgggaatcaggtggccctgggcgcctcccacacgctcgaaactgaggctgccttgcttctccgtggagcctggagccccacccacgagggaaccccccatgatctgcatgtacacaaacaaaccttccactcaccctccagtcaaccaccaccttctcactccacagggtgcgcgaagaggcggccgccgccgagccgcgacccaagctccagttcgtgctgggcaccgagacgggcatggtcacggccatcgtgcgcgctgtgcgcgctgagctggagcgcctgcccggcctgggcgagctccaggtggagatcgtgttcccggtctcccctgatgccatcaccacgccggagcaggagcggggcgcggggtcagcgtccctggtaggttgggggaagggtgggcgggtgcgctgggagaggggggagggaggtggggagtgctcgttgcaggctgcgtcggaggtcctggggtcacgcagtgctgagcgaggccatgcccaccgtcccgcacacgagaagctagggatggcatttgctcgcagttcctccacccaaagcgtagattatccagctgggatgcctcgaacctgcacagttctccccccccctcgactaaacaatgcctcgactgctgccgcagacgctgcccgggggcgtgtcgctgatcccgggcccggcgggcggggagggctgctcctcctctggcggctgcgcctcctgcccctacatgaagatgaacacgctgagcgcgctgctggacgtctgctccgcgctgcgcgacccggcgcgtgaggcgcagctggcacgccacgagcccgtgccctacaccgagaaggtggcggggcgcagcgtggcctcgctgggctgcgagaccatcctgcacatgcgcgacttccagaaggaaggcaggctgtcggaccgcctggtcgcagacgtcctggcgcgcaagcgccgcgcctgagggggtccgttggggtgagcctgaagaaggcggcggggcctccgcagggccctttggccacctggcaagctgccgctgaagaatctgcccttcactgtgactgaatgtgtgcaagcgtgtatttgtgtggacctgcttgatgacatgtaaccctgccgtgtcccggtcgtagccgatttaggtaacctacaagactagtcattcccggttccgacgggctccccaccaagtcgggatcttgttggagcgctgtcacccaaacaatgtacgcatgatggatcataagcatggtagttttcatatataggaaatcgatccccgaatcatacatctaaaagaataaaggcttctttgaagtacctcagggcctgccgagaaggagtcctgcacggcagtgtgtcgtggccgcgtagtggagaccctgctgcnnnnnnnnnnatgtcccggtcgtggccgattttggtaacctaaaggactagtcattccgggttccgaccggctccccaccaagtcgggatcttgttggagctctgttacccaaacaatgtacgcatgattgatcataggcatggtagttttcatatatcggaaatcgatcccctgaaccatacatctaaaagattaaaggcttctttgtagtacctcagggcctgccgagaaggaatcctgcacggcagtgcgtcgtggccgcgtagtggagaccctgctgccctaaacttcaaatcatgataacaaacaataagataaggacgcatcgcatatgacggcagatagctcggggaagcctacgcccgctctggcggagctgcaggtggagtctgcgcatgtagcgtcagtgcctgggtttgccttgacagagcactttcaggatgccccagcatgtcactcgggcgtatcgtcgctgcctgaagcatttgtaatgtacccatgatgcaggctgacctgttggccctgcagtccagggtgcctggcttgagattgcagcgtgcagcaagggggaccagcgacgacgcccccttccccatcatcctctctgctgtcgtgactgcgccgccccaggggtcgcagtatgatgtggacagcatcaaggtaatgcatcgaattgggcgaggcttcatggcgatgtttgctgggcatggagcaaggagtatgggttatgaacatcgatgggcactggattctgtgtgctcatcactaccttgaacgctgtgagcggcatgcacagccagtgcnnnnnnnnnntggattgggcaaggcttcatggcgatgtttgctggacatggagcaaggaggatgggttatgaaaatcaatgggcactggattctgtgtgcttatcgataccttaaacgctgtgagcggcatgcacagccagtgcctttgtttacacccagccttcctacccctgtaggtcgtcgtccgactccaggcccccctccctcgacctgctgtcagcatcgaagtgcactcccctatcctgccggagcggctgcgccgggcggtggcggaggacgtgctggcgacataccaagtggaggccgctgcccgtgccggcgacgcgggcggcctccacctcgaccgcatctgggccgacctgcgtcggcgctgggtgaccctcatctccagctgccccgagctgctggaggcatacacgagctcagacgccgacgggcgcacggtccggcgctatgcattcgtggacgaggaagaagttccggctgggcatgggtctgccactggagcacccgacggcacaggcgctgagctgggcgaccgagcgagagaaggtgcctcgctggcggccgcggcggccggcctgactctgggccaaggccagggcgccggcccggcctcgccgccagcagcttccacccagcttcccgcccagttggcggcggacgtgcgctgggccgaggtgcggtaccgcgccgcctgccaggtgttctggcgcccgggtgggaggccgggccccgggcagtgcaggccgcccagcgcggggcagaggagccnnnnnnnnnnggaaggccggggcgccggcccggcctcgctgccagcagcttccacccagcttcccgcccaactggcggcggacgtgcgctgggccgaggtgcggtaccgcgccgcctgccaggtgttctggggcccgggtgggaagccgggctccgggcagcgcaggccgcccagcgcggggcagaggagcctgctgagcatgctgctggacctgaccccggcggacccggactggccggcgggggccatgctgcacctgtccctctctgtcgaggcggcggctggagaggatgggcagccaagtgttcaagtgtcaggcctgacctgctccgggagcacccacctgacaggtctggaaagcacggcgctgcagcgcctggtccaggccctcctgctccaggagggcggcgccaggctgcagtccgcgctgcgcacgctggagaacggcgggggcggcctcctgcggagcgcgcgctgcatcgccgccgaggtggagcggcgccgggctgcggcgggaggcaatgcggacggcggcgctgggaccgctgatcaggctgacaaccccggggtgtccgactccgcagcaggttcggatgactctcccaaggactcgagcagggaagggggcgagggcagcggctccgacgctgagggcgccgaggcgggcggcgggccagggccagggaagccgcgcgacaggagcagcatgcagggcggcaggcnnnnnnnnnntgttgagggcgccgaggcgggtggcgggccagggccagggaagacgggcgacaggagcagcatgcagggcggcaggccggtgctactacgcctgggtgggctgcagctcgcgggctgcgacgcgctggaggccctgaccctgatcatgcaggtgggtggcagaggggcggcagtgaggtccttgggcgctgaggatcctggtggtcctcccgggctcattctgaggccagcgctgggcttccctccccctctgctcccgccaccgccccttgccgctgtcactgaagttccacccaatccgctccggctcgcaaggtggcctgcggccgctgcggcgccacggccacgctggcgctggccctgcagggccgggagggggccgatgcggaagaggcgtgccccggctgccacgcacgcctggccctgcacgcctcgccccgcatcgtgcatgagcacagcaacgtgctgtgccggctggacgcgtcgcggtgcgcgccgcgagacctgtcgctgggcaccacggtgcagggccagtgcgggaactgcaccgcgctatgcgcgctgcgcggggtccaggtgggccagtggaacgcgcgcgcgtgcagggcctgccactgctccgtcggcttcaaggtgcgggggnnnnnnnnnnnnnnnnnnnnnnnnnnnnnnnnnnnnnnnnnnnnnnnnnnnnnnnnnnnnnngtttggagctttgatggcttgtgtggggactggccagcttggcgtgagctggcaggccgcacaccgtgttggtaaggcaactcgtcccagggcacagtatttgcaatgcaacctcgagccggtcagcgttcccccagcctgcatgcccatcattcccannnnnnnnnnatgatggggtaaggcaactcgtcccagggcacagtatctgcaatgcaacctcgagccggtcagccttcccccagcctgcatgcccatcattcccagttcgaccagccggagtttgaggagcaggggccgcctgggcgggatcctggcgcgcggcggagggaggcggtggcggcggggggtgggccgaagcgcagccgggcgcccgaccacatcctgaaggccggccagcccctgcccagcttcggcacctgccgccactactgccactcctacaggttgggagcagagggggggcaaaactggcgattctggcctgtcacaagggttgcagacctcctcttatacctgttttgaaaacccagtggctcgcacctgagcctcatgcatttgacgtacactccctgcccgctgcttggcccgtcatccattgtgcaagcaaagtttgccccccccctctttccccccccccccccccccacaccaccacaaccacaccacacacacctccaggcggcggcggtggcgctnnnnnnnnnnttccaggtggctgcgcttcccctgctgcggcgaacgctacccctgcgacctgtgtcacgaggagggggtggcggacggacaccccgtggcctgggccaagcgcatggtgtgcgggtactgcagtgtggagcagccatgtgccccacgctgcgccaactgcctgaggaagctggctgccaccgggcataacccctcgggaacccacagccgcttctgggagggcgggaagggggagagggaccccaggaggctcgacaggtgtgctggctgggtggggtgggggggtggcaagtggaacagcgcgcaaagaggcggtttactgattggttgccagtgtgcctctctgagcatgtgctgcattgccttgggacaatggcaggccctgcagcccacgatcacgcttcagtcctggacattcagtgaccgaaatcacctatcacatacaggcgggatgctcggaagtatcgcaatagcaaggcgaagactgcatcccgtaaacacatgagaaccggtcaaaaggccggaaccgcgacgtcatgaagttgccgccatttatgggtgtgtcgatgtattcactctacaccgagatggaaacgaacccaagactctgacatgggacaaagattgctcaccaagacattccttgcccatacgcatgagtacatgtcatgcgccctgtgcgaaatggggcgacgaggcactccaattgaccctgggtgtagatattctcccagcccggcccgactttgacaatccacgtacaaactcttatcagcagcaaagcggagcgcatctcaaacactccataccctcctgtgcgataacgggtgtactgggtagtcatcaggactgagcttgggcgtcgcgacgcagccaaggtggggaccgggtggcgaggattcgctcgagccggaggtaccgagttacggagttacggaagagttggtgcagctatgccgcggcgccctggagagccaccctgctgctatcgggctgtatataatattttaagtgtgggtgtactgatcatggccggcatcaccaccatcccagaacttgtgctgggaagccgacgggcccataccccgtccaagcccctgatcggcgtccggctctttaatgcttctttctgaactacccattcttcttgccataccccactgggtgcacgtgcagagacctcccctcccgtcgatgtcggagtgagtgaagggaacagctgtagaacaccgtggaagaagaccgtgccagctggccctcgcccggaatctgcgccgccgtgcgcatggcgaagcaggaagccaaaatattcatcggtggtctgagctgggagacgacaggtacaatggtgcagggagggtgggagtggtcagggaccctgtcgtctatgtacaggtgccctgcctggcctaggtgcaggatgtggccctgatgatgggcaccccggccaccccgctctctgagatggaaattcacgaccgcaattgtctctcaaaacccacgaagtaatccagcgtggcgacgtgcccgccaatcctgctccaatgccccatctgtacgccccactttgcacagatgaaaagctgcgttactactttgagaactttggcgtcgtgcaggtggggtttgcggcaaagaaggactcgacaaatcgctggcttgctatcacggcggtagagtcaccaggatcgtgcgatgccctgcnnnnnnnnnntgtgcaggtggggtttgcggcaaagaaggtcttgacaaatcgctggcttgctttcacggcgatagagtcaccaggatcgtgcgatgccctgccgccgggtctctggaacgagtcgtgcggcgctttgcttcactccatgcaacttgcatgcctgaggccagcgcagctcccccccacccccccttccacacgcgcactgcctctcccttccctcatacaggaggcctttgtctcgtacgaccggcacaccggccggccccgcggctttggcttcgtggtcttcgccgaccccgccgtggcggaccgcgtggtgagccagacccacaccatcgaccggcgcgaggtggaggccaagaaggcgctgcccaaggaggactcccccgtgtccaaagagggcgccgggtcgaaccccgcggccgccagccccgggcccggcgcaggccccggcgccgcgccggcgttctctccgcgcacccgcaaggtgtttgtgggcggcctggccgccagcgtggacgaggccgccttcnnnnnnnnnngcttccccgcgcacgcgcaaggtgtttgtgggcgggctggccgccagcgtggacgaggccgccttccgcgccttcttctcgacctacggtgcggtggaggacgcggtggtcatgtacgaccacgagaaccggcgcccacgcggcttcggcttcgtcacctacgccgacgaggccagcgtggaccgcctgctggccgacggcccgctgcacgccgtgcagggcaagccggtggaggtgaagcgcgccgtcccgcgcgacgccatgccgcccagcccccggggcggccccttccgcggcccgcctgccgccgccgccgcggcc

SEQ ID NO: 31058 - DNA, 108 bp, Chlorella protothecoides
cgccagcttgcgcttggtggccgctgcttctgctgtgatccagccttcccaccttgctttgcctccgcgcgaggagcctctgaggccggcagccacttgatggggtgc

SEQ ID NO: 31059 - DNA, 129 bp, Chlorella protothecoides
ggtgcgacagtcattgctgggttcactcaggagagtgaagcgtgagagaccctgaattgacctcatgacgtcacaagcatctgcgccattgcgcacacgtagagctcatgctgcatggctttccctggc

SEQ ID NO: 31060 - DNA, 61 bp, Chlorella protothecoides
agggtacgtggggatggcccctgcagagtaccatttactggagtcccccactccctcccca

SEQ ID NO: 31061 - DNA, 64 bp, Chlorella protothecoides
caccagcccgcagtactcccccaccagcccccagtactcccccaccagcccccagtatagccct

SEQ ID NO: 31062 - DNA, 61 bp, Chlorella protothecoides
tggtcctggtagggtctgtgatcaaggctctgcagtgcacagggcaagtgcgtgctgtggc

SEQ ID NO: 31063 - DNA, 65 bp, Chlorella protothecoides
tcaagcgtgctggcactgcaatggtggccaccaggcatctcctacatatccatcctgagccactc

SEQ ID NO: 31064 - DNA, 2302 bp, Chlorella protothecoides
  modified_base (1024)..(1066): a, c, t, g, unknown or other
gccagagccccctccctccccgccgccggcagagccccctccctccccgccgcctgcaccgcccctactccccagcccctcgccgccgatgcaaccctcgacccctccacccaccccagtgccacaaccctccccgacgccgcacccagctccaccgaaaaggtctccaccgccacctgctccgatagtcccctatccccccccaaggaagaggtctccgcctccctcacctcgcagacgcccaccgctaccgcccccccctcacaagaagccaccaccgccggcacacaagaggtcaccgccgccggacaacaagaggccaccacctccaatctacaggaaaccaccccccccgacccacaagaaaccacctcctccccccaaaacgaagcctcctcccccccgcaggaagcctcctcccccccgcaggaagcctcctccctcccgcaggaagcctccacccccccttcgcaagccgccacctccccgcaggaaggcttttcctcccaataaatgaagcaacctttcacatcgcacacataccttttatcgtcccaaagtgattagcttgggatacatcctccgagaaagggacgatgcgcctcctagagattttacatctcacttttgcaaacttgattggcattcccctgcacacacggcttgaccacaaaccgaatcgcgtcctgtactgcttcatttcacccttcccgcctcaagtttttatgaatggaacacctggttgcgaattcctgatcttgagtaccatgcttcctggctgccttgatttcatcatgattgtcagagagagttggggcttggtgtgaagctagagtagctgaggtgggaccaacatgcctgctggaactcatcacaacactgatctcctctgaaggccacctgagtaagcgctccgtgtgatgaagggtttcacaagtcacctcttagacgccagttcttgctaaggatatctgtcggtgccggttgggtcggctgtccccccccccccccccccccccccccnnnnnnnnnnnnnnnnnnnnnnnnnnnnnnnnnnnnnnnnnnncgttttcgcgcgcgcactccgcgagatctatctcccatcccgtacattgcaacctagcgacagccttcggagagcaaaccctgggctggtcataatcaggctcgaaacttgccgttgctgggcctgtgaaggccacggcccgcagcatacgttgctgcacggcaaggccgggggagggggaccccgaatagtcatacggtacaggctgccgtacctcagcgtgccagcaagctgaaacacgctctgagagaagctcaattgaggcatggtgttccgtgtgctgcggccgacgctgctaaggggcatggtcggcgccctggcaagaggtgggcgttcctgagtccagcctcagcaccgatactacctgacacatgcaggcctacaccctcccaccaaccctcttcctttgtaactgctcagatcccggacagctggtttgtggcaccacaaccgtccgccctaggctggtgtcctctgccatgtctgccaccgagctgtctgggtcagtctttgccgaggcggaggaatcctcgcccgagggtcagcctcgacctgcttgcaagaaggagggcccaatgaaggcttacgaggagggtgtggcctgtggcgctctccgccaggtccgccagagccaaactatgtcgtatgggcgggcctcgctcgacatgggcggagcctgcaagtctgggcaacggtgctctgacccgctatttgtgcccgcggctgagggcatggtggccaaccagtggaattaagtgtggattgcccgacgagtttcctgccactccccaaggagcctgcttcgccacgctctttccggggcgcttaccggcacagggctcccagctctcgctcctaggcccttgccgctcaccctctccactcccccaacccctcctctccacaggacccgcgccaggcgctgacggctcgacgcctgcagcgcgtgtttgacgacctgtgggacgttcggggcctgcccccaagcggctccaaccggcgcgggcgaggcctgaccctggtgcacgccgccgagcccacgcctgcgccgcgtggcggcggctggctgtcagggttcttcggcgggcaggctgcttcgccccccccgcaggcccccgctccccgcggcctgtacatgtatggcggggtgggggtgggcaagaccatgctcatggacatctttgtctctgtggccccgccagagttccaggcaagcaggccatgagccttgggggg

SEQ ID NO: 31065 - DNA, 74 bp, Chlorella protothecoides
ttggagatatgaactctgcatcttctctcaactgttacctgttgctttccgagaatagccttgaaggtgaaatt

SEQ ID NO: 31066 - DNA, 63 bp, Chlorella protothecoides
gatgccctgggagagtggaaaggcagggggttgggggggctgacccagggagcattgtgtaag

SEQ ID NO: 31067 - DNA, 438 bp, Chlorella protothecoides
  modified_base (152)..(327): a, c, t, g, unknown or other
gcggcactggcaggaccctcaaaacgtgtaagagtccaactccccccccctgcatgaagggcctgcacactcgccggtggtacaggcccctttgtccaccctcagacctgcataacaacgcaccgtgcttctcatggtgcaccgtgaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgggattgtaggacttgtggagacttggcactgttcacgtcctgaggatgcagtccctgcaatggtgatgtgtttatttcccccagctggcaggtagtggagaccaacga

SEQ ID NO: 31068 - DNA, 115 bp, Chlorella protothecoides
ggtctcgcacctgccgggcgtcaccaaggaaaagatctgagatccttttgtggtgccaggagagcggggtaacgcctcccggtccaatcaagctccgccctcacacaaggcagac

SEQ ID NO: 31069 - DNA, 68 bp, Chlorella protothecoides
tccctttcctcccttactgaacccaggacttggagctgatccttccagaaacttcagtggtgcagcac

SEQ ID NO: 31070 - DNA, 189 bp, Chlorella protothecoides
ggaggcggcgcgcctgaaggtggggagttttggggtgagaggggaggtgctgccgctgtgccagcctgcattctctcaatgcttccttggcagccagaggtccagacatttgatgaagttccttacctgactccccatttcccttcccgtcctgtcccaccccccaggagtgctccttccaacccacca

SEQ ID NO: 31071 - DNA, 65 bp, Chlorella protothecoides
cgatggattcaggcgtggtgcatcgcctgcactcagtgctcccaacagaccccagcagacatggc

SEQ ID NO: 31072 - DNA, 76 bp, Chlorella protothecoides
ggcatgctcaatgctggacacctccacgcatgcggctatggggccgagcaccatgcccctgaaccgatcccggttg

SEQ ID NO: 31073 - DNA, 790 bp, Chlorella protothecoides
  modified_base (515)..(606): a, c, t, g, unknown or other
actggggtgtgtgctgctgaggatagctcttctggcttgtcgacatgctgcattgattgcctgggacgcttgcaagtggtgcgggagtgttggctgctctgttcctgggagtgactgtggatgtgctgtataccagcagcgaggtgcacccacctttcccacccacccatttccccgccaaccacccacacttgccgcgctcctacaacacgactcaccccacaccacccacctatacacacctctgcaggcaggacccccctccagacgatgccaggatagacaagtacgtcggcatcgaccccgggcggaccaagatgtacaccgcggtggacgaacacgccaacgtgacatcctgctcatccaaggagttccacgccatgtcgggatccaagcggcgggagaagaccattgcgaagtggcacgcaaaggccccagactatgtcaaggagctgcacaagtgagtggtgtttggtgtgtggggtgtatgctgggacaggccccacaggggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctccttgctcaaacccatcttcccacaggtgcccaacccacaagacagccagcacagaggtgcttttattgcgggttgcgtggatcattccctaccagcgacggggcctggcctggcgcatctacaagaagcccttccgcaagcagcggcaccatgcctacgtcggcagggagcgggccat

SEQ ID NO: 31074 - DNA, 130 bp, Chlorella protothecoides
tgcgcaggggctctgcagaaaacacaggctccacgtgagcagcgaaggaaccctcaccaaaccaatgccatccccacaaagccccatcgctcacgatggaggccttctcggcctcggccttgaactctgc

SEQ ID NO: 31075 - DNA, 75 bp, Chlorella protothecoides
tgcaggtgggcacacgtcgccctgcagggaccgggtgggtctcgcttgaacacaggagactcttcttcagccaag

SEQ ID NO: 31076 - DNA, 98 bp, Chlorella protothecoides
gtttgcgcaggctggggatttgcgcaggctgggggggtgcgtaggttggattgttgcgtaggctgggttgctccagccaccgggtgtcacctgcaggt

SEQ ID NO: 31077 - DNA, 243 bp, Chlorella protothecoides
ccgcgtcacactgcagtcgagcagagcaaccggtgggcgaggggacctgcacgtttggggatgactgagggggagggtgttgcttctgcagcaagggctttgtggacagagtgaccagcacctggcagctttgcctcctcgcccatcacgcttcaccctgtccctctcacatgagccatacaaaattttgcatgatcgtccacctgttccaaccccccccattggcaattgccagggtgctgg

SEQ ID NO: 31078 - DNA, 120 bp, Chlorella protothecoides
gtgcggatgggggccagtgggacggggatcgggcccctccccttacactgttcccgtgtcaaggctggaaggttccagttgtgaccatggctggggtggactcagcagctaacgtccccc

SEQ ID NO: 31079 - DNA, 140 bp, Chlorella protothecoides
gagcctgaacagaaagatcccgccttctccctggcaatgaggcttaggaccagactccagccccattcgccagggctccagggggttgcaaaatagcagcagaacttcccctcaaaagccctctcaccagattgcaatgt

SEQ ID NO: 31080 - DNA, 96 bp, Chlorella protothecoides
accgcatactgcacaaactcaccactcagcctgagtagctccccctctagcagctcattgtggtcgaggtacaggaacctcacattgcacagcagc

SEQ ID NO: 31081 - DNA, 76 bp, Chlorella protothecoides
ggtatcgtggtgcactcccccatctgactgaaacacgtagccatcaccaatctccagtaggtcgtacagcgtcacc

SEQ ID NO: 31082 - DNA, 67 bp, Chlorella protothecoides
ctgccaaggccgacgaggaaacccctgacctttactcgcagcatgtcgattccagccaagccggagg

SEQ ID NO: 31083 - DNA, 3888 bp, Chlorella protothecoides
  modified_base (443)..(452): a, c, t, g, unknown or other
  modified_base (1391)..(1400): a, c, t, g, unknown or other
  modified_base (1749)..(1758): a, c, t, g, unknown or other
  modified_base (2405)..(2414): a, c, t, g, unknown or other
agaaagcgcggcggcgcgccaggggcaccccgcgccccgggccagggccgccgcctcggccacgcgccccgcgcgcaccaggcgccacagcgaacgattcagccgctcctcgtccgccgcgttgtcggggtccagccgccggccggcctggcgcgtgggagcgtccgggtccagctcggtgacggtctgggacgctgcggttgggggggttgaaggagtgcatgcggtttgcagggctgcgcatctgaccggaaggccaaggtccggctctttcgcaaagtgcagccccgcacggggtcctggtccagatggcgcctgcaagggtgctgagtcgtcgggctccggcgctgcatgcctgggcccgtccccgtccctcgccgtcccgagtcacccttcccccatcgtcccccgatttccagctcaccgtccacgctggtgatgcnnnnnnnnnncccggcgctgcatgcctgggcccctccccgtccctcgccgccccgagccacccttcccccatcgtcccccgttttccagctcaccgtccacgctggtgatgcccagcctccccgactcgatgcggcgccgcgtctctcgccagacgccgtcgcccgagccgacggcgggcggcccttcgccgtccagcgcggccgccgccaggccctccagccaggccacggcgcgcgcggcgcggttcagctcggggtcgagcgcgacgaggtccgcggcgcgctgacgcgcggtcttggcctggcccgcgccggggacaaagccgccgccggtgccggcggggaagtccggctccgccacgccgtgcaggtgccagagcaggcgccaggtggcagcctcgcccgccaggtcggaggccgcgcgcaggagcgcgccgcgcttcctggcgcgtgccagctggctgccggccagctcggtcagctgccgcgcgcgctcctcgcagatgcccgcgtacagggtcagcgcctcgcccgcgtccacgccgccctgcatgacctccagcagcacccgcgcaaagtcggcgacctcggggtggggctctgggggtagggggtcggcgtgcgctgtgggcaccatgccctgcgtggcgtctggagttggggccatgccaggcccggcacgcgccgagaagggcgcctgggccggcacggcgtcccccagccgcctcaggccgacggccgaggatggcgggcccctggtacagggatgtgcgctgctgctgggtgaccaggccgggttcagcccggcgacagagcccggggaggggacatgtatgctgccgaacaatggattgtcgcccagggaagggccatcccctgcgcgaagacaaggaaaggtgtgccggttcggtggtggcacagggaagggcagggcgctcgccgacagcnnnnnnnnnntcctgtgcgaagacaaggaaaggtgtgccagttcggtggtgggacagggaagggcagggcgctcgccgacagcaccggcaccctgtcccagggagaatcctggatagatgccataatacgccttcctcaccttgttcagggctcagtacccaggccatcggctccagaaccagctgcacccaggactcaccgctccatgtccagtatgaaagtcaccggccttgccgcgatgggtcggtcgtgagaggcttgatcagtcgtattcagccctgtgttcaactgaatacgacgtgctcatattcaggcagaagcccgacgaaccagctttcgaatgatctgccctcccggnnnnnnnnnntcttgatcagtcgtattcagccctgtatttaactgaatacgacgtgctcatatcaaggcagaagctcgactaaccagctttcgaatgatctgccctcccgggaggagacggtacccatcggacaaaatcgagcgcgcgctggcccacccgcaaaagttgcacgtagcctggggacgctgtacgcgaagaggggaatgattgcctgatgctgttggacagatcagggacgagtgaaacaccaccacacgctcctgtttagatcccgaagctggcgagccacaacgacgggcgtgcgccataggtggcccggttaactgcttgtgtaccggagtacctcagtgcttgatgttcgaggagcacgcagcctccctgccgagcagtccatagacaaaaacatatcgtcatgagattccgattcgtgtgcctgtccctgctcctcctcgtggcatgccaggtgcggctcgagggtgggcaccctgtccttctgggtcgaggcactcaccttgcatgcccgtgcacgagcctgccgcccaccttgggttccattcccgcgacctacagggggttcaggtgtctggagacgccattataaaatctatggacggcgaggacagcggcggactgggcaatgccaaggccggcaacgnnnnnnnnnnggtctggagacgccatttttgaatctctggagggcgaggacagcagcggactgggcaatgccaaggccggcaacggcgcgcgggtgctgcagcgggtggaggccgttaaccccttgcctccccccccgcccaaggtgtcggccgccacggtgctcctcatgaccctgtgcatggccagcgcggcgggcctgggcgctctccctttcttcttcgtgcgcagcctgtcgccggcctacgcggcgattgcgacggccagcgcttgcggcgtcatgctggccgcctcctttgacctcatccatgaaggtgaggaaggggggagggcccgaggatgaagggcggggaagggcgcggtggcgatgccggcagctgcgctctggggctcccaacaggcggggtgcagcggcgccaggcccttacccagcctgcatatagtcctgcatgcgccatccttcccccgaccctcatcctgtcccactcgcaagcttcctgcaggccagccgtatggcggtggcggagtgttcgtgggcgtgctgtgcggggcgctgttcatccagtggatgcaggagcgcatggcctcctgcaaagacatcaaggtctggggtgggggtgttgggagaggccaagcgtactgggtgatgctaattgctcccggcgtgtctaatcccggtgccgggctcctgacggggagggtctgtctgtcgctccgttccctctctggacacccagccacccagcagctcgcgtctgataccccatcacctcccaccccccacactcctcctcgcagttccaggacctgaggggcagcgcggcgcggcgcgcggccatgatggtgggcatcatggccgcccatgccatcggcgagggctgcggcgtcggcgtctccttctccggccgccgcggctggacccaggtgggctggggatgcgcaggcccgctcgcgattcctccctggacgccaccctcgcccacggcctccagtccgtcccctttcctcatccccactggttccccatccaccctgcccccacccacccccaacacacagggcctgctgaccacgctggccatcggcgtgcacaacatccccgagggcctggccaccgccacggtgctggtgtcccagggcctgcgccctgcccccgccctgctctgggcggtgctgtcctgcatgccccagcccctggtggccctgccctccttcgccttcgtggaggccttccgccccgtgctccccgccgcgctcggcttcgctgccggctgcatggtctggatggtggtggccgagctgctgcccgaggcgctgcgcgacgcggcgcccgcgcgcgtggcgctggccaccaccgccagcgcggcggggctggagggcttccgcatgctggtggaggggctggagcggcgcgacggctccctggccccgccccttcccaccgacctggccgtcccggcgggcacgctggcggtcgccacgctg

SEQ ID NO: 31084 - DNA, 103 bp, Chlorella protothecoides
atcttccctcctcgccactgagattgtcattggatatatagcgttgatctcgacgaaaagcggccgaaacgcaatttgtgagccacaacctctgccatgggtc

SEQ ID NO: 31085 - DNA, 109 bp, Chlorella protothecoides
ggcaagccttgccagcacagatgaggtcccgggatgtgaaggatagaagttattatggaggcgcgcaggccttgggcgatggaggccttgctcctcaggctggtgatga

SEQ ID NO: 31086 - DNA, 78 bp, Chlorella protothecoides
ggcctccagctccatcctcaccctctcattagaatcgagtggacggtcaacaaacaaaaatgtccgccgtgaccggcc

SEQ ID NO: 31087 - DNA, 182 bp, Chlorella protothecoides
cgcacccggggcgcccagaggtgcgtggtggttctgggcctcgttggggaagtggttgcgtgtgtctacaggagaaagtacgagctgccctgcgaccgcaccgtgactgtgcagaggcgggctagggtctgggtgaactcgccgaaggagcacagccattcagcaagcctgcccagcgcatg

SEQ ID NO: 31088 - DNA, 61 bp, Chlorella protothecoides
gttggatttgccctcgtcgtctacggctggtccataccaggtgtgcctttggtagtaggca

SEQ ID NO: 31089 - DNA, 71 bp, Chlorella protothecoides
atatgcattgtacggcttgcaagctctccaccccttacccaccctggtgcaaacgagggtccctctgggca

SEQ ID NO: 31090 - DNA, 61 bp, Chlorella protothecoides
ggactggtctcacgaggtggcctggaccgaagaggaacgcgacgaggtcctggccgaccgt

SEQ ID NO: 31091 - DNA, 156 bp, Chlorella protothecoides
tggttgaaggggtacggagtgaggtcagaggggtaatgtgaggcactggatgtgggtccgtggtgcatatgcctttgcagtgcgacaccgccgccgaggctgaagcatttgcgcagcgctgctattcatcaagacccatgcaaagcttggctctct

SEQ ID NO: 31092 - DNA, 79 bp, Chlorella protothecoides
tctcactccttggagagggattccatgcgccggcaaacgatacttgtcttccgctcacgcatctggccctcaaacacca

SEQ ID NO: 31093 - DNA, 5835 bp, Chlorella protothecoides
  modified_base (1672)..(1717): a, c, t, g, unknown or other
  modified_base (3872)..(3881): a, c, t, g, unknown or other
  modified_base (4100)..(4109): a, c, t, g, unknown or other
  modified_base (5269)..(5278): a, c, t, g, unknown or other
  modified_base (5761)..(5770): a, c, t, g, unknown or other
cgcccgccccgcctgcgcggagaccgggcgcgcgggcccgcccgcctcgctttcctccccgccggcgcacgcgccgcagggctcccgcgccgcgaccgaaatggccgtcgcctcctcctccagcatggcgcgcaggcgggcgcagcgctctcctcccgccgccgacatccccccgggctcgatgctggacagctcctcctccagcaacgccaggaccctgaaaggggggaagggggggttggggaagaaggggcatggggctgcctaggtctgacgccagagggagtcgaagacggcggggggcccacggtcgggcgcacaaggcttcacagctcgagctctggatgcgcatggtcgaagcagccaggtgcacgccccaccgtttacagacatgcgcgccgggcaggcgtcggccccagccgctgcgccggcataatcccccccctaccaagccatgcacacgcacctgcccgggtacgcgtcatgccaggggctgggcccctggccaatgatcctggcggcgccgtgcctgcaggtggtggcctcctccgcccggccctcctcagccatggccacatctgcggggccgggcgtcgtgacggcatgcgtcaccacgccctgaaatgaacccaatgcgcgcatgcgccccccaaaatgcacccaatgaccaccctgcctaccgccgtcctcctcgtcgtcgtccccggcgaagaactcgtgcgccagggcctcctcggcgctgcagcgccgcgcggggtcaaacgcgagcatgcgggccagcaggtctatggcgcactcccccgcgtcggcaaacctggggtgtcattgtccagggggggtggacatgggactcggatctggagcgcgcgcgtcgtggcggcacgagggattcactgcatgtgcttcgaatcgccgcgcagcccagtcagcgtagggtgggggccccgggaggggactcgtataccgacccctgatcccttcgcccccaggcccctgcaagggaggttgctccggcacccccactctatcccgtcctgcgcacctcctgtacaaggagggcgccttgcccggcaggttggccaggtagcgccgccaggccgggctctgcaccttgtccacgtccgcccaggagggcgtgccgatgacgtcaaacagggcctgcagctcgcggcgcgtgacgccgcagctgacggaccccggctcggcgaagcggtcgccctcgtcgggagtgcgcggcatgccgtggatggcaaagaggggggccacctggagggcgggcgtggccgcgccgcccacatgggagatgcgctgcaggagctcgccgaagatgcagcccatgctccacatgtcgatggcggaggagtacccgccccgcgacatcaccacctccggcgccctgagtgcgcggcggcaggtgagggtggctcgggtcggctggcgtcggagggaagggctgtgcatgtaaaagggccggcaccccttcccatagcattgcaaaggacctccgcacaccccttgatctttctgctcggtcacgtggcgccccaacactcacgcagacggggctgcagtcgaaggctatgaaacacaggaccccccagctctctcacatgtcactcgcagcccatccgctctctgaccaaaacccctcaccccccccccccccgggggnnnnnnnnnnnnnnnnnnnnnnnnnnnnnnnnnnnnnnnnnnnnnngcgccacctgtagcacggggtggcgaccacgcgggtgagcggcgccttgaacccgctccgcgctgcggcgcccccgccgccggccgcgccgggctccggggtactggtctggtactgcacgtacaggtcctccgcctgcacgccctcctgcatccgcctgaaggaggaggaggggtgcaggggcgaggcgagggactcctgggcgtctatcgcggctggctgggcgagcgacctcgcgggtgcctgctaggagaccagggacatgatcaaaggagaggggggggggattagatgagcaaaaacattcccaggtgaccagacggcgccagcccttgcacctccatgtggacgcacagcatatgctggtgggcctcatgcgagcactgcaccaccctgccaacccagcacatacaagctggatgggctgcaactggtggctgggagcctgctccgcccagtggtagccctcggggatggcggaccgcgccgacccaaagtcaccgacctgccggggtgtgtgtgtgagtgtgtggggtgtggggggtcagacacaggggcgcagtttgccaagcaggggtcctcctcgaacccagacacagcctcccacgaccagcacctccccggctcgcctttggcacacgcttgcccgtgacggggtgccgcgtgaggaaaacgttctggctcttcacgtcgcggtgccagacgtgcatagagtgcacgtagcgcaggcactgcagcatctggcgcatcagcgaccgcacctcctcgcctgtggagggggccggtgggggggggagcgctgctcagcctgtgccagcggggctgcaaagcaccgcgccgagcccctccctgcccgccatctggcgcgtttcacggccccctctccagaaacaacaggccaaaccccccttgacccggccactcacccgacagctggccccgcaggtggaagaggtcgccgcactccgcatactccatggcgatgtacatgtccaccgacaggctgacaagcttgccgcccaccaggcggcattgccccgtggcggcgggcctgaggaagcagtcgcgcaggcccaccaggttgtggtggcgcaggcgccgcaggatggacacctcccgcagcacgcgcttggcctggtcgggggactgcagcacgtccccgatccgcttcagggccacctgggagggtcatgtgggaggacaggaggctggccaggcgataccactgctgggggggaggcccgatcagcgccctggataatgaattctctttcagcctggctccatgcaccatcaatgcattcccaccttctcgccggtctgggtgtccgtggccaggcacacgcacgagaaggagccgtagccgaggaccttctccaagcggtacctcgtgccaacctgcgggcatggcatggactcctggatatcggggcatgcgaggaggctgcacagcaccacggcatccgcatccagagcgatgccggtgctgcctccacggcgcacacctgccactgctgactgccgatgctctgcagcgtggtgccgggctcgggggaaacaaagtagaggccaggttcatagggggacgcgcgaatggactccgacatggcatagggagcactgcacagatgtgtacaaggacgagcacggattctccggctgcgtgtcaacgacagagagtgcttccccagcgttgcataggtcctgatacagtaaatgcgcaggttttcataatatttatcagaggtaagttgtggcgttggcgtgctttctgtggtcctggaatatatgaaggatcccgaggggcccagggtgctcgatcgggatcccgactccgatactattttgggggaggagccaagtttgtacttcattattcagcataccactcaactcccccactctggttgcccatagccaacacctgatactcacacgatagtatttgtccttgagagtatattggacgtcagggagtcgagttcttcaacatggcagcgcaaagtcatttccttttataattgtggcagactgaattaccagcttcttgaaagagctatgtgtttgatgtcctctatcttcagcatgaggaatatgctaaacgggcgagggagaaagggacccccccaaggtcatcagtaaggattcttggtcnnnnnnnnnnaggcgagggagaaagggaccaccccaaggtcatcagtaaggattcttggtctggacagtctgattagcgaactgagagcgcccgcaaacaattctcattataaagcatttcaattatcatttgtgttgtgaagttgcttaggatactgttttcaaagccttgccgaaccatgcaatgtaagatgtgtgaacatttggcggaaccgagattcctgggcannnnnnnnnnccaattctcatgataaagcatttcatttatcatttgtgttgtgaagttccttaagatactgtttccaaagccttgccggcccatgcaatgtaagatgtgttaacatttggcggaaccgagattcctgggcaggaagtgattaatccggtccgttctttgtcgcgttttccatcccgaagtaataaaagtagtaacctcagaataaattgagcgcatcgatatcacaacgccgtgcaaggcggacttttcccatctctgtgccccgggaagtctcccttgaaacctcgtgcacctagactgcaggacaactttgtgcttgccgggacgccacgatgattccgaggaagacgcagtagcctaacaaccatgtcatcggctctgacacaggccctgcgggcgttgcgcgtcgcagcgcccggaagggaggtgtcccaggatacggactctcccttcgcgcgtggcccctcgccagccccccacaatcccagggcaccagcctcgccgacatgcatggcaccggactgtcgtcggaactcatcgacgaacgatgaggggtgagggagggtatggcagtaggagttccgggaggggtgcgtgaattggcagtagggggaaagtagcgtacatcacattcccatcctcccctatcgatatggcacatgcagggtcactgtgtccccgtccctcgaggatgtctccatccccccaagcttcctctgccctgtgtccatggaaataatggtgaggcatgggagggcagaggtcagctagccagttttggctgtgcagagacaggcatgccccatgcaggtaccatcctggctgacctccttccggaccccctggcccacgctttcccccagtctgatcccgtgatcctggccactggacacacgtatgaccggccctccatccagaggtggctcgacagtgggcacaagacgtgccccgtcacaggcacccgcctgcgccacacggagctcaccccgaactttgcgctgcgcagcaccatagcagtgcgtcggtgttgctggaggcgttgggtggacgagggatgttcatgtcttgcagcgcaatgctgctgctggggacgggatgtggggaccgaacccggggtgcacaccagccagggctggccggcctgttggatgaaggcatcnnnnnnnnnntgagggatgttcatgtcttgcagcgcaatgatgctgctggggacgggatgtgggggccgaacccggggcgcacaccagccggggctggccggcctgttggatgaatgcatccccaacccttcccttccaggactgggccgcggagaatggcatcgacctgcagcgcacgcggccgagcgagccagcagcagcgcccgcggagcccccccgccaggcgccccagcaagccgccgggcgccagtctgccaacatcctgcacgtgcgctcgcggcatgcacctcagactgctgggctggggggagtgcatggtaaattgtgacgcaggggctgcattggctggccagcggtgtccatcagtcctgtgcagcgccaagcgggacccccagtgtttgggcccacgcggcacaggcccttgggaggcaacttccgccgcaacgcctcgctgcgcgccgctcccagcactgcccgcgtgccccccccccnnnnnnnnnngaatcgtgacgcaggggctgcattggctggcctgtggtgtccatcagtcctgtgcagcgccaagc

SEQ ID NO: 31094 - DNA, 127 bp, Chlorella protothecoides
tagccagggctctaacctttgtgagggttcgtgggaggtgcatacggagcccggctggctggcgcaactcggcccaaggcatgtcctgccaggaacccccggccccaagttctgggtactgccttct

SEQ ID NO: 31095 - DNA, 77 bp, Chlorella protothecoides
ctcggctgcaaccagggggaggggccagggtcgtccgggcacattgaaggatttggacgccaccagcacactgcagc

SEQ ID NO: 31096 - DNA, 167 bp, Chlorella protothecoides
tcctgcaggggtcgggggtgcatgcgagtgggtcccagcccgcctctgcaaccctccatcagctttgagcccagcgagcccactccccacgctttgcgcagaaacgcactgccgccttcaagcgctggctgtacgaccgccccgagaccgtcatcgtggcgttcggg

SEQ ID NO: 31097 - DNA, 61 bp, Chlorella protothecoides
ccctccagtctggctacctggtgcgtgggcgtgggtggtatgggcctgtggagggtcgcta

SEQ ID NO: 31098 - DNA, 71 bp, Chlorella protothecoides
cagagtactatcttgccacgtcatggtgtcagcgcatgttgtcctgctgcagattgcgacagacagtcctg

SEQ ID NO: 31099 - DNA, 100 bp, Chlorella protothecoides
cgcagctcacatcccctcctcatcctcatcggcatcgctgaaccggtttgggtctcctcccaaagcctgcaaataccaaaagatgatgactttgctgggc

SEQ ID NO: 31100 - DNA, 431 bp, Chlorella protothecoides
  modified_base (108)..(362): a, c, t, g, unknown or other
cgcagcggttggatctggaatccggggatgtgagcagaagctcctgcgaggcagggcagggagtgcatacatgcggggtcgtgccattcaagctagcttccaggagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgacccttgcatgcctgcatttcaaccaacaggcacctgggtgccgtggggtttgcatgtgaccat

SEQ ID NO: 31101 - DNA, 61 bp, Chlorella protothecoides
ttgataaccctactggtaccgcgtccggaaacccattcactcagcggagcagagccttgtc

SEQ ID NO: 31102 - DNA, 61 bp, Chlorella protothecoides
tgacactcaccctacgcctcgcgcacctcttagcctgcgtctgaatcttctcgctcgtcag

SEQ ID NO: 31103 - DNA, 61 bp, Chlorella protothecoides
aagcacaggccagctgtacgacctccccgtggccttccgctttgtccagctctggctggag

SEQ ID NO: 31104 - DNA, 110 bp, Chlorella protothecoides
gggtttagacctgaggacataccctggctcaacacagaagatcccagttgcccaaggccctcctcataaaaaaatgacaccccagctttgccagatggagcacaccattc

SEQ ID NO: 31105 - DNA, 80 bp, Chlorella protothecoides
catgtcagtcaagcatcagagcatgcgtgacactgttgcgatcatcatcatcatcctggcaatgcccacctgcagtgatg

SEQ ID NO: 31106 - DNA, 62 bp, Chlorella protothecoides
tcggcttgcccgactccccaccctcttcagcatcaagaggcgttgccctgcaccagcggcga

SEQ ID NO: 31107 - DNA, 61 bp, Chlorella protothecoides
ccttaaaatttagtaacgtcattggtgatcagatatatgcttgtcattaaggaagaacatc

SEQ ID NO: 31108 - DNA, 63 bp, Chlorella protothecoides
cataggcgtctctcgcaatcttcaccaccgaaaccccccccctcctctggtgttgctatgaca

SEQ ID NO: 31109 - DNA, 70 bp, Chlorella protothecoides
ggcaagacctgtgatctgcctctttgtgttcaacgaggtactccaatgtacatactgccaggcgttgggt

SEQ ID NO: 31110 - DNA, 74 bp, Chlorella protothecoides
aagggggatgttgaggtgccacaatggccaggacaatcatcaccagggtgcaaaggggtctgcaagctgccctg

SEQ ID NO: 31111 - DNA, 68 bp, Chlorella protothecoides
gcatgccagggcgtaggtattcaacaccccccctccttccgcactgaatgcatgacctccagtcactc

SEQ ID NO: 31112 - DNA, 101 bp, Chlorella protothecoides
cggacctcatgcccttgccgtcccaatgccgagggcaccccccccttcccttctcagcgacaaaccacaggtgctcacctccaccacgggttcgacccgct

SEQ ID NO: 31113 - DNA, 12123 bp, Chlorella protothecoides
  modified_base (125)..(134): a, c, t, g, unknown or other
  modified_base (896)..(905): a, c, t, g, unknown or other
  modified_base (1353)..(1362): a, c, t, g, unknown or other
  modified_base (1830)..(1839): a, c, t, g, unknown or other
  modified_base (2408)..(2417): a, c, t, g, unknown or other
  modified_base (2788)..(2797): a, c, t, g, unknown or other
  modified_base (5448)..(5457): a, c, t, g, unknown or other
  modified_base (5862)..(5871): a, c, t, g, unknown or other
  modified_base (6289)..(6298): a, c, t, g, unknown or other
  modified_base (6717)..(6726): a, c, t, g, unknown or other
  modified_base (7408)..(7417): a, c, t, g, unknown or other
  modified_base (7724)..(7733): a, c, t, g, unknown or other
  modified_base (8484)..(8493): a, c, t, g, unknown or other
  modified_base (9065)..(9074): a, c, t, g, unknown or other
  modified_base (10047)..(10056): a, c, t, g, unknown or other
  modified_base (11235)..(11244): a, c, t, g, unknown or other
ggggggggtgcggggcgttgggccctgcgccgtgatcgtgtgtcctaaaggcccagatgcaggtgaggtggcatgctggctgggagcgggagccctaccaccctccatccgagattctttgggcnnnnnnnnnnctgtgatcgtgtgtcctacaggcccggacgcaggtgaggtggcatgctggctgggagcaggagctctaccaccctccatccgagattctttgggcaccctggctactgcacctccagcccactgcacccttcaaggagaccctccactttccccaagaccgacttcccatggaacactctccctgcgcgcgcacacgcacacaaactccgacacacgcaaacagccgggcccacctcgccatggccaggacccccagggcgctggacgcgatggccagggtgggcgtgccatgccgcgacttgcgcgcaaaggcggcggggaggaagccgcgctccgccatgccatgcaggaggtaggagtcggtggacatctccgcctcaaactggcctacctggctgaccatggccgcgccgaccaccgcccagcccagccagcggccgcccacgcggtcccccaccaccgcaaagtagcccaggtcccagtccgcggcgtcggcggagtagctcagccccacgatcagggggaggaggtaggaggccaccaccagcaccaccgcgcctgcacgagggagaggtgggggttcagccactccacacaccagacagtgaagacgtgtttcgggaggtgggagggcaccgcatgccgacagacgtggagacgccagtgtcgcgacgcccagcagcccctaggtgctccggcgcccgccccccacccccccatgcccccgacgtgaaaagcatccccacctgccagggcccggnnnnnnnnnnggggaggggtgggggttcagccactccacacgccggacggtgaagacgtctgtcgggagctgggagggcaccgcatgccgacagacgtggagacgccagcgtcgcggcgcccagcagcccctaggtgctccgacgcccgcccccccacccccccatgcccccgacctgaaaagcatccccacctgccagggcccgggggaaggtcttgccggggttgcggacctcgccagccagagtcgacacgctgtcccagtagttgaggttcctgcaggatgcccagggaaatgcttggggctgagccaggggtctgtgcgcccatgttgccagccatgtgtgtagcgcatgaaacaccctgccatcgacgctgtcaacccctcttcattcatggcaagccacgcatcctctgttcccctccttaaggccatccagcactccacggcacctcacnnnnnnnnnngagtgcttggggctgagccaggggtctgtgcccccatgttgccagccatgtgtgtggcgcatgaaacaccctgccatcgacgatgtcaacccctcttcattcatggcaagcaacgcatcctctgtttttcctctcaaggccatccagcactccacggcacctcaccagaacatgacgttgaagaagggaaaccactgcactgcagaccagtccgacttgaccaggttggctggcttcaggtgaggcagccctgtggcaagggggcatgggggagagtcgagatctgggcagcagtatcaagaaaggagcatgccaagatagaaggtacagacaggcccgatgacattgtcacaagccctttgactcgcggtatcagaggcatgctgtagaccattggacaagctacgtgaaactcttccaacccccagctgcagtgtgctacaccacaattcaccatgcatgccaccnnnnnnnnnnttcgagatctgggcagcggtatcaagaaaggagaatgccaagatagaagacacaggcaggcccgaagacattgtcacaagcaccttgactcacggtatcagaggcatactgtagaccgttggacaagcaacgtgaaactcttccaacccccagctgtgcagtgcgctacaccacaattcaccatgcatgccacccagatggcccccagaggcccttccccccatcattccccctgttccaaacacacagcgcccaccaaggagggtgatgatcacaaacggagccagggtgagccccgtcatgacgatggcagcgttgcccaccacatgcagtccccggtagttcaagtaggtcagcgtcagattcaggcccacaaggaataccctacaggaggaaaattgggggagaatgatagaaactacgacccacagtgggcgagtctagcaggtgctgcattggacaccaattccactgggccccacattgcaacagtaccgatcagaggaccactcacaagcgcggccatccgtccttgaacacggggacgccctcctgcaggtaggtcagcnnnnnnnnnnatgggcgagtcttgcaggtgctgcattggacaccgattccactaggccccacattgcaacagtaccgatcagatgaccacttacatgcgcggccatccgtccttgaatacggggacgccctcctgcaggtaggtcagcagcattactgggtagacagcgttgtccgtgactccgctgatccatgaccagaagccctcctgcgggtggagggtttgcagaggcggttgaagagagactctgtggagccaccgtcagcatgttgagccctccagccggccagcagcgcgcgtgttgagtgccaccatccggacaatgatggcacatccgattccacctcctgtaaagatatctccttccaagaatgcaagaannnnnnnnnntgtgttgagcgccaccatccggacgatgatggcacagccgattccacctcctataaagatatctccttccaagaatgcaagaataccctaccacacccttgcctggaatccccagaagggaccaaaggcagcggtgacccaggcgacatagcccgagttctctgggaaggtggtcgccatctctgcggtgatcagcgcctccggcacggaccacacgatgggtagcaccatgaagccaagcaccgccagcagtggaccccccgagctcacagcatcctggcgtgggaaatggggggggtggaatgtacaccttcctggtgcataagcaacttgcgaatgtatgcatggcatgttttaccctgcactggcaaccggcgtcggcccctcgactcacctcgatcccaaagggcccccctgccacgtcatagaaaatgagggcaatcaagggaagcagggacagcggcttgagtgcctgcggggcgaagggtggaggcagtggaggcacgtttcggccagctcacgcctccaggctaggtcgctgtgcaacccccgtgcagcgccctgtgcgcacaccgttttggatgaagccgcacggccgttctcggccgtgttcagggcatcctccaggagagcatccgtttcgacatgcattgtgccggaggggctcagctccagctcgctggcagcctcccacgcgggtcgggttgtggactccagggtgccaccccctcctgccaccccgctcgctacctcgcgctgttcacaagcaccatcgacccaataacttccacatgtgcattcgggggagggttgacggctcctgcaggtcttagaattgatgtgcttcgcatcctagggcttgatgctgcctcgtcgcgcgctggatttcgatgtcattcacccgggccaccccccctcccgcgagtccgtgacccctgcatagaaggctttcctccagcatgcagcattgcctcccatcgcaatcctagccatgtcgaggttgcgatcggctttgccggccttgcgccagctggccctgctcggtggcccaggcatcacaggtggggattttttggtgtcgggatgcgtgcatgtcggcgacaagcactcgaatgagctcaccccagcttgtgatacaatatgcaggccctggcgcattgcaagggtgcgctggccaggcgggcaaggcccttgcccagctgcccagcgcagccggggccacccttccggcattcgtcggcctggagctggcacggtctttcgccacagccccggcgggaggacggcggcaacgccctggtcgtcaggctggatcacaggtgggaggcagatgagtggaagtactgcttctcacccagcatcggggtgctgggaaccgggtgctgagtccgccagcctgccccaccccccaggagctcgtgagcgccgaggaggagttcagtgccatcaccgacaagatcccccagcgacctgtgggtgtggtggagggcaccagctacaccgtcatcatcctcgcagccctgggggtgagttggctgactgggttcttgggcacggtgaggtggcaggcggcatgttgtggtgtttccaaaacagccctgctgggcgctggatgcttgacgacttcccccatgcctcccagttcgcggcggccgtgctgtatgccgctgtgaacgagctgctgctgcagcccgccgagtacacgtgctacaacaagacgctggacctgatccgcgacgacccccgcgtgactgtgcgcctgggcgagccggtgcacgcctacggcacggagagcaggaatcggtcggcgcggcagcgcatcccacaccgcgagtaccaggacgtggagggcaggcagcacatccaggtgtgtgtgtgtgttcgggggagcatgtcctcagcagctcctgcgccccctgcagcgcccacggggctgctactgctgccggaagggagcgcactctcgccgtagtcactctggcaagcatgccgctccctgtcacatgcttccgcctggagctccagcatcccctcccccaccccttgcagatccagttccacctcagcggccccagcggccgggccactgtgaacgccgacatgtacctagagagtggggcctggaaacacaatttcctgtacctcgacgtgcaagagcccatccggcagcaggtggggctgcggagcgggccaggcagctacttgatggtgtgcctggggctggccagggttgggacagatgcgatgcgtccaaaatctggagcgcacgggagggcggctccctttcttgcacccaaccagccgccacctgcctcgcaggtggtgctggtgaggcctgaggtccagatggtgccagctgcttgacagaggcagtccagggcagtgcaggcctgtgatgcgcagttttctgtctgccagtttcgagacatggtatgctgcccggcctccccctggcacccgtcgtttcatggcgacgccgctcgctatcctacaggcatgcacaaggcgctgtgggtgcatgcagtgtaggtcaggttgtcaagtcagtgtacagagcgccacgacacgggctggagagggctgcaggggaggattagattcaaggaggtgccagtttgcaaggccaaggctgggactggctgggcagtctnnnnnnnnnnaacacgggctggagagggctgcaagggaggattagactcaaggaggtgccagtttgcgaggccaaggctgggactggctgggcagtctggcacacacagcgggccagatcatgacggggacagggtttgatgcgtgccaagctggcgctgtgtctgcaagggttgtgccggactgaatcatttgaacatcttcttgagttccttgctgaccttgtgcacggggcccgcaattggtccccggcgcttcttggtgggggtgctgtcctgtgacggcagtttgtggaaaggggagggctttggctgagggcgtgtacacaacatcagtgcagaggaatgcgacaagatcaacgacccgcccgctcctcacagcctcgcaccttggagctggatccatcgacggggtgnnnnnnnnnnaaaaggcctgcccgcacctcccagcctcacaccttggagctggatccatcgacggggtggctcgcaaggtcgtgctttgccaccgctggcagcggcgcggtgggtgcctcaaggcggccaggagtggcgggcggggtactggagatctctgcgctgagcttgggggtggccggataggacgagaggggcgagctgtcagtcccaccctgcgcagttgaggggctggaggacgtcctgggtgggcgggaagaaagacgcagagtgtgccctccatggttccaagaagacaatctccaccacttgcagtaccttgaggggagcctggggagcaaatggcatgttagcagctggaagagggagttgctggtggatgggccctcctaagatcaatggaatttgcggaggatggctgtaactnnnnnnnnnntcaagaagaaaatctccaccacttgcagtaccttgagggaagcctggggagcaaacggcatgtcagcagctggaagagggagctgctggtggatgggcccttctacgaccaatggaatttgcggaggatggctgtaacttcctagttgtgagatgaatgaggaattttcccgccccagcatacacaggctcaggagggcacatggcattctgtggcctgagcaagtttctgcctacccctcgtagatatggtctccttctgtatgatctgaggtggggtgggcacaggggctgagatggtgcgatcctccgttactgttgctgacggcctgctctccacttctgcagtgaccagccaggagggtgtcattggtggagggttgccgggcacaggaggcgtcacacaagccacacctcaannnnnnnnnngggagggtgtcattggtggagggttgccgggtacaggaggcgtcacacaagccacacctcaaagagtagccaagatgcccacccattcaaagctgacaaacctttcgactcaccaggtcctcgttgatgaggtgcaattgcatcctgtgtcgttcccccagaggtgcgcctggatgtgagcccatatgtgcgtgccaggggcaggattttcgggtggctggccagccgctcaagcctggaggccacggcgggctgcagggacttggtccagatcagcttggagccctcaaggatgccctgccgcgacatggatgcgatggcggcactgagccacaaatctgtcattcttggagtacaggcagggcagcgcgcccgaggggttgtcagctcagggatgggagctgcgcgcacctgagttcctcccgcaagaattcctgcaacggtatataggaaacggatgctgctctggatggtgtacacactggtccagagtccggacttagcggcgccagcaaatctgtcgcccagcctgcgagcacgcgcggcatacgtggtcgccatcgtttcctctgactgtcagctagatctggagctggcaatatgatgtgttgatccagcatgtgtgtgtcctggatactcgcttccacatgctgaaggtatctgcttggaacctgagtgcgcnnnnnnnnnntggcatatgtggtcgccatcgtttcctctgattgtcggctagatctggagctggcaatatgatgtattgatgcagcatgtgtatgtcctggatactcgctcacacatgttgaaggtatctgcttggaacctgagtgcgctgcgttaaatattgccgggccagccctggcgcgcgcgcgctctggataccaatgtggtcgtccccgaagaggtttcttccacatttaaccttctggatgcacagccgccactccattcacccatccaatatagaaatcaaacagatttgcgcccgcttgacgactcgnnnnnnnnnntttcccgaacaggtttcttccacattttagcttctggatgcacagccgacactccattcacctatccaatatagaaaccaaacagatttgcgcccgcttgacgactcgacctggaaggagctctgcagtggccggcgggccgaggcacgcatcattgagccggcaggatggctgacacagtggtagagatgtcccagcaggctcagaaatcagctgcctccaggagggcagggaagcccaagcgcaagcctctcacacgagtcgagcttcgggcaagagcggcctaccgagcgatggagaagtgggtgtcggggctggagtcgaggacgagcgacagtctctgtgcccatatgagaattaacgtgggcacatcccatccttgccgtccctgcatgccgacctcaactcagtacctggctcgattgcccaaggcgctccctggctccatccccaggttgctggaggtgtctgggagcagctcagagcacgtgtggagcctggcacgcgtcatgagtgcagaggagtaccgccaggtgggtgtatgcggctcaggaaggttgcccattcagcagggcgtggatgctccggctgcgaaggggactgacctgtgctggcagagggcctcggattctaccagcgagtggaaccccccctccagcgttattttggctgtctgagcactaccaagtacatacacatcaaccacactcttccctgtcactgcagctggcccaggagcgcgcgctggccnnnnnnnnnncattttggctgtctggacactaccaagtacatacgcatcaaccacactcttccctgtcgctgcagctggcccaggagcgcgcgctggccggcctgtgtggccagccgacctgcgcctcgccccagccccagctcccgccccgcagggcgctgctgcgcctggcggagcccgcccccgaggaggccgaggaggtggacctcgccggggtcacgtgcagcccggcctgcgcggcgcaggccgaggccgtggcgcagcggctgggcggggcgcagcgtgcacagcagcgcttcgaccacctgtacgacgccgtgctcgagcggcgtgccgcccacgccgcgcccggcgccgccgccgtgccagcggagccgcaagcgggcctggcggccggctccgccaaggtccccatcatgcaggcccacatcaaggtgcgtcccgagatgaggcgtgcgcaagactccatgagagtttgcttgggcgtgcatggcttgagcgcagccgccccaccttttgcactgccccccgacccccctttcctccttgttttgccacagtaccccaccctacacctatcnnnnnnnnnntccaaggtccccatcatgcaggcccatatcaaggtgcgtcccgagatgaggggtgcacaagactccataagagtttgcttgggcgtgcatggtttgagcgcagccggcccaccttttgcacagctccccccctccctccttggtttgccacagtaccccaccctacacctatcctctctcttcttcacaggagcgtgcacctgctgcagctcctgtggcaccctccaaggccgcatcctccagagccgtggaggggtacgtgccacgatcctgccccccgccgccccggactgcctcggagcggcgcgtccactttgcggaggcggagccggccgcggcaccggccgccgagcttgctgccgccgtgccggtggtcgtgccccccaaggcccacttcgtgctggaggtggaggatgccatgagcccgctggagggggccggcgcggccgccatcggctcgctcttcggccgcctgcgcctgacaccggagggcggtgggccgggatcagacggcgacggcgaggcggcagaggcaccggggagggcggacgcagcagtggacacgctgtccgctgaagcttccgccgcgccgtcggccctcgagctcactgcagagcaggtcaaggggctgacgagcctcaacccgcgcctggcgggggtgctgccagtgccctctaccaagggaaacagcgcgcaggaggcgggggaggagcgggaggaggagggcgatgcctgggcgcccagcgacgatgacgagcaggggctggagctcgggtgagcctgcagcgctggggttgatggagagggcagtgggcctacgagcggtggcatgtcaggcatgggagacttcctgccgagaccctgcggcaatgctttggaccatctgcagtccgggcggtgcgggctgcacacagcttccaagaccttgccggagcaaccacaccagcaggcgatgctctgctcccagtacctnnnnnnnnnnccagcttccaggaccttgccggagcgaccatgccagcaggcgatgctctgctcccagtacctgctgcacacgctcacatcctcacagccgtgccgctacaccctcccctttctccccacccagctcctccgacgacagcgagacggagctggtgaggggacaggggcccaaccgtccccggctcacactctccaccttcggcctgctcttcacccacctggaagcctgggtgggcgaagccacgctggagctcctgggttccggcccaggcgcgggacctgccagccacgcccccgcgcatgacaggccggccgctgaggcgctgctgcgtctgctgcaggctgtgacccccggcatctgtgccgagctggcgattgcccagctggcgcaagtgcaggccgccctgacccagctcgtggcctcctttggcgtgcgaggggcgctgccctccttcaaggtgccgtgtgtgtgctggtgtgcatttctgtgttgtgtgcatgcttgtgttctgagcgccgggtgcaggcaacccccagcaccttgttggcgtggcgctcattcacaccatctggggaaacaagagcgcccagttcccatggctgggcccatccccgaccgatcccctccctgcaccccgaatccaacagacggggcagtggcagctgctgctcatcatcctgctcaaggcactgtccatgcagcgggcgcccttcctacggccggctttcgagtcgcgcgagggcatcagcaggctgaacgctgccctagccaaccgtctgttcaccatcgaggagttttatgccgtgctggagctggtggtggtggaggagacgcagtgacccatttgctggcgtgcccttggcggccattcccgcctgaattcatgctgcaggcatgacctttaagccagtggcttttccctgaagagaggggttggtgagaaacagtctactgcagttcatcaccctccttccttgttcatggtctcgctcatggagagggcccagatagcgtcttaacgtgaggatttgtcagcgtttcgccgcatgagagcttccgtcaacccgtcgagaccagccgcgacgccaatgcaccaaacattcccccctagcgccatgatcctttcaagcactgatttgtgaacctgctacccaaggacacggccgagacccggcctgnnnnnnnnnnattccccctagcgccatgatcctttcaaacactgatttgtgaacctaatacccaaggacacggccgagacccggcctgagccatgccctcctcccccactgaaatagactggcggggaatcaaatgtgaggcggaatcctcctcagcctcgggagacttcatgaggtctgtcgacgagtacaggcgcgcactggagggcctggaggccagcacctccggcccgcaggagcgcgagcgggcggagctcctggtggcgcagtgcggcgccctgctagagctgcacgagtgggacgcggccgctggtgtggctacacgcgcggtagaaacctgccctaactgggaccagggtgcgcggggccatgtcacggacaggtctcgggtggcaggggccgagcgtttgaaaggggggccgggaacttgtggggatggcaccccactcgtggcatgcaggccacaatggaggagtctggccatccacgcacctcatgcctcccttcccctcgcagcgtggttggtgctgggcaaggccctgcgcggcgcgcgcaacatccacggcgcgcggcgcgccttccagatgggcctccaggtcgacccttccaaccgcacgctgtccatgctgctggccaagagcgtggcggaggcggtggagtccgacgccagcgaggacgcggcccgcgcagccggcggcggcggcggccggcgcgagccctcctccgtgctcccccaagatcaggaacccgcgctgggtgactccgacgctctctcctgcgacgaccccggctccaccgcgccctgctccccccgctgcactgagggcgaggaggaggggcccggctccaccgccgccgtggccgcggcggccgaggcggccgcagcagc

SEQ ID NO: 31114 - DNA, 71 bp, Chlorella protothecoides
cgtcagggtgaagctcctcctgctatcaatactgaagtcgtaatactgagcgacacattccatttcgagca

SEQ ID NO: 31115 - DNA, 75 bp, Chlorella protothecoides
cgcgcgggtcggtactgatctccagcctgaaaggggtttgagggcgggggagggtgtgcggagggagtgaatatt

SEQ ID NO: 31116 - DNA, 61 bp, Chlorella protothecoides
ggtgcaagatgttcctgggctgtgaccgtcaggaggtgtgtacagacccttgacctacggc

SEQ ID NO: 31117 - DNA, 99 bp, Chlorella protothecoides
gggcagatggcggggggaggcacgagtgacggttcgtagggccagcatcgccaggcgtgggttccatgccgagctgagggggtgggcctggtctgcaga

SEQ ID NO: 31118 - DNA, 61 bp, Chlorella protothecoides
tgccagggtctcgtcggtctgggcctctgctgccccctcatcgccatgccctcccgccgcg

SEQ ID NO: 31119 - DNA, 185 bp, Chlorella protothecoides
tctgtaggttacgttgcatattgacagagtaaggtcatccaagggccacacagaccggaggttaagtgcctttaaaacgctacctctcccacccccctgggcgaccctgtaacaaatcatccacctctgatcggcattactcggacactgaatggccttgatcaggtttgcgcaccatcgcagag

SEQ ID NO: 31120 - DNA, 126 bp, Chlorella protothecoides
attgcacctgcgcagaggtagtgggtggagagtaatgctcgggtcgtgaagcagccgaacttggtttcatgaaggaacatcctccttttcatacatttccgatcatcactgctgctctgaataata

SEQ ID NO: 31121 - DNA, 121 bp, Chlorella protothecoides
ccattctgcctccagaacaatcctttcactcgtcctccaactcaaggaggcagtccccactacaggacgggtatctcccggctacaatggttcgacactcaaaagtccagccattctcggt

SEQ ID NO: 31122 - DNA, 61 bp, Chlorella protothecoides
cggagcttcggcgcccacgccgcacctcggaagcggaactcccggtcgccctgcgcaatct

SEQ ID NO: 31123 - DNA, 68 bp, Chlorella protothecoides
gaggactaaagtatgatatgtagcatccgggcttgggtgtctgggattcgtggcctcctgtcgcgcgg

SEQ ID NO: 31124 - DNA, 103 bp, Chlorella protothecoides
ttgcctgtgggttgtgggagtttgtgggggccaaggcagttggttttggtgggaaaccatgataccagagggctcaaacagggcaacacacaagctttgggac

SEQ ID NO: 31125 - DNA, 142 bp, Chlorella protothecoides
tcgagatcctccagccttcccccgtgaccacgagatggtcacggggagcggccacgtgccaaaatcttctgacaacttcgctgtggtattggctccgaggcatgctcgagtttctgagtagctgatatccgaggtacaactg

SEQ ID NO: 31126 - DNA, 69 bp, Chlorella protothecoides
gccccgcggcctccccctccccggcggccagcccggcggcctccccctctccagcggccagccccgcat

SEQ ID NO: 31127 - DNA, 804 bp, Chlorella protothecoides
  modified_base (117)..(126): a, c, t, g, unknown or other
  modified_base (661)..(670): a, c, t, g, unknown or other
gggctgggaggaggagacggcggcggagggaaggttggtgggccgggactttgtacgcacacagcgttgtagagggtttcctcgtctacttctgtggtgcagacgatcaggaagggnnnnnnnnnnagggtggtgggccgggactttgtatgcacacagcgttgtagaggatttcctcgtttacttctgtggtgcagacgatcaggaagggagatccgggatagttgcatgtgccgccggacgtgaactggaaaaaagccgggcatgccgagacacctgttggaacagttgcaatgcagacggccgtggggacacttttcagtgtgcagatgctggggtaaagccccgcaccgcatgtgaacgaggtcaacacgggtgcactcgagcaggcttcatttggggatggtggagggctgggaggtggtgacggcggcgggggtaagggtggtggtggggatggtggagacattggtggtggagacgggggcgggggtgaggggggggaaagggatggaaggctgggtggtggagatggtggcggcggcaacggtggtggggatagtggagggctgggaggaggagatggcggtggggggaagggaggtggagatggcggtggtgaggatggatggggagatggtggagggctgggaggtggagnnnnnnnnnncggtggtggagacggtggcggggggaaggggggggaaagggatggagggctgggtggtggagacggtggcggcggcaacggtggtggggatagtggagggctgggaggaggagatggcggtggggggaagggag

SEQ ID NO: 31128 - DNA, 80 bp, Chlorella protothecoides
acttcccacctcggcctggtgccctggcacagtgtggcgcaatcaaaactctggcacaggacagcctctgctgtgtggac

SEQ ID NO: 31129 - DNA, 61 bp, Chlorella protothecoides
gcagacccgttcaagacctcaaaccagcccaccacctgccgttccacgctgagcaggctct

SEQ ID NO: 31130 - DNA, 87 bp, Chlorella protothecoides
gtgagtgtgatgtggtcctcctgtctggatttgggtgcccttgctgtgttggatcgcatgcaagtccgggagtgcagcgttcaattc

SEQ ID NO: 31131 - DNA, 77 bp, Chlorella protothecoides
ccccgccgtatgtacaccccaccaaccatcaacccacccatccatccatttcacacccccagattgaggagttgact

SEQ ID NO: 31132 - DNA, 112 bp, Chlorella protothecoides
aaagaagaaggggctgggcatggcattgggcaccgcggtcaccgcgccgtgcccgccacgcccgcaggacgccgtttcctcctccaggtcgagcaggacgaggcagaggcgg

SEQ ID NO: 31133 - DNA, 77 bp, Chlorella protothecoides
gcgacagtgggaggccggggcggatggagaagcaagaggagcaggaacgtgggccttccaggcggcacacgcgcagc

SEQ ID NO: 31134 - DNA, 61 bp, Chlorella protothecoides
aactgcgccagcgacatcccgtcctcgggagtaagctgctagcaaccggcgcaagcccggt

SEQ ID NO: 31135 - DNA, 71 bp, Chlorella protothecoides
tcaacaatgcctcccgcatgtgagatggagtggcatgaggtttacgacatgcgcagggtcttgcatgtcaa

SEQ ID NO: 31136 - DNA, 9776 bp, Chlorella protothecoides
  modified_base (133)..(142): a, c, t, g, unknown or other
  modified_base (742)..(751): a, c, t, g, unknown or other
  modified_base (1697)..(1706): a, c, t, g, unknown or other
  modified_base (2112)..(2121): a, c, t, g, unknown or other
  modified_base (2410)..(2419): a, c, t, g, unknown or other
  modified_base (3012)..(3021): a, c, t, g, unknown or other
  modified_base (3131)..(3140): a, c, t, g, unknown or other
  modified_base (3257)..(3341): a, c, t, g, unknown or other
  modified_base (3543)..(3552): a, c, t, g, unknown or other
  modified_base (3662)..(3671): a, c, t, g, unknown or other
  modified_base (4519)..(4528): a, c, t, g, unknown or other
  modified_base (5385)..(5394): a, c, t, g, unknown or other
  modified_base (5653)..(5662): a, c, t, g, unknown or other
  modified_base (6627)..(6636): a, c, t, g, unknown or other
  modified_base (6731)..(6740): a, c, t, g, unknown or other
  modified_base (6830)..(6839): a, c, t, g, unknown or other
  modified_base (6927)..(6936): a, c, t, g, unknown or other
  modified_base (7203)..(7212): a, c, t, g, unknown or other
  modified_base (7776)..(7785): a, c, t, g, unknown or other
  modified_base (8672)..(8681): a, c, t, g, unknown or other
  modified_base (8764)..(8848): a, c, t, g, unknown or other
  modified_base (8929)..(8938): a, c, t, g, unknown or other
  modified_base (9491)..(9558): a, c, t, g, unknown or other
agtacatgagattgtggacggggcccgggagatccattgcgcacgtctgtaagcccgaggcaacaccatttcccagcccatcccacccgcctcaagcttccacgcgcctcggccacccccgcagccggacacnnnnnnnnnnaatgcattgcgcacgtctgtgagcccgaggcaacaccatttcccagccccatcccacccgcctcgagcttccacccgcctcggccacccctgcagccggacacgtacatggcggaggtgctggcggcggtgtcgcgctttccagacatcgaagaggtggagctgggggccgacgggcggtggcggccggtgggccgggcctgcggacccttcgacatcagggacggcgtggagggcgccgcggcggcgatcgctggcgcggcgagcggcatgcccgcggggtcggcgagggtgaaggcggaggccgacgcggcggagggcgcgtcgggcagcggcggcgaccacggcgccgcgagcctcgccgtggacagcgagacggacgaggaggaggagctgcgggccgccgcggccgccgtgaagaacctggccaggccccaggtgcgtggcgggggtggtgggtgggtggtcgtgcttggaatcggacgcatggggcttgaaggggggggcctggtcgacgggctgcagtcgcggggttgagtccctttcctacctcctgcactcgagcaccctctccgcttggtgctcgcggcgacctcccccnnnnnnnnnnatcggacgcacggggcttcaagggggggccctggtcgacgggctgcagtcgcggggtcgagtccctttcccacctcctgcgccgcgagcccccactccgcttggtgctcgcggcgacctccccccaaccacacccaacgcccatgtccagaaacgggcggcgccggaggtcatcgacttgctagactcctcggacgacgagatggcggcggccagggccccacggccagtcccgcccgccacagcgaatgcacgggccccgcccccctcgccgccgaccatggagtcgagtggctctggggcctcccgctaccagcagcccagcgcgccctcaggcgcctccacctccctccgcccgctgtcccatgcggccccggcgccgccgcactcacgcgtgcttgggagtgtggaggcaggccagcagcaggggggtccccccggctcctgtctccagccaaccagcggcttcacgctggccagtggcggcggggacggcagctcgggcttcctccctccacgctcattggcggccctcgccggcaacccggtgtgtaccccgcccctcccgctggcacctccaaacgaggtcacactgcccgtgcccaggcaggtcggcgcgtcccgcctgcgcctgccgccgcagccgccgcaccacctgcccgaccacctgttggacgcggcggccggcgcgcagctgtcacccagcacgcgcgcggcggccaacgcggcgcgcgaggcggcggccgccagccgggcctttggcgccgtgccgatgcacggcttgggggccccggactgggctggcctgcaggcgccggggtacggcgtgtgcatggcgccggcctcaggcgcgctgccgacctgggacccgttccaggcgctggcacaaggcgtgctggcgggggcgggcgggcctgcgccgcccaacggcatggtggacctgcagnnnnnnnnnngcgaggcgtgctggcggggacgggcgggcccgcgccgcccaacggcatggtggacctgcagcggctgatgggcggcgcggcggtcacgggattgccgggcggggcggccacgggattgccgggcggcgcgccgccgatctccgtccccggcctgccagccatgagcccctccaacgcccaggcctggctgctgtcggcctaccaggccatggccaaggcgcaggcgcccgcggcggggcggcctgggttgtccccggggatgggcggcgtggacgcgggcggccagccggtgggcgctccggcgcacagcgcagacgcggcgcgcggcgtcgacgagggcctcggcgtccccgcgccgggcagctccggggaggtgtgcaggccggcgagcgcggcgcaggggggnnnnnnnnnnacggtggggcggcctgggttgtccccggagaagggcggcgtggacgcgggcggccagccggtggacgctccggcgcgcagcgcagacgcggggcgcggcgccgacgagggcctcggcgtacccgcgccgggcagctccggggaggcgtgcaggccggcgagcgcggcgcaggggggtgccacttcgggactgagcgtgcccggacccgatgcagccagcgctgcttctgtgccgcacgaccccggccccagccccgggtctggaggtcaggcctcgccgcggacgcccnnnnnnnnnnccccggacccgatgcagccagcgctgcttcggtgccgcacgaccccggccccagccggggatctggaggtcaggcctcgccgcggacgcccttcttggcaaggggtggctccgcccagagcagggcagacggcatcgaaccagcggtcctgacgtcctcacccgccccggcgggctcgagggggatgccgttctggccagggagcatggtgccgctggatcagccaggccttgggtcgccggcgggcgatgtgtgaggcgctggcctgttttttcatcctgccccttctcacagatacgacgtagccttgaccgttctgaaagccttgcacgcccgacctgacccctcccttgatgtcacaacattccgcacccagcaatgctgccccaaccagcgcgcgagattcccccgtttgacgggggccgaccccaccccagcggggacccccaccacttcctctcctgcatttttaatagcacaaaggcagaagatcgatcaaccattgactcagctccagctcacagtggatcacctgggagcagcaactgctcgggggaagtgccctccccagtgtccccgcgccatgggcgcgnnnnnnnnnnggtgcagagcgcgagctgtacccacccccacctggaggcgtcgacgcccggtcatggggtgaagaaacgccgggctgagtttgaaccactcttcctcaatcaccctcccnnnnnnnnnngtcaccggggagcagcaactgctcggggaaagtgacctccccagtgtccccgcgccatgggcgcgaaacaggtgagccctgtcgagggcagaattccgagtgcacatacatatgttnnnnnnnnnnnnnnnnnnnnnnnnnnnnnnnnnnnnnnnnnnnnnnnnnnnnnnnnnnnnnnnnnnnnnnnnnnnnnnnnnnnnnagaagaagaagctggtgcatggcgagcgcagccaggcctggctggatcgccaggactcagagacacgcctgatcatggaggatctactggaaaactctgcctttgaggacatcgtgaaaccctcgacttctgagggagggaactcgtccaatatcagtgaggatacaagcgccgggctagggaatagcactgcgcggaaagnnnnnnnnnnagtgcagagcgcgagctggacccaccgccacctggaggcatcgacgcccggtcatggggtgtagaaacgccgggctgactttgaaccactcttcctcaatcaccctcccnnnnnnnnnnttctgcctttgaggacatcgtgaaaccctcaacttctgagggagggtactcgtccaatatcagtgaggatacaagcaccgggctagggaatagcactgcgcggaaaggtgcggcacgtcgcagggtcaggcaaaacttcctgctttctaagagggccgctgagctcgagcatccgctggcccactcggcgtcctgggtgacattgctgagcagcagcgacgaggaagccagcgatgagggcggcgagggcagcgccggggcgggtcggggagtggactcccctacaagccaggccggtgggagtgctgccagtctgcaggggagcgtggcgcccgggatcatcagtagcaccttggcacagcaacgcttcccggtcggtggcaccggcaagcagccgggagcgaaagccaggattgccaagccgatggcagccagtgcccagcgcaagacggtacagatgagctccatcgccaagacgccaggtgtgcgagaggggcggcgctggcattgtcgtgtcagtgccgtgccggctgatgtatttggccgctgctcgcaggagggttccctgcatgtgtaagcatcagggccagagggtgggtggtcgcccccatgtgcccgcgcgcacagccgccgaatcgaaagcagcccgccctgcctgccagatgggcgaatgtttggctgcgctggctgtgtgtgtgaatgagttcccgcagcagcaccaccccgcacatctgggccccagcgcccacgaccttctttccgttttcacatcgagcattccaccctgaaccccccactcaccccccaccccgtcaatcaggctacaaggccgacctgtccatggagannnnnnnnnncgaaagcagtccgccctgcctgccagatgggcgaatgttttgctgcgccggctgtgtgtgtgactgagttcctgcagcagcaccaccccgcacatctaggccccagcgcccacgaccttctttccgtttccacatcgagtattccaccctaaaccccccactcaccccccaccccgtcaaccaggctacaaggccgacctgtccatggagacgaccgaggcgaagcgggcggcgcggtcgatggcgcgtggcttcgaccttgctgcggtcgacgcctacttccggcacgctgttgagacggggctggagcgcggcgacctgcccggcgtgaagcggctggagctgtgccaggtgcgcgccctggcctccctgtacggcctggagatcggcggctcgccctcgcagccagccttcgcggccacgccgcgtaccgtgctgccagcggggcgtgcggcggcggccgcggagatcatgctgcaccagttctcgctgcgcgctcggtttggggccgcactcttgctggccgagggcaaagccactgggaaggagaaagcggggcgccgcgactcgcgcgagtcggtggtgaaccgattcgcggaggtgtatgcgcgggagctgggcctgcgcgcgccgcgctgggacgaggagctcgtcggcgagcgcgccgtggccgcgcggcggctggccgcggaactggggcgcgggcggccgggcgcggaggaggcggtgcaggcgctggtggagcgcggagaggtgatagcggtggggaagaaggccgcgaagaagaagaaggcggcgggaaagcagttggaaccacaggaagagcagcagcagcagcagcagaagaagaagaagannnnnnnnnngaagcagttggagccacaggaagagcagcagcagcagcagaagaagaagaagaaggagaagaaggagaagaatccgagcctgccagaccggggtgagcgcgagaggatgggggactagatctgggcggggggagggatgcttaatgatggggctcccaccagcgggcgtattatcataatgcatgctgtgagcacgacttgtcgtgcctgggaattgcaggccacattaattatcctggagagccccgccaggcgacannnnnnnnnntgagaggatggggcactatgatctgggtggggggagggatgcttaatgatggggctcccaccagtgggcgtattatcataatgcatgctgtgggcacgacttgccgtgcctgggaattgcaggccacataaattatcctggagagccccgccaggcgacactcatctgcaccgagcacattgagggagggacgctggttgggccagcctgaagcctgatagcctcgacgtacatgagattcttgccaacacagcccctccatcacacctgcaggcctggcggccaagcccttggtgcgtttcgtttcggcggggacgctgctagacaacgggccgtccattctgcagccgctgaagccggccacgtgggaggacggggcgggcgaggctgcacaggcgcacccagactccggagccagcaaggcaaggctggtgctggatgcgaggctggcgggcggcgagggcctcgcagccgagctgctgcccgtcctggaggacactgcagggggaggcggggaaggaagtgcacccttgtaccataggtgcgcggcggtgtgatccacggggaagcggacaggaggtttggatcaaaaggaggacggtttcacataggagagggcggcaaggacggggcggagaggagttgcctctgacttgggaggacagaaactgcaactgtgtgggctcagagctcgtgcttgcttggaccagtgcccgatccatgctccctcaaccgccctgacgctcacctttctgcaccccacagcacggcgcggggattggcgcttcgcagggcggcggcggtggcggcggtgactgcacccatgcagcagctgtcactggggttgaccaaggggcctggacttgtgaccctggcgggttcaggtgattgcttggttccgtagtgggatgggccaccccctctcctatagcctggtggagggtagaactgctttgcgttcccannnnnnnnnnagggaagcggacaggaggtttggatcaagaggaggacggttctcacataggagagggcggcaacgacggggcggagaggagttgcctctgacttnnnnnnnnnnactcacctttctgtaccccacagcacggcacggggattggcacttcgcagggcggcgggggtggcggcggtgactgcacccatgcagcannnnnnnnnntgccaccacatcatccacactcttccaacctcccagacgaggaggtgagcgcccttgtggcgctgcagcccatgatgacgaagcaggnnnnnnnnnnagccaccacatcatccacactctgcccacctcccagacgaggaggtgagcgctcttttggcgctgcagcccatgatgacgaagcaggaagccaaggcggcccgcaaaaaggcggcccgcaaggagaaactggcccttgaagggcgggcggcggcgggtctgccaccaccgcccaaggccccccagcatgggggaggggccaggatcgaggccatccccttgccaccccggaaggataagcagaaggtggccaagaacatgggttacnnnnnnnnnngagcatgggggaggggtcaggatcgaggccatccccttgccaccccgaaaagacaagcagaaggtggccaagaacatgggttacggccagttcgagcggcacaccaccggcatcgggtccaagctcctcagcaagtggggctttgcgggcgaaggtgctgggctgggcaaggacggagtggggctgacagagccgctcctggtgtcgcagcgtgcgaggcagcgaggattgggggcgtaggcggggctgcaaccgtcactcaacgaatgttatgtattttgttgttgccaaaacatgtattcctttccccatgtgacccattgttgaccccggaagaggcgctcctcctggttctggtgtaaagacacttacagtattacattccggcacagatgggactcacaaagcttgctctggtcgagcatgggacctttcgaccccttcacatccatccattcatttatttggactgatttctggtatcgagcttgcgacccacccggacctcgtacggggcacgggtcgcaaggttattccgtgctttctatcgcataagaaagttcnnnnnnnnnnattatttggactgatttctggtatcgatgttgcgacccacccggacctcgtacggagcacgggtcgcaaggtttttccgtgctttctatcgcataagaaagttccacacagtccctcggtaaatttaagtctccggccgtgccccggaacgctccatttcccatttcgacaattttcttttctgtcggaactaaaaatttcaccacgctgcagatatcacatgcaattttaggtggtgaaagcagcgaaggagggccctccggcctcgctgttgcgatggtgcaggccgaggatgctggcgccccgatgggtgcgcccctaccaaaggggctcaggatgacgttccgtctggacgacggaaccaccatccgaagctcaggggaaggcaaggctaccgttctcaaggccagggagtcgtatgccgcggggttgctctccgagacccacctcctgcgagtccaggcactcctgtgcgaggtccacgctaaattgccggacgaggggcccctcaagaccctgtccctcagcagcaagcgcagtgccgagactgatgtcgaggtaggcacgggcattctgctgccctgctggttgggggcgttgggtgctccccacatacccttttccccttgggatgtggtggatgcacgccccagccagcactgccccgcccacgtatcgatacataacatgaagaaaatcatagttgatgccatcgacagcacaatcacacggaccctttacaggctctggacatcgtctctgccaagcggtcgcattccctgaatgggcatggaccgacagcaggtgccttgggagtggcagggaaggatgggtccagcgcggccatgcccagagcacatgcatgtttgtgtagtagaggggagacnnnnnnnnnngacatgaaggaaatcatagttgatgccatcgacagcacaaccacacggacccttacaggctctggacatcgtctctgccaagnnnnnnnnnnnnnnnnnnnnnnnnnnnnnnnnnnnnnnnnnnnnnnnnnnnnnnnnnnnnnnnnnnnnnnnnnnnnnnnnnnnnncctcacgaatgcatttacgcgctgaacgctccccccgtcccgcgcccctcgcccacagagacggcgtcggccctgccctcnnnnnnnnnntctcacgaatgcatttccgtgctgaatgctccccccgtcgcgcgcccatggcccacagagacggcgtcggccctgccctcgccgcagtcggctgcccccgcgcccctcgccccgcgccccatcgtcccgcctcccgcctaccctgagccctttgctggccgctgcctggccatggtggacaaggtgatcaccgccctgggggggcccaaggatgccgcagcgctgggcttcacagtggccgtggacgccaagctggtgccggactactacaccatcgtgcgcaaccccatccacctgggcgagattcgcggccgcctgcgcaagtctgcttacgccgatccgtccggcttctaccaggtggggggagagatggttggtagaatgaaaggggaggggagggggtgacggggtgacgtgattcctgctgccgcaggccggcaacccatgctgtgagcctgtgccctggatccctgctgtgctacatgaatgaccctcattgggcccgcgcctaatcatgcaatctgcatcatcaccttgctcagacacccccccnnnnnnnnnnnnnnnnnnnnnnnnnnnnnnnnnnnnnnnnnnnnnnnnnnnnnnnnnnnnnnnnnnnntctctctctacgtatcaggatatgcacctcctcttcgacaattgcttcctgtacaacccggagggcacggccgtgcaccgcctgggctcggtggcggaggccacctttgagcgcgagtgggcgcgctcgccgtacaccgcgctggtccccgcgcgcgcgctggccacgccggcgtacgacctgcccgccgcgccgccgcgcaagcccaacggcggcgc

SEQ ID NO: 31137 - DNA, 80 bp, Chlorella protothecoides
tacacatgtacacattcacaaaatacccctcccccccaaaaaaacaatttcctctgcaaggctttgcgctcaccagtgcc

SEQ ID NO: 31138 - DNA, 77 bp, Chlorella protothecoides
gtacgacagagaccccaggccggcggggtgccggcgggggggcgaatttgcctcctaccttgtacaaagatctgcga

SEQ ID NO: 31139 - DNA, 91 bp, Chlorella protothecoides
atcgactcaacgacgcgcaccccacgatcatagccatgccaaggctcctcaccaccccaagcaagcgacatcgccacacctcggagggggg

SEQ ID NO: 31140 - DNA, 3644 bp, Chlorella protothecoides
  modified_base (121)..(378): a, c, t, g, unknown or other
  modified_base (1419)..(1428): a, c, t, g, unknown or other
  modified_base (1824)..(1833): a, c, t, g, unknown or other
  modified_base (1898)..(1907): a, c, t, g, unknown or other
  modified_base (2838)..(2847): a, c, t, g, unknown or other
  modified_base (3420)..(3429): a, c, t, g, unknown or other
agttctcgtcgttctcgtgctcggtgatgggaactcggttgggggccatgctccgtggtgtatgtcgtcgaggaccgtgctggagtggatgaagtggaggggcgggagtcctgcagaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatcaggggacagaccttgtcacaaacgtggccctaacccatcgaccgtggtcgcatacgccacacgtggggatgcgtcaaatcccttcttcacgcaccttggcattatatgctctgggtgtcttcaagagtgccctgatcaggaacaggacgggagagcccgcaccgcagcggcagagcgtgaggccgtcgggattgggtgccaccggaggtggcaccacatgccgtggttgtccagtatacacactcaagcagagtacctgtcaaaactcgcccgagtacgttatttccgtgctggccttgaagcagcaaggcccccaccccttgggtatctggactgatctgggcatcccagggcctatggtggaccatcacaggctagggtttttgccttggggagggaggggagctctcttgcaaatcatcaatctagacgcagaacacactacgagggtatgtgtgcggattcaatggggaggctggggggatagtgattgcagcactctagctttggggcctaagccagggcccctggtgtggtcgaagtggttgcagactgataatgttacagagcaggcccaggagggttgcaattcgatgtttcaagggtcgaatttgcgaaagtggccgtttgtcatactgcaagatgggaaggaccacttcctgagcagaacaaatgcagctgtggtcggggtcgaacaacaaaaaattaggaatcggcgtccgtgtggactgcgagggtcatgcaaggacgtcaaaatgttgcaaatgcttgtttgttaaagtgaaagggccgagagtgggaaggaaggggtgattgaggggtcaggaacgtatctttagtaaaagaatggctccaaggcggatcgaacgcctgaccttggcatcttcagtgccacgctctcccaactgagctatagagcctctcttcgtgatttctcggattttcccagcgcctattacccacacgtttgagtttctgcattcaaaatcagtcagcttaccaattccccccattcccattccactcttatccgaannnnnnnnnncaggttctgcattcaaaatcagtcagcttaccgatccccccccattcccattccactcttatccgaagtctcccgcatccaccatttgcaattctgacgagtttgagcaaccctgatcaaccatggcaatgaccctgggcagtcttgcagctcatcttgtcgcacctccacacagcagcacccctccattttggacctggagtgctcttgaacgccacaacctcgcctcctcaacctgcgcttccgtttcactggaccatccaccacttgcaattctgtcgagtaaaaatgcctgtttcatcattgcaatgacccagacactctgcagcctatgttgtcgcacccctctagtttagacctggagcgctcttgaacgccacaacctcgcctcctcannnnnnnnnnatttcactaggggtaatcaaaccctcaatctgatccaacctctagccacccgagagacgtcatgnnnnnnnnnnaggtaatcaaaccctcacgctgaaccaacctctagccacccgagagacgtcatgtcttgcgatctcgccttggccactctgcaagtgctgttgttgcactcttggcagcgcaaggccccttgcgagagagttcctctacgcaatacctcgctgcatcttccgagcaccaactacgcttgattacccaatcctttgcagtaccccaagagaccctgcaatgccactgcaacgacctagacagcctgtaggtcctgatgcacatgtacagtgcaacacctccacgatacgtcctggagtgcctcccagaagaccatctcgccgcctcacccgcgttcccactacacgatctcatccatacctctacagatccaacactctcacaccctggattgccattgcaacgaccttatcagtctgcaggtcgtgtagcacttcgacagcctaaaagctcttcgagatggatcctggaatgccccaccctcgccaccttccccgcgctcctgttccaggagctcaacggaggatggtgtgcaaagtcaatccacggcagggcgtgcagtatcacttgcagcgtgtcattatgtcctctgctgtttgtcgctgctgaggctcctatactcgccagatcaaacacctcacagggtaatggtggccgctggagaggcaggcacccagctacctgtccgttgctcagcataaaatgacagctctacctgctccattcacgatcacaggtgtgcacccctcctgcgcatcgtggggagccggctgtcgctctgcagctccttggaagtgggagattccaagatgctgagggctgaggctaacacgccaagcctgtgaggcaacaggccctttcggagagcattccttgctcagaaacgccgcccaatccccatttggtgaagttgaatgtgcgcatggacacttnnnnnnnnnntggagagcattccttgctcaggaacgccgcccaatccccacgtggtgaagttgaatgtgcgcatggacacttgatgcattgttgcatcccctcatcaatattgaaccgagatcacatgttgctccctgtcatgccgatgaaccaagcacaggcagctgttagcaatgactccccacatgtagtccagggcgatcttcgatatcacaacggtcatccttttaaatggaaaagggcttgtgatagacaagcgatacagcatgcaggggcaggttggggcgatttgatggtgtacatggaaaggactcatgccgcagtggtggctccgatgaccaaggggcgcaaagagcaaggatgtttccagaataagagcaaaggacgagggtgggaaagccggggtcgtgcaacgaccatcgagtgaattactatagttaccagaataccaagccggaggtagctgaaagtcttcgacaaaaagtgcagtggctgtgccatcttgggtgcagataggtgggtttaagctgtcgtcacaggtgaagccagagttgagtagggaggctcctgcagggcaaatgnnnnnnnnnnctggctgaaagtcttcgacaaaaactgcagtgattgtgccatcttgggtgcagataggtgggttcaagctgtcatcacaggtgaagccagacttgagtagggaggctcctgcagggcaaatgtcaactggagggctggggcttggactgaggaatggagaaagagaaggagcctcctcagggcggggggctggggctggggctgggtgactcctc

SEQ ID NO: 31141 - DNA, 6427 bp, Chlorella protothecoides
  modified_base (3050)..(3121): a, c, t, g, unknown or other
  modified_base (4369)..(4378): a, c, t, g, unknown or other
  modified_base (5200)..(5209): a, c, t, g, unknown or other
  modified_base (5271)..(5421): a, c, t, g, unknown or other
  modified_base (5567)..(5576): a, c, t, g, unknown or other
  modified_base (5656)..(5665): a, c, t, g, unknown or other
  modified_base (5732)..(5741): a, c, t, g, unknown or other
ccacccccccgttcccccaccacccctgccaagatttgaaggcgtttgtccccctcctgaccgaggcggcccggacatcggccttcgaggccgacatggccttcttcctgggcccggactgggaaacccagctggtccgtacccccgctgtggaggcctacgtctcgcacctgcagcacctggaggacaccgccccgctggccctgctggcgcatgcctacacccagcacatggccctgctggccggcggccgcctgctggctgccagcgtggccaagggcatgggcctgcaggccggcggcgccggcaccgcggccttcaccttcccgccccgggacaggacggggcggggcctgcgcggcgactacaaggacgccctgaacaagctgggccgggagctggacgcgccgacccgctcgctcctcctggccgagcacgcaaaggccttcgagctgaacaacgccgtcatccgcgaattccacatcggcctgcagcggcccctgctgggctcgatccgcctggtctgccagacgtggtggatcgcggcgcccctggccctcgggctggcgtacacggtggccagatactcttccctgttgccagcaaactcctgagtgttctaggcgaggagccttgcccatcttgcaccctgtttcattcaacctgtcgaatgtgttcctcccatctcattcggcagctcacacaccctcacagtcgcactaacctccttcactcctcttgaaactcgctacgttgccacattcctgttcctagcttgtgtgcttgtaatctttgcagagggcctgaggatgcaggggtgcaaatcggggagtgttgtcatgcatcgggggggagcgcgcccgcccgctgggagggatgtcgctgtgcatgtgcacaaatgtcgacccagtgccaccccatcgcaagcctgattgaaaaactacacatctgccttcgccatgacaagcccagatcaagtgctgggccccaaaagccgggccgatgctctggcaactgtctcggggtcgccctatgtgctggtggggtgctcctccttccagggccagaaatggacgggagggatagcgttgatccgtgaatcgaatttaagcggcgaggctgctggcctcgtacaggcttgcgtcgagatgccggccggcgtgccggcgctggtgtgcttgagcgaccgggacccattcacaggttggtattgggctttacaacccacaccacgacgacacgcgggaggaagacactcctttttcgttatgcagtacctctacagtcaccaccctttccccctgacatgcaggtcaggtgattgcagtgagcggcagcgacgacggcgcggtgggcatgtggagcgtcagcaccggcctgcagccctccatacaggaagcgtcctctgtccggaggcatgatgacattgtgggtcggggatcaggtgctgggtgctgttgtatgaccccagactatggagtaggggcgcctttctgtgacaaggcaggaaggacttccacacctcagcacagtcatccaaccctctctccacccctccacctcttctatgccaccacgacaggtgtcatgcattgctccctccggccaggcgtcatcacaggtcgtcagcacctcctgggacggcaccgcagtcctctgggactgcacctccactggcccgcgcagggtctccgagctgcgccccgggcagcacgctgtgcacgctgcggcctggtgcaattcctcggtggcgctggccactgccgccgacggctgcgtgttctgggacccccggtctggggaggcgggccgcagcggcctcgtgggtggcgcgagggagctgcagcgggagggggtggctccgggtccggcggccgcccgggccggactgacggctgtggcggcgtgtgagaacgagcaggccgtttacctcggcaccgacgccggcggcttgctgtggctggacagacgagcggctgggggcgggcgcccgcagaccctggcttcgccgcacacagaaggcatccggcagctgctcctaggcggtgagaatggcagcatcctggcttccagcgacaccgccgggaaggtggtgctggcccacaccaccgacgcggcgcttcagcgcgtggtgcatagcgcggcggtgcctggcgggctggcgctggggtggcagggcccccagctgctgctagggggtgtggccggcgtgcggatgcttgcgctggaggactgcacgttttgacatgtgcggtgatcctgcatccatttcaaccctcactgcagtcctgtcccaagccatctggatgagtatgcattctctctcccacccatctccacttggttctcaacaccactgcgtgacaattcaacgaaccccacagcaagctttcagtgggtgattttgcttattctatggcatcatatgggcaggcaatgacaagatagacccctgcatgcagccagcagcactccccccgcacgccgccctacagttcccgcaggaatgccgagatgtgggtggccaccgttccaggtatctcctcctgaggaacatgaccgcactgcgacagcatcaccagttttgaccctggcaacgcctgtgccagcgccctgctgttggtcgcagggatggcacgatccccctccccgtgcacgatgaggcacgggataccatgccgccttaccacctgatgaaggggaggaaggcatgctgcagattggtggtatgcttgtggttgctcggcccagtgcgtgatgaggaggcatatccagagcgactggcatgctcgagtgactttcctgcagccacactcccctctgccagccgctcggcttggctgggtttcggcggcccatgcagcgcaactcgcaagctggacaacagaccccccttctctgctcaggttggtgcggggtagcagaaggtgacgagccgccattgatgtgcgcatctacatagtgtgcggacacctcgttgcatcgtcacaataaagctgccccgtcacctgcgaagcgagctgcgaggaatctgcagaaccccgtctccnnnnnnnnnnnnnnnnnnnnnnnnnnnnnnnnnnnnnnnnnnnnnnnnnnnnnnnnnnnnnnnnnnnnnnnnaagggggggggggatgatcttgaacatacttcgtccttctctaggagcaccatgccacctgatgctcagattcaaaccagaacgcccgccacgccgacccactttttcttcctgatcctggagcggagtgtgaggacgatgaatgggcgagcgagccgcaggataacacgcgccacggcaaactgcagcgcacgagcgcataggcgcaggcgctgcgcccatggcttggaatttggcggtgatggggcgtcctccgcctccaccaccctctcgacagcctccagccgtcgatccagtgcctggttgtgcctagcaggtggctggccgggcaccttggctgcaaagatggccggggacacgaggacgatgcccctgtacccctgggcacgcagcgaccaaggttgtgtgtgtgtgtgcaggcaaagacatgggcagctggtctcccacgcattctggagtgcgccccgttgacccaggagcatgtgggaggctggaagcacgagtcctgcacagctctcctccccatgccgcaaacagcatgcgtaatcccacgcatccgcgcccccccatgcaccttgggatccctgatgacctcgtcggcgacagacaccgctcccatgctgtgccccatcagcacccgcttgcaggggccgccagttgcgcctgcctcagattttgcaacctcgtccatgataaatcgggctgcttcaccgttgtatgccagggtgtagggctcatcctgagctggcctgggtagggtgcgggacaatcccattggcaagggtggtggatggttgatctgcgctgcaacatggcagtcggaccgatgacaaggcccgccagttcagctcatgaacttcccgcacctctctgacagcccgaacccgggcatgtcgtgggcggtgatggttgctcccagcgccgccgcaatgcgtggacccaccgccagccaggagtgcagggcggagccaaagccgtggaggcagtggatgcgcaggtcggaggtgggggacccagtgcctggcgggaaggtggccacatgcaggcgggagcgacgaaagggcaccagcgaggtcccagccttcaacaggcgcacccactcctcctcactgcgctgcagggcctgcgcggtagaccccaagggctcccatcctcaacagatacgtgccacgcatgcacgcttgcgtcgtacagatcaggcacatgtttcagggggcggtcaatcacaacacacagcccatacccacnnnnnnnnnntgctgcagggcctgcgcggtagaccccagggctcccatcctcaacagagacgtgccacgcatgcacgcatgcgtcgcacagatcaggcacatgtttcagggggcgggtcaatcacaacacacagcccatacccaccttgtgttgcctctccagcagcagtgcccgtgtgcacgctaggctggttccagccagtgctgccatgcaggtgccgaaccacaggctcacgaccctgggggcggccagggcatagacagagcagcagacgccgagcgcgacgccggcgctggcggcgacatcggtgcgcgacaggcgcggctggaagtccaggccctcctggctgtatgcgcctgactgatatgcgccgaaaccagccatgccgtcagctgccgccgcggctgcctatgggaggtgggtgcacaacgctcgatcacatggaggcagggagccatgctgcagggacgggcagctacctcacaccggtaagcatgcctgtggagtgggcatgcgatgtcgcccgatggcacggtgtgggctcacacgaccagccaagccttgagtcggccgggcgagcagcacgccgcgaggtgggagtggcgcgcacgggacgattccggtcgggagactgcacatggatgaagagtcacctgttctgtctcatgccgtctgacacaagggcacaagaggacaactagcagatgcacatggtgctgattgtggctcattgccgctgcttctagatgcatgcatggcgtttcacgccggcgcgatctctgtggtcgccaatcgtcccacaaatcttgcacacctgtccctggtcgctcnnnnnnnnnncctgtctcatgccgtctgacacaagggcactagaggacaactagcagatgcacatggtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcttacagtgattccaccttcatcagtcgcaaggcctcagtttgttgtggtgtttagaattcttgtcctgccgagggtcctagaaccctcaacacagcagactagcggattcatccttcccgacgacgaccctgccaccactannnnnnnnnnagtaattccaccttcatcagtctcaaggcctcagtttgttgtggtgttcagaattcttgtcctgccgagggtcctagaannnnnnnnnngcctgcctgcctggcgctgtgatcgagggctctgtgttaccatgggcactcgcgcaatatgcacatnnnnnnnnnnttacacccgcctgcctgcctgcctgctcagcgctgtgatcgagggctctatattaccatgggcactcgcgcaatatgcacatcaatgaaagttgggggggtctggggtcagtacgcggcacagaatgaaagggctggtgtgcaaaaaacacctggagggtgcgcatcgctcaagcgggcagagtcgaggtgggggggagaaggttttgcagaagagcgacaagggggggatgagaagctgtgaatggcaggcaagcaaatcaactctgctcggaggcagcccaggtacaagcacactcgacgcatacagggcacgcacagcaactttcatgtgttgtggcgggtgtattctggcctgccacctgtcggtgctgtggccagtcaaacatccacgagccgtcgggcgctgcgatcgaccgccctatcggctcgtcctcaagcctcccgcccgcgacagagagacgtcaagactcgtcgagggaggctgtcacccggacacagtggcgtcccacaaaaggtgccctgaaccgcctcccctgcgtctcagcaggaaacagccgcacatctcctgcgctcgcatcacaccgactgcgcgtcggcggcatgcagggccgccctccgtcgcagcctgcgcacggggcgcggcatcggggcggccagctgcgcgtcggcggcgcgcgcgcccgc

SEQ ID NO: 31142 - DNA, 6821 bp, Chlorella protothecoides
  modified_base (1286)..(1295): a, c, t, g, unknown or other
  modified_base (3790)..(3799): a, c, t, g, unknown or other
  modified_base (4013)..(4022): a, c, t, g, unknown or other
  modified_base (4183)..(4192): a, c, t, g, unknown or other
  modified_base (4289)..(4298): a, c, t, g, unknown or other
  modified_base (4536)..(4545): a, c, t, g, unknown or other
  modified_base (4765)..(4774): a, c, t, g, unknown or other
  modified_base (6413)..(6422): a, c, t, g, unknown or other
cgagtcgcgcgggtccgggccccgcggcggccggcagccccgagcccgcctcggtgaaggagccgctgcaggaggcggaggagggggtggagggcgccgaggtggggcggccgggcgcggcggggccgggacgggctcccgccatgcactggctgttctggcggtagcccaccagccgtcccgccttgttcaggatcggcaggcgcgccgggcgaccctgacacggggccgcgctggtgccttcgcgcgcctcgtaggctgtcggggcgcaggcctcgccccacgcgccagcacgggcgccgggtgtgggccggctcgcgcccgacgccaggtcgtcggcggcgaggctcattgtctccagcccagacggcgtcccgctgctggggcactcgttggtcgcgcccagggaagccgagtgcggccagcccaggtgggagccgggcggcggggcgcggatgggggacagccgccgcccaatcagctgagtgtctgcggggtggcgaagatgggtggggggacgggcgctgagtgagtggtgcgagcgacaccaggattggcgggtgggtgagactctccctgggcagcaaggatatgcagacggcaagcagtgaagtaaatttgtgcttgctggtaaaatgtgatgcctacactccatcccaggagcgtgttggagatgctcaggtgggacttggcagccaacaggttggcacgaccaaaggtccttcatttcaccctccttcacaagaaaccaggttgccatggacccttcacacatgggactcaccaaggatgctgttgccggcagccccagccgaggtcacgctgctctgccagccaatgctggcagggcccaggggactgtgtgggcgggtgatcgcctcgcccatgccggaggacacggtggagggcgggtggaacctcttggcagagtcgtcggcctggtggatgccggactggccggcgggcgccgggcagcacccgccagggtagatcccggccgtcctgcgtgctggcagccaggacctggtgacgccgggctcatgcctgcccaccacatcgtttggccagtccatggaccagtaggagccgggtatcgcctcgcatgccatgggcgagcttggcatgacggtggagacgcctgcagcacaggagggtgaagaggatgggtgtgtgggttggtgggggggagggggggcctggagagggaggggtaagccggcgagaatgcccctcctgaacccggtccacgcagcgaaaaattgatattcaggttgatgcaagaattnnnnnnnnnngtgagtgtgtggattggtgggggggagggaggggctggagagggaggggtaagctggcgagaatgcccctcctgaacccggtccatgcagcggaaaattgatattcaggttgatgcaagaattaaactgcatcgcccaccaatggagagggtcgaagaggggtggatcaagggtcgacgacgggcctagtgggcgggtgcccaaccgtggctggcaacgccgcggtgtcaggaagcagggtgcaggaaaggtgtagcgccgaaggcagggggttttgatagggaaatatactggagagcagggaacggtgtacctcatgggcacgggcgcgtcatgggaacgcacccaagcccagctccgtgccccgtccaagaaacacccgaggacacgaggggaccagatttctgggagattgcggtggacgtccacagatgcaaatagtcaggatcgatggcggaaagaagagcctcgaattgaaggactcggggtccatgggatcgggagtgggcagttgggacgtgttgtcgccgacaaccgcgttgggttcgcaggtgaggagaacgcgatgcggggcccggcgcggtccgaacaagatcccaaccaccaccagaccagtgggaccgaaatgccacacaggctcgacccgacacgcatctcagcctcaaaaaaggatcagaaataagttgccatccaaaagatgtcgctttctcacctccactgtcgtgcctgatcatggcgttgtcaaccgaatgtcgacggaacgggtgacggggcggctccgccccctgacagcctgtacgacgcccggtagatacaggaatggctcctccttctatttgcacggtgaatatagcgtcgatcaggtggtgccgggcatcgtgcccatcctgtcgcaacgagcctgcagctcaaaacctcaaacgccagggggccttgtcgcaccgcagcccaaccgatttcgaagtatcttactcatttgggtaagcttttgctcattctaatctaattcacggctaatcccaatgcccatgtttttgcatcgggcatcggcacagccaaggcaggggctgtcccccggtcgacccggggccccagactgactgagtggtttcgggaggtacgatactcctgaggtatggcctacaaaagacaaccagatctcattgggaatatacaacattacagatcatgcagagttgcgttacaccttttcctgatcacccgggagttgactaagatcttggggaaggcaggcactacagaggccctacccctggcgctgcaccctcctgggctgtcgggtcattcttgccgggccgggcgccaccatccagaccccagtcgggaagggatggctcagcaccaggactctgtgccaccaccacaccagataaacagctctcgcagcaggaatctgcatctgccgccaggaggaactccagccgagagcgcttgctcgtctcccccctcatttcgaccaggacggcctctgcctcagccgtgccaccacatgtcacacccttggcccggtgcaccacgccacggaccccggtggtcgcccaagccagcgccagctgggccctcagctcggcgctcgtttcgcgctcctggaagagctcccgttccaccgattccagtcgagtcctcagcaccgaacactctgcagccgcgagggcctggcccgagctgggccccgtcggtgccggtgcgccagggcgccgccgggagaccgagaaggcgtaggtaaccagcacaaaccgcggcgatgcatccccgccgcctgccagacggtagcaccgccgttgcagcgtggctccgcccgtgaggctgatggccggggcatgggagtagtacacctcgagggcgcagccacgcagtcgggtgtgggatgctgcatggagggggggaaggatgagggggggagggaggggagagggaaggggttagtatgctgaaatcgattgtgcatcccccctccgcgtgagctctggtgatctccgtgtcttcctggagcacgtctgtgctgcctccgaggctggtggtctcgtgtcctgcccattgccctgggctgggggtcgtcctgtggtcgaggatgctgaggagagagagtgtggcccggccagggaccctctcaacaagcaggtggtgggcgtgctctcgagctggtacatcccggagccagaagtgggctgggatggtgttctggcgcctcaaaaaggcggtggtgggctagggagcgacagacctttctgggagggcggtgaccaggagacaccgtcgaaggtgctgcaggcccgctcgacaaacagatgccgacctgcgggtgggcaggaggcatgccgtgatggagactgagattgcggagcgagactgtgccaagatcggccggcacccagatccgacacccagcccggtgacgcgcaccggaaggccggtcgacggggatggtgcgagtgaggtgcctcggcccgtgctgcaacagccattcgatgccnnnnnnnnnnctcctaggcatccttacagatgatatggaatgctcacgtgagcctaaaatgtaacttgtgtgcacagggagggaatgcatgagtccgagcagattcttacgatgattctcgtgaagctgccacagcagctgcatggggcatgctccctgattcagacccatcagaccaaaccccctcgctgcaagacaagttacttgctcgctatcatatcggnnnnnnnnnncttggggaagccatctccgtacagcgccgatgccgcatacgctggcaagggctcctcgaaaggagactgagccgtgcacaacccggccatgctattcctgggcatcttacagatgatatggaatgctcatgtgagcctaaaatgtaacttgtgtgcacagnnnnnnnnnncgggtacagctgatagaggacgatcgtgacactctttgtgggagtttgaatgcaattggcatggtaataattccattcgctggcaccaggaactgtnnnnnnnnnntgggtgcagctgatagagggcgatcgtgacactctttgtgggagtttggatgcaattggcatggtgataattccattcgctggcaccaggaactgtagattaaaatgtgccaagagcactggtggcattgagaactgtatatatgaattgagagtgcatcctcattgttttgttgctgctgtcatattgtattagcagtcagcagcacagcaggtttccaatagttgacatgggcacnnnnnnnnnnaattgtattagcagtcagcagcccagcaggtttccaatagttgacatgggcacagtcagcgtaaaagtgcacctgtgagcggtgacccgtgggatgtttgagctactttaacagaccaatcttctcaatgtgaggctccatgatacctagtcacatagggcagtcatagggagtagagttgggaggctatgagtctggctcagcaatgctggaccagaannnnnnnnnngatgaggctccatgatacctagtcatatagggaagtcatggggagtagagttgggaggctgtgagtctggctcagcaatgctggaccagaagaggaagcattcgggaagactaaaagaccccaaatatgtagatactactgttgcattggcccttgtacagacaaagcagttgtcgcatgtcaagctgtagtgaaaggcagagctaccctcacctaggcgagagtttggtactgcagcttcggcccccatccaatgtcatatgggcccccccgaccattctctccagcaacctgcttcccaaggtttcatgcgctgctgcgggatgcatacatgtctctgaccttctgcccgtcttgtggcaacctgctgctgggtgggtagacgaggctggtgtgcagaatggggcgcacctccccaccgcgacgaaggccagtaaattctttggacggggcccatgcgcgatccaccctcaatgatgaactccctctaccacattcgcagtcgagcttttaaacggagataattccctcacttgccagacgtgcccgtatatctacaccctcgacaggcctgtacgtggtgctgtttggggtgggggcacccctccgcatgtatgggctgtctgcagcgatcaaagacgttcatccgttcaccggtcgagctgagcggcccaaggtcctgtctctcacgataaagttccagtgatacgattggggccctgatgcctctccatgcctgcctgctgcagctgatcaagagggtgcagctcaagcgcaaggaggttgacgacgtcctgggaggggaggaggcttgggcaaacgttcagaagacggacggtgggtgggtggtgtcgacacttgggggttgagcttggggcagcgcagcacgctcggcaatagagcagctgcttctcggcaagggccacgctgctctgtttctcgtcgcatgcaccattttcttgctcttcgctggccctctgttctgttctttgaatggcggggacctgatcggcactcctgtccttccatcaccgccaaccctccttccatcatcgaccctccctcgcagtcacctgccccaagtgcacataccaccaggcctacttcatggaaatccagatcaggtctgcagacgagccagccaccctcttcttcaagtgcgtccagtgcgctgcccagtggcgcgaaggttaggcaccccgctccgaggaggcacaccgagttgatacattgaacctgcccaaacatgcaaatcgctcgcgccccgagcgcccgccacggcacccgcgccccctgggcggggcgggctggcgggccagctctgcacgcgccgccgcgcgccgttcggcccctggtcgaatcgctgagcccagcaggccggtcgagcgcggttggatctcgcaggcgcaggcacgaggtcggcccgctggccgcggctggaaaggccggggacagggcaacagggggcgctttcccagcaggagactccgccgcagagtccagatcggtggctgggacctctgccgtcgaagcccggggtgaagcactgcccgcgccgggtcctccaggatcaggccctgaccgagccgcgcaggctgtttttggcgggggggagggcgccggccagccgcccgtcgcnnnnnnnnnngagcccggggtgaagcactgcccgcgccaggtcctccaggatcaggccctgacagagccgcgcaggctgtttttggcacgggggagggcgccggccagccgcccgtcgccacgaagacagggacgaaggacgtgctgggcgccggcgacgcgccgcgagagtccgaggctgccctcacgctcggcgcggcgccggcgggacgggagtcggagctggccgagtccaggcggcagtacacgcggcttagcggcgcggtgcaggcgctgaccgccgagctggcacaagcgcaagcctcggcggccgagacggagcgccggctgtcggccgccgcaacgcacgccgcgtcggatgcgcgcgagctccggcggctgggcgccgagctggccgcggagagggagc

SEQ ID NO: 31143 - DNA, 205 bp, Chlorella protothecoides
tccacacactctgtgctcccatcacctggacagcaaaatcatgggggggcacagaacccttgcacacacatgcggccctctcggcaagctcggccagccacagcggtggtgacaggcctgaggggagtccatgcatcctcacgaccacttcattgcctcccctcttcacccccattccttcaaaccctaagatccaacacccacc

SEQ ID NO: 31144 - DNA, 64 bp, Chlorella protothecoides
ggtgctgagccagctgccggagctgcgccccggccagctccccgcgctgacctcgctggcgctg

SEQ ID NO: 31145 - DNA, 77 bp, Chlorella protothecoides
ttctacggaaggcttccccaggctagatggttgcgcaagtcacaattgtcggtcgatggcgcacccctccctgcagg

SEQ ID NO: 31146 - DNA, 69 bp, Chlorella protothecoides
cgtgacaacagcggcatccttgtacaccttgcagaatggctgaggtgtggtgaacaagccgttccctgc

SEQ ID NO: 31147 - DNA, 459 bp, Chlorella protothecoides
  modified_base (124)..(236): a, c, t, g, unknown or other
ggccaagcagtctaatgtgacatcaaacagtctgggcaccgaggaggcccctgtcggcatcactttcatcagggggaatcaaaccggactccaaggagggttgggcccaacctcacccagtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatctgatgagaagttggaacggtgcccacgtctcagggctccagatagacgaggacaaagttccacttggtgtcggggataggcaggcgcgcgcgcgactggcctcacacccatgcatgtgccaaaggacggacactactcatccgtccatttgctgtccattgtcaagctacgtggagatttattacaatcaagtctgtacctgataagtgctgctcaag

SEQ ID NO: 31148 - DNA, 63 bp, Chlorella protothecoides
ccatggccgcacgtgcctgatgcagcaggggcactggtcaaccccagccccagcaaaacactc

SEQ ID NO: 31149 - DNA, 70 bp, Chlorella protothecoides
ttcacatttgctcttgcagcgacttcatcgagaactgggtgcactacatgcaagcaacaggctgcaaggc

SEQ ID NO: 31150 - DNA, 103 bp, Chlorella protothecoides
tttccatgttctcattgttcttttggacaccttctcacgtggcctccatggtcagccatcagcatgttaacgtagagagcattgctgtcatgggaaacctgag

SEQ ID NO: 31151 - DNA, 61 bp, Chlorella protothecoides
gtgaggccaaggacggcacatggagggcgtgttatacaaaagaggtgtgcgtggggagaca

SEQ ID NO: 31152 - DNA, 63 bp, Chlorella protothecoides
gggggggggggttgtaaaccccccgtccctctttcccgtgccagctccactctgaaattcttt

SEQ ID NO: 31153 - DNA, 125 bp, Chlorella protothecoides
tttccagagaaaacgctctggcatgcacatgagggatttatggtcggattttggtagctttgctgttgcagcgccggaatatgacaggcgtcggtgtccggactgcggaaccgccctccacacgc

SEQ ID NO: 31154 - DNA, 77 bp, Chlorella protothecoides
ttgggaagagtgtctgcgtgatgtccggccatcacagctcctcactgccctacacccaaaccacacagggccccgcc

SEQ ID NO: 31155 - DNA, 75 bp, Chlorella protothecoides
acgccagcacaggggtccgccactcccctccttcacctttcgataaccgtccctgccttcctaaccccacaccct

SEQ ID NO: 31156 - DNA, 75 bp, Chlorella protothecoides
ggtaagccgcctgttcattcctggtccatgcaggatacattgcatgcgggcaccagcggcgcatggctcagctcc

SEQ ID NO: 31157 - DNA, 153 bp, Chlorella protothecoides
ccgtcaccctcaaatcctgaaggggaacggaagagacagggacggcgggatgggtacatgaccacagtcccacttgcagggacgcttcagccatccccctccagaacgctgacgctgcacaccacacatccctaccagtttttcctccctgcc

SEQ ID NO: 31158 - DNA, 67 bp, Chlorella protothecoides
gggagatggactgggactgggactgggaccgggagacggactgggactgggactagggcttggactc

SEQ ID NO: 31159 - DNA, 151 bp, Chlorella protothecoides
cagcacgggcgggtcccccaaagtccacgcctgcatcccctccatgactgccaagctggaagggggccagacgtacttcttcatggttacgacggccgtgaaccaggtgagcaacacccttggcatgaccatctccctgcatgatgccaac

SEQ ID NO: 31160 - DNA, 262 bp, Chlorella protothecoides
accggagcttggggacgacgtcttcctctgtgactatgagtacaacgaagcctggcaggtgtgtttttgtgtggatgggggggggggctggatttcagggggtgaggccttggagatggggaagggaaccggtgcgccgtgcacaggcctgggctggggtagtgcaactgtgacgctgcgcccggaagcgtcgcggcgagaaaaatgaccgatcagcggcatcgtagtgagccgtgccgctggccgtggatgcatgggcttc

SEQ ID NO: 31161 - DNA, 71 bp, Chlorella protothecoides
ccggtcttggtgtctcccggccgctgggacgcagtccccatggaatggaggccacctgtcttgagcttgca

SEQ ID NO: 31162 - DNA, 115 bp, Chlorella protothecoides
ggctttggtctgcagggataccaccaaactagggtaatggcctttgctgacgcaatcctgtgtatcaatgaccaacactaacgcgccacaccctcccttccaaaccctcttccgc

SEQ ID NO: 31163 - DNA, 73 bp, Chlorella protothecoides
caccaccacgcggctgcaggccgggtcgcgcacccaccccgttaccgcgccctggaggtaggagtcggcctcc

SEQ ID NO: 31164 - DNA, 110 bp, Chlorella protothecoides
cgggagcgatgcctggcctgggccgggcggtcgggcggcgtcgggcgtgcaggtggcgcctggctggaatgttgcgaggctgcgcctcgcaccgaccctcgaccggcgcc

SEQ ID NO: 31165 - DNA, 142 bp, Chlorella protothecoides
aagacagccaggccacgccctttgcatggccagtcaccttggccccgcctggtccactgtcgagaacgctgctgcattgggtccctggtctcgccacacaggaccgtgcacgctgccggcacttcctcatccgggttcctca

SEQ ID NO: 31166 - DNA, 61 bp, Chlorella protothecoides
cgggtgggaagggggagtggtgggtgcgggtgggtctcgcatgcatggcaacccaggaata

SEQ ID NO: 31167 - DNA, 90 bp, Chlorella protothecoides
cttggtggctgatctgcacaaaagagcagctcccaggaaagtcccagccacctatacctgtacaaatccagcaccagatacagactgggg

SEQ ID NO: 31168 - DNA, 21391 bp, Chlorella protothecoides
  modified_base (840)..(849): a, c, t, g, unknown or other
  modified_base (1521)..(1704): a, c, t, g, unknown or other
  modified_base (1807)..(1816): a, c, t, g, unknown or other
  modified_base (2286)..(2295): a, c, t, g, unknown or other
  modified_base (2442)..(2511): a, c, t, g, unknown or other
  modified_base (4037)..(4046): a, c, t, g, unknown or other
  modified_base (4399)..(4528): a, c, t, g, unknown or other
  modified_base (5385)..(5394): a, c, t, g, unknown or other
  modified_base (5693)..(5702): a, c, t, g, unknown or other
  modified_base (6134)..(6143): a, c, t, g, unknown or other
  modified_base (6202)..(6211): a, c, t, g, unknown or other
  modified_base (7159)..(7168): a, c, t, g, unknown or other
  modified_base (9495)..(9504): a, c, t, g, unknown or other
  modified_base (9934)..(10054): a, c, t, g, unknown or other
  modified_base (10169)..(10206): a, c, t, g, unknown or other
  modified_base (10400)..(10517): a, c, t, g, unknown or other
  modified_base (11029)..(11038): a, c, t, g, unknown or other
  modified_base (11704)..(11713): a, c, t, g, unknown or other
  modified_base (12479)..(12488): a, c, t, g, unknown or other
  modified_base (13596)..(13664): a, c, t, g, unknown or other
  modified_base (14148)..(14157): a, c, t, g, unknown or other
  modified_base (14621)..(14630): a, c, t, g, unknown or other
  modified_base (15091)..(15100): a, c, t, g, unknown or other
  modified_base (16147)..(16156): a, c, t, g, unknown or other
  modified_base (16353)..(16362): a, c, t, g, unknown or other
  modified_base (17063)..(17072): a, c, t, g, unknown or other
  modified_base (17677)..(17686): a, c, t, g, unknown or other
  modified_base (17927)..(17936): a, c, t, g, unknown or other
  modified_base (18414)..(18423): a, c, t, g, unknown or other
  modified_base (18922)..(18931): a, c, t, g, unknown or other
  modified_base (19342)..(19351): a, c, t, g, unknown or other
  modified_base (19693)..(19702): a, c, t, g, unknown or other
  modified_base (20454)..(20463): a, c, t, g, unknown or other
  modified_base (20986)..(20995): a, c, t, g, unknown or other
ggcgggcgtctgcgcgggcgcggcccgcccgccgctggccagccaggggtggcgggagatgtcctggagcgagatgcgtcgctccggggagatggtgagcatggcgtggatgaggctggcgcaggcggggctcaggcggcgcggcagcgggcgcatgcgcccgcgcatgatgttctgcagcgtggccaccacgttctgggggtggagcgggtcctcgaaggggtactgccccgtgaccaggaggtagagcaggacgcccagggcccagatgtcggaggcacgggcgtcataccgccccgtccgccgctcgtacagcgtctgcacgctgccgttgcccagcagctccggcgccatgtagtccggcgtgcccacgcccagcgtcaccgccgatgcctggtgcttggacaggccaaagtcgatgatcttgacggcgcgcgccgcgcggtcgatcatcacgttctccggcttcaggtcgcggtggcagaggccgcgctcgtggatgaaggtcacgccgcgcaggagctggccaaagtagaaggccgcgtcggcctcgctcagccgcccaccgcactcattcagcaggtccagcaggtcagggccgcgaatcagctcccacacgatcaccacgtgctccgcctcggcgaaaaagtccagcagcttgaccacgttctcgtgctgcacggacgccgtgtactcgatctggggagcggttgtttggagggggggggtggggtgagggtgtgtaattgggtgggaaacgatggagtttaatattggtagaaacctcctttaatcatttggcatgtacgtgcatagcatgctgcaaattccaggcttgannnnnnnnnnggtgagggtgagtaattgggtgggagacgatggagttaaatattggtagaaaactcctttaatcatttggcatgtacttgcatagcatgctgcaaattccaggcttgaggcgtgatgaagtccgatggagggggcttcacaaagacacccttcatcaacccctcatcgcaactccaccgacacacacctcgcgcttgacgcccttgatcggcatggtggcacgcccatccttcacggtcatgacctgcaccagaatgagtagagtgcattagaaactagttggcatacgcgtcacaccatgcgcacgtcaccccgtgcctcacaagatcccggagcccttcgtgggtgcagctgcgggcccttcccgtacggaagcctcaccttgagggcgacatgctcgccgctaggcagggtctcacactcgtatacaacagctgtgccgcccctgttgacctccttgaggaccctgtaacggccgttgcccagcagggttccgggagcaagagtggccatgccgtccgggttccgctaggcgacgagagctgctcgaaccagggcagctggatgtcgtggtaatccgcaagtttggagaaacacacctcgagtggaaatgaaatggtgatttgcaggtcctggctggatgcctgtattggctctcgggagccttgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggaggcaatatagctgagcagaggcagcacgagccgcttagcctcgaccgacctccgcgcgatcggatctgcggagtcatgacagcacgcgcagcatgannnnnnnnnngatccgcaagtttggagaaacacacctcgactggaaatgaaaaggtgatttgcaggtcctggctggctgcctgtattggctctcgggagccttgtacatcggtggatcgagcgtatgtgcccatctccgaaccggaggagctgcgctcgaggcatgacgaagaggctgcgatggccatgatcatcgccccacccactgagcaattggacgaatatgatctcagccatgaaagcagtacaaataggaggcaatgtagctgagcagaggcagcacgagccgctcagcctcgaccgacctccgcgcgatcggatttgcggagtcatgacagcacgcgcagcatgaacccttttgtgcgatctcaggaaggagtgagggcccactctagggggagctgtagtgggtcctgcagacctttttgacacaagttgtctacaaggaacccccagcgccctacctgatgcaacattatnnnnnnnnnnttctagggggagctgcagtgggtcctgcgtaccttttcgacacaagttgtctacaaagaccccccagcgccctacctgatgcaacattatcgtccgcttcggaattctcccatcgcaccctgccagggttccggatcgttgtgaaannnnnnnnnnnnnnnnnnnnnnnnnnnnnnnnnnnnnnnnnnnnnnnnnnnnnnnnnnnnnnnnnnnnnncatcacgagaggaatatgagattctgatcccggaagatttcctgtacagggccctttggcccgtcgacttgggtgtgcaccggtatgctgcgccggtgccggaccttgcagcccgtcttctgggcggcatgtcctgcaccagtcgcggcatgctattcggcgctaccgcagccgacggagggggagtgtaggcccgccaccacccacgatggggaccagtccgcccaggaacatggccctcctggcgctggtcatgccctcgccaccctacctccttccaagctgggaccccggccatccgcaaaggaggcccgcgaggagctaaggcgctttgcggggtcgccccgcccctcgcccgaatggcgggagctggtgcgactgtcccacgccgcacttcaacctcctggccaggcgaatcccgccatgctcaccgacagcttcggccgggtgcacagctacctccgcatctccctgacagagcgctgcaacctgcgctgcctgtactgcatgcccgacgagggcgtggagctcgcgccggcctcgcacctgctcagcagcgaggagatcctgcgcctggtgtgtggtggggatcattcggccgggtgactgtgctccctggagcctttgggccttgcctgctcagaatccgccaatcccccgctgccgctgcacacgatgcacatgcacacgtgcacacgcgtcgcacctccattccgcaatcaggcgcggctcttcgtgtccgccggcgtggacaagatccggctgacgggcggggagccgacgctgcgcaaggacctggtgcggctcgtggcctcgctctctgccctgcccgggctggcctccatcggcatcaccaccaacggcctcacgctgggccgccagctggcggcactgcgctccgcgggcctgacccacctcaacatctcgctggacaccctgcggccagacaggtttgtgaccctgacgaggcggcagggccatgcgcgggtcctggcatccatccaggaggccatcgcacaggggtatgacccaggtatgtgtggtttgagcaaggtgatggggtggggtcttgagatgcatgccagcagctggagcctgtagatctatggtcaggtgcaggcttggaagttgtgtcccacgttttgcagcccatcgcggctgagcctgagctggcttgatgtttgagatctcagtatccatacctccctcatatctacctggccacagtgaaagtgaatgtggtggtgatgcgaggggtcaacgacgatgagatcgctgactttgtggagatgacgaggcatgcgcccatcaacgtgagctgggctccaggatggcattacaaggcctccatgctgtgcctgtcctgcagtgggctttgcaggaatgaaatgtgcaggttggaagaaggaggcagtctatgccttccactcaccctccaacttccctccacatctggcgccgatggcaggtgcgtttcatcgagtacatgcccttcgatggcaatgtctggtctgacaagaagatgnnnnnnnnnncccactcaccctccagcttccctccacatctggcgccgattgcaggtgcgtttcatcgagtacatgccctttgatggcaatgtctggtctgacaagaagatggtgacgtacagggagatgcggggggccgttgaggcggagttcgggccgctggagcccatcctctccccggcgggcgaggtggctcgcaattttcggtgccaggatttcacaggctcggtgtctttcatcacttccatgaccaaggcattttgcagcgactgcaaccgactgcgcctgatggcggacgggaacctcaaggtctgcctctttggcgccaatgaggtctcccttaggtatgtggtggcatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaccttggtcttgggcctccttgcatgctgcttgcccaggctcatgaatgaccggtactatgggtagcatgagagaagcagcccttgctcatctcccaaacctgttcactcactgggcagggatgctatgcgggagggtgcgtcagaggaggacctggcggccgtcatctctgctgcggtgtacaggaagaaggctgcgcacgcgggcatgttcgagctggccgccacagccaatcgggccatggtgaaaattgggggctgagggtccagccaggcgcatttgcctgtacatgccccctatgttgatgtccttgccagtcagtcgcccagctgacggcagcttcggtttgcagtctgagcatcaactttcccgctagctcatcgtgaataaagacatagcaggcaggtgcttcccgtgtccccatgatgctgtctgtgcacatgaactcgtgtcaagcagaacaagcggccctgcatgctgtctgccagcgtagacgcacagcagtacaggcggccagggccactcgccgcaggcctcactcctgcacgcccatgatgtcgtgcggcttgaagagggccttgaaggcctccgaccgccgccgctcctcctccacagggacggcgcacgccttccactcggcccgatcgggcacccccgccagctcggccaggacctcccgcccatagttcagggggtggcgctcgccaaaggctatggggtgcacgaggtaggagccatcggggaggaaagcctgaaagtactcgccatcccccaccacgtcccgcagcgcggctcgggcagcctcgcccgcggcagcggggatgtgggtgaggctgaaccccgcagcctttgcnnnnnnnnnnatgcacgagggaggagccatcggggaggaaagcctggaagtactcgccatcccccaccacgtctcgcagcgcggctcgtgcagcctcgccggcggcagcggggacgtgggtgaggctgaaccccgcagcctttgcccggtcctcgaagacctggcggtgttggtgtgagggtatggggggaggggccgggtgacgtggcctcgagctgtcgctgcaggtgccacatgggagctcgagtcgaggcggcatcactcgagaagtgcacgccgccccgcggatgctgcgactcagggagagcnnnnnnnnnngcgggtgacgtggcctcgagctgttgctgcaggtgccacatgggagctcgacttgaggcggcatcactcgagaagtgcacgctgccccgcggatgctgcgactcagggagagcggtggactcgcacccctcgcacagaccccgtccgacagaggagtgccggggcgcccaatcaccacccagcctcctgcacacctccctgtgtcccgcacaaccgcgcccccaacccccacgcacctggcgagccctggccgcggcctcggcgctgacggccagggcgttgatgtggcagtggttgcccccgctcttcctcagagccatgtaccgctcgaagcccaccagctgccggccgccagccgctgcacacctgtcgagcgcggcccagtacctgggagggcgggatggggtttgttgtggtgcagtgggtcctccnnnnnnnnnngcccgcacaagcgcgccccccatccccgcgcacctggcgagccctggccgcggcctcgnnnnnnnnnnacctgccgctgcacacctgtcgagcgcgccccagtacctgggagggcggagtggggtttgttgtggtgcagtgggtcctcctcggagcgatggagcaaagtcacgctatgtcccaagaccaggcgaccaagaacccatgaagcccacctcctgatctcggcatagcagtcgatgctgagcgactggctgctggggaagtgctccacgctgacgacgaggacatgctcgtcggtgatggcgcccttgtcgacggccacgtaggactcctctccttgaaaagggtggatgtttgacgttttctcatatgtggccgcagggcacagaaagaggcatccgcacagccttcacggtggtctgcaacaaaggaattctagacgccctgtcctgctttccacggattcctgaaatagcacatggggcagctcaccaacgctgaccaccaggtctatgtctgcattggcgttggagaggcagaaccagcagccctccacgggcttcccggttccggccctggggccggtggcggcggcgtcgattcccagctgtcgccccatgagctctgtgcaggaggagattggcgggtgttaccagctggacatccaatggcaggggcagactaccgtgtcccgatggctgggtccacagaaagcgcatatgagtgccatgtgtaaaacgaacatgcgcagaaactcccaacgataccagagaagggttgggccatgcgcagtgcggatcctgcttaccggatccattgagctggcatgccttctccatgccctccttcgtgtcaaactggatgtggcaccatgtgttgagccgccctgcgttgtatggtggtacatccgtgcgatgagtcaggcacagcacaggactgcggggataatcatgctctcctcattggcaagccagcgcccatgcccctggcgagcaacacccagccagcactcnnnnnnnnnntggactgcggggatgatcatgttctcctcattggcaagccagcgcccatccccctggcgagcaacacccagccagcactcccaggcaccttctccgttggttcggcgcacgacatccaccaccctgccagcctgtgcaaaaaactcgacgagggcctcctcggtggcagcaaaggggacgttcctcacaaatatcgtcttgtgcttgtctttgatgatgtcgggccgacctgcgtgtggttgaacaggtagagggggtcagctgggaggagggctttcatgtgtaaggtaggataatcgggacgcacggcatggggaaagtgatgtgtggctggtcctgcagaccccctggcgatctcgcacatgcagatctctgctgcacccacttccccatcaccccggcacctcatgccagagccctgagctggctcaaggagcagtgctgttcgtttgcatgccgccacccccactcgcctagactgggtgctgccatgatctgccgcgccttcttctgctcctgccacctccagtcctgggacccgaggtcggtgccgggccccgcatcccccgcggccctcttcaggcgcttggccgcagctgcctggaaagggttccccgtcgacccggggggttgcacctggagggcctccggggtcatctccgctgcgggggtcaaggccagggcgtgcagccacttctgcttggccccattgccgacctgggcgggagcgaggcaggcatgggcagtgggagcctgggaagaacgctcttccaaccctcctctttccacccctcgccggcctgaccccgaggacaagcctccaagagccacagccaccaccaccagacacctgggccagtccgatgaagcgcgtgacatgcgccccggcccccaggtccgcattgaggtagggtgggcgagcgaagaaggtgggcttgccggcggcgatgtggtatcgcggccgggccgtcatcaccagctcagcaatgactggcgagcctgcacggagagagtgcgaggtgaggagaggctgcttgagtctggctagccagctcggcgcccgcccagctacaggcatggcactgcgccgtaggctgaccgtgaacccctgcttatagaaccttaaagccagcggaatgtattcccactgggtgtagagtcgccctctggtcctccaccagaccctcctgccgcaactaatcatcacctaccgtgcgagtctgggggcgccacaccctctggcagcccctcagccaggccctctggccattcattggtcagcaggacgtcgatgtcaccctgcaaactcaggctgtgctggaggagcttgatgtcagcctcggtgtagtaccgagcagatccggagttgtctggcacctctcggaaggcagccgcattgtgtgtcccatccagataggccagggtgaggcccttcacctccttgaccccggcgcggccgaggtagtggatgttgctctccggcacggccgagatggcctccaggacggagaccgcccccccgccccagccacccatgaagtaggtgggcaggggcgctgccttgcctcccgtcagatactccagcagcggaccctggtactctccgtcatctggacctggcaggggagtaggcgaggggggtgggagggcgcggctcgaaggtgaatgggggcctgcacacgacagtgtcggccttccgggagcctacctgcagcaccgaagaactggcccacgcagatcagcaggtcgaagggaccattggaggcatttacagcgctcgcacgcttgaacagggcatcgatgctgccgttgcaggcaccggcgaagagggctctgacggccggcatcgggttgcaggtggcaagcttggtctgctagtccctcatccttccatgatcacagacgacaggaggagcagccgagcaagagcactgcagattatttatcatatgtgcatgaggctgcctgcctgcctcagtcagaaatgggcgatgttgcatcgcgagagctctgctccgcgcgcgctggcgaaaataaaaaggtgtactcaagcttagcatcaggtgttttcacggcggatctaactccctgctctcactccggtgcgctcgggaccgatcacttccaaggcactcaagacagtgtcgcaggtttggagtcccctcagcagtatcctgtgccagccagcgagggcagggactgggcgcgggacatgggcatgctccagcccttcacaccttgcacggccctcccccagcctcaagggcgctcggtagccaccggaccacccctgcccacctcacgtgctccttcagccacgccagggnnnnnnnnnntgggacatgggcatgctccagcccctcacaccttgcacggccctccccagcctcaagggcgctcggcagccaccggaccacccctgcctacctcacgtgctccttcagccacgccagggccacctccgcgcagggcgtgggcggcccctgccccgcctcctcccgccgcaggccctccaccagtaccggggtggcgcccgccagctcgcggtccagggcgccgcgcagccaggtgaaggcccgcacctcccctgcccgcgagatgccgcggtcctccagcgccaggtacgcgccggcgcggcgctcggccggcgtcgcggcggccaggcgcagcgcgcgcagcaggccccagctgggcgcgcccccccaggcgatgcagcgctcgccggggcccagcgccagcgccgcgccacgggcggccacgcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgttggtgtaccgcccgtagtccaggaagacctgggcgccggccggcacgccgagcaggcccgcggtgatgcggtacgtcgcagagtcagcgtcgtaccgccccgtcccgccnnnnnnnnnnnnnnnnnnnnnnnnnnnnnnnnnnnnnnggcttgggcgggtgcggctcgcgagcgcgccccgcggcgtcggcccccgccccgccccgcgacgccacagacccggggagcaagtcgaccagggaagggaccaaggggcccgccggcggcgcgtagttgtgcaagtcgcccaacggggtcagccccccagggtcgggcccgggccccagaggcccgccgccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccaggcacccagccgccgccagcgatcgtcggggaagggcatggcgcgcagcgcggggagcgccgcgtgccagtcgcgccgcgtgcgctgcgcggcctcggccacgcggcggtgcacggagggggcgggggcgagcgcgtccaggtcggaggcggcgaagtaggggccggaggtgtagctgtgcggcagggtctggaggtagggccaccaggccgagcccgccttcttggacgtctcgaacaacacatgcatggtcagtacctgggtgtgagggtgtgggaggcagcgggatgagggagtcctggggccgtgcagacagccgtgcaagcacctgggtggtcccagcgccggggtcgggagggtgaggacctcagccatggcatccaacccccacccccgcacgcaaacatttcggagttcacctccgacaggccccctttcccagcgaggaatgcattacaacacaggaacgccccacttcaacccatgcacccacttgaaagggggtnnnnnnnnnntcttcttggacgtctccaacaacacatgtatggtcagcacctgggtgtgagggttgtgggaggcagcgggataagggagtcctagggccgtgcagccagccgtgcaagcacctgggtggtcccagcgacggggtcgggagggtgatgacctcatccatggcatccaacccctacccctgcaagcaaacattccggagttcacctccgacagtcccccatcccagcgaggaatgcagttcaacacacaggaacgccccatttcaacccatgcacccacttgaaagggggtcaaggggagtggcccagcgttcaccactgcgctgaccgtggggcaggccagtgcactggagcatgtcatgaggcaggggaaggggacctccaggacgcaggccccgggagcaatgtcccgggtggccacgatgcctcgaccaccttgggccacctccccggcctcgatgtcacggagacgcccgcccctggactcaagccatgagatcagctgcggtaccgcctccaccattcctcgcaggtgggtgcagtagacggcccgtgggagcgtcgaccgccgaggcttgcatgtccacgtttgacttgtattatttgtgtgcactgccaaggtttaaattccttgtatcttgcgtgccctcgtgtcgtaattagataacnnnnnnnnnncagccacgagatcagccgcggcaccgcctccaccattccttgcaggtgggtgcagcagacagcccgtgggagcgtccacagccgacgcttgcatgtccacgttagacttgtattatttgtgtgcacagccaaggtttaaaatcccttgtatgttgcgtgccctcgtgtcgtaattagataacattgtaatatggacgtgacgtccccatgagaggcgcgcgcgcgcttcaagacgtccaaggcaatgtcgtcctgtgagcagtttcaataaaatggttactccgaccatgtagatcggtgtccttcgaacattcaaacacccaagaggtcgaataaaacacaacaaccatgctgacccatgctattcgacgtgccagccatatgttggtcacggcgagggcgcccgcgagcgctagcctgcgaaacctcgctatcacggcaaccccaggggacgaccagcagatgcgagcggtgagaagattgttccagagtccactgagccatggattcgtgacatagaccagctggaggaagcattgctgaccgttctcggcctcccatgtgtctggcaggatgtgaaccggctactctacaggagtcgccagagaggctggttggagctggatctgctcatggtgagtggtcatggagccatagaggccacaggcatgcaattttatgggaccaggtttcgtgaggcctcctaagttggatctacctcaagatgtctcccaccctccacaacattgacaaacacccacaaacnnnnnnnnnntgggtctcgtgaggcctcctaagttggatctacttcaaggtgtctcgcatcctccacaacattgacaaacacccacaaacacccccccaccctccaacaccagggcatgtgggctgagcagaatgtccccaccatgactgcaaagcaactagaggactacaatgttgtgctggatgaggtaagcatgactacggacgattctgaaggtgtttgatgcagactgcagaccggtgttttctcccatcagcagcacctccgtccgtcttgactgcactttccatcacggtgcaacccataggagaacccagacctgttcaagtggctgacgaaccaactccccacgcctgagcatctacggaataattcggcataccaggcaagtgtacatggattgcttgcgctggcggggacggttgagaagatggattggggcatcctcagctttactagttctttttgccgtcctgttagttcagcctctactcttattcgtttcccgccctgcagctattacacgctagcgtgcaacagtccatggacaagcacagcgtcgtgagcactcgggcaacgcaggggaaggactgggtgaaaggctgggacgataacaagaagggcgagctcactgcagagcaaaagtaatggctgcttggggtggggcacgaagatcgaggagactgccaccaactccgacacacatggtggatctcttcgctgtcatgatttggtaaaccgttgaacgaattgtaagtgtgtcactgcaagggtatgctacagatcgccgcaaagcatagcaacgcatggccgcagcacggcctccccaaaccacggctcgctcgattgcttgtttgagaagcaacacacatgcttcagtgccttgccgtcgataacttgccgtgaaaagggtgccgaccttcgcagttttcattgggacggcaccaccgcatacaatatattaaggtgacgctcgccccgactggcgacgagagtgaaggctagtcctctcaggtggccccgccatggcatttctgcaatgtagaagtggcctgatactggcgcggcgaggatggggactgtccgctgggttcattggagtacctgctgcaaggcnnnnnnnnnnnnnnnnnnnnnnnnnnnnnnnnnnnnnnnnnnnnnnnnnnnnnnnnnnnnnnnnnnnnncatcgtagagggcctggttgtcaacggtgaggtgatacgattaattattgttttgtccttgtcacgctttcgtcgtcttttggaggtgcagctgagcctcatcataatggcgccccatccccgacagaggctggcctggccagcaatgagcttcccatcacaaaggcctttagggacctgatgcacagggtggcagggtacaacgagtcagacctcctgcgccagctgcaagagtccctgtctgcggatgcaaagccagcgggagagcagaaacccgatggtgtgtgtatgtgaacagtgccatagaggctgtgtctcacagtttattgagaaatagctgccttccccagcgctggactcccttggctattttaccttcagtcagatatcataccccagttgtgcgcgctccagggcgcacaattcatgcctcaatctccccctccaaacacatgtcgcccgcagaccctgcaaagattgaggnnnnnnnnnnccagtcggatatcataccccagttgcgcgcgctccagggcgcacacttcatgcctcaatcaccccctccaaacacgtgtcgcccgcagaccctgcaaagattgaggacaacctccggctgctgtcagagacactgaatgtcatgtttgccctgctggaggatgagaacgtgcccattgctgagaacctgtccgacctggatctggcaggcctggaggccctgcgggcgtcattgaatgagcgctactcgggtgagccgctgggccgaggtcccatggggtgctggcttggggcagactgggtgcattgggcttggactgcgatgaagattttgctctttgccctccagtagtggccccctgcgcaactagatcagacaaaacgaaggtgtgatggtcagtgtatcaccgctcatgtcctgctaccttccctcggtcgtgtaggtccgaatgagatggtggtgannnnnnnnnnaccgaggttccatggggtgctggctttgggcagagtgggtgcatcgggcttggattgggatgaagagtttgctctttgccctccagtagtgccctcctgcgcaactagatcagacaaaacaaaggtgtgatggtcagtatatcaccgctcatgcccttctaccttcccttcgtcgtgtaggtccgaatgagatggtggtgaacactgcccctccaggccagctcccatgggagatcctgggcgtggacgagtccagagggggtgagcccggcgcagggcaggctgtttcagggatgtgaggttggggtgccctggtgtcgtaagctcgcgctgccagggcagggtttcgaggtgtcccacgtctgcaatgtccgactgtccctccgacacacaaacaactgcagccatccactgggcggcagacctgacggacgggcgggcggtggcgccgtggagggctnnnnnnnnnnaacacacaaaccactgcagccgtccactgggcggcagacctgacagacgggcgggcggtggcgccgtggagggctgcctccctcgcctttgccaccaaggtccgcatgtaccagctctactgcgacgacccggtcaggtgtgctgcgagactggcggcgggcggctatgagaagggggtaacgttcaggggaccacgtcgtggaggtcgagctgtgctggtcacctccggaagcgctgctcgattgctcggtgaagccttgcacgcagtgcacgagcgacctccctctcccttgtccctcgttgggtcttgctgcctcatcaattcctctatattgatccccctgtgcctgttgtatgccgctggaccccaggctccaccgttggcaatctccctctcctgctcatcccaccgcaggaacagccccgccgcgcttgcggcccagtttggcgtccgcgagcagcgagtgcacgccatcctcgccctcaaggagctcgaggccaaggcgctgtcggccgcgccaccggaggacgcgcgggctgccctactccgcgttgccgaggtgcggggaggggtcctgagggatggggggggtggagggcaactgcgtccgaatgttgcctcggatgggggtcattgggtggttggatgttgctcaacctggggccactgggattgccgtctcactcccacccgcaccgccagtgcccaagcccctcctcttccggtccgcattcactcaggaggacgccgagctggggtcggacgtgggcgtgtctggcgagggcgagcggcaccacgtcatcctgccctcctatcccaactacgaggagatggacctcgctgccttcagctcgcgcctggaggcgcggctgggcaagcccatggcggagatcagcgaggcagacctgaccccggccattgccaaggaggtgctgggcctggagagcaaggaggaggttgaggcgcgggtgagtggtggaggctgtgagtgggaggacctggcgtggaaaggagggcatggagaggtgccagggtgggttggacnnnnnnnnnncgtggtgaaggctgtgtgtgggaggacctggcgtggagaggaaggcatggagaggtgccagggtgggttggactgtgcatgatgcccgggcaggaccatcaacctgcctgtgaccaacttgttttcgcagctggcggcggtggaggaggcgacgctggtggaggagttcacctcgcgcctggcctacaatctgggcnnnnnnnnnnagcacaaccatcaatctgcctgtgaccaatttgttttcgcagctggcggcggcggaggaggcgacgctggtggaggaattcacctcgcgcctggcctacaatctgggcaaggtgggtggtgccgcgggagtgtggctgcgacatgttgggaagcaggctgtggctcacgagtgaagcccaggccgggtcgaggacagaatcgacgccctctgtcgaaacgcgctgggcccaccccgcatccatccgccaaggagtgcctcacatcaatcctgtgcctcaaatcaacaggagggcgccggtctgcagcgcaagtcgcggcgcactcacttcccccgccggccgccggcaggctggaacctggtggtcaagcccctgggtcaatctgacgaggagccctacgtcgccgaggcgaccggcgggcgccgggagcccaacgccgacgaggcgttgctgctcaagcgccagacgccccggccgcggcgtcgcatcctttgatcgtttgcctagccttccactcccccaaatgaacctctttgcgctggcctggcctcggcgaggtccatgcctctcaacctgcttccatggacagtgcaggcacgatgcagtccccgctggagtggatgtccttgagagtgaggaaaaatatgtcactcctgcagagcacgctccagcaatgagaggagggatccctgggaggagcnnnnnnnnnnggtccccgctggagcgtatgtccttgagagtgagggaaaatatgtcactcctgcagagcacgctccggcaatgagaggagggatccctgggaggagctacagggccagccaccgggcatgtgccctgatgactaatgagcagcagcttccaggtccagcacctcttttcgcctggggtagggtttagagtgatccagcaccagtcagcgagccgcatgatgcagctcatgagacctgctcagcccccagccgcctcttccctccatcgcatccccaactcaaaggcaggcgtcctcggtccataccatgcttctagatgcccgagcttctggagctgttccggggaaaggacggaaccagctgcctgcgccttctccagctcctccgcttgcctcactttcttcttcagggcacgaagggctgaggttgggaccgggccatctggcttggcacccggctccagcgtgcaggctgccagctgctgcgccacgtctgaggggtttgctgcaggggtcttcccctgctccaacttggcagccgccttgccgggagcctgcgtcactcctgcgggctggccgccgtctaccttcttctccttccgcttnnnnnnnnnntgacttggcagccgccttgccgggggcctccgtcactcctgcgggcttgccgccgtctaccttcttctccttccgcttggcatttttggttgctgccttgctcttcggctttggggcgcctgcaactgcgaggcagcaggagtgggaaccgatcagcatcgacgcctgtgcgctcgccagaaccgtgcagtcccagttggttgacacatgattcgcccacgcaccctgactagtctcgtcnnnnnnnnnntgcagcaggagtgggaaccgatcagcatcaacgcccgtgagctcgccagaatcgtgcagtcccagttggttgacacatcattcgcccacgcaccctgactagtctcgtcaagacctgggcacttggggacattttgtcttgcctgcgatcagagaatggggcaagtagggtcaggtggcaagcaaactgccttggtcgcaatatatcttgggccccgatgtgagtgacgcatgcccatggagcagcatcgtgcctgtacttggcgcggaacataggcaggctgctcgtcctgggggacgtacccagccctgacccggacctccttgcgcagcgtgccgtcgggccgtcgggaaggggggatcacagtggctcccccatcacccataatcgttgcctctcaagctgcacggcgcctgagacctcgtgcgatcgcctactgggtgatttcaaatgtagattcctgctcagctttgtcggnnnnnnnnnnggacttcgtgtgatcgcctgctggatgagtgcaaatgtagattcctgctcagctttgtcggggacactctcagagtatgtttcgttgtaccttatcgaggctcggtggcaaaataaagacaacgtgcttaatcaagagctttaggtggttctcgattcgatggaaagtagacatagaaatggactctcgcatcggcagtcgccatcggtttcattataaggaaccgacactcctgcatcgtgttcgaaactggagtgcaggcaacagcgggaaaactgcctacagccaacatccaggcaggaagctcctgctaggtcgcccagagcccttgatccagcgagcaatcgctcttgaatctatgatgttgtacaagtttggcatagaagaccccaagacatgtttatcagcaagcgttgccagcacccgttatgcagtcacggatttgccagcctcggcagacagcacggtatctgaggaagtccggggcatgggttccccnnnnnnnnnngagatcccaagacatgctaatcagcaagcgttgccagcacccattatgcagtcacggctttgccagcctcggcagagaggacggcatctgaggaagtccggggcatgggttcccccagagctccaattgggagcgtttctgccttccccttccctcgttttacgttcttgaaccctgctagcggcttccgcatgtcaaacgcgtcctcgccgtctgcatagtactgcgcctcccggtcacagaggctggagaaaggtcccgggaggaaggatggggcgatgagcaaggcgcagcctgcatttggcctgtgcagcgcctcactgcatgccacctgaggccttgtgccccttttcgccataggcatgaccctggggtgacacagcaatcgatctcccaagcctgcaccgagannnnnnnnnncttcgacataggcgtgaccccgggtgatatagcaatcgatctcccaagcctgcaccgagactccactgactgacacccccagcaacaatctgtccccgcggaagacaccacgccacgtactcgtatcccagggtgtccatgtaaagatgcagggcgccacggttggaggctcgcacatggagcgatgcatagtgggccgcaaatgtgtcctccatcccggcatctgcgcaagcgatggggatgagttggccggtttcgcaaggggtagcatgaatggcagagggtggagtgacatccagattcaagtgcactgaatcacaggcaccatacactcacgtgcannnnnnnnnnagtggagtggcatccagattcgagtgcggtgaatcacaggcaccatacactcacgtgcagctgtcatgagcttggtggcaagacccagcttgcggtggctcctggccacggctagagaggtgatgtggccgtgcgtctctgacgcctcctcctcactgcagggggtggggtggaacaggggttgggctgttcaaatgatttcaccagtgggatggtgggcggcttcgattgtgacacttcagcagggacctgcccaccatgacctacattttggctaggacgtagcccacgatggtgccatcgtagtcctcagccacatacaggagctgtggccacgatagggcatggtagaagtagtactgtagggtgtgtgtgaaacgaggtcgagtgagcgggggagtggagcacagagtgtaggcagccccagtcgccacagagacaccaccctgtaccagcccagtacgggggcttgaactggcccatgataccattccccaccttgagctggtagttctcaggcaagcacatcaggttgcaccgctgcatctgcagcaggtccgcgaccacagcaggccgtatgcacaccatcacggtggtgggaacgcgtgcttcacagccagcggctgacctgtttgcagattccctggggtttcttcggcataccagttttcttatgcattcgcgtaaggatgttgactgggcagggagtcgaccgcatgctgtttaggcggatcgccgtcccgtggtcaggnnnnnnnnnnagcataccagttttcttatgcattcgcgcaaggattttgactgggcagggagtcgaccgcatgccgtttaggcggatcgccgtcccgtggtcaggagccacgtgggttcttctcccagcaccacccctctggtctacgcctgctcggcaatcacaacaggcacggagcaccacactcgcaggggagcccggtcacaggctgcagcgcgtcaggccgcggggaggacgacgcgccccacatgcgccagctcccagatcttgatctcggggcccagcttcacgatgccgtcgccgccgtctgtccccaccagctcgcccacacggccggccaggtcgccgcgcagcagctgcgtcgtgtggagggcaggggtgagggtgcatcggcgaggtgtggtgggcggcggtgcgccaggcagtcgcacccgaggggcactgagtgcacggccgcgcggagcgctgcccgaacagcagccaagcccttgcatttcccgaatctccaccaccccgctgggctccaccactcnnnnnnnnnnggcgccaggcagtcgcacccggggggcactaggtgcacggccgcgcggagcgctgcctgaacagcagccaagcccttgcaattcccgagtctccaccaccccgctgggctccaccactcggccctccccacaccctgctccacccaccttgacggtgtctgtccgcgccggggtcacggcctgcaagtccctcaccggcacctccacgctcgcctccgcgccctcgtaaccccaggcgccgccgtcgccctggcgccccggcgcgacgcgcgcgagcagccccgcggcatccacctcgtgcaccgcaccccgcgcctcgccacccggcagcagcacctccacgcccacccagtgcagcgcgtcgccacgggccgcgtccgcgccctcggcggcgac

SEQ ID NO: 31169 - DNA, 101 bp, Chlorella protothecoides
gcatgctgagattgaatggcgctgcaatgccgaagcaggcccggcatcacagcaccgatgtcaccccaccgcacgcaaaacaccagaggtcctgctccccc

SEQ ID NO: 31170 - DNA, 110 bp, Chlorella protothecoides
gactcacttcccggtgtctggataatcgtatcaaagtacctgcatggacagcccagttccttatgtccccaccattgccagttgcaggcttcaagcaggctgtgggctct

SEQ ID NO: 31171 - DNA, 108 bp, Chlorella protothecoides
acagcacccaagcggagtggaggtggtccatcacgccgatgcggcggtgtgtgggaatgggtgtgtttgcatccgatgcggtgacctgcctcttcgcctggcggtggg

SEQ ID NO: 31172 - DNA, 127 bp, Chlorella protothecoides
gcccagtatgagcaacaaataaaccgaggccagccctgcgcatcatcttttgctcattccaggcagtgcataccatccttgtcagcttgttcatccgacacaaccatcccccacccacacagccaac

SEQ ID NO: 31173 - DNA, 739 bp, Chlorella protothecoides
attccccatttcgggcacaatatatgcgagcatcgcctacgtggtctgcaacgcaaatagtgccgatggccgtctctcccccaacggttctctgacaaagtctacatagtccccttcaccagatcagtaacaggcccttcaggcgcagtgttgcatccttccttgcagcactcaccacaattttgacttcaggagtatcaggagtgagcatgatcctttgtacccattggaagtgatgagatctccgagcacaggtgtacagtgagcagtttcaagcaggaactgggtcgctgcgtagacaatgctgtccctcgaatcggacgacaaggtggtagcacgtacgggcagaggacctgccaggcctttacctatactacctggaatgatctcttggagcttctcggccgtattctttcatttggcagcatgcatggctggtgttgcttgcccgtctgtctttaagttagtatcggcaggttactttaagatagcacatcgtctcatgcaggcgtcctggactcaaagtctgaagggacggcgaatggatcttgagtctcgccactcacgtcatacgcactccagtgaatatgaatcctcaaacggcgttgtatttctgatggtaggggtgccaggatataaacctcatcctccatacatcctgcacaggacatccaaaagattggacccttcggaagatactctatgcagggatctctggactggcaaatcggttgcagcc

SEQ ID NO: 31174 - DNA, 76 bp, Chlorella protothecoides
tcaagtatcatttggcaggtgtttccccccccttggccctcccatgtcctgaccccacctgcactccgccaaagct

SEQ ID NO: 31175 - DNA, 111 bp, Chlorella protothecoides
acttggccaaaggtgcagaaagctgttgtacggtcagtgcggcctcctgggacctctgccaagcccggcctcgccacccccctcagacgttggaggcatagagtcgctggg

SEQ ID NO: 31176 - DNA, 108 bp, Chlorella protothecoides
cggggggtgcccgatgagaagatgttcgtcaaactccagtcctccaaaagaacatcgttgcaaagtgcaacacaaacaccaccacctcctccgccccaaggaccaaga

SEQ ID NO: 31177 - DNA, 119 bp, Chlorella protothecoides
gatgtggcataggtgatgatgacctcttacattcccaacaccaacgaaataacagtgaaagtactatgggacgtcgcagtgatttggatgcctgcactccgcatgcttcctaaagagcc

SEQ ID NO: 31178 - DNA, 99 bp, Chlorella protothecoides
ccccgggtgctggagggaggcggggaggggtgtcgggagacctggcgaggaaacttcaggcaaatcatgcctggcgcgatgccccaggccctcacagtg

SEQ ID NO: 31179 - DNA, 716 bp, Chlorella protothecoides
  modified_base (184)..(378): a, c, t, g, unknown or other
gcacttcatcgtgagtcagggctgtgccagtgggtgatggacctgagcgcaaggggtgtgtgtgcgcatgtccagcctgctgttccattcggggcccggtgcagggtctgcagctgggacccttgttcaggctgcccatgcacctcagaaacgccacatcacacgtgccctgctgctccctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttatgggggagcggagcgggaggggtggtagggaaattatttgggggggcggggggcgggggggcaggtcttgaccacagccttggagcgggtgctctgtgccgccctggccacagccatgccgcagacgtgagatggccatgacctgtgtccttctgcacgaggtccatgctcagactcagctcttgtttatcctcttctgctacaccaccctaactccccccattccaaaccatcacacaactacccacagatgggcgtgtgtatgacgatgtccgcctggagccagacagggccaggctgagggcgtgccgcgcagcagaggcttgaggcga

SEQ ID NO: 31180 - DNA, 76 bp, Chlorella protothecoides
accactcccttcgccgccgccctctcctccaagccctcccctgatcccaccagccgaatgcctgagtgcgcctgtg

SEQ ID NO: 31181 - DNA, 24750 bp, Chlorella protothecoides
  modified_base (194)..(203): a, c, t, g, unknown or other
  modified_base (397)..(406): a, c, t, g, unknown or other
  modified_base (510)..(519): a, c, t, g, unknown or other
  modified_base (610)..(619): a, c, t, g, unknown or other
  modified_base (2686)..(2695): a, c, t, g, unknown or other
  modified_base (3494)..(3503): a, c, t, g, unknown or other
  modified_base (4558)..(4567): a, c, t, g, unknown or other
  modified_base (5620)..(5629): a, c, t, g, unknown or other
  modified_base (5930)..(5939): a, c, t, g, unknown or other
  modified_base (6059)..(6068): a, c, t, g, unknown or other
  modified_base (6227)..(6236): a, c, t, g, unknown or other
  modified_base (6660)..(6669): a, c, t, g, unknown or other
  modified_base (7179)..(7188): a, c, t, g, unknown or other
  modified_base (7643)..(7652): a, c, t, g, unknown or other
  modified_base (7875)..(7884): a, c, t, g, unknown or other
  modified_base (8101)..(8110): a, c, t, g, unknown or other
  modified_base (8775)..(8784): a, c, t, g, unknown or other
  modified_base (9290)..(9299): a, c, t, g, unknown or other
  modified_base (9386)..(9534): a, c, t, g, unknown or other
  modified_base (10307)..(10316): a, c, t, g, unknown or other
  modified_base (10452)..(10565): a, c, t, g, unknown or other
  modified_base (11292)..(11301): a, c, t, g, unknown or other
  modified_base (11498)..(11507): a, c, t, g, unknown or other
  modified_base (12918)..(12927): a, c, t, g, unknown or other
  modified_base (13602)..(13611): a, c, t, g, unknown or other
  modified_base (14086)..(14095): a, c, t, g, unknown or other
  modified_base (14352)..(14361): a, c, t, g, unknown or other
  modified_base (14872)..(14881): a, c, t, g, unknown or other
  modified_base (14962)..(14971): a, c, t, g, unknown or other
  modified_base (15081)..(15090): a, c, t, g, unknown or other
  modified_base (15407)..(15416): a, c, t, g, unknown or other
  modified_base (16133)..(16142): a, c, t, g, unknown or other
  modified_base (16515)..(16524): a, c, t, g, unknown or other
  modified_base (17541)..(17550): a, c, t, g, unknown or other
  modified_base (18427)..(18436): a, c, t, g, unknown or other
  modified_base (19805)..(19814): a, c, t, g, unknown or other
  modified_base (19883)..(19892): a, c, t, g, unknown or other
  modified_base (19961)..(19970): a, c, t, g, unknown or other
  modified_base (20097)..(20154): a, c, t, g, unknown or other
  modified_base (20582)..(20591): a, c, t, g, unknown or other
  modified_base (22578)..(22587): a, c, t, g, unknown or other
  modified_base (23509)..(23518): a, c, t, g, unknown or other
  modified_base (24055)..(24064): a, c, t, g, unknown or other
  modified_base (24373)..(24382): a, c, t, g, unknown or other
  modified_base (24580)..(24589): a, c, t, g, unknown or other
ggaaaggggagcggggtggccagagccttgggcaccagcgcctgcaccgcctgcgccagctcgaacaccatgggctggcccagcaggcccagcgcccgctcgtgcagcgcccgcgtcagcgccagcgtcgcgcccgggggcagggccgcacacctggcgagtgtttttgtgtgtgtgtgtgggggggggggggnnnnnnnnnntgggggcagggccgcacatctggcgagtgtttgtgtgggtggggggatgggtggggggggataacattgatggcgggacggtgaggggtttcgggtgacttgcacttgctaagtcaagaatcacacacgcagagaggagccgcctcagccctacgaccaggctttctccccctcacctgacgctgagaacgggnnnnnnnnnnccgggtgacttgcccttgcgaattcaagaattacacacgcagagaggagccgcctcagccctgcaaccaggccttctccccctcacctgacgctgagaacgggnnnnnnnnnngtcgggcgcctcctggtcgatgtccagcgacaggcggaggtcgagggaggccgggccgaccgtgacgtcctcttcgccaaagatggactgnnnnnnnnnnggcctggaagggatagcgtggtgcggcgtcgccggtccacacggtgaggtgcaaggagctgggtccgggcgcctcctggtcaatgtccagcgacaggcggagatcgagggaatccgggccgatcgtgacgtcctcttcgccaaagatggactggatggtggcgacctcctcctcccacatgtttgagcagtcgtcggaacgcggcggcaggtcagtggcgctctcagtcaggcccttgtttacagctgtgagggtgggcgtaagggattgggaatggttgcagtggggactcgataatgttgaaggcatggctcaatgcaggcatggtcagaagcagtgtgccggtccagcatcccagcacacaccaaccaccacaccacccccagacctgtcagcatggcaaagaggagcctgcgcgcggcctccacggccccgctgccctccgccacggcccgcatgacctctggcagggggtagccgcagtcgatcagctcggcaacggcggggtcctccagggcgatggcctctgcctcggccgcgctggtccagccgttgccgcgattgagcacctcgggcgccttgcccgccgcgcctgcggcggccagggggtgggaggtccagcatgtatgcaagaccacatgcaagttcaagatctatgaacacaggcagggaaggggatgcgttcaagcagcagggcgggtgttcatagcatgcatgcctgtcgctcagagtcggactcacacgcagcgccctgccaccaggaagcccatctccagccccttcccacacatgccaacagattccagcaactccccaccgggcgcaaatctggtgggcagctcctcctccggtatgttgaggcataaccagtccagggcctgcatcagcgagaccgcgggccccagtacctgcatggcagcggcgacggccgcctcgctgaaccccagccgcctcgcctcactcgcgacggagctgccctcagggacgggccccgcatcgattccgaggcgcccgccctcgccatcccgcacgctgaggtcggccaggaggtcggccacggcgcggcggtgctggtccgtcatgatgacggcggagggcgcgtggcgggccgcccgggccacggccgccttctccctggccgccgccctttccttgcgggccgcagcggccaccgcgcgggccttggactcctcggcctgcagtgttgtacaggagggagaggggcctgggcggggcaagatctccttgccggctcacacgcagcaagggacatgcaaagttcaccctcccaggccaggccccaccagtctcccacccaactccctgcaggggcctgcgctggccccaccccctcactcctaaaacccccttcaggtccacagtaccttgtggcccagctccttccacagcccacggtattgctcggggaggagggagtgcagggacctgtcccctgccaggcggtgcaggcccaccaccgcgccacgctgcagcgcctcctcctccgtctccgcggccgcctcctctgccaggaacatgatggcgtcggcctccgcctggcgcgggtgtggcaggaccacgcgacaccgccaccgcccaggcgcggcggccggcactgccttgtagcgcggcttggggagcttctccttcaggcaccactcgtgcagcaggagcttgggcgacttgccggcgtagtacccgcccttgctgcccacgtccatgagtggggcgggggcggcgggcgccggcctggcagccggggctgcggttgcagcagttgtgggctcctcccccggggcagcctcggcatgttgcttcttgatgtgctcctgcagtcggttggcctgcttgtacaccttgtcgcagtggggacaggtcacctcctgcccacgcttatcgaccacagcagggcccttggtcccacccccaccgccagagctgtccgtgaggggggatggtatgcaaggggagggaatgaggagggacttgaaagtttatatacatttagcgcatcccgacgttcccatgaatgcacccccatcgacgagcctgcatgagttgtcagcnnnnnnnnnntgcagggcccttggtccctcccccaccgccagagctgttcgtaaggggggagggtatgcaaggggagggaatgaggagggatttgaaggtttatgatacatttagcgcatcccgacgttcccataaatgcacgcccatcgacgagcctgcatgagttgtcagcaccaccgacctgaacactttagcggatgctcgcttggcatctctgttgcgcactccccccatacccttaattccatgtcacttttgggcgagagtgtcacagctccaaaaggctcatatagtctcgaagctctagtgcgcagtactcgcggttttttaaaagccaaacagcgcgcgcgagagagatcctccgccgccgcaccgcacgagggtggtactggttgagaaaggatggtgacctctctgaaaagattctaaagatgatatcaaggtgcaggagggacagcatcatcagacagcaggtgagagagatcaggaagggagtccaggatggccagggccggatgcggggaatccgatgggaggtctttgggtgccccattcacagagtccctcatgtcaggctgtatcactgaggatgtcccggctccgagcatgtctgtggggggttcagtcttggcggccggctcgctgaagtatggcacgattgtttctccacccagacccacgggaagggattcaggaacaccctccaccggggcctcctcaaaattggaccagtcctctgaaaggtctccgatggcagccgcctctctgctaagcggctgaaactccctgtcggcgagcgtgggctccnnnnnnnnnnaatggcagccgcctctctgttaagcgattgaaactccctgtcggcgagcgtgggctccacaaccggttccaaagcttgacctgctccagcctccctgcccacgggtggaccattccccgccaggaagggctccatgagcgaggcagaggcacctcctccctcgccagcggtggatgtgccgcccattgacgcctcgccagcgtgagtgaatcccccgtctgctgctgaggaatcagggttgcccccactctcctcagaggtctcctcgtgctccacccagtgctgccccaggggggtggtggggtggaggattggccatcgagcaagctgaaagggtttcaatgacacaccattttgccgatagcctgggatcgccagggagcgtcccaacacatgccaggacccgagcagtgttactttcgcctcatgcccacccccctacctacctcactggaccatgcctcctgcagggtgtgctcaggcaggtcctggtcgccctcagctgccttctggaacggcacgcctgcgacttcatgtggtgctggtggcagcgcggatttatggccccaggaaaacctgccctccagccggcgctgactcgtctgcgccgttttgggcacgggcagaccctgtaatcaaggggttggtgcagggttggacattcaatgccagatcccgggcactgtggcatctggagacaagggcttagcctgtggcaacatggctgaaggggcatgcatccccacagtgtccaggatgctgcagcattgctccggtgcagctgtactcccaagcgccgcagggacattgacgacgccacccagtgcatccaggcgatgcagagtgagtaccacctagggcactccaatgatcacaatcgtaccatgctgttgaggaagcgtgcccccgctggcaggtgctgccacaaaggcataggcggctcggcgtccagggtcacgtggcgcgggtcccatgctctgaggccgggatatgcagcctcgagctcgtccagggagagagctgtgcagaggccggcgccagggtacaggagatcnnnnnnnnnntaaaggcataggcggctcggtgtccagcgtcacgtggcgcgggtcccatgctctgaggtcgggatacgcagcctcgagctcgtccagggagggagctgcgcagaggccggcgccagggtacaggagatcctggaggaatcggtcatccactaccccaccagtcgcatccttgaaggggtcacagggtgacgcttccggcaccccggtggaagacctttgcgcctctgtggcatctggctcttgatccaggacttctgcattggcacacatatgactgtttgaagcgttcaagactgcattcctcttttggcaaggtggtctggactccataactggccaccaggctgcagaatcaccttcccacgcacctgcttcttgaaattcctccacaaagtcatcaaattctccaaactcgtcgaggtccgactcaggcccttgtgcttgttgcactggagcagcatcttcgcttgacgctgcagcctcatcctcctctgagcccgtctgctgggactttgcagctgagctgaccccctccgctgcatcagacttttgagagtctggtggctcatcaggggaaggtgcactatcggaagatgaacaatgtatggctgtagagcgtaacgtcggtgggtctccactcaaggcgaggacgacgttgctaccgtcagagagctctgctgtgtcaccagcttctcctatgccaacatcactggagacaacttcatccgagctggtgggggcctcatactcctgatcgattgtttctgtggctggatcctccagtcgtgaggcagttgcctcttctccatgagacagatcgtccgccatcggcaccaatcctgcctggtcaaggggtaggggagtctctacaaggtaatgcttcgattgtactgcagcagtctgaaacatcgtagaaatatctgatacatgtctcaaatttaatagaatgaatccattcgccctcgctgcgcaccgcgttcagcctgctgcttgggagagtgctgacctctcctccccccagaaggaggatcgatcaagccttgcctgcaccannnnnnnnnnttaatgctacgattgtactgcggcagtctgaaacatcgtagactatctgatacatgtctcaaattttatagaatgaatgcatctgcccgcgctacgcaccgcgttcagcctgctgctggggagagtgctgacctctcctccacccaggaggaggatcgatcaagccttgcctgcaccagttccaaggtgttgaaagtctagttcgattgcatttgacatggagctgttccaaagatagagagtcatacacacgatgcaaacttcatggagcatctgttggactcacgatctccggcgtggnnnnnnnnnntctaggtgttaagagtctagttcgattgcatttgacttgaagctgttccaaagatagagagtcacacacacgatgcaaacttcatggaacatctgttggactcacgatctccggcgtggnnnnnnnnnnatccaacgtgccgaggaagcggcagcgatatatcaggctctaccccctagatgcaaattcagctaccatcgaaatcatgcaggcttgcgtgcgatatctcgcgagatccgcaccagtaacttggtcatcagtttgctcgtctgttcctgctgctctccnnnnnnnnnnctccaacgtgccgaggaagcggcagcaatatatcaggctctaccccctggatgcaaattcagctctcatcgaaatcatgcaggcttgcgtgcgaaatctcgcgagatccgcaccagtgacttggtcaccagtttgctcgtctgttcctgctgctctcctccacctccgacagtattcagaggcacagcccagtcaaactgacgatgcggaacctgtgcgtgaccagatagaattcaacactttgtccaccccaagctgcattctcaatgaggactacccccagatccagtttacttctcccttcctcttcacaaaggacggtgagctggggtgacgctggtctcagggaggccgtttactggcaatctgtgacctcacagcattacaaggttaatcaatcaaacccacatccaacagatgtgtnnnnnnnnnngggcgctggtctcaaggaggccgtttattggcaatctgtggcctcacagcattacaaggtttatcaatcaaacccacatccaacagatgtgttcatgccaagggcggtgggcaagcccatggcgacgtggactgcgccgctgatcgagatcaggaagtacttgaatgtgagtcgagttctggaccgtaagcagagtacgctggccgctgcttgttttctgttcctgatgcagtctcgtgtcgtggaccgattcctgcatgccgatccccctctacctcagaacacggtgatgtccaagctcctgcaaagcaagtatgaccagacagccaagaggaaggacctggaaagcggggcatggcaggccctggagtcaagtgcgtctgtatgtgagacaatatgtgggccacattgatcgctctgaatgcttgcaagggtggttcagggaaccttgattgggtccctgccatgaagctggcccatggcatctacccctgccggttgcccttcacnnnnnnnnnnactctgaatgcttggaagggtggttcagggaaccttgagtgggtccctgccatgaagctggcccgtggcatctacccctgccggttgcccttcacatgccccagaattcacgcaagccttcctgtcgcacccccagccgtggaggcatacaacacgggcgactttgatatgctgtctgagtttgcagaccacgagctggtgggggagttgcgccgcaactacacccacacaatggggaccaagggcatggaggagaagggcgttcggttcaggattgctgaccggagcagcctcattctcactgacgtcctggagcggacgcggaccccagagggcaggtgtgttgcgtggcattggaagtcagggtaccatgggtgctgcagggaggctgggcagcaatgctgtgcctccctcctatgcctagaccactggtattatccaagtgttggcctctnnnnnnnnnncggcaggtgtgttgcgtggcattggctgtcagggtaccatgggtgctgcagggtggctgggcagcaatgctgtgcctccctcctgtgcccataccactggtattatccaagtgttggcctctgatttctgcctcagctcggcagcgcctcgcccaccaggtgggtgaagggagctgccgagggttcgagctcgggcgtgagtccgcagcccctcctggacggnnnnnnnnnntccttgcccaccaggtgggtgaaggaagctgccgatggttcgagcttgggcgtgagtccgcagcccctcctggacggcccagagcccgaacgcttctgcttcctgtatgttttgtacgactgcgacctgcgggcagacatctacaggaagagtgacaaggcggtgttgcgggaggtcgtgctgccacggccatatgcagccgcgttccgcaggggannnnnnnnnncgacatctacaggaagagtgacgaggcggtgctgcgggaggtcgtgctgccgcggccatatgcagccgcgttccgcaggggacccctccccctcagcctcccggcaggctctctggaggcagactgggagctggtgtgcttgagacgaacaaatctgggtgcagatgtgcaagtggaatgaatgtagaaagcttttaggaaacgtaacatttatggacgaaaggtatgtcatgatttttgggcgcgagcgggtcccgttgctcctcctcgaatgtgtgggcaggatgcaggccctggagaggagggtgcctacaaataatagattcagaaatttcattcttcgatcatttttccttacgacacttcaagatggccgcaagagtggcgagtcacagattcgcccaggctgccaccagggcctggagttttggcagcaggaaccccggccccgtgctagcgagccaggcgcggggcatggccgcccaggcagagccctcaattggtaagctggatcacattgcaaatgggaaccccgaggtccaggacctggcgcgcctatgtcacgctgggggtgccagtatcaggtcggcagcatccatgcacgcgccctccccactctctccaactcgcagatgccagcgatgtcagcgactttgttctggagnnnnnnnnnncatcaggtcggccagcatccatgcgcgcgccctccccactctctccaacccgcagacgccagcgatgtcagcgactttgttctggagaaaaagggcatccgcgtgcgcggcacgcccatgtacctggacatgcaggccacgacccccgtggaccctcgggtgacggacgccatgatcccctacttcacggagctgtatggcaacccccactctcgcacccacttcctaggatgggaggcagaggacgccgtggagaaggcgcgggcccaggtgcggcggtgtgttgtgggagggatgggaaattgactgctgggttgctccttgtttctccacctgccatgcagtctgtgcctcaggagtgatcaaatgggagggcccctggtcctcaccagcaggaacaaagccctcaccacacatctgttcatctggactccctccaatccctcgcacatcccccccccctccccaggtggctggcctgattggggccgaccccaaggagatcnnnnnnnnnnctgctccttgtttttctcctccggccatacagtctgtgcctcaggagtgatcaaaggggagggcccctggtcctcaccagcaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttcacctcgggcgcgacggagtccaacaacctggcgatcaagggcgtggcgggtttctaccgggacaggaagcgccacatcgtgaccacccagaccgagcacaagtgcgtgctggactcgagccggtacctgcaaaaccgcgggtttgaggtgacctacctccccgtgggcccctcgggcctcgtgtctgtgcaggcgctggccgacgcgctgcgccccgacaccgcgctcgtgtcggtgatggcggtgaacaacgagatcggcacggtgcagcctctggcggagatcggcgcgctgtgccggcagcgcaaggtcttctttcacaccgacgccgcgcaggcggtgggcaagctgccgctggacgtggacgccatgaagattgacctgctgtccatctcggggcacaagctgtacgggcccaagggcgtaggcgcgctctatgtccggcgccggccgcgcgtgcgcctggaggcccagatctccggcggcgggcaggagcgggggctgaggtccggtaccctgcccacgccgctgattgtgggcctgggcaaggcctgcgagatcgcgggggaggagatggaggccgacagccggcacatccaggggctggcgcggcgcctctacgacggcatcaccagccagctcgaggtgtgtgtttgtgtgttttggggaggggggatgatggttcggaggaaggcacggaattctttgcgtgcggtggcttgtggagcttgcagatggctgtccatgcacgatcgcaaggaggtggnnnnnnnnnntggaggaaggcacagaattcttcgcatgcggtggcttgccgagcttgcagacggctgtccatgcacgatcgcaaggaggtggtcaggcatggaatgggaggcaaggcccctggctcttcttcttgctacttctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttgaattctccaacagcacagcccgcacccactgctcgcactcacccacccacccacccgcaacctcgcagggcgtggtgctgaatggcgacgagcaggcgcgttactggggcaacgtcaatctctcctttgcgtatgtagagggcgagtcgctgctgatgggcctcaaggacgtggcggtgtccagtgggtcggcctgcacctctgccagcctggagccgtcctacgtcctgcgcgcactgggggtggaggaggacatggcgcacaccagcatccggttcgggctggggcgcttcaccaccgccgctgaggtggatgcggctgtggaagctaccgtgcgccacgtcaacaagctgcgcgagatgagcccgctgtgggagatggtgcaggagggcgttgacatcaagtccatccagtggagccagcactgagcgctgggtgttggtgtgggccggcatgccgcggagaggcgtaggagtgtacgtgagggcatggaacctggcgtcactccgaatgcctcatgtgtgcctttgttccaatatctttggggcccaatcccttggcacgttgtaagagaataagctgaggatcaggggttgaaccaaagtgacatggctcctctgatacaggggatgggcgatgctcgatgggccgaccaggaacatgagatgggactgcaccgaggggcaatggcccccttgcagggcatgcgcaatgcattttnnnnnnnnnnttgggcaatgctcgatgggccgactaggaacatgagatgggacagcaccgagaggcaatggcccccccttgcagggcatgcgcaatgcatttttcgcatgcgtgcaggtccgattctcgaacggatagtgaaaagtatggagaacattcattgcctcgcgcaaatgagtgattcgcatctcatgctgtctcgatctnnnnnnnnnnaaacggatagtgaaaagtatggggaacattcattgcctcgcgcgaataagtgattcgcatctcatgctgtctcgatctgtcgtcccatgcgcattgaaagtcggcctggcctggtacacacatcatgatcgaacaaatgcccatgacagctcgcacgttggccactccttgtccgtgaagacactgtcctcgacgtcctctcatacgacttgagctctggtgcttctgccaacatgaacgtgcataagcgcattctccactccacaatgccgtgaagacatcctgccgtgatgctcctcgagcgcattgcatggcgcccccgcatggccattcctcacacatcttcacgaggaccccgccagacatcatgcccacgccgtgcggcattcctcatctgcgccagcaaacgcagggacgtggacatgatgcgcttcaccctgggcattccgggttttgatgatgcccagatacccaggatcatagggctggcagggggcagcctcctcatcgccaatcatgtgctcggatcccagcccactcccctggcccaggtatgaatgggtggggagaagcattgctcatggtgtcggaggaccgcacccactttcacccagcttgtcaagcatgcttgtttccatgttggaaaacaaccgcctcatgcacacgtcaaccttccagttctctgtgcagactttggccgaggtgttgggcctggcgctggcaagcctcgccttcgccatcccaaacttggatgcctgggtcaatggggggaagcaggctgctagtgcgaccatcacaggtgctcgcaacgtcttcagcttggcagaggatctcagcgaggatgccaaagtggtgcgtgcccggtgaattagccgagtgggcgttgtggccccttgttgattgcaagcatccgagtatgcagcagacagggatcccacggctagctgaggcaaccctcactttccctgtccccgacaggaactggcgtgggcttcgtacgtcctgctgttgaatacgggcatcgctgggctgggtatggtggctggagatcgcatcttgctcctccggggccaggttgcaggcacagcaccggcgctcgaagacggcgccggcggcgattggagggcgcagacccggggcgcagatgccgggcatggcgaccgacccagctttgtccctgcctctatgcaaaatctcctggtgaaggcgttcacgaccaggcacgggcaagccccctcgcgtctgtatgtctggacggcggacggtcaaagtttgccgccaaacgacatcgtatggctggatgcactggtgaccaagcttgcccgtgctctgtgacatgcaggattagactgttgcaggctgatgggtgcggctcctcttgttgagagcactttgctgcacatgtgctggnnnnnnnnnnctggctggatgcactggtgaccaagcttgcacgtgctctgtgacatgcaggattagactgctgcaggctgatgggtgcggctcctctcgttgagagcactttgctgcacatgtgctggaattgctgcagccatgtgccttatccgagtctgaaaactatcgagttaacaccaggcatgagacagagagtgtgcgcggagggccgcctgcctggcgcccggccgcagtgctgtactgagaggcgctgtgccatgagcctggcatgcaatgcacacaaagggccaatgggtcggtatggagacttccattgccagccgccccctccagtgccggcctaggcagccctcaaactgcctgcacgccttgcaacgccttcttgacggcggcgtcgatgcgcccttgcaacgcggcgtcccccagccgctgcacgacctcgcgcccaaaggagtccacgaggattcgccgggcggccgtggcgtcgatgccgcgcgagctgcgtgcgtgcgatgatggaggggggatgtggagggcacgtaaccgaaacaggctggttgcaaccccgtgcaacaggcggatactcggtggtgagcgacatgaccaccctcaagagagggagcaggtggagagggggaccagcacatgatttgaccttgcgagcacacccgctgctcctccnnnnnnnnnnggggcgcgtgaccgaaacaggctggctgcgcccccgggcaacaggcggatactcggtggtgagcgacacgaccaccctcaagcgagggagcaggtggagagggggatcagcacatggtgtgaccttgcgagcacacccgctgctcctcccccctcccccctcgcaatcactcccccagccacacctcaagtaaaacagctggtcctcctccaggtcagagatggcggcgccgtgggtgcacttgacgtcgtcggccacgatctgcaggttgggcttcacgttcaccgtggcccgcggcgccagcagcaggttgcggctgatctgggccgcgtcggtttgctgcgcgccgcggtttacgcgcacattgccgtcgaagacgccccgggagcgcccgtcggcgacgatgcacctgcaaagagggggagaagtgggatttgggggggaaggtctcaggaaactgagaagagcagcggcnnnnnnnnnnggagggggagaaggggggttggggggggggaggtctcaggaaactgagaagagcagcggccggaaggtctatccaggcagggcacattgcacaggcctttgagggcaagcagatgaggagctggacattggccgcagagacaggctcagtttggtgagaacaggcgtccaccgactctgcgcccagtccgcaagggggacagccccggcgtcccccggcccgatgccaaacagccatcccactcgcacttgtgcagnnnnnnnnnnctgcacaggcctttgaggtgagcagacgagtcgctggacactggctgcagagacaggctcagtttggtgaggacgggcgtccaccgactctgcgcccagcccgcgagggggacagccccggcgtcgcccggcccgatgtcaaacagccatcccactcgcacttgtgcagctggtcggcctgtccggcggggtggtccagcgtgagcttggagtgcaggtcgtgcagctgggcctgggaagccagcaggaagctggccagccgcgtctgcgtggctgcgcccagctgcacgatgctgaggtcatgccgcgtcagtgcgccgcccaggcgtgcctccgtcaggctgtaggagctctcagcgccctggtgagggggatgggtggggtggggagtgatgcaggtttggggggccaaagggaaaatggtgtgcacaggtccggaggggagcgcatgctgcaggttcacggattaatggcacagagaccagggggggggggggggggggggcgacannnnnnnnnngaggtccggtggggagcgcatgctgcaggttcacggatcaatggcacagaggccggggggggggggggggggggggggggnnnnnnnnnncatggaccatgccatgggcgcgaagggacgcggagtcgggaggcctctgtcgcctgcaccagagcagcgtggcgcctccctgcccatcccctcacgataacggtcccccnnnnnnnnnnatgcaacgcggcattgaccatgctgtgggcgcgaagggacgcggagtcggtaggcctctgtcacctgcaccagagcagcgtggcgcctcactgcccatcccctcacgataacggtccccccatcccctcagccatcctccaaacacctggtgcacaaaggtggccttggtgtggctggcacctgccacgtccgtcgccacataggcgtgactcagcgccgcgcggtcgtccagctccacctccagcacggcattgacgtagtagggcgcgggcgcgccggcgggggaggcggtgccggccgccccgcccgacggcgnnnnnnnnnnatccagctccacctctagcacggcattgacgtagtagggcgcggcggcaccggcgggcaaggcggtgccggccgccccgcccgacggcgacgccagcgggacaaactcctccaccaggccggccgccgcgccctcctccagcaccaccagggtgcggggggaggacatgggcacggcgccggggtcgcggtcccccacgccccccccgggcgaggacaggtgcacgacgtggacgggcgcggccagcgtgaccccggcgggcacgtgcaccaccagcacgccggcggcgcttgccgcattcagggcggcaaaggcgccgccgcgctgtccgctctgcatgcccaggctgaaggccaggacgtcggcgggggcgtcgtgggaggccccgacgaagacaccggggggcagggcctcggggccggggacgagccggagcaggaccccgtccaggaccactgcggtgaccgccgccgggcgcgtcagggtgaggtctgccgcggcccccagcgcggcggccgcgtcgccgcccggcggggccgccagctgggcgccggtgatgcgggacacgtcggtgaagcggaactcctcctgcttggaggtgggcagtcgcatcgtgctcagcgccgcctccccggccctcctcaggccctggagtctgtgcgtgtattgggatggacagcgcgtcaggctcctgggccagggctccagaggggcacnnnnnnnnnnatggattgggatggacaccgcgtcgggctcctgggccagggctccagaggggcaccacctataaggagaccccgttgccagacgccgcgacccaactcactctgctgggactgtgtctgccccctccacagtcctcctggccacatccaccataaacgtggctggaggggacttgggcagggtgctctccgctgcggcagcggcagaagcctggcacacgcccggccaacacctgaaccggctgtgtcgggagctctgggtcgcggggacgggcgcccggccttccaagaatactcctgcgtatggatggtaacatggatgaggctcgcacctcgcgattataatgccagcacatcctactcccgacctcgcnnnnnnnnnnctccaagaacactcctacgtatggatgttaacatgtatgaggctcgcacctcgcgattagaatgccagcacatcctactcccgacctcgcgcacctctgggcctggtgcccgacccggctgcatgctggtgagcgccactactcagcacacgcattgacatgactgatctctgtaaatgccacgagtggctgaggaatgtcatgcatcggctgttgactcctgcctcatgcgcgcgggatggaagatttcgtcgcatggcgtgcccccaactagatctacatggatacatctccggaatattatgttgcggccattctgaggatatcacaacacccgatcacttgctgtgcatttccaacatgtcgatggcaatgaatgccggtgtgaggccgtgtgggcaggcactcgccgccggaagatgcctgccatgcgcacccatgctgcacacgtcgccactccgtaggtgggtatgcctcatacggctgccgatgcacacagcataggtttgtgacagttgttagctacagggcatcgtatgggtgtgcatggcacatgtctggcatcccgtattcacccgtgaccccaggcactcccctcccagtggcccccctgccacactctccaaggccgagcatcctgggcgccggggactcacagcggcacgggccctccctccactcatgcaactgccagcctccctggccgaggaggtggctgaccctgtgacgggcggcaagctggcggacctggggcagctgacgtccggcatcaaccccacccagatcatcctcctgctctccccgttgctgctgtatggaaccttctacctctatcgcgagaagtttgatcgcaaggccaaggtgaggcagggccagcaagttggtttgttgggtcccacgactgcacacccacgcagatgcccgcgtgtgcagctccggcccccgccactcaccaactccaactccccccctccgactcgcagattagcgacttcttgttcatcatcgcggcatctnnnnnnnnnnttatgttgggtcccacgactgcacacccaggcagatgcccgcgtgtgtgcagctcggggccccgccactcaccaactccaactctccccctccgtctcgcagatcagcgacttcttgttcatcatcgcggcatctgccatcgcctggaacatcatcagcatcctggtgctcaaggtccgactcttctgagcagccagccacactgacggcaaagatgtgctcggacattccgagacccaccgctgctccccctttcgctcgtcagcacgtcaagtcacagctgtgcatggcagggcctcgccatgaaacgtaatgatataaagaatgaggggtcagggatctggagaaggcgggtgtgggatgcctggtggcatacacatgggcaggggtcggtcctaacttggcggctggataggaggggggctctgccccggccccggccccggccccgcctcctgcgtcccgccgctcgtcccagagcgaccctctgatggggcctgtggcgctcgtgccgggccgccgggctggctggcagcgcccgcaccgccctcagtacctctcgcctccgggccgtgagcctcgcctgttgtcgtcccagctcccgcatcccgcatggaggcctcaccagcggcggccgtcctgggcggcaagggcgggagcccccttccagacgcgtctgctgccccaccgacatctgccattgccaaggcggtgggctgtgcagccccgccgccagtcggctcggccttcaccgcctccacccgcggccgggcctgcagaccagcgaccccatttggggtccccgtctccgcttctctcttaatcacgacgcccccgccgcttgcgggcggggcatgggcggctgagccgttgcccnnnnnnnnnnctccctcttaatcgcgacgcccccgccgcttgcaggcggggcatgggcggctgagccgttgcccaacgggaccatgccagggccctcgctggcgggggaggggtgcgtcaggctgacggggtctgacagcgcgggaactaggcccagcggctgcgagggcagaaagttgttggccaggtccacattcaacctgtgcgaagcccaagggaagcagaatcactgagggttatgtgccagccaaggactgggaggcaccccggacacagcgaccctcagcagcggatctctggctcagagccacctctatcaagcaccacatgctgtacggtgtcctcacaggcagaccgagccaggcaaccgccctggtcctatccagcaccaccacagcaggacccccacacacatcagccgcatacctgacgggtagctgcggcatctgggccatcacgccgtccatgctctccatctgcttgatcaccgccaggatgttgtcccggaactggaccagcagcctggtgttgtcatgcacccgaaaatgagtcatgttgcccttgaactgctggagcagggccaggttggcctccagcagcgaccccaggctcgcctcgccacggcccggacccggcgccggcgtcgccctttcctgcgccgggggcggggcgggcgcggcgctcgccggcacagggcccgggtgggagggcatcatgattgggcccaggccccccatcgaccccggccagttgggcatggagggttggggcacctgctgcgatatggcaaggggggatgcgagcgtgtggttccggggatcggaggtagggcggcagggagagtcgtggcgggaccgatgagctggcccttgaaccctggccagccccgtggaagagcagtcgggaatgcaaatgttgatgcgacgcatgcgtcagccgcgtcatgtacccaccaggagggggttgtgcaggagggggcgcttcgcggcgctctccccgctctccagctcctccgtgcgtcgcttcttcagcagggccgcctgcttggtccagcgagcacgcagcgccacctcccgcaccgactttcgtggaagcgccagggcgatgcgcacgtactgcgccagggggctgccctgggtgggcgggaagcgggccaggcccgtctccagcgcccgctgctcctcctccgaccagtccaagctgacgttccagtgagcgatgctggagggggcactcatgttggcaaccacacctgagcagaaggagtgtgatcagaagtggatccctgggggctgtctggagctccaggagtgcgccctgggggttggctcttgtggcaagggtgggcccagatgtgatcggctggaggcagcgaaatnnnnnnnnnnggatcaacctcaggcggagcagatgctcgtgcgagacgatgccgcctccccgaaaactctggctgcctnnnnnnnnnntgatcaacctcaggtggagcagatgttcgtgccagacaatgccgcctccccgaaaactctggctgcctnnnnnnnnnngttggctcttgtggcaagggggggggtccagatgtgatcggctggaggcagcgaaatttccactgcctgcgagctaccacatcgcagcacaccctttgcaagatagaatggccatcagcttacaggnnnnnnnnnnnnnnnnnnnnnnnnnnnnnnnnnnnnnnnnnnnnnnnnnnnnnnnnnngctgctcgagacacctgggcagtggtcgactcttcagccctcgagttgcccgcatcggcaagggttcatctccctaaaataataaaagcttgaagtaaacagcataatctcgctgctgcagactctcacgcccactcaggtcaaggttttacttaattgcagcgagtgtcacaagcggacatgttatctatacgttgtcccgctttccaactcctgctgaagattagccggttggacggtgggctccgcagggtccagcttcgcccagaggactcaatttgctcatcagtaaccttgcatatgtaatgcagagccacatcttgctgttttgatccctacgacagtgtgggtccttgtttggtgaggtgtacagatagtatgtgcattttcgtagatatacatctactaatatggcgcgtcgttctggnnnnnnnnnnccaacgacagtgcgggtcctggtttgggggggtgtacagataatatgtgcactttcttcattatattctcaaagtttcaccaactccctcgcagtcgaatcttgggtaatggcaagcacagagttttgctcattctcgactgtcgacctttgtcatggatcagtggatgttggatgctatgctgaagatagcacacgccagttttgccttgaacactcgccgacgccaatagcagaagatgctgtacaaggcagacagccaaaactcatttggatcggcccaaaatgcgtttatcccaagaccctccttggttctgtggaccaactctattcatatactcgtgtgatggacttacagctcttgtggccacaatcttcaacactgaaatcaaatgcttcacatttcatcaagctcaaataagaatgtggggtactgttgcattttgttgcagctgcccaccacgtttcgacactgaagcactcgtgccacttccatcctgagacacctaaaggtggccaattattgatcggaagctggtgcttgggaatccttgacggcagcaggtgaagcttgacatagaatctatctagaacggcatcaatcgacacgtcgactctgggatccacacctcggagttggatggcatggcggctagccttcccgacaacggaattccgctcccgcaactctagtggttcctcgtctcgtacaaagcgcacgcgccatcaacatacaagagaacttgtctcggtctgcccacagcgttgggttcaaagtgtccaggagaagggatgcccggataggccacaaactgctgtcgtggttagcacctcagcgacgagagctcgcatatgcctcccatacagctacttcagcacagcaacagggcttgataccagctccaatgcccgcctgcacgctcgccaccgccactctcactgagaacacggacgtggtggcttggtgtccctcgagccgacacaccgacctgctcgcggtcggcacctaccagctggatgagtcatcaggtctccgcgcaggccatgcatacatgtatcgcgtgcgtacagaaggccccgaggtcctgcagctggaggcggaggcacgctgtgccggggtgttcgacttggcctggcacccctcttcctcctccacaccgctcctcgccatggcgctgagcgacggcactctgcgcctgaccgggcaggacctcgtcaccatcgcgtccagcacaccccagccggactccgatgcgctggcatgctgcgtggactggcggcgtgacggccagccccctgacacagcgaggctgctggcctcctactccgacggcgacgctgcacggctccaggtgccaatctgacatacccggggcgtggggcgtcatgaagggtggtctctcctgcatcagaccccaccaaggcgggcacccgatcgtcgcatgctccctgcagcccatccagtgagcctcctgcccgcaggcgacgccggccgggctgacgacgttggagcgctggagcgcgcactccctggaggcctgggcggtggccgccgatccgtggcagccagcgctgtgcttcacgggcggcgacgactgcgcgctccgtgcctgggacgaaagagcccccgccagcccggcctgggccgaccggcgagagcacggggcgggggtctgctgcatcctgcccagcacccacacggagcacctggtggccaccggaagctacgatgaagctgctcgcgcctgggacctgcgctggccgggccggcccctgcttctgagcaaggcgaggggccatgtgaagaggactctggcgggggtggcatgggcatatagaggggaggatgtcacgcttaaagcgtacgcgacaccctgatgcagctgcttttaagctcagcatgatgacattgcaggaatgcagcaaaggggtcccttgcccaaaaccatccacctctacctccctgcacccatggatcagcagatctnnnnnnnnnnaaaagcgtacgcgacgccctgatgcagctgctcctaagctcagcatgatgacattccaggaatgcggcaaaggggtcccttgcccagaattatccacctccacctccctgcacccatggatcagcagatctcgacggggggcggggtgtggaggctcaggtggcatcccaccgacccccagctcctcctggcggcatgcatgcagcatggcttccaggtcctgcgactcagacccggcagcggcgagtgggcggtggaggagcggtatgcacaccaacagacgctggcctatggcgccgactggcagcggcgaggcggcgaccaggcggggccattcgcggtggcgacggccagcttctacgacaatgccctgcacgtgtggcagcctgcgacccaggcatagccgctacatgcactgctgtcgatcaggaggtggttgtcgtgattccttgcaggccctgttttcctgagcctcgaaagggctgcatctcatgactgggagccctgcagcttccagggggggcccatggggttgcctaggcttccccaccccttccttgcaaacccaattgtatcatgatgtgcagacatcaattcctgtatacaagcagtgggacagtgacaacacggcgccagcaacatttgtgaaaaagacggcctttgaggaaaggctggggtagcacactcccataggatatacgtcgtgcaagccagacaggatacagcagacacaccaggtcgaatctgcaatggccggggctccaaaacctgtggccgccccgtaggacagggcatggagaaggcgggcaccaggcgggccagaggatgggccgagctgatgggaggccaggcagctggcctggctggccgtgccatcatgttggccgtatagctcaaggctatgggacgtgcgagaagcggnnnnnnnnnnatgccatcatgtcggccatattgctcaaggctatgggacgtgcgagaagcggcagtctgctccctggcggcaaccctgtgctcgtggggagggtggagaggaggaattggagtgggtctgccgcggggagggcttgcatgcctgccaaccccccggcacccagcgcctgccgcgctcctggtgcgcccagaaggcttcgggcctgcacaccaatcgacccacccacctttggaccgaagaagaacttgcagcgcacgtggggcagcggcttcagcccgtggcctccctgccggtgtgcctgccgtccactgagcggctcgctcggcggccgggggggtggtggggccggggtcggctgaacgaggccctggggccaggcccctgccggcgcaaatcctcggctgttttcggccggggggtgtgcttgcatgttgggagggccatggccgtacccctgcccctggaagcccatgggcgcagggccctccggggcatgccgtattgcgccgcccggcgccggcggcccgctgtccagcnnnnnnnnnnaccccccggggcatgccgcattgcaccgcccggcgccggcggcccgctgtccagcgccggcccgctgcgcatcccacggagcagctggtccagcgccccgaaattcaggttgagaggcggcggcgccgccggcggtggcggcggctggccgtgcggcatgtgctgccccgctggggtgccgccgccctggtagtgctgctgctgcggcggcggcctgttctggaccgtgtcacgctggctgacgggaggatcccgcgcgccgccgaacggggccagctgcagtggctgctgcagctggggcggcgcctnnnnnnnnnnaggtgtcacgctggctgatgggaggatcccgcgcgccgccaaacggggccagctgcggtggctgctgctgctggggcggcgcctgccgcgtggcggcggccgcggcggccgcctcctccacggacagggggatgcggaggggcgggtgccgcgcctcccactccccgcgcgaccagccgtcccccggctcctccgcgnnnnnnnnnntaggggtatgcggaggggtgggtgccgcgcctcccactccccacgcgaccagccgtcccccggctcctccgcgcaggccgggcagtccagcaggccccgcgggtagtgcgcgcgcggcgtgcggctctgctcgcgccgcgcgagcgcctcgccgacctctg

SEQ ID NO: 31182 - DNA, 170 bp, Chlorella protothecoides
agctgctggccaagctggccaagcccggcgacgcgcagtgatggctcgtgggctgggcgggaggtgcaggacactgtacacccgcagtgccacaggctgctgtcgcagccaacgaacttttccagcttgcagcttcaccttcccctctctacccttcctgccctgcacgt

SEQ ID NO: 31183 - DNA, 97 bp, Chlorella protothecoides
gagcctgagggggcgacctcggcggcatcagtgaaggggcgccacaggagaggaatcatgggagtcgtgcatcacaccggacgtgaggtaggtcagc

SEQ ID NO: 31184 - DNA, 79 bp, Chlorella protothecoides
cccatcccccctgcccaccctgtccgcaaccccccctccaaaccacaactgccccaacccaacaggagcctgcgggtgg

SEQ ID NO: 31185 - DNA, 106 bp, Chlorella protothecoides
gcaaggcaacgctcaagtccttgtggacatggggggccctccttaggcttccacgcgtgcaggccagcatggatgtacaccttgcgccgcttcatccacacctaca

SEQ ID NO: 31186 - DNA, 133 bp, Chlorella protothecoides
tggacctgagcccagacgctgcctccctgagcatgcacagcaaggctgcagtgaggccccccctcaacagcacaacacaaagccctcacctcaaacggggtatgcccggcccgagtggcatgggccgccaggt

SEQ ID NO: 31187 - DNA, 71 bp, Chlorella protothecoides
gctcgcccgcgccgggggtgagggggggcagcccctccccgcccaggctggaaagcagggcccggcaggcc

SEQ ID NO: 31188 - DNA, 79 bp, Chlorella protothecoides
tcgcggggctgctcgcctcggcgcagggtgtgtggaaacggcgcgtggctttgtgtgtgttttgtgtgggtgcggagtg

SEQ ID NO: 31189 - DNA, 185 bp, Chlorella protothecoides
tttgtgtgtgttttgtgtgggtgcggagtgcatgtggcagtggggttgtgattttagatgccggaccaggtgtgcgtgccagcagcggtctcggtgggaatgcattctgggacagggatgcccgccaactcaggacccctccaacccctttttccctccgccctccctctctacaggcggcggct

SEQ ID NO: 31190 - DNA, 115 bp, Chlorella protothecoides
cactcgacgtgtctcatggtagttgatgcttctggatttttgcaggccggctctcttcatgccgtcccctagcggcagcgaagatgcatgcagcgcgcccaacttttcgacgttg

SEQ ID NO: 31191 - DNA, 113 bp, Chlorella protothecoides
gtgcctgggtggcttgtggagggtggggggagaaggggtcccatgtggggccccccatccccactcctcacacacacgccgctgcacacgcgctcacttgcccgcgatctcgg

SEQ ID NO: 31192 - DNA, 117 bp, Chlorella protothecoides
ccgatccgaacttccaactgcgagatcgaaaagataaagtgtgtgtactctcgactgccgacccagaaaatgccgtcagcttgcgaaggccccgaaaccaaaagaccagtctcgccc

SEQ ID NO: 31193 - DNA, 74 bp, Chlorella protothecoides
tgtttacttgaacagggaaaactgtatgcaacaagtgaaaaaacaaaagtggggacctgggggaatcgaacccc

SEQ ID NO: 31194 - DNA, 93 bp, Chlorella protothecoides
ggcccgcctcctcgatcctgatcacatccattgctatgcgtggaaatgccccgtgctgccgacccctacccctgcgctgcccaggacaccacg

SEQ ID NO: 31195 - DNA, 4193 bp, Chlorella protothecoides
  modified_base (509)..(571): a, c, t, g, unknown or other
  modified_base (635)..(644): a, c, t, g, unknown or other
  modified_base (804)..(813): a, c, t, g, unknown or other
  modified_base (2198)..(2207): a, c, t, g, unknown or other
  modified_base (3485)..(3494): a, c, t, g, unknown or other
acaccttcccccccaacaacccccccaaagacttcccccctaaccccccaacctgcggcgttgacgctggggatgatgcggcgcgggcgcagggaagccacgcaggcacgcaggtcggcccagctgctgtgttccgagtaaggcgcgcccacgaccgccgcgcggccctcgcgccacacgctcagcgcctcggcccgcggcgctttcttataggaccagcccgtggcccgaaagcccaccacgcaggcccagggcgcggcgggggcgcagaggcgcgcctccagcgcggcgggcgccagcgcctcccccggcccgagcaggtgcacgtcggcctccagcgggcgctgagtcagcagtcccagccaggcgggaggcaggtccagccaggagagcacgcgcgccttctgcggcgtgcagaacaccctggaccccagccgcagtgccagcccaaagtagaaccgctcctggcaggtggggagggaggagggggggggggggggggggggggnnnnnnnnnnnnnnnnnnnnnnnnnnnnnnnnnnnnnnnnnnnnnnnnnnnnnnnnnnnnnnnggcacacacatattaccttctgcagacccaccctgccaccctgcatgtccccacctttgccctnnnnnnnnnnagcgggaagggaagggacggggactgagagcgagggaggggggctccctgtacatcaagaatccagaaatgggcccttggtcgccacgcgacgagccggcaggccagcgattctccttgctgagggtgtgtctcatctcctatttccctctgaagcgggnnnnnnnnnngacaatccagaaatgggcgcttggtggccacgggacgagccggcgggccagcgattctccttgctgagggtccgtctcatctcctatttccctctgaagcgggaaaggcacacacatattaccttctgcagtgccaccctgcatgtccccacctttgccctgaaaaccctcttgtcctccccacacttcccccagaacaacataaagcaccttgccaatgtggtagctgttggccacggccagcactcggcctgctgacctggcggcctctcgcctcacaaactcggcggcagcctggatcacctgctcctggggtggaaacgtccagcgtggcgcacagtaggtggtgtccaggaccagcgtgtccagagtgcccagcgcgcgcagcgcggggtaggccatcatcgcgccgtcgtcccagcgcatgtcgcccgtgtgcagcacggtgcgagggggccggcccccgccgtccccggggatgacgaagaggaacatgacggcgccgggacagtggttggcggggagaggggtcaccgccaccccgcccacctccacggtcacgtggggggacagggggcacacgaccccggcgcgcaggcccatgtcgcggatgagcaggcgggcagtgacgggggagcagtagatggtccccgcgtcgaagcccttggtcaagcccgtggtgtggtcgccatggaagtgggtgaggaagaagtggcgcgcgccggggcgcaggaaacggaagccgtccacgttcaggctggtgccggggatgtacttgagcgcctccacctggctggccatgccgccgtggaattgcttgcgggcagggcgggagagctccaatcgggcgggattgagggagaggcagctcctgcccgggctgggagccggggcaatcaggcctggtgaaaggagcctacaaactcgaagccagcactcccagtctcaaacccatcatcggactcgactccgtccactgaggtgtctgtgaggataggggtcagacacagcctaagcagcagcttctgccggagactgagcaccaggcactgtcagggaagtgcacttgcaccctccataacccctcaatgccgccctgtccacctggaactgccatgttgtcgacttcctccacatccacctcgtcttcgccggtgtcgtgctggggtaagggtgagtccgccggatgcggcagagcaacagcgcccaacggggtgaggtcgcgtctccagtctcccacgtgcttcagctgcgttgcgggtggtggtatggagaggaggaggtgtatcaacaggccgggtagggttgtcgggacacctgttcctgctgcgtcgtccttcatgttacctgctgcgagagctcgttctcgagcaggatgatatcgnnnnnnnnnnggggtggggttgtcgggacacctgtacctgccgcgtcgtccttcatgttacctgctgtgagagctcgttctcgagcaggatgatatcgaggaatctgttgggggcagggcccaacaagtcgacagggggaggagaaaaggtggggcaggggaacattggcgcctggcagggtccctcctccggaggagatgcaagcggtatgctagacagctctaccctgtccaaattgcagcctggtatttacgtctataattctcaacacaaatcgccagtatttatcccttgtgtgagtctgtagcactgcgatctgaagcgatcctggtgctgcgcattcaaagcatgaggctccgagcatcaatggaaagttggaaggctatgggcgacctgtccatcgcagaggaggaacatgcaaccctcttctctccgggataacctgagcaccatccatcgctactcaattcttgctcggtgacagggtacacacgcactgtgtttgaaagccaccccctggatcagtcagtggtgtctcccgtgttctgtagacacctgcttggattgaaggtcgggaggaatccgtagagccccgagcgatgcagtatgggactggggtgaccccccaggttttcgtccctccccagccttctgtcctgaacccccagcccggcgtcgactgggtcacaccagcgtcgtccagctatgcccccgactccagtgcctacccctcgtacggaggggtcggcacctcaggacatggcgtttatggtagcttcgaagacgaggcacccctccttgaaggtgacaccctagaacttggattctcttcagtggcggtgggcagggggccacctgtcggctccaaggggcttgatggagttcacctttagccaacatcgtcaggaactctgctcgattgcttgccccactcacacgtttgtttcaggccgcctcttccaccatcacagaactgggcatcgacattcccgccatcatcaatcggacagctgcaattctgacgatgcggctgtctaaagaaagcttggaaagcttggacttgggtggacccctcatattcatggccctcctaggcttcgcccatctcctggtgaggaagtactgcatcgcaggcggtttgggtacggcagtggcctggcgtgacgatggcaggctcggacgagggtgatagggacgtctcatgagtgctgtcggacattgggccagccaagaccttgtccttgccatacaaagcccctgcaccgggtcaccctccacctccccttnnnnnnnnnntatgagggctgtcggacattgggccagcaaagaccttggccttgccatacaaagcacctgcaccgggtcaccctccacctccccttcccctacaccccctggctgcccaggtgggcaagctccatttcggctacatcctcggctggacggtggtgggctcgggcctcatctggtttgtgctgaacagcatgacggggtcagaccccgaggctgctgacctcggcctctacgcctgctgctgcctgctgggctacgccctgctgccccttgtggggcacgccctgctatccttgctcctccctaggcacgcacgggcgggctttttggggggcccacgtagtctgcggtctggcacccgcatgttaagactgctgatgggttacctatcaccacaccaggcaagagctcaaacccctccccctggccccgcaggaggtcgctggcggcgataggtctgggcgtggccgccgtcttctggagtgcaggcaccgcggccaagctcttcaccaagcgcagcccggcgctgcggggccagacctccgtcatcatgtaccccgccaccctcatgtacaccgcctttgccctgctcaccctgtactagccctgtggagccatgcgagccgtgaggatccgacacccgcgccccacgaggggcggtgtacggggcaggggagggcagggatgcaagggagggggggg

SEQ ID NO: 31196 - DNA, 88 bp, Chlorella protothecoides
aggggtctcaagtgccatgcagcctccagaatcgcctggtgtcatgctcggctggtatactcctcccctcctgcagacctctggcgtc

SEQ ID NO: 31197 - DNA, 68 bp, Chlorella protothecoides
taccctctcggcacacacaaacttcacccctacttcaacgccaggcacttggaccgccggcgtcgcag

SEQ ID NO: 31198 - DNA, 61 bp, Chlorella protothecoides
gggacgctgcgtcgtggtcaggcattcaactcccacccacaccccgactggctgctcatcc

SEQ ID NO: 31199 - DNA, 61 bp, Chlorella protothecoides
cggtgcgtgggtgtggtggctcggcgccgcgtggtggactgcacctggtcgcgcatggagg

SEQ ID NO: 31200 - DNA, 119 bp, Chlorella protothecoides
cgccgcaataccctcgagggttgagcggaagaatagtaccccgcgggcgcaggccagcgaccgctggcacatcctgaggcttcctgggacggacattgtcccgacttccatgcaaggtc

SEQ ID NO: 31201 - DNA, 61 bp, Chlorella protothecoides
tggcgtcagccgcccggcccagatgccgggccccagccagtcacgcagggcggagacgcac

SEQ ID NO: 31202 - DNA, 61 bp, Chlorella protothecoides
gcatgaatgggcatccacgcatgaagggacatgcatgaagcacccacgcatgaagcaccca

SEQ ID NO: 31203 - DNA, 61 bp, Chlorella protothecoides
ttgcactgacaacactctgccagcgggaaagtacaccagatttgaggaagatgcctgcgtg

SEQ ID NO: 31204 - DNA, 72 bp, Chlorella protothecoides
ctgtggctcgttggggccctggtgtttggcgttgcgcgcctgcctggccccgctcgtcgcctgcctgccgcc

SEQ ID NO: 31205 - DNA, 62 bp, Chlorella protothecoides
cccttctcttccctccctaacttcacgagtttaccaccccatttcttcacacacacacacac

SEQ ID NO: 31206 - DNA, 134 bp, Chlorella protothecoides
tgcagagtgggagagtgaatgaatggggtgtttttccatctgtcgtggcaaggcgacactgtgacaattgcctaagcccctccagaatacattcgtaggaatgtcttgccccaggacatccagccaacctgggt

SEQ ID NO: 31207 - DNA, 61 bp, Chlorella protothecoides
atttgtggtggggaattgggagggatctgggggtggctggcatctgaagtcaatggtgatg

SEQ ID NO: 31208 - DNA, 73 bp, Chlorella protothecoides
ctgtcgtggcagacttgacctcagctgcaggtttgtgattgatggtggggccagatggtgccactttctcagt

SEQ ID NO: 31209 - DNA, 61 bp, Chlorella protothecoides
tcaaaggcaagggcatgggaggagcaccgtcaccgtgcatgccctggttgcagatatgttg

SEQ ID NO: 31210 - DNA, 98 bp, Chlorella protothecoides
cagtctccaccatgaagaccatccagtctcggcacgccggtcccatcggacatgtgcagtcgggtcgccgatcggcggggcgcgcgggatcccgcatg

SEQ ID NO: 31211 - DNA, 61 bp, Chlorella protothecoides
ctcccacatccgcccatgaccccctcccataccccctgccaataccccatcaagaagaccg

SEQ ID NO: 31212 - DNA, 156 bp, Chlorella protothecoides
ttcagagagagcaccacctcatcgcgatctacgctatgatgtggagatgggccatggaggtagcaagacagatcaaaatacatcgcgttgtgctcgttccagtcagatattcatatatatactccattcacagcacgacgactgccctctggcaaa

SEQ ID NO: 31213 - DNA, 61 bp, Chlorella protothecoides
ggggccctgtgtcccagcaggctgcgtgcctaggacccaccacgagcccgcccagcctcgc

SEQ ID NO: 31214 - DNA, 61 bp, Chlorella protothecoides
cactgagcaaggggtccctcgggtccccactcctgctgagaaaaattagcggatttctctg

SEQ ID NO: 31215 - DNA, 80 bp, Chlorella protothecoides
gccctgagactgccccagccccatcgcccacgccggaggctgaggaggacgaggagcacaacacggagcgccgagccagg

SEQ ID NO: 31216 - DNA, 76 bp, Chlorella protothecoides
gaggtgagtcagaggtgcttgcaggcacaaaagtaagaccacttctgcagtgccactcgcatgtgatgtgaatgct

SEQ ID NO: 31217 - DNA, 79 bp, Chlorella protothecoides
tccaatcaggaccattgcgtgatggtttcagagcatatgggattcctcgtggccgatgggccagcaggaaggtcgtccc

SEQ ID NO: 31218 - DNA, 260 bp, Chlorella protothecoides
cttctatagctgctatcattccttgcgaaacactacctcaagcttcgcagaaccttggcatgggcagatgatctttagagtcacctagcgaagctcaaggagagaatcccgccgccatcttctgcaaagcagcactgatgcatcgaccatctgattacacattcaagttgtgctggacgtccaaccagcgagagcagggtcaagaggaatggctttatgatcttgcttgatgtatttacaagagtgttcattccaacaga

SEQ ID NO: 31219 - DNA, 102 bp, Chlorella protothecoides
cgcaaacctggtggttgtaggattgtgatccgcctcgtcacagatgcaagcgatattgtaacgtgtccatcgtgggagttcaccctccccagtcgcacctgc

SEQ ID NO: 31220 - DNA, 205 bp, Chlorella protothecoides
tacttccttggatgactacatgcatgggtcacatgatgaaacccaagaagttgtgccacatcaagcaagatgaaggctgctgcattggaggggaagttcctgaccaatgcatgcaagttggggctctggccttcaccaagcgacccacagaacaaaacaaggcaagtagataaactgcatcacgccagacagctcttgtgaagtt

SEQ ID NO: 31221 - DNA, 257 bp, Chlorella protothecoides
ccgccttctggagcgggcgtgtattgcatagtgaagctgtgaggcccccatccggacaggtactaccggaccccttcacccttcatcccctccatcctctccaacaggtataaaacacatgtctatatgctggagttcaacagcgcggatgccttctgcgagtatgtgctcagcccttgtacatattctggcttgaactagtatgtttcagaattaaagctcgtactagtgatggctcctcatgctactgcttgatc

SEQ ID NO: 31222 - DNA, 66 bp, Chlorella protothecoides
tgccggcgggtgggctctcagcgagcgcgcaggggtttgatcgagaatgaacgtttcagcgtgatt

SEQ ID NO: 31223 - DNA, 3166 bp, Chlorella protothecoides
  modified_base (643)..(714): a, c, t, g, unknown or other
  modified_base (1426)..(1435): a, c, t, g, unknown or other
  modified_base (1930)..(1939): a, c, t, g, unknown or other
  modified_base (2012)..(2021): a, c, t, g, unknown or other
  modified_base (2287)..(2296): a, c, t, g, unknown or other
gcggcgggggtcgtggtggcggtggcggtcggcccggtgagtgggagactgggtgtagagcttgctggttgcaaggcatcgacactcggatcaggccatttgttggtgctgaagagcaggcaacaatggagaacgacgtcacgagccacgtcccttcacccccaacccggcaggtgactggccttgccccagctgcggcaacaactgcttcggctggagggaccgctgcaaccgctgcaacacgcccaagcccgaaggcgctgctggtggcggcgggggtggcgggtatggagcacctccacctcgagacaattatggaggcggctaccagtaccaggagcaggcccctccacagtacccgcccccagcacagggcggctaccctccccagggccaggcatacggcggtccccctccccaggcagggggctatgacccccatggggccccgcctgcggccggatatggaccccctgcaggagcctacgacggtgtgtgtgctgtggtgggcaggtgcactggggcttgagccatcgttgtgctggcacgggaccataggtgatgcttttgccacaccttgggtgtcacattcttctcatcatcctgcgaaagtggcgtctccacccccgtcttttggtcgccnnnnnnnnnnnnnnnnnnnnnnnnnnnnnnnnnnnnnnnnnnnnnnnnnnnnnnnnnnnnnnnnnnnnnnnnttccacggtcacccttcctgtaggtgggaggggtgggtatggcgccccgccccccaccgccgcaggacccccttacggagctcctgcgggcggccccccgccccgcgagcgcgtcgtggccgcgccgcagggtccgcccggcctgttcgcgcccgaggactgggcctgcaccgcctgcggcaacgtgaactgggcgcggcggcgcgagtgcaaccagtgcaatgcgcccaagcccggcgcggtggacctgacgcgcgagggcgccggcggcggcttcaaggagctggacagcgccgaggtggaggaggcgcggcgccgccgccgcgagcacgaggcgcgcgaggagtacgacgagtttgggcggccgcgcaagcccagcgcggccgaggaccgcgcggcgcgtgagcgcgccgcgctggagcgcctggcggggaagtacggcgcgcgcgagcgcagccgcagcccgcgccgcgagcgcagccgcagtccccggcgcgagcgctactgagcgccatgtggagtgccggtggcgtgggaggtggtctgggtgcatcaggtggggtgcgggcgcgtccatcggcgctgtggctcgggagagcctcggacggacggaggcaggactccaggccatgctggactgcatggagcgatctggagtatttttgcacccctcgaaaccccctttgcatgctgcctcgtctgcctgccgttnnnnnnnnnntcgcgagcggagccgcagcccccggcgtgagcgctactgagcgccatgtggagtgccggtggcgtgggaggtggtgtggatgcatcaggtggggtgcgggcgcgtccattggcgctgtggctcaggagagcctcggacagacggaggcagaactccaggccatgctggactgcatggagtgatctggagtatttttggacccctcgaaaccctctttgcatgctgcctcgtctgcctgccgtttcattgtgcggcaagccagggtgtcgccacgcatgagcgagcaagcaggattgcccgggggaatgcgcaacggcaagggcgtcgtgcaggcaccagtccttcacacacacacacaccgttccgcctcctcagaacccgctggtgcggccatggggcgccgcagcaaagggcccctccacgatctccagctccggcacggagcccagcagcatgcccgcgtacaccgcagcgccggcggccactgcgtgggcnnnnnnnnnnacatgagcgagcaagcaggattccccggaggaatgcgcaacagcaagggcgtcgtgcaggcaccagtccttcnnnnnnnnnnggaaagcgtgcacgcccagcatctccgtggcctggcccacgcacagcacgcgcgtgacgcggcggggcggcggcaggccccacgccgcgggcgtggcctgcggggggggtcccggcgatggcggcgcggctccggagcggcccagggcctgcgctgggtcctcgccgccgccctcgcccaggctcgcgacggcccgctctgcggcgacttgaggctccgtggcccatccgatgccgtgctgggtgccaaactcttccagcagggcnnnnnnnnnntgtgcgtggccttcggggggggtcccggcgatgacggcgcggctgcggagcggcccagggcctgcgctggatgctcgccgccgccctcgcccaagctcgcgacggcccgctctgcggcgacccgaggctccatggcccagccgatgcagtgctgggtgccaaactcttccagcagggcggccagggcggcgaagaaaggggggagcacggcctgcaggtcggacagcgtgcaggtggcggctccctggcccgactgcgcggccacggggccgccagggccggcgctcagcgtgatcttggcgcgctcggccgccgactgcgcggccgggtctccgcggcctgcctctgggaagagccgcgccgccagcgcggcgtccacgtcgttcccccccagcgccgcgtcgccgatggtccccagcagctccagcgcgcccgcaaaggcctgcaccaggctgatgcatgacggggatcggggaggtaagggctgcctgagagggggacaggcctgggcgagcacggccccacactcgcgtcagctcctcccgaggcaccgacccagaggggaggagggaagaatcagcccccccgcctgctccacagaccctcgtcccgccccgacagcgccgcccggctcgtctccactttgtcccccgcctccctgcccatgagacacacaccaacaaacacctgacgtcagtggtcccgccgccgatgtccaccaccagcgccagctcgccgtccaacccggcgcccaggccgtgggccagcgcggccgccaccggctcctgcagcaggcgcagcgcgtccggcaggcccgcagcgcgcgcggcgcgcagcacggcggcgtgcctgctcgggccccagtccgcc

SEQ ID NO: 31224 - DNA, 77 bp, Chlorella protothecoides
gagcaaaatcagccaggcagcttctgctcacacgtggcagagcatgttgaaggccagatgcacaatgcccaaagcca

SEQ ID NO: 31225 - DNA, 86 bp, Chlorella protothecoides
gattccaacacacgagcccgtgagtgtactgttaattttgtgagagtctccaggaattaccttgtctttgaccatgcccaaagaga

SEQ ID NO: 31226 - DNA, 69 bp, Chlorella protothecoides
gccatctttttggatcagcgtcccatcgtcgggcaggcgcgcatcctcctgagcgccctccagggactc

SEQ ID NO: 31227 - DNA, 100 bp, Chlorella protothecoides
atgtgagggctacactttgtggtttcaaaggtctctttatcaaagcatgcatacatatcttgcaggaaataggccacatgactcacgataaacccatgcc

SEQ ID NO: 31228 - DNA, 1232 bp, Chlorella protothecoides
  modified_base (459)..(468): a, c, t, g, unknown or other
ccaaggctggaggccggcatggtcttctcccgccctcccaccccaccccaccccctctggttcgctgaatgagcaaccaactgcgccagtcagatcccgcttgcgggaacaagctgctagcaaccggcgcaagcccggtagggatctgtttgcctaagcagatcccaacctattatgtttgcagttccaactttgcctgatctgcatgctggcgccagagagactgtgcttcgagggtcaaacattgtggaaatcgttgcatttcttaatgtttccttgcttgctttggaatttcgcaaaccatcaggtgttgttctcagcacctctaactgagtaatcaaatgcttgtcaccttcaaaatatgcaaaattgctctccaggaaaagccatgcacacctcccctccgtgctttctagaagggagtttaatatgcgccgacttgaggccgtggtcgaggtnnnnnnnnnntaagcctggtagggatctgtttgcagatcccagatcccatggtttgatttgcaaaccctttccctccgtgctttctagaagggagtttagtatgcgccgacttgaggccgtggtcgaggtttagagtggggccgagccctcgccacacctcttctcgactcaccatacgaaagttactcgacagagaatccaaataaacctcaactttggcatgacctcttgggaccagcaaggcaactactccaatggctccggcgcaggccagggctctcggggtagcggtgagtggacccggcggagcttttgcggacttttcttcttttaattccattgacaatttgttcccgatggtgtggggcgtggtttggttctccccgagcactaacgtcccccaccacacgcacccacccgtgccgcgcaggttacgtcccgccgcacatgaggggagctggaggtgcgcggtgtcccgtcgacacagggcttccggcaccggaggcgctcgacatgcgttcttatgtcttgcttgccgggcagcctctttgttacattcctcagaccttctcccctgcacatggcgtgctgaccctccaaaccctcactcctctttccccaggtgctcctcaagcttacaacggtggcagtggtggtggcttcaatggcgccggcggtggtggctacggcggtggcgccggctacggcggcggcggcggctacagcggcggcggcggtggctacggcggcggctatgaccgcggctacggcgg

SEQ ID NO: 31229 - DNA, 115 bp, Chlorella protothecoides
ccaaggaggatggatgggttgggtaaagctatacccaggatccactctccgatacgagcattttacgtatcctaatcaccatccaaacaccccccgaatcccctactttggtgcg

SEQ ID NO: 31230 - DNA, 135 bp, Chlorella protothecoides
acgagcaccatacaacgaccaggctctcgggtacatgaagaataaaacttgcacattgtctctccttcaccggcaagccatcgcaccatccccagccacacgcattcccccacctccgctgtcaaaagtgaggcc

SEQ ID NO: 31231 - DNA, 98 bp, Chlorella protothecoides
atggtaggtgggaggcgagatgttgtgggaccagagcttgatcgaatctacacctcaagctgcgctcgtgcacaacatggggataccccatctctcca

SEQ ID NO: 31232 - DNA, 77 bp, Chlorella protothecoides
agcttggtactctttgcttggagcttctcagactggcaccatggtccgactcccctcccagcctgcgtagcctgtga

SEQ ID NO: 31233 - DNA, 99 bp, Chlorella protothecoides
aggggggtggaggggatgggtccaatggcacgatcctcactccatgaggctgagggccttccagtccctcgcctgggcccgcctcaacagggcgcagac

SEQ ID NO: 31234 - DNA, 498 bp, Chlorella protothecoides
cgcggcctcgggggcggtcagcagcggctcgccctccgcctcccaggtggccgcctcgtagcccaggccctcccacttgaccagcacctcccagccggggccggcgggggaggcgcggcgcgccaccagccgctcgggccggcaccaggccgggtcggccaggaccacgggtgcgccgcccgcgcgcttgcggaagttcagcaccttgcgcttggcgatctggagcagcaccgcctcgggcacccactcgtcgtgcaggtggctgcgcccgctgtacttgaccaggtactcgggcgcggggccgggggagcggcgcgcgtcgcccagcgcctggtcctccgccgcccaacgccaacccaggatggcctccaccacgatgcgccccgaggcagggcccgcgtcgggcacggcgccgccgccgccgtgggcctgcccgccgcccggctcgtagtcgtcgtcggagccgtcgtcctcgtcgccgcctgcgccggaacggcc

SEQ ID NO: 31235 - DNA, 61 bp, Chlorella protothecoides
catcgtggtggaggccatcctgggttggcgctgggcggcggaggaccaggcgctgggcgac

SEQ ID NO: 31236 - DNA, 67 bp, Chlorella protothecoides
gttgcctcagggaggagtcggtcgtgcgtgctggaaccaatgcacaccaggccatgcataggcgccc

SEQ ID NO: 31237 - DNA, 130 bp, Chlorella protothecoides
ggcgagcttggcctgcagggcctcgacctccgtggacgtcatgtgttcaggagcatccctggggatttattggggtgccgaggttcacatggtgccaggtcgcggattgtcagaggccgacagcgctgtg

SEQ ID NO: 31238 - DNA, 61 bp, Chlorella protothecoides
tcgatcacccctcacatccatccccccttgccccctcctccgaaccgtaggcggtcacggg

SEQ ID NO: 31239 - DNA, 61 bp, Chlorella protothecoides
ggcatgcactcccaccatccgaccccacaccagaaccgctgcgcaccagtgtaccggattc

SEQ ID NO: 31240 - DNA, 188 bp, Chlorella protothecoides
agaagtgacgttgccaatgtcacctgcccaataggggccatgtgctctcatatctatctgggataggatgtggcaactcacacacctttccccctttctttatcccccagaccagtacctgctgagcgggggagaggggggctaccgcggccgcttcggcgcgcccgacacctccgccggtgcgtcgg

SEQ ID NO: 31241 - DNA, 95 bp, Chlorella protothecoides
tggcacctggaggaaggaggacgggtaaagggttggaggtgaggtttgggggggggtcctccacagtaggggctgatactgcgcatatgagcggg

SEQ ID NO: 31242 - DNA, 126 bp, Chlorella protothecoides
tcgcggaggggccgcatccatccatcatcctggcttgctgcggaatgatgtgggaacactggtccatcccaggacgcccccggcgccactcttcctaaaccacaccgcacccgcgctggcgtagaa

SEQ ID NO: 31243 - DNA, 258 bp, Chlorella protothecoides
aacgagcgtttcttcacgctgagctgtctgaataagggtaaagaagaattgaccgaaattggacgctcctcccatcactcgtgaatcccgcagccactgcactggggggggggccatcagctccagatctcacgcagttggaaaaaaacgcggagcgcccggttccctcctggatccagacgcagcgcgttactgctcactcacgattccagcatcgctcgcgaatcgaacaggaagtatttcccaagtagattgcat

SEQ ID NO: 31244 - DNA, 117 bp, Chlorella protothecoides
aaggggggggggggggggggggggaggggagtggggtctggaagtggagggaatctgcccatcgacaggacgggcccgcggcagcagcgcatgttgtggcaccctcgcaagctcaaa

SEQ ID NO: 31245 - DNA, 112 bp, Chlorella protothecoides
tcaccaggctgcaggggggtgaaggcggcgctgagatggaggaattggcgcgcaggacgcgcctgctcctgctggggaagacggagggaatgacggcttgaaaagaagggtc

SEQ ID NO: 31246 - DNA, 74 bp, Chlorella protothecoides
cctgcctagcccgccatgctggccgtcctgtcagagggtgtactcacggcatttcgtgcatcccggctcctgga

SEQ ID NO: 31247 - DNA, 113 bp, Chlorella protothecoides
gaagaaagctgggcctgctggcacccctgaccagcgcccggccccatccaatgcctagctccattcgtgcaggcaccacaaatcctatcacgcccacgctcatcaccccagcg

SEQ ID NO: 31248 - DNA, 79 bp, Chlorella protothecoides
gctggcggccttgtcctcgctgggcaaggggtgcgcaacatcctcctcaccggcgctcatacgcgcaccgccccccccc

SEQ ID NO: 31249 - DNA, 61 bp, Chlorella protothecoides
caagcttaccgtcaagcacggctcgagggggggcgcagcgtctcgtggtggctctccatga

SEQ ID NO: 31250 - DNA, 61 bp, Chlorella protothecoides
atcgcgccgtctctaggcggggcatgtcacacctgcctgttttgggtgggataccgtccaa

SEQ ID NO: 31251 - DNA, 61 bp, Chlorella protothecoides
acgcctcccaccgccgacccacacccgtggaaacgccctgcactcccggcgacgccatcca

SEQ ID NO: 31252 - DNA, 121 bp, Chlorella protothecoides
cctgtcagactccaccacgagcaccaagcattcgtagcccgcggcagagcttgaggcggacacgtggcacccacccccccacctcctgccctccccccaacctcgagcccacacacctcga

SEQ ID NO: 31253 - DNA, 65 bp, Chlorella protothecoides
gtctcggcctggcacaggcggcggtgtgtgtgggagggggtggttgtggtcatcgacactgcggg

SEQ ID NO: 31254 - DNA, 61 bp, Chlorella protothecoides
tgatcacacggcttgcagcagtgatgaaggatggtttacgcaaagcgatcactgcggatac

SEQ ID NO: 31255 - DNA, 77 bp, Chlorella protothecoides
cccagccactgtctcagtgccacaaggaggatcgaaatccgctcctatcaccccgccgacctcaaagtatcaggatc

SEQ ID NO: 31256 - DNA, 61 bp, Chlorella protothecoides
gtggcgacgctcagctgtccccagtagtcggcatgcgggcatggtatccaaagtgcatggc

SEQ ID NO: 31257 - DNA, 135 bp, Chlorella protothecoides
ccgagggatgcgagcgatgggttgagagcgaatcccgacaccataagcgggatgtcaagcttcggcactccgactccgacatgacggggctaccagctactccgcgtgtactcactccggggcggcatcgatgat

SEQ ID NO: 31258 - DNA, 469 bp, Chlorella protothecoides
  modified_base (172)..(380): a, c, t, g, unknown or other
gtgacactctgggttgggggctggcagtctgactctagcttgcaaatgtctaggaattgtgtcaccgcatggtgggagtggctgcattactcatggtggattccccatgagagttgtccaatctgaactccgaacgatattctcggcgcagcctggaccgggacctttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagttctagtccgcgggacgcggaacgctgctctgcacacgcctgagcaccccacacccgtgcgctgttgcacggcgccgtgacacc

SEQ ID NO: 31259 - DNA, 73 bp, Chlorella protothecoides
cttggcagatcctgggtgatccagtccctcaacaaccccccctccatggcagggcgtggtgctcgccagccct

SEQ ID NO: 31260 - DNA, 247 bp, Chlorella protothecoides
ctggcggagcaggccgaggccgaggaggtgcgtgcttggagggggtgaggggcccgtggggatccgagcggccgtgcacggcgcgtgagacggggattggggcggagaggtgggaggatgaggagccggctcatggggacgagcacatgctggtcaggggaggctggctgtagcgctgcctttccacgccaggggtgttcggcggcatcagcactagagggcaatcatcgccccctccgtcacccgc

SEQ ID NO: 31261 - DNA, 61 bp, Chlorella protothecoides
cgtgttcacgctggacgacatgccgaacttcgaggacgagaactcgtgcaaagtgtgcggc

SEQ ID NO: 31262 - DNA, 132 bp, Chlorella protothecoides
ggcggcgtgggcctggtccaggtgaccctctaatccctgtgagtggttggggagcagaagatggatgaaatctgacctcagcagaagcaccggctgtgccaagggggttctggctgtgaaactgtaaacacc

SEQ ID NO: 31263 - DNA, 61 bp, Chlorella protothecoides
agaagccagaggccaccctggccctattcaaggccgcgaggcctcgtcccgggcttggctg

SEQ ID NO: 31264 - DNA, 61 bp, Chlorella protothecoides
cagactggtcttgcccagccgaagggataatacccctgggaggcagtctctcgtatgcaag

SEQ ID NO: 31265 - DNA, 118 bp, Chlorella protothecoides
agctagtatgagaagacacagagagagggaaagggcacacaggtcatggtcgctcccatggggtggccaccttgatgggcggggtgttgggtgtggagcaggccaccgccatgggact

SEQ ID NO: 31266 - DNA, 661 bp, Chlorella protothecoides
tctgagcagctagggaaatccacatccgattgtaatccgagtggaccagagtataaaatcccagaaaacggcggacatgacactgctgctatcatatgcgtaagttttcagaaactatttcaaaattcctcttgtaacgtcatgaagccaataggcctcagcgtgtttcagcattctcgagcttgatgtgtctttgttgctgatgttcaccgaagtgcataccagcctaaggacatagccggcggagtcctcaaaaatataaaaggaatcgccacgtatagaagaatcctcgatttgtggaaacatacagcgggaataaccgacacaggtgtgccatggcaatgtacgagctccttccccatcgaggttatccgaaagagcattattaatatgcgttgtgagcctgtcctacattatcctgctccttaaattactctctcaccactcagcctgttcgaaaatatcaattttctgatctctacccaaaatggggaaccttaggctcttcatacatgcctgtgtcgctagtctgcttgtgaatcatgctcttgatcacagggagtcggaactcgcgctgatacaaccgaaggcgccattgtataaaagtgaggaagaaccatactggagatgtgtataatgatggatcgtgtgccatgaaagt

SEQ ID NO: 31267 - DNA, 70 bp, Chlorella protothecoides
agccgatttttgaatcgccaagttgtggggcgggttagaacctacaatgtggactgctgtatatgaccta

SEQ ID NO: 31268 - DNA, 64 bp, Chlorella protothecoides
ctacaatgtggactgctgtatatgacctaaagttggaatgttacagaacaagaccccgaatacg

SEQ ID NO: 31269 - DNA, 61 bp, Chlorella protothecoides
ccaatggcacatgcacacatcaccccccccaccagccaagcccctgcccccacacacaggc

SEQ ID NO: 31270 - DNA, 78 bp, Chlorella protothecoides
gtccgacgatgggattgatcatgcgctggggaatgagctcgtcagcggcagtcaggggcacaggaatggctgtgtacg

SEQ ID NO: 31271 - DNA, 67 bp, Chlorella protothecoides
tggcgctggagcgcctctgtgcgccgggggggggaggcggagccggcacgggcctggtgtgcacggt

SEQ ID NO: 31272 - DNA, 259 bp, Chlorella protothecoides
cagtacagcaggcctctgtaagagggggaatatgttgcatcaaggacgattggattgtctgtaggatactcaacacagtgcagtggagtgccggtgttactcggtgtatgattctttcgaggtgtgccctaccaagtagtgtgctcatttcctcctcgcttccagcaccctcttacccattgggccccaaatctagctcctctgcaacatcatctagggtgatgaggtccctcacatcgatggacacggggtagttgaa

SEQ ID NO: 31273 - DNA, 3214 bp, Chlorella protothecoides
  modified_base (325)..(334): a, c, t, g, unknown or other
  modified_base (874)..(883): a, c, t, g, unknown or other
  modified_base (2081)..(2090): a, c, t, g, unknown or other
  modified_base (3143)..(3152): a, c, t, g, unknown or other
gcccagggggcgacaggaggtgccgccgcgtcggcggcgcggggcgtgggtgccgccgagccggcggcgctcgtcccgcggctgggagcccgacgcgccgccgcctgcgtcgccggctggagcagggcggtctgagcggcgccggctgccgccggcggggggcggaaggtggcgatgggtccgtcggcgccctggctgcccaggctgggtttcaagcctgcagggcgtgaggcacgaggacttgggatgaggcggcctgtcctgcggctggtggtgtccatttgatgacaaggggttcgggtgggagcgagcttggcacccacannnnnnnnnngggcatgaggacttggggtgaggcggcctgtcctgcggctggttgtgtccctttgatgacaaggtgttcgggtgggagcgagcttggcacccacacatgcagcaggccccatgctgcccgaggccccgccccacctccaaacatggacggagcgttctctgggagagccaggggcggcgctcccaagccaaaggcaggggccgcagcgtagcgggaagccacgcccagtggacggccgggtgcccccaccgcggccatgggtggcgggagcgcggcgccaggcctgtgaggaaacaccagggggatgagggatgaaggttgtgatgcacgcagcacacaatgggtcccggccgtccctcgatgcagccctggcaccatgttttgggtgcattgagcacgtgccgacacccatactcaagacgaggtggccactgcctgcctctctcctgagaccctcatcaaaagattggttctcagcggaatcacgcaccctcggtcggagaggccatcgtgttgctgccgcagggccaggggtggggnnnnnnnnnncctccccagaccctcatcgaaagattggttctcggcggcatcacacaccctccgtcggagaggccgccgtgttgctgccgcagggccaggggtgggggagctgccagggcagccttggcagcgcgaacctcctcttcttcgcccctctttacccaggccttgagctgcagacggaatccgggcaggcaaagtgctgggctgataggttgaggcctggagtgccaccagaggaagctgggcagacaggcgagcagtgctcagctgcaccgcgtgataccccagggtgaggcacactggtacccgagttctcacctcttcgttgaaatacatgtcgagctcctctccgagtttggccttggtgaccttcttccctcgcccctgcgtggcgggatgggcagaggacgaccccttcctcagactgatccggcatacaaaatgctgccaatgtggtcctttaccgccacccagcttacaaggagtctgccaaagacgccaggcggggcctcggtcttgtcaggtgggggggctgtcgctgtagacattgtggggggggtccagagaccaatcctcaagctctctcccgatgcgtgcaacgaactgcaatgataaggtatcaagcgcgccctcaggcgagctctctgaacactgctgcgcgattccagtcttggtagaggaggcgatcgcactcggctgtgcgaatcagcaatatgagcccagcctggtgcgaggccttgctagtcatcgcacattacgtggcgtgaaataaagcacgcaacagggaggcatgcctttttggcgaggatcgacacggttctgtgtcttgctaccagtatcgcgacagttggggtggaccgcgaaatttcactcgctccaggtgatggggcccaccagaattcgcacaacgacatgttccaggagccacatcccactcaatggtaggagttgaggatgcatcgttgatcacatgtcccttgctaatactatatcattgcacttgcatgtcaatgtcatcaatgcgcgctcctgcgccgtctgcatttgctgcaatctctcccagcacgatctcccctgacaggacatgggtggggcacagcaggcagttctgagtggcacgtactccctctcgacacttcttacttagcatggctggaaagggggagtgatgcatgtggcttccgcccagcatcatgaaagtgannnnnnnnnnggcatagctggaatggggagtcatgcgtgtggcttccgcccagcatcatgaaagtgattcaagagtactgcctgccaagttgaccttgcagcgggacccaagcactccccaacgacagcacaagcgccccactgggcatgtcttctcaaacaacgcctgggctcatagttttccaatgaggcccagcacatcatcgtctgtcacggcgctccctggcagcaggggtgtcaggtgcagggaggctgcacagtctgacagcagctcaaagtcctcgactgtggatttgggcgcagcaataaggctgggacgacgcactgcaccatcaactctcagtgacgctccgactcaaaccctggcatgtctgggcttccctgtgcaaccaacatggtacccacccagcctccagggcgcacactcacccaggcaggcctcggcgactcggcaaacctcctggaacagggtatgggcgctcctggaccctggtgcccacccgatcctgaccagggcacctgtccgcgccccatccacgccctgtgtcgattggaaagtgcgggtgccgtgtctgatgtgcgtgcaccttcacactcctgcacgctggtccacgccatgatgtcaccacctcccccacagatgtaagcacaccagaacatgaaagccatactatgattctcccccaccaaacacaacatacacacgccaagcccacttgccctgaggacgcgtcgctgcagcacaaacacggcggcacccgcgtcctggaacagagacagcggcgggagcggcgtgcatggcgcctgcggcggctgggcctgcgccgggtcggcccggcccgtgtcgacgctcgcgcgatcctcgtcccccgaccgctcggcgtctgtgggaggaggtcaggggcttgcatctggcccggggagccctccacgcccgacgtcaagcaatctgtgcgccttggaggggcgccccacgcggcccacatgccattcgccggccggccgcccccgcgcagctcattcaagggtgcaacctgtctcgcgtccccccccctcccccccnnnnnnnnnncagaagccatgctatgattctccccccccaaaacaacatacacacgccaagcccacttgccc

SEQ ID NO: 31274 - DNA, 121 bp, Chlorella protothecoides
gccggcgctcgcccaggccggcactcccgctggcctccgggtggccaactgcagcgtgctacaggccggcatgggcagcgcaaaggcggggccggggctcctggtggtggatgtggggccc

SEQ ID NO: 31275 - DNA, 61 bp, Chlorella protothecoides
caacctggatggaaacgttggcactggcaatgtcggcaggaacaacgtgggaaatgacaac

SEQ ID NO: 31276 - DNA, 65 bp, Chlorella protothecoides
tcgatccacgagggccaacagtattcaaggcaactactttccaccacagatttcctctgagttgc

SEQ ID NO: 31277 - DNA, 115 bp, Chlorella protothecoides
gccggccgccgcgccggagggcaggtgccattccatgaggtcgccgcccgccagtcccaccaccagccagccgaaaaggctctgctccatggcgctgtgcgtcgccgcccccatt

SEQ ID NO: 31278 - DNA, 61 bp, Chlorella protothecoides
ctgaggtcctgatccctttccagaggaccgtagggtgtgaatgtgcaggccaggcggattc

SEQ ID NO: 31279 - DNA, 102 bp, Chlorella protothecoides
gggtggcgcattggataccatggcgcgcgcctctttgcttgtgtatggctgactggtgaggattcttccacgcgccaggccggagggaaggtcctggaggtg

SEQ ID NO: 31280 - DNA, 79 bp, Chlorella protothecoides
acataccaccttggggcagattcaggcaggtgtctcggccctgaggcctgtgcatggagaagggaagctggggcgatgg

SEQ ID NO: 31281 - DNA, 75 bp, Chlorella protothecoides
cttcctgccacctggaacattcgagcacacggcgcacatcccggtcttgctctccagcaccttccaccttgcttg

SEQ ID NO: 31282 - DNA, 79 bp, Chlorella protothecoides
ccctggctcattaagatgcttgaggggaaccttaagctcacccagggcgcattacatccatctggtgcaggtctgaacg

SEQ ID NO: 31283 - DNA, 69 bp, Chlorella protothecoides
gaaggagcggcggaaagaggtgagggtgggcttcaggttgcgccgtgttaccccgggagtgatgcaagc

SEQ ID NO: 31284 - DNA, 115 bp, Chlorella protothecoides
gtctggatcgcttcattgcatcctcctctctgaacgcctcccaagtgacagcccacaaatccagtgcagtgacgtcaatgcgaaacgtaacgtgttgcgaggtactcacgcctgc

SEQ ID NO: 31285 - DNA, 70 bp, Chlorella protothecoides
ttcctggaggttggtggggttgggtggagggttgggtgggggtcctgggcgtgggagagggttcagccct

SEQ ID NO: 31286 - DNA, 90 bp, Chlorella protothecoides
gacaggccaatctcgatctcatacgctggtaggaggcgttgctttgctccttgtgctgataccgcctgctaacgctgcactgtgtacccc

SEQ ID NO: 31287 - DNA, 94 bp, Chlorella protothecoides
gagggggtggagcaagggatgcagagattccctccctgtcatgccccatcgtacatgaaggcaaatcgcggaagaggtctgccccgcatagcaa

SEQ ID NO: 31288 - DNA, 61 bp, Chlorella protothecoides
cccggcccaggagggcgccgtgattgcggcacccgccaagccccaggctggcgccgtcgcg

SEQ ID NO: 31289 - DNA, 61 bp, Chlorella protothecoides
cggaggactgctttccctctgcagtcctccagcgggcatgttggattcaggaccctctgcc

SEQ ID NO: 31290 - DNA, 78 bp, Chlorella protothecoides
ggaccctctgccccgccaatgcatcggaggattctcgaaggaagtcccccccaaggaccctccccttcacccgcccac

SEQ ID NO: 31291 - DNA, 90 bp, Chlorella protothecoides
gggatgggaggactggttgcatcacgcgtgaaaaaggggcagggttggggagaggagaagaggatgggcgcaggagcacttgttgggggg

SEQ ID NO: 31292 - DNA, 61 bp, Chlorella protothecoides
cctgacatgcatcgtcatttgcaacgccgcgattgcaggcggcgaaatgcagctggatcac

SEQ ID NO: 31293 - DNA, 61 bp, Chlorella protothecoides
cgggaagaagacatacacgctgctcatggggaagcccagcccagccaagctggccaacttt

SEQ ID NO: 31294 - DNA, 78 bp, Chlorella protothecoides
gtagttgtagattaggtgtcgtcaaacaatttaatcctcaaagggggccttcacgctgcggcgaatggatctcgccat

SEQ ID NO: 31295 - DNA, 76 bp, Chlorella protothecoides
ctgtgagcagctgaggggagcggggctgatcgccactctggagccggatgggggaggcggcggatcatcctgagca

SEQ ID NO: 31296 - DNA, 85 bp, Chlorella protothecoides
cgggtggggacagtgggctgcatgcatgtgccatgcggtgtgctaggcccgcacacattcatgccccagccccctcagttacctt

SEQ ID NO: 31297 - DNA, 73 bp, Chlorella protothecoides
ccccgccaccaccgccgcctcgcgacccctgcgatggttgttggggtgagttgtgtgggatgggtgagttgtg

SEQ ID NO: 31298 - DNA, 61 bp, Chlorella protothecoides
aaagcacacaatactggagggcatcggtggtgcaggacgacctcaagaatgcgggtggtgg

SEQ ID NO: 31299 - DNA, 519 bp, Chlorella protothecoides
ggtgcggggaggaaagggggtgcggggaggggggtggcatgggagttgaggcttgtgtgtgtgtgtggtgggaggggaaggtgcgtaacaggggggcaggtcccaggtcgctgcctggttgggtccgctccgccctgcacgcccctccaatgcctcgtcacccctcccatgtcgcacttcccaccccccatcacccatcaccccttcaccaccacccatcacccctcaaccacccacccccctcccccgccacgcaggccaccgccaaggagtacggcatcgtggagggcgacgaggaggaggaagcggaggccgccgagggcggggacggcatccgggaggtggtcaagaaggagctggacatgcagagcacggtggagaacgaggcggagctggcggcgctgcccccggagcagcaggcgcgcgcgcgcgaggcgcagcgccgcgccaaggagaccctggaccgcctggcagcggcgggggcggggccgcccgggtcggcccccggcgcgcccatct

SEQ ID NO: 31300 - DNA, 5092 bp, Chlorella protothecoides
  modified_base (194)..(203): a, c, t, g, unknown or other
  modified_base (2058)..(2067): a, c, t, g, unknown or other
  modified_base (2802)..(2930): a, c, t, g, unknown or other
  modified_base (3476)..(3485): a, c, t, g, unknown or other
  modified_base (3888)..(3897): a, c, t, g, unknown or other
  modified_base (4141)..(4150): a, c, t, g, unknown or other
  modified_base (4879)..(5027): a, c, t, g, unknown or other
ggtgggtgcaggtggtgaggggggtggggtggggtggaggtggtgagggggccgggacgaggcgctggtatcgttggccacacgcccaggcgggggccacccccgcctggtccatgatggtactcggcgagggacgaggaggccgtcgacgccacacagtagcctcacgcacaagcacatgtacacaagggaannnnnnnnnngacgaggcgctggtatctttggccacacgcccagacggggccaaccccgcctggtccatgatggttctcggcgggggaggaggaggccgtcgacgccacacagtagtctcacgcacaagcacatgtacacaagggaagcagggatgtggatgcgcagcatgccggccgggggcctggagtggtgaagctggccctgtggggaccctcccccaccaatccccatccagtcatgggagggaagccggcaccctggtgacccacgttccggggggtgatcccgggctccctttgctgtgaaacaaagatctacacacaagccaactcaccactctcgtccttgatgacgttggagtagaccacctcgcccacggagcggaagtggtccttcaggtcctgccaggacgacttccacgccaggttgctcacgtacacccggcggcccacgcgcataacttcttcctctgcaaatgggttgattggggggccgtgagcccagggaggcacggtcacggccaggccgcacagcaccacgcccagcgccggcgctctcacccgccatcgtgacgcttcctggcctccggattcacccgacacctcacgctccgacaaaagattcacacccttgcagcagtgggagaggagggcgagttggggggggtcccaggctcaagatggtgcgagggcagggaccatgccccggggtcgctggcaccgggttgtagcaatgtttccagctttccaaaagcacccctcccacgatccacgagtcttggcttccgtgccaaaacccagggcctggggagcaagatggacacctcgcttggccagtgcttgctctttgagcatctaaaaccgtgttgaatctctgggcatcgctcccctctttgggtcatccctctgctcgtgaaaacagatcgagggtcaccggtgtcgaggacagaggcccgtggaaggccccttcagactgataggaagttctcgccgccccatcttctccttgggtctgcctcatcggctttgagagcagggcgcgcgtcctcatggcggggtatggagaggggcttgacccgtatacgaccctgaacacccccaccatcctccgcacccgggacatcccatgggacatatacatgacggcccggctcatctccgaccgggagcttcagttcctgaggcgatatgacaagaaggagcccacataccagaccaagctcctgaaagaggcaaggaacttgggggggggggcaagggcccgccgcccctgggcgtccactttcacctctgcacatggcacgggactaagaatcacccgtgcatgcctgctgcagggcggcaagctgtatacaaatgccttcctgaccgtgctgaagaacgtcaccaaggacgagaccctgcagtatgtcctggcgctcatcgacgacctgctggacggtgggttggggttgactcgcagcagggtttgactgtagggtttcccttcatcttggcaacaactcatgcatgctgttgcctggcttggggttttctgatgtggacctcttcccgtcttgcattcgtcgaggcggtgggctgtgcccccactcaggtgctctgtacctgcggcccttgccaagcacccaagcattccgcatgccttcatcatgcagtggacccctctcacgtcgcgctgttcctgccgcccggggccgaggaggaccagccatatgttgagccgtaccccatccttctccggtgagggctgccgtgaggtgctgggtggtactgcctctcacctgcctcctgccctgagactgtgtgaggcagatcctcaatggccgcatcgaaagcagtttgccgcgtcgcagccacctttcannnnnnnnnngtcctccatggccgtatcgacagcagtttgccgcgtcgcagccacctttcaaccagcatcatcccacccccaccccaggctgctgcagcgccccgactggttcacgcaggagaaagcggcgcgcctgctgaccgccatcctggccagccagctgcggcccagcgccgcggcacagacgctggacgtgtcggcggccagcccggccgcctccgccctcaccgcctttgtggactggctgtgcgcgcagctgcggcgccccacccacccgctgctgggcgtgccggccgcggcgcactgcctgggcgtgctcctgcgcgaccccggcgtcaggccactggccacgcgcgccggcgcggcggggctgctgggcgcactggttcgcgtgcctgccggcggcgtgatccagaacccccagctcctgtacgaggccatgctcggaacctggcagctgtccttccacaagcctgcggccgacctcttggccaacaccggtgaggggggcttgtggggttgtgtgttcgtgtgcatgctttccttcctgtccatcaaaaccccatgccggccccctcaccccatgccggccccctcaccccatgccgccgccctcaccccatgccgcccccgccccgccctgccttccctcaaacatcccacccccattcatcactgcctccctcccaacactgttccacagccacggtggggggcctggtggacgcagtgcgcgtggcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgggtgctggaggtacgcgcgacgcagagctgggacgacggcgacgtgccggagctgctggcggcgctgggcgcctcgctggagcgcggcgtctgcgagctctcctcctttgagcgctaccggcgcgagctgctgctgggccagctggcctggggcccgctgcacaccgccgacgacttctgggcgcagaacgcggagcgcctggccgagggcaacggccagctgctgcgcgtcctgctcaagctggtggagtcgtcgcgcgacgccaccacgctggccgtcggctgcaacgacgtggcgcgcttcgtggccgcctacccgcacggccgtggcatcgtcacggagctgcgtggcaaggaactggtcatgcgcctcatggtgcaccccgaccaggccgtgcagcgccaggcactggcctgcgtgcagaggatcctgctgtccaaggaccacgcctccgccctggtggcgggcgtgggtgcgtgatggggaaggggaaacaggatgtcgcgggccctgtgtggccggcgtgcctgggactgcgagnnnnnnnnnngtcccaggccgtgctgagcgccttgaggcggccgaaccccgccagtgcgaccgcgtcgatgcaggcctccgcgccgcccgccagcatggcatcggcgtcgcccagcgcgaccatgcgcgccgcgtcgcccagcgcgtgcgcgcccgtggcgcaggcggtggaggcggcgtggttggggccgcgcaggccgtgggccaggctcaccgcgccggcgggggagttggtgaggatgcggggcacgaagtgggggctcagccgccgcagcctgccctgggactgcggtggaagagggggggggggctgtttgagggagggggcccgagttgcgctcaggagggggtccaggactgtggagaacgtgacccggggtgtgcagcactgctcacaggaagcatgcaggggnnnnnnnnnnttgcagcacatgtgatgtaacaagcctccttgagcttggtgtggttgatcggcactgcaacgaatcggtggtagatcaggaggtgccgtaccaggtgccagcccggaacggaacgatggcggggaagcatggtgcgtccagggagcccggatcctgggccatcgaggcccccgcagccccagcgcgagcaccacagtgctgtcatcgaattcgccattgctcagcatgtccatcaccagccgcnnnnnnnnnnatccagggccagagtcgcctcaccatgagcacgccggcctcggccaggtcggtggagaagctcatgcccacgccgatggccacgcccgtggcgtcgcgctccgcctcgctctgcgggcgccaccccgcgtccagcagggcctcggccgcggcccagagggcgagcgtggtcacgcgcgcgtggcgctttgcgtcgggcggggtcgcccaggggtagggcgtgtgctgggcgcgggggacgcagctgatcacgcggcaggggagctgcgccatgctgtccctgtgcgactgttgtgggcaaggggatggtggggggtgggcgagaggaggggtcttggggtcgtgcatggctgagttggaagggtctgggcccctcaggaccgccaatggcatacagcaggagcaccgcctcccacctccggcagatcttccagggccagggcccgcaccccggtctcgcccgccagcatgcgatcccaggtcagctccttgccgatgccgaggggcgtgaccagccccaggcccgtgaccaccaccctgcgcaggccgtctacacaggtggacacccgacggacggcagcaggcatcccgttcaggcggctggtgatggacatgctgagcaatggtgaattcgatgacagcactgtgctgctcgcgctggggctgcagggtcctcgatggcccaggatccgggctccttggacgcaccatgcttccccgccatcgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcccgcgacatcctgctcccccttccccatcatgcacccacgcccgccaccagggcggaggcg

SEQ ID NO: 31301 - DNA, 92 bp, Chlorella protothecoides
agaggtagcgatttctggggcactctgcctccggtctcggtggttcaggtacgaccttactatgtcaatgtgcaacgtaacctacagactgt

SEQ ID NO: 31302 - DNA, 74 bp, Chlorella protothecoides
ggacacctgtaaactcgaaaagctcgcaaccagatgtgatgccgttcaataggaggaggaaagcagcagcacca

SEQ ID NO: 31303 - DNA, 103 bp, Chlorella protothecoides
gatggcccatccctgacaggctcagagatcaacgagatactcgacatggaagaggacgacccatacgctttcaccatcaccgactaggtcccttgtaagcacc

SEQ ID NO: 31304 - DNA, 61 bp, Chlorella protothecoides
acacgagcgcgtgcagatacaagagcatattcattgtatataacctttttctcgggcgtac

SEQ ID NO: 31305 - DNA, 61 bp, Chlorella protothecoides
gttgtgtgtgtgtgtgtgtgggggggggggagtatctcagtgtgcgcttatggacgcgggg

SEQ ID NO: 31306 - DNA, 166 bp, Chlorella protothecoides
ctgccgggacctcccgtgcctgtggagctctgggcggcctcgagtcactctgtggctgaacaccagcggtggggtgcaggccggtctgtgcagggccgagcggtgacttggcgggcaggcacccggccttctcgaggactggttgggttgcagtgcttggcgtgcc

SEQ ID NO: 31307 - DNA, 77 bp, Chlorella protothecoides
cagcccgcccgagggcgcctgggcgccctctagccccctgcaccccgcctccagccccctgcaccccgcctccagcc

SEQ ID NO: 31308 - DNA, 117 bp, Chlorella protothecoides
tgagggggggcgctggtgtgtttcagctcaaattccaacacacgaccatggaggagagcctttccagctgccttcccactcaaacctgacagatggccatgtaccccacccttgcgc

SEQ ID NO: 31309 - DNA, 76 bp, Chlorella protothecoides
tgcgcagcagagggcgatgttccggccccgacctgtgttcccgtgaccagccatgacggtggggctctggtcagct

SEQ ID NO: 31310 - DNA, 101 bp, Chlorella protothecoides
tctggtatttcatggggctggcttgccggggatgggaagcagcctggcgatgtgctctgcttgaacagcgccatgcccaaaacccactgcagtgttccagc

SEQ ID NO: 31311 - DNA, 134 bp, Chlorella protothecoides
tgggagcgtgaagagaacgaggatcagtgctgttggctacatataactccacgatgctgcatgcatcctcaggtaacctgccggctctttctcagaccgacaacctcaccctgggtgcgtctgcctgcagtatt

SEQ ID NO: 31312 - DNA, 61 bp, Chlorella protothecoides
ggaagcgaggactctgctcgcaagatcgccacctccgccaggcaccatcgattgcagtggt

SEQ ID NO: 31313 - DNA, 100 bp, Chlorella protothecoides
gaagggctcgatagctcccgcgctgacgccctcgccggaccccatgccgtccggtaccctggcgggcaggtcccaggatctccccacgctcggacccctg

SEQ ID NO: 31314 - DNA, 80 bp, Chlorella protothecoides
tggatttggggcaagatctgcgctcacacaggaaacccgatccctcaccgggcctccaccggcaatgcagccgcacccca

SEQ ID NO: 31315 - DNA, 137 bp, Chlorella protothecoides
gcgtccaatgacaactcgcaatgacaaccctaacatcattacgcacatcactaatctcaaggcgaaccttccccagtccctccgattgtatgtcaccagctgcttatgcaactccttatgtgcatcgtggccttccc

SEQ ID NO: 31316 - DNA, 80 bp, Chlorella protothecoides
tcgtcacgccaggcgaccgggcccccactcgagataatactcaccccgatgagaaactccccttacctgtgcctgctccc

SEQ ID NO: 31317 - DNA, 72 bp, Chlorella protothecoides
tgtgcctggtgctgccccctcatccctctttccccccggagaatgggagcagcacggccaggggaacaccac

SEQ ID NO: 31318 - DNA, 61 bp, Chlorella protothecoides
gtggcggcgcagccccgccgcgatggaaagtgcggcctgcacgccccgcaccgcacggtcc

SEQ ID NO: 31319 - DNA, 80 bp, Chlorella protothecoides
ggacaggccctgcaccagcagcaagcgtccgcacccacccacccaccttcgaccagctcatgctggctgtattctccagt

SEQ ID NO: 31320 - DNA, 70 bp, Chlorella protothecoides
accttcagtggctatcgtccttcgtcctcctaccacctttagacactctgcctcttggatccctcccgca

SEQ ID NO: 31321 - DNA, 116 bp, Chlorella protothecoides
catgccgtcagctcccctcgccctggtcaggaggcccgcgtctcgtctcgccctctgcgtgtcatagagacagcgtgcggtctaacaggttgttttccgggaggggaacgggaagg

SEQ ID NO: 31322 - DNA, 67 bp, Chlorella protothecoides
gatgagcggcgccacgccggtcagcatccaccagcaagcgctgcgcgggatggcgctggtcgcgctg

SEQ ID NO: 31323 - DNA, 61 bp, Chlorella protothecoides
gagtatggtgcttggcagctccatgccatgataggatcgtgcagtctgtgcaagggcccga

SEQ ID NO: 31324 - DNA, 184 bp, Chlorella protothecoides
ttgcagctcagtgagcagtccatcgctgagagaggaccaagagcggcggctgacaggaatgtttccagaaaattgagagttggcctgcataatttggagcccccgaatgccatagggccatcaacataccccacagaacattcagcagctgatgctgataagagtcgcatcctttccccgagct

SEQ ID NO: 31325 - DNA, 61 bp, Chlorella protothecoides
cgatgcaggtgttcatgttgggaaatagatagaggactcactcaggattcttctcaacctg

SEQ ID NO: 31326 - DNA, 62 bp, Chlorella protothecoides
gacgcgacgccccagcaaaaaagcacttggatagcatcagcatgttggccgccccgttcaca

SEQ ID NO: 31327 - DNA, 69 bp, Chlorella protothecoides
ccggccatactcgaggtcgtgagatctacagaggcaagttcaattcgtgtgacattacattcccttgca

SEQ ID NO: 31328 - DNA, 61 bp, Chlorella protothecoides
ccgcatgttccgaacgtccttccatcggaaagcccaccccgcaacccaggttcgaattcga

SEQ ID NO: 31329 - DNA, 70 bp, Chlorella protothecoides
gtggagggaactggcttgtcacaggcgggcttgtacgcatggaggggaaccctgcgtgctgcccgtggcc

SEQ ID NO: 31330 - DNA, 127 bp, Chlorella protothecoides
tcacgccagcttctcgacgttcttctccacattgtcggccacgtcctcggcgccagcagccttctggacgccgaagatcttggccaggagcacaaaggacatgccccccgccacattattgcccgca

SEQ ID NO: 31331 - DNA, 73 bp, Chlorella protothecoides
ccccccccattcacacagggcctttgggtgtgacgctcccattggcatgatatactccatcaatcccttcacc

SEQ ID NO: 31332 - DNA, 114 bp, Chlorella protothecoides
ctgtgggcccgggacaagctctccccatgtcctgttctattgaccatgcatggcgggccttctcatcccctggatctgccagcgtggaagtatcagccgcaccgtcgggctgtg

SEQ ID NO: 31333 - DNA, 180 bp, Chlorella protothecoides
tcctgtcgcggtctttcggaccctctgtcgcccgcgtgacaacggcccagctgttgcaagggcacgcaaactgccgcgttgccgcctacatttaggtgctcagtcctccgctccaaaaggtttatgccatgtcaaacaacgacctgactacataccaagcgcttgggcaagcaccctcat

SEQ ID NO: 31334 - DNA, 220 bp, Chlorella protothecoides
tccttgctgcaagggcacagcggggacttggctggcgtgaggggtccgagccctggccgtggccggcgcgggctgccatcggctaggggcctgaccccggagcatgacaccccaggcctgccctgcaggcgagcctcgctccaggctgctggcagcagcccaggctcctaccagacccccggcctcaccctccagtagtactccaggtaggggtaggagc

SEQ ID NO: 31335 - DNA, 108 bp, Chlorella protothecoides
cttgttgacacaccgcttcgtgtcccacacatccaccagcttctccttgccgttgcgcacccgcacgtactggtgggagtgcagggtggcgtgacaggcgcagcacag

SEQ ID NO: 31336 - DNA, 98 bp, Chlorella protothecoides
tatgaatatgccacatgtgcctccttccccccaccatactccaccccgcaggtctgggagcaccctattacttgctcaaacctagtagcagcgacctg

SEQ ID NO: 31337 - DNA, 61 bp, Chlorella protothecoides
gatcgtggagggactgccacgcgtgggaccctcaggtcccagatcactctgatgctgcgtc

SEQ ID NO: 31338 - DNA, 61 bp, Chlorella protothecoides
gcggcgactggctgtgccccggcgtcagcctcttttgtggtgatggggtggtggtcgcaga

SEQ ID NO: 31339 - DNA, 109 bp, Chlorella protothecoides
cacccgatgaatggcatgcagtgtccccgtggcagcatgtgaccgcatgcgccccgagatgccacgtcctgccaccaatgccccccctcatcatgctggcactcccctc

SEQ ID NO: 31340 - DNA, 7330 bp, Chlorella protothecoides
  modified_base (561)..(570): a, c, t, g, unknown or other
  modified_base (1342)..(1351): a, c, t, g, unknown or other
  modified_base (2212)..(2221): a, c, t, g, unknown or other
  modified_base (2362)..(2553): a, c, t, g, unknown or other
  modified_base (3087)..(3280): a, c, t, g, unknown or other
  modified_base (3358)..(3367): a, c, t, g, unknown or other
  modified_base (4598)..(4607): a, c, t, g, unknown or other
  modified_base (5187)..(5196): a, c, t, g, unknown or other
  modified_base (5695)..(5704): a, c, t, g, unknown or other
  modified_base (5985)..(5994): a, c, t, g, unknown or other
  modified_base (6971)..(6992): a, c, t, g, unknown or other
gggggggggacggctcatgtccggcaaagtgcaggcgccgaaagtgacgggcacggaggctcacctacccgacctagagtgatcgcgaccgcattacgtacgtagctacagcatgagaaaggatggagagacggcctcgtcgcgtcgcttctccctaagatgtccccgggattgaggccgggtcaaaggcgcaggagggttagctcaccacaggcccgaccgctcgtcggactgggaacttgccacgcgttttctccaatctgctctgcaatggtgtcacagctggttctagttccccgttcccgtggtctgagccaaaatcctggtctccgaaactccaggggctgaagcgcgttggatttacgcggtgccttctctatagacgagacctgccttggcggggccccgcacccacccttccggcgatgaccctccgttcagcacggccattgatccaatgcaacctgctgtgctggagtcgatcctatctcatccacattcgccatctcattcgcatccctgtgcatccatcgtacggaagcaattccttgccgggtcgtnnnnnnnnnntcaacctgctgtgctggagtcgatcctaactcatccacattcgccatctcatccgcatccctgtgcctccttcgtacggaagcaattccttgccgggtcgttggagtggtccgtgagacgaatctgaacggcaacctcgtgctggcgtacgtagctcacagattccatggtcgtacagcctgaccatggttttggggttgtattcacatatcccgatgccgtacgcattgatcaggcattcaccttcagcttgctctccacgtccgcggtcgccttgttgacggagttgtacgtgaagatggcccgtcgctttggcaatgccgccaagctcttcagcacctcctcctccaatccttgcgaggacaccgtcacctccgtctgggccaccaggtttttgatcttgaaaactccctgcggggaagacggatccggaaggggatgcgttcgggcaggggagggcatcgggatgaggcgccctgatggctgggaaatgcacaaacacgccacctcaaaagctcgccatcaaccagagaacacactgccaggcgcacattctccagctcattctctccaaaaacgaccagcaggtcgatcccctgcttcagagcataacctaacgagtcgctcatcttggggttggccttgaagccgaactcagccttgatgggagcagggatggggatgattggtctgatcgcgcccacgcagtcggcaggctggtgaacttcacattgcaggcacgcagatgcatggcgccttcccggaaccaatnnnnnnnnnnggggatggggatacttggtctgatcgcgcccactcagacagcaggctcgtgaacttcacattgcaggcatgcagatgcatggcgccttcccggaaccaatggcaaatcgcatccccagactcgccacaatcctgggcccccggcacaccttgatgccccgggcccacaaccgtgaggcgatgctcattctccgtccctggtagccattgccaatggaggccaccagcacctccgtctcggtctctcgtatgctgcacccctcctgcgcaatccgaggagggtttgagagtgggtgatgggcatgcgctggtgtccctgtctccttggtgggaaggagcagccacagttgggcagggatgcatcctcctgatacccaccggtttgtagcctcccccaacgggtggtacaagtgcaacagtatgcagtgtctgcaccacagactctgcctcaggccctccaagctccgctgcacacaaagtgtgcacccgcacaccctgccctgtgggccgcctgctcacctccttggcttgcgctcgtgcctgctcctccatgatgttgtagatgcgctcgatgccgatggagacgcccaccgcgggcacgtccttgccgctgaacatgccgaccagcgtgtcaaacctgcgatggtgaggtggaggtggttgcagcagactcctcggtcccagccggggatgtagggtggtttggtcaccaagtctgcgccaaggcaaacggccggccggtgcgcaccgcagattgcggagctgccctccctcgcctgcacatccactcgcttgcaagaccagatttacccctcttacacacacacacgtgtgcacccacctgccccccgccgccacgctnnnnnnnnnnaactggtttgtagcctccccaacaggtggtacaagtgcacagcatgcagtgcctgcaccacagactctacctcaggcccccagctccgctgcacacacagtgtgcacccacacaccctgccctgtgggccgcctgctcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtaggatggtttggtcaccgagtctgcgcgaaggcaaacggccggccggtgcgcaccgcaggtcgcggagctgccctccctcgccaccacatccactcgcttgcaagaccggattacccccctttcacacacacacacgtgcacccacctgccccccgccgccacgctgccgactgaagcccccttcagcaccgcctcgtagatgacgccggtgtagtagtccaggccccgcgccagggacaggtcgaagacgatgttggcgagcgcgcccatgccctccaggtacccaaacagcgtgcgcagctcctccagcgcggcgcgggcgcccgcgtggccggcaaacgcgtggcctgggggttggtttgggtgttggagaatcgtgggagccgcttggtggggctctctaccagcgccgccaccctggcaacctcatagagcagcagcaggcatgagccaggtcccagtgccgggaggatccacatcccaccctgactccacgcacccttgtccagcagcttggcgagcagtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgcgctgtttgcccggtgaagcgtagaggaacccccccggggcccaagcacctccggcaggctcccacccgctccnnnnnnnnnngcacatcccaccctgaatccatgtacccttgtccagcagcttggcgagcagtgcctggggctggcccctcagctcgacaaagggcctgatggcatcggccacgccctcctccaggcccttgtccaccaccatctcccgccgcacaaagtcccatggctccttgtccagcttgtcgatggcagagcagatgggcctgggaggtggcaggacaacatggaaaggggtcagcaggcaggactgctctgagaggagcccagcagggacgcgctttttgcccggtgaagcgtagaggatccccctggggcccaaagcacctccggcaggctcccacccgctccctggacaagggagcacacccccgccccgctcacctgaacttctcggggggcacccccgcgatgtccagcatggcatccagcagtccccggtggttcagcttcacctcgtactggcccaggtcgaggtcatccaggatctctgtcagcacctggggtcgacggggaaggaaaggcggccacgacggtgagtggcggagtcggtccagccaaggcgttcaggctggagcgcgtggtccagtgcggctgtgccctgcaggaggcgccaggcctgtcccgcccaaacccaacccccccatcacataatgcctgactcaccttgagcacctccgcgtccggcaccatggaggggtagacgccggcgatgtcgaagtcacactggttgaactccctgaagcgaccccggttcatggcggggttgtcgcggcggtagacctgcgctatgtgcaggtgggcggcggtgacgcaggtgcccaaagagcctccggcacccgccccagatggagctgacttgcacctgatccccatcaaacagcagcccatgcgccctggttcccaacctcccagaagcggacacacttggaccccacattgcccattcagagcccagcaggcagcgccggcccaccttggcaatgtggtagcgcttgatgttggtgatgccgttcagcgccacgtagcgcgcaaagggcacggtgaggtcgtacctggggtattgtacgtgatgatgttgtgatggaggtgggtgagcaccatgtagctccagtgtgtggcgtccccgggatgaacaggatgcgagttctgccctcgtctgccctgggggttacgtcgatagcatgagtcagcaaccagcatccaacatgtgcataagagcgggtctgcacctgagggacagnnnnnnnnnnacgtctgccctgggggttgcgtcgatagcatgagtctgcaagcagcatccaacatgttcataagagcgggtctgcacctgagggacagcagttcacccccctgatcagccagatcatagatcagcttggagtcctctccatactttccagtcaaggtctccctgtcgaacatggaggatgtggaggtgtggtccaaatcactactgtccgcgctgcatgatcttcacctcccctgcaaacgagaaggcctgcacccctgcatgacgctctcgcgcgacgccgctgcatgccgagcacctgagctcgaaaacgggggtgtcgatggacacagcgccgtggcgcttgaacacggcggtgatcttttcgaaagcttcctgctttatcgtcatttggtcaggcttgaaatctcgggtgcccttgggaatctttggcttggccactctggctttgggggccatggctgccagacctgggacaggagataggaccagtggatggttactcaccaggcaatggaggtttgatggtcctagaacatacaatctgttcgaatgtacactcagtaacttgcttggcctcnnnnnnnnnntagacctgggacaggagataggaccagtgggtggttactcaccaggcattggaggtttgatggtcctagaacaaacattctgttggaatgtacactcagtaacttgcttggcctcgctaaacacctcttccttactatcggcaaactcttcaaaggtggcccctggctgcgaccgcaccgacgtgagcgacctgtgctgggggcagtatagtgtgccgtcttcaaacagaattttcggattgcattcacaaggaagatgatagatcgaggggaagctcccagcagcagggctgcagcacgtgcgagccttgggtgcgagggcgcgggcgcagaaagctgctgcgcctggtttgaccctgcgaatgtcagatctaacgtcccggctgtcaccaaccaactccccaaagcgcccgcacctataaagccgactcccccctcctgtactgccacaaacatcatattattctcccaagcaagtactgagtctcgacgaagtcannnnnnnnnnaaagcgcccgcacctataaagcccatccccccctcctgtaattccacaaatatcatatcatttctccaagcaagtactgagtctcgacgaagtcacttgcgcctcccactcgaaactcagtagcagacccgctccacagcccccaaccaaccaacacccaccatcctcacaatgatgcgcaaggtaggacatgtgagccttaaaaactctctgatgtactccaattggtccaattcgaggagatcccatcactacccgcgtcgcagtgtgcccaactgacnnnnnnnnnngctcagtagcagacccgctccacagcccccgaccaatcaacacccaccacctcacaatgatgcgcaaggtaggacatgtgagcctcgcaaacactctgatgtactccagttggtccaaatcgaggagatcccattactacccgcgtcgcagtgtgcccaactgacgactaaccgaccgccctccgcacaccttgcagatctctttcgcggtcctgctgctggcagtgttcggcgcctccaatgctcgcgctgcggatgatacaccccttggtgaggtttctgtcctcgtgcatgcagctttctggggggtgccggctcccatggggatgccgactaacggtcgcccggaaatgacgcggggccccagccctgacgcgaccccctccctccctccgcagagtccctgggatctcaattggccgacgcactgacctccaccgccctcgacaagcttctgaagctgtcctccaccgcctccgttgctgccaccgcctacgggcccccctcccccggcccatactccccctcccccagcccctacgccccatctcccagaccctacagccccaaggtctcccccagctcctactcccccagccctgcccgctacagcccctccgtctcccccagctcctactctcccaccccctacagcccatccagcccctactgggcgccttcctctccctacccactcaaccgcggccgccgcctgtttggcgtcaacctgcgcgcttgagcctcctgatggggccagagctgtcccccgacccccgcggcatcctttccgcacacccctccccttggcagaaatgctgagactcaagaccagcacactggactgtgcatgacaccaacattcttcattccactgtgggtggcagagcagggcatcatctggctcgcgccaagtctgcacaccgaccaccacctgcactggcattgacaccccccccccccccccccccccccctttnnnnnnnnnnnnnnnnnnnnnntctgcttttgcctactctttgttgcccatgcatagcgctgtgatgcctccactgcaactgcgagaccgcggaagcacgcgactgtaacaaagtgccccaaacatttcttgagcgtcagcgaggtggggcagaacgagtgtttggcggtggaattgagtgctcaggggggtgcggcgccggcccccgtcctgcgcccggcggcgtggcgcagcaggcgcagcgcgttgagcgccaccagcagcgtggacccctcgtgcgcggccaccgcggcccacatgggcacgcgcccagccagcgtgggcagggccagcgcggcggcggcgcccagcgccagcgcc

SEQ ID NO: 31341 - DNA, 140 bp, Chlorella protothecoides
gtgtgaggaggagaggatccgcacatgccgcctgggctctcaggctcgcttgacccccccaacccgccagcatgccccccatatgctcactgcgcaggcgctgggggtatagcgtgaagggcgtgcccaagaaccaggcc

SEQ ID NO: 31342 - DNA, 76 bp, Chlorella protothecoides
tacaacgcctgcatggaccgtcagtggcccggccgaggtggtcctcgcgcggctcgaatgcatcccgcagggcgag

SEQ ID NO: 31343 - DNA, 126 bp, Chlorella protothecoides
agccccctgcgaccccgggtcacaggaggcatttgaatcatggagcggtacccattccttcattagatcccaccacaaagcaacaaaatatagcgcaaagctagcattgtaaacatattgcccgcc

SEQ ID NO: 31344 - DNA, 65 bp, Chlorella protothecoides
ctgcgcacggagcatgggagcgggggcgtcgagagagggtccgcgccgagcggggggaggcacgg

SEQ ID NO: 31345 - DNA, 80 bp, Chlorella protothecoides
ggtggcgcagagtgtcacacgagttcaatgccatcctcccgcctcccaaccccagcctctgcattccgcccctcacatcg

SEQ ID NO: 31346 - DNA, 61 bp, Chlorella protothecoides
gcaaagtgcctgtttggggaggggggggggggcgagggggtgcaggcatggcaggtgtcgg

SEQ ID NO: 31347 - DNA, 61 bp, Chlorella protothecoides
attgtcgaatgtcgggctgtatgtgatgtgtagtggtccgaggacgaggcaggcgcctctg

SEQ ID NO: 31348 - DNA, 104 bp, Chlorella protothecoides
gatgctgtggttcacgagctggaggctgcgtgcaaggaggccggtgggttacaaggggattgcggtgtgggaaacgtgttgttgttctggcacttgcatcggcc

SEQ ID NO: 31349 - DNA, 65 bp, Chlorella protothecoides
tgcgagagggtcgcccccgactccagagtcgcgctggctcaatccccgaaggaggcgacggctgc

SEQ ID NO: 31350 - DNA, 101 bp, Chlorella protothecoides
acggcatcgtggctgggcggaggatctacctcgagcacggcctccaccctcggcctcttggccatggcagcctcccctcccacctctgcctctccgtcctc

SEQ ID NO: 31351 - DNA, 68 bp, Chlorella protothecoides
gttcacgcttgtccgagatggctttgccgggattatgcatcaggccagtcaagaccgatcgtggctaa

SEQ ID NO: 31352 - DNA, 134 bp, Chlorella protothecoides
cgaggtggagctctggggaagcgatctgcgcgccccggaatcagtggccccatcaacgccacaggacaaccgatcacaaccccctctagaatgaagtggagacgtgtgaggtttacagtgttttgaaacatgtt

SEQ ID NO: 31353 - DNA, 61 bp, Chlorella protothecoides
ttttcacgtaactggtttatttggtcctggcatttgggtatcagatccttatggtattagt

SEQ ID NO: 31354 - DNA, 61 bp, Chlorella protothecoides
agcatgagcatgagtttctattttgaaaggcgcctccagcccatcacgtgacagctgcggc

SEQ ID NO: 31355 - DNA, 61 bp, Chlorella protothecoides
ccaccaccccgccctggggcgggtcggcgctgtcggcgccgactcgggcctctccctcaag

SEQ ID NO: 31356 - DNA, 61 bp, Chlorella protothecoides
gagaaccgcaagaagagcgaggtgacggtgcgggtgtccagcgccacggccaagaagatgc

SEQ ID NO: 31357 - DNA, 61 bp, Chlorella protothecoides
gggcgtactccatgacaggcttgggtcgagaatatgttggttgcgcccagcctgccgcggg

SEQ ID NO: 31358 - DNA, 66 bp, Chlorella protothecoides
cctccagagtcacctggtgtcatgctcggctggtgaactcctcccctcctgcagacctctggcgtc

SEQ ID NO: 31359 - DNA, 61 bp, Chlorella protothecoides
attgctggctgccgcgggaggtgaggggcgtgaagcccaccatgaagaagtggaggcgggg

SEQ ID NO: 31360 - DNA, 131 bp, Chlorella protothecoides
cttgctgtgtttggttgggacttggtcatcgtatcgcttgactgatgaatgccacagcggactacctagccacattgtgggacgagcaaaataaaagtcttacaagcagcgcggcctctcctccaccttgt

SEQ ID NO: 31361 - DNA, 61 bp, Chlorella protothecoides
ccagcgcggcgtgctccgcctcgggcacggcggggagcagggcgcgcgcgccgtccacgtc

SEQ ID NO: 31362 - DNA, 75 bp, Chlorella protothecoides
cgtcgggtgcgatgtaccacattaaatctttacctaaactgcctgctcattgcattagcagtcctacaatggatc

SEQ ID NO: 31363 - DNA, 61 bp, Chlorella protothecoides
tgcggcagccctggcgcttggccttgaccacggggccctcggacgcctttccctgcggtgc

SEQ ID NO: 31364 - DNA, 78 bp, Chlorella protothecoides
tggatcggtacggtatgacatcatatttaaagcctgtgtatagtgctcgaaagtgcacatcttgtgtggacgtgaaat

SEQ ID NO: 31365 - DNA, 69 bp, Chlorella protothecoides
ctgcacaggtcatccatgccaaccctgctttaaagttaaagacccgcatccaccctcgccactgaccag

SEQ ID NO: 31366 - DNA, 74 bp, Chlorella protothecoides
ttccgacggcaggtctgaggccaagacgaacgatggctcggaaacccctgcgacagctgctcatccagaggaac

SEQ ID NO: 31367 - DNA, 69 bp, Chlorella protothecoides
cctcgtgcagcctattcgtgagaagctgtgcttgttaatgccctaaagccacagcagctcactgctgtc

SEQ ID NO: 31368 - DNA, 61 bp, Chlorella protothecoides
ggcgcgggcgtaggctgggcaggagtgggcacgggcacaggctgggcaggagtgggcgcgg

SEQ ID NO: 31369 - DNA, 146 bp, Chlorella protothecoides
aatgatgtcctagtcttttcagaaccacagcccggttgctctggaagtcatgaactcagtgcactcggataatccggatcgcaggtaatgatctgagaagtatatctgccatacagcagattgtcagggcctcagacaagctggtc

SEQ ID NO: 31370 - DNA, 62 bp, Chlorella protothecoides
accgaagagcctgggatggcctgcatgtgtggtaaagaggcaagcgtttattcagagcgtgg

SEQ ID NO: 31371 - DNA, 116 bp, Chlorella protothecoides
tcgttatcgtctcgtgtgcgattctaaaccaggggggggcaaagatcattttgaaagccagcaagtacactgacgaggacagcgcacagccgccaagcagctgctggtgttaggtt

SEQ ID NO: 31372 - DNA, 61 bp, Chlorella protothecoides
ccgactcgtctcatagcttccaagcatcgctttcgtgcgctcacaacatattctgatacat

SEQ ID NO: 31373 - DNA, 122 bp, Chlorella protothecoides
gttgaccggattccaggccaccgcattcaccgtcccggtgtgacccttgaggatctgcgcaggattggttgggaggagtggcgtgcgcgtcgatgggcagtctgtgtgatgagagccagggc

SEQ ID NO: 31374 - DNA, 158 bp, Chlorella protothecoides
gaaggggagccggcaggaagatttggatggtttggcgagggtcatgggtgagcgccgatgggtggcaagggctggaatgggctggcagggagccaggcgtcgcaggtggtgcaccaccgtctgacagccacctcccacgcatgagcgtcgaggtgggg

SEQ ID NO: 31375 - DNA, 61 bp, Chlorella protothecoides
cccctggtataacctgtccacacactcttctttgcccaatgtattcattatagcgcgactg

SEQ ID NO: 31376 - DNA, 434 bp, Chlorella protothecoides
  modified_base (113)..(329): a, c, t, g, unknown or other
ttcctgctccttgctgtgccatagcaggttctcatggccaacatggcacggcacctgttggctgcaaggcctctgcagctcaggcttgacagcctggccacttgaacaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaggggccgcggtggcgtgacaggtcgggccccactcttgcccacattcccagtgcctcgccccctcctctcgcaggcctgggcgcgcacatcgtgacggtg

SEQ ID NO: 31377 - DNA, 686 bp, Chlorella protothecoides
  modified_base (105)..(325): a, c, t, g, unknown or other
  modified_base (409)..(526): a, c, t, g, unknown or other
aagtcagagtggccaatggctcgatctggttcttacctggagaccatcccttccctgcaccaggtaaggacgctacagaggatttcgaggagattggccacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgccggtcaagaccaagaagcagaatggcacgctggctgggtcgaccactgggaccaccagtctgtccaccgccctgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgggtcacccagggcatggcctcggcacccctgggccaggttcaggccgtcggcaagccacagagggccccaggtatcgtattacccctgtgtcagcccttttgtttcccgttcagccacacgcactgcgttcagtttgtagaaacgtcacttccttcc

SEQ ID NO: 31378 - DNA, 130 bp, Chlorella protothecoides
gagggttgagagcaggcaaacgagccgcatgaccttgtattacgcgaatttactgcttataggcgatgttatgcgttctccaccaggattatttctctgactctgatgggagatgttcggagcacaaggg

SEQ ID NO: 31379 - DNA, 139 bp, Chlorella protothecoides
ccaaggtgcagccctcgtcacgcgtgcacagggacattgacaaggcacgtgaagccgagcaggggggcgagtgttcggctctgctcgccctctgggcctcgcacgcattgcagatggcatgctgctgtgcggccctgtc

SEQ ID NO: 31380 - DNA, 115 bp, Chlorella protothecoides
ggtcccagcaatgagcccgcctcggccccccgggtgcgtctgtctcacgtcctcgcagacccatcccctgagcaccccgccccttcctccaccctgcagccgattctctgcgcat

SEQ ID NO: 31381 - DNA, 3773 bp, Chlorella protothecoides
  modified_base (1420)..(1599): a, c, t, g, unknown or other
  modified_base (2058)..(2067): a, c, t, g, unknown or other
aacttgctggacacttgggaatccacatccaagcactgcattctgcaaccctgtatgcacagaaggaagcgacacatatacagcctacacagcacgtacttggtggtgagggagggggcgtcgtctttgggggaggcttgcccttcttgggaggaggggggggcttcttcttgggaggcggcttcttccttggtgggggagggggcggctttttcttgggaggcggcttcttccttggtgggggagggggcggctttttctttggcggcggcctcttcctcggcgggggtggcggtggcttcgtggccagcaggctcctgtggggtccctggagagcgttgacggtattcagactccgttgcagtgcctctgcgttctgcatgccctccacggtctcggaagactgaagttgtctgaggctctggatctctgcgtgattgtcccatgcatcttcgatctgtaggggattattcatggtgaaattattaggggagactctggaggtggaaccagcaactgtccgacaaccaatagacgtaacggctatcaccattcgctcgccttctccgccttgacggccacaactcccaaaaggagcaggtacgatacaataacgagccgtgatggactcattctcaacactatgccgtatcccgacctctgagaatcgggacccgcaacgggtcagcactgaggtgctgccggccgcaaatgcagtgtttctagggatggagcaattcgtatcgatgacgaggcccgtaaaggccagcgatacctttactggggtaaagtattcgatgcactcctgtttgtcggttgatctgtcaaattatctccaggtcttcggacgactcccgccccgggtcaatgatgcgccaaccaccgtggtcgtcgggcgcccgcaaaatcttgctgggctggccactgagtcataccgaagcccggaagtcgcatccttgaatgataagatcgtcgcgtggtggcagctgcggactttcccccatgcaaggataagttggatccggtacggaagctggcccgggcagcccgcatccgcttgtgaccccctgccgggatgatgtttgcgcagggacatgatcccaccgagacctctcaccaaatgcacaatgaccacgcattcctcatctgctttgatttccctgaaatgtgaccgctgaatgctttcaaggtgcctttagagtcagtgtcaaacagccagggcggcttgcaaagcacgagtaaggggttcaactatggctgacatcagccagtcagtactggggccaaatacatttgtcgatggcgttgtcagcaatggtgagcacatcagtggatgtggtcagcatgggcctggctggggtaaaccctagctcagctcagggcaaccaggccggccagcgcgccggtgaagcccgcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagcggtggtggggctgcttggggtagccggtgcccacgccgcacacgaagctgcggccggtcgtccgcagggcatagtccacctgcccctgcacccaggccaggttcttcccgcggtcgatggaggagtaggaggcgcgcagggccatcatgaaccctgcattgttggcgtagcgcaggttcccccactggctccaggaggggtacaccaggccctcgggcgtcttcacgatgctccagttgcctgaagaggagggacaggggaaagggtgacgagcaggccagctcttggggatgccagacttccttacggtcccaggtcgaggcacatgggggcacacatgggggggcacgtggtcgactgctggtgcccgcgtatcgtggaccgcaccatggcccccacgtaccgtctgcggtctgccaggccgagaggaacgatgacgtcatccaggcctcgnnnnnnnnnncgcacatggttgactgctggtgcccgaatatcgtggaccgcaccatgcccccacgcaccgtctgcggtctgccaggctgagaggaacgatgacgtcatccaggcctcgtacgatgccctccccggcacggtcttgccctcgctggcgagcttgagcagcaggttgatggcgggggcaaaggtggagtcccagctggtgtagatgtcacccgaaccggcagactgccagaaggcgtaggcgtcggcagcgtacgcggcctcccccgtggccctgaacagccaggcggcggcatacatgagcttgtccaggtagcgcgaggaggagtaaacgtatgtggccgccgagtgggcggagttgtacttgcctgcacatatgggtttgtgggcaggaatggcggccatgaccagcgccaatgagtgttgccagctgcttcccctctctcacaacgccactctgcccctggtcagcacgactgctcagtcaggcaccttcctccgctccctctcccatcccagcacccttctgctgtgagcgcaatctcgcgccttctccggttcccatccgtcgtccatccaaccacagcctggaccctgctccctgctgacaaacgcacccacaccaaacgggaaaatatctggaccagacgtcacctgggtacttcttcccccaagcatacagctgcttggcatggctcagctgcttggcggcaaaggcggggtccctggtcttgaacagcaggccggtggaggagagggcggccgacaccgcgccgagcaggtcggaggccggggtggccgccgtccagatgtatgccggccggcttcccggctgctgctccggacggccccagtaggcgtggtcggggcccggatccccaatctggcctacgtacttgtagtcggccgtgtggcagtctgcgaggtaggtggccgccagccggacgttgttcagggcgggggtggtggcgtccgcctgcgcataggctcccgggaactccagcacgctccaggccaggaaggagacgctcacgcccagcgggaagttgagcttcaggaagtccccggcgtcatacctgcggcgtcagagtacggtgagggagcacggtatggttgaagtgacaccggcagctcttatcccggcatgagcttggtcgagggagcattgcaagggtgagctgggcatgcttgcgggcccgcagacaggcagggcgacacaagcggtgcgtggtgggcccaccctcaccctcagcagtgacactcaccagccgccgggcacagggtcgtccaggtgggaattccctcggtaagcaatcctgttccaggagggcttcttgccactgacctgagcctcgtagaagagccaggatgcagccagggcctgggcagcggtggaaagggggaaacaagatcagtgatagtgcacggccatcccagagtggattgcgcgaggtccagagcatgaccggcagcatgcacgagggcaaggggccccaccttcttgtacagggccagtgatgggggaggaggcggaggactcctttgcggtggtggtggggacttcctgggtggcggggatttgctggggggaggaggaggcaccttccgtccaggcggaggaggagggctcttcatctggggtggtgggctctttcctttaggtggtggaggaggtggcggatgtggaggtgggggaggggggggcggagg

SEQ ID NO: 31382 - DNA, 70 bp, Chlorella protothecoides
cctatataggaacagcatccccggggctggtgctgcaattgacgatagacattgccagctatcaaatttc

SEQ ID NO: 31383 - DNA, 61 bp, Chlorella protothecoides
ggggaactccttgaacaagcgcgctgggacggcgacagacggcaacaagcgcgccagcaca

SEQ ID NO: 31384 - DNA, 122 bp, Chlorella protothecoides
tcggggatggcaggaatgaaggggtgcccgcgagctctatcttggcctccgctccatggtggttctcagcgccagtggctgtcctgacgagtaaaccaggatcgcactccccttggctctcg

SEQ ID NO: 31385 - DNA, 141 bp, Chlorella protothecoides
cgacggcgggccgcccgcgccaccctttcctggcggcacaccggccgaggaaggggcgacggtggaggatgcggcggacgcggacatgccggacgccaagccggagccattgcgagacccggaggtggcggccgcgctggg

SEQ ID NO: 31386 - DNA, 88 bp, Chlorella protothecoides
cttgccactgaagctttcaggtatgcgggcctgttgaagctgctaagcgcatgcccttcctccgggtcttcaagtgtaaacttcacat

SEQ ID NO: 31387 - DNA, 79 bp, Chlorella protothecoides
ccacacttcagggtccatgcgcgaggcgttttatgaattccacaaaccctcccggcatcgcacctggaagaacttggag

SEQ ID NO: 31388 - DNA, 68 bp, Chlorella protothecoides
catagcacttgcctctgcacccaagcacattccatttcgccatattttgaggtcttttacgtgttcga

SEQ ID NO: 31389 - DNA, 70 bp, Chlorella protothecoides
accatctcccgccccaccccatccgccgccatctcctcctcccagccctccacctccccctccgccgccg

SEQ ID NO: 31390 - DNA, 61 bp, Chlorella protothecoides
ccgccgccccgcccacctttccgcttgcgcgcggggccagccacggggccgacgcccgcgc

SEQ ID NO: 31391 - DNA, 77 bp, Chlorella protothecoides
ttgtctcgtgtctggctcgcttgcgagaatgatgtgcatggagttctcgcgccctgacttgtacccagacccacccc

SEQ ID NO: 31392 - DNA, 61 bp, Chlorella protothecoides
ggtagtgtgcctatcctctttatgctcgaaataaacacgcggataacatattttgaaacgg

SEQ ID NO: 31393 - DNA, 73 bp, Chlorella protothecoides
gctcgacgcctgcgcaggcagcggagcgcatggccgcgcaggcggcggcgggcgccctgtcgcagctggcggg

SEQ ID NO: 31394 - DNA, 65 bp, Chlorella protothecoides
cccggcagcggctgccaagctaagctggtctgatatgctgttggaagctgtcagcccaatatctc

SEQ ID NO: 31395 - DNA, 61 bp, Chlorella protothecoides
tgggagtagcacctggggtgaggctggcgggttcgttacagaatttgcagacaaagatgct

SEQ ID NO: 31396 - DNA, 124 bp, Chlorella protothecoides
tggagtggttgaccatgtctatgccgggcagcaggtacagctcacagcctgtgtggaaaagatggcgagcatgctgaggcggggtggagtgcagccctcttgagcgagccttggttgaccagcg

SEQ ID NO: 31397 - DNA, 104 bp, Chlorella protothecoides
ttgggaagggtgatgcatcacctgtgtgcacaagtgcgcacaacacaatcacacaaccccaaggcgggtctggaggcccaccttcatgtcgatgccggaagaga

SEQ ID NO: 31398 - DNA, 69 bp, Chlorella protothecoides
ttccacaccgggcgctctgccaggcatctaaattaacttgtatgatgcagagcacacagggccaaattt

SEQ ID NO: 31399 - DNA, 77 bp, Chlorella protothecoides
cagcctcggacgatgcttggagtgtgctggggttgcactttctggggtgactgctgcggcccatctgcattgatggt

SEQ ID NO: 31400 - DNA, 76 bp, Chlorella protothecoides
cctccagcttcagccagtccatgaaactgagggaggtgcggtgtggggagggcagggagacgtgagccagagcggg

SEQ ID NO: 31401 - DNA, 78 bp, Chlorella protothecoides
cacactgcattcccgcaggacacatcccattccccgttcaccctcctcacgaatgtcaccaacacactgcgcagggag

SEQ ID NO: 31402 - DNA, 61 bp, Chlorella protothecoides
ccggtacggctccagcgccaccacccgctacgacggcgagaacgacggcggtcgctacgag

SEQ ID NO: 31403 - DNA, 61 bp, Chlorella protothecoides
agcagtgcatccctgtttggggccagcagcacccccgccttcgggttcgggtcggccccgg

SEQ ID NO: 31404 - DNA, 143 bp, Chlorella protothecoides
gaggtgagttggcgaaacagaggggggtttggggggtcggtgggccggcaagatctttttggtcacgtgcgatgacgcgtccctgggcgggcatacctgccagaatacccctgcagtggcttctgtgacttgaggcggtctcc

SEQ ID NO: 31405 - DNA, 251 bp, Chlorella protothecoides
cttgccgatggccttcagcaggggctgcagtggttgatggggcggggaggcaaatggaggggggtgcctggggtgggggaggcatggcagcgcatcgcgcaggggaggcccgtgcgctggaggccagcaaagcagctgccctggtgagcccaaatgacgggatcataatcccacacacaccagacacacacactcacaagcccaccctccccggggagctacgtcacccaccccggtcatgcgtttgacaa

SEQ ID NO: 31406 - DNA, 23518 bp, Chlorella protothecoides
  modified_base (96)..(107): a, c, t, g, unknown or other
  modified_base (743)..(752): a, c, t, g, unknown or other
  modified_base (991)..(1000): a, c, t, g, unknown or other
  modified_base (2263)..(2272): a, c, t, g, unknown or other
  modified_base (3177)..(3186): a, c, t, g, unknown or other
  modified_base (4117)..(4126): a, c, t, g, unknown or other
  modified_base (5047)..(5056): a, c, t, g, unknown or other
  modified_base (5414)..(5423): a, c, t, g, unknown or other
  modified_base (7307)..(7316): a, c, t, g, unknown or other
  modified_base (7379)..(7388): a, c, t, g, unknown or other
  modified_base (9776)..(9785): a, c, t, g, unknown or other
  modified_base (10170)..(10179): a, c, t, g, unknown or other
  modified_base (10246)..(10255): a, c, t, g, unknown or other
  modified_base (10329)..(10338): a, c, t, g, unknown or other
  modified_base (11539)..(11582): a, c, t, g, unknown or other
  modified_base (11732)..(11741): a, c, t, g, unknown or other
  modified_base (14107)..(14116): a, c, t, g, unknown or other
  modified_base (14347)..(14356): a, c, t, g, unknown or other
  modified_base (14586)..(14595): a, c, t, g, unknown or other
  modified_base (16096)..(16105): a, c, t, g, unknown or other
  modified_base (16909)..(16918): a, c, t, g, unknown or other
  modified_base (18041)..(18050): a, c, t, g, unknown or other
  modified_base (18546)..(18555): a, c, t, g, unknown or other
  modified_base (20981)..(21040): a, c, t, g, unknown or other
  modified_base (21364)..(21373): a, c, t, g, unknown or other
  modified_base (21994)..(22003): a, c, t, g, unknown or other
  modified_base (22158)..(22167): a, c, t, g, unknown or other
  modified_base (23243)..(23252): a, c, t, g, unknown or other
  modified_base (23335)..(23376): a, c, t, g, unknown or other
cgggagaaggggcggaggtaaggttatggtagggcatttgagagaggtccgcaatgggcctgagattttcagggagggcctgaggcgcacgacgcnnnnnnnnnnnnggggcctttgagagaggtccgccatgggcctgaggttttcagggagggcctgaggcgcacgacgcgagccggaaactccctgccatgccaggcggctctcctaggtcagagccccagcgtacatggaggcctgcgcggcagcccccaggtggaaaggagggctctgaacccctcccgccggccttatccaccccctcccccccttcaaccccacatgcctccatggggatgatctgggagtagccgccccccgccgcgccccccttgatgccaaaggtggggccctggctcggctgccgcacgcaggttacggcgcgctttcctagatatgcgcccagcgcctggcacaggcccacggtggttgtggacttgccctcccccaagggggttggggtgatccccgccacgatgactgcaggggagtggggtgtttgtgtgtgcatgggtgggagtgacgaggtgccaccggtcggcagtggaggccgtgtgtgacgctcggcggctggaccaacccgcagtggccttcgcacccctggcaccgcttgggacaacagtagcctcacatctcaaagcatcctgcactgtagagggggttgccgcggcctagagctcgggcccagccccccatgccagcannnnnnnnnncgggacaatagtagcctcacatctgaaagcagcctgcactgtggagggggttgccgaggcccagagctcgggcccagccccccatgccagcactctacctccaaagcctcctcaccatagttgccattgggggtgtcacggtgcttctccagcacctcgagcttgacctgatcacacgtgtgcgagggtagtgtggcagggtgcgtgagcgttgggcggcaaggcagtttgattctcannnnnnnnnngacctcgagcttgacctgatcacacatgtgcgagggcagtgtggcagggtgcgtgggcgttgggcggcaaggcagtttgattctcagatcccatccagcagatgagccaccatcaagccagccacaggagggccacatgggtaccttggccttggtggggccgtaggtgatgaagtcgtcgtcatccaggcccagcgactgtgcaatctccgtgattggcaggggatccagggactgtgcgatgtcaatgtcgctggggaccgggtcccggacactgagccgcttggccatcccccacctgagcaggagcctcgtggccctaatggcagtaaacgttgatctattgggacctaacaccctgaacaatcatccgcgcatcgaggacgatggatttgcgggattagtcccgctgatctggtgccgggcacctttgtaatttcgctggattcgtcatcactgtcggaacccccctctcgttccccccttccccgaccacctcgcgctctcgatgtatgctgcccctcttacaactcgagccctcaagaagggcgtcttatctcgccaaggctcgcatggacgggggttgaagggtcagcaaagggatgctgcgctgatctaagtgatgactaagctgcggtgggcctgcctgcgccggccgtggctcagaggtccacctccagcgcggaggcgccccaagtgtttccccccgcgtccactgcctccacctcgccgtcgtcatccgcgagccgctggtactcttgccgcgcaaaccggtcccactccgtgaccccaatctcctcccgttccttgagtaggaggggttggggaagggtgcaggcgataaggataaagcacacaggcacccattcaggacagggtggagcacggcagccaggcagcgccgcaggcgggatcggagctgaccggcaggatgcatccctggggtgtcagcagccgggcttgacatagctacgacccagactaccacgtttgcaacagaccgagcgtggccctcacccaccaccccgcccccagtcccacacctgccgcgcagagaatgggtcccgggtctcgaattgcacaaacttgttcaggttgaagagcacgttgaacagggttcctgccatggcccgattccgtttcaggtctcccagcgtgtagtacgtcgggttctggagggaaagcaaggggttgagggattgggacgtgggacggatcgggttttgcaagtagggatttggaagggccgtgcggcgcgcaggnnnnnnnnnnagttctggagggaaaggaaggggttggaggattgggacgtgggacgggtcgggttttgcaggttgggatttggaagggccgtgcggcgcgcaggtggcaaatcggcccaccaagttgcactcgcagcctgggatgctctgcccagccccgcatctcccagcacccgcagccgccgccccgccctcccacctctgggttgagcatgtcgtgcagctgacccatgacgtcaaagtaggagaccgactcctggctcaggcactccatgcggtgcagctgctcctcgtaaaagtactgcgttgatcgagacatgtgcgggggatggcggacaggaggaacacacgataggttgaagcccagtctcggtaatgctgtaaggtttgcaggaggccgcggcagcgaccgcgctgctgaagagcaacgtgcgtgccgatgcttcgtaacctcccgacactccctctgcatgtgcgctccaggcacgaccacgctcccccccccccactcccactcccccatctcatcccaagtcccactcacatacaactcgctgctgtgcaggtgctcatcgccgtccaggtcgcagcagcggaaccaatactccaagctggtgtccgtggtcttgtcctcctctgtgggcgtggtgtgatgcaggtggatgagggaatgactacgcagtaccgtggctgaacacgggaggccacgtgcaccaaggtaccactggtgtacctgtttgaccatacatcccgccctgaattcacaccctggattgccagaggctctcccctgccccagccaccccctgattccctccagtcgccccgtgtcatggatcctcacccccccccaatccaaccctactctacccccatccctggctgctcaccagacaggatgaaccagatgaagtnnnnnnnnnnaggatcctcaacccccccccccatccaccctgctctacccccacccctggccgctcaccagacaggatgaaccagatgaagtcttcgtaccccatctgagctgggttccccgtggagaagggccgcgcggcctggctgaagatgcgctccgttatccggaaggtcagcgcgtggttgccgtagcgcaggaggtcgtcgcgcgagagcaggaagtcgtggtccgtgtccaggtcccagaacttgcagtagatgacgtagaagtgctcgtaggagaagtaacgcgcgacgcggttgatgtcgtcctgcgcgtccacctcgcccagcgcggccagcaggtcgccgcggcgcagctcgcgctgactcagcacccctgttccggagcgattgagcgagtagaagatgcggtggatcaccgtctccgcgtacctgacgaggggatgcgggagaagaggggggggtcagaggtggggctcaggggcaggtccttgggaagagccaagaacagggcaggcctgaggaggagggctttcacgccccgaaacccacgaggggcagatgaacccatgctgaagcggcagggcacagagcaggtccgcggaggtggtgcgtccaggcggaggctcggaccacagactccacctcgccctctccctgggcaccagcgcaggcagagcaccagcaaaggcggggaaactccaactgctgccacccgccacatcccccccgaccaagccactcaccaagcatgcatacacccccccccaacgccccaacccccccgaaaaaacacccatccacctttcttggaactccggggactctgccaggaactccaggcccggatgactgatcaggatgccggccagcacaggcttgaggtcggcgggggtcacgcctgccgaccctggtgcacgcaggatctccatggccnnnnnnnnnngggcttgaggtcggcgggcgtgacccccgctgaccctggtgcacgcaggatctccatggccctgcccgggccatccaggccccagaagccggcgcggtccagccaggcacgcagggcagcgcgggacaccaggccctcttcccccggcgccatcttgtagaagagggggtaggccaggggggtgggcaggccgaacacctgcttcagcagcgccttcaggttgtcaagggacaggccctgcgggtacaccgcgaagaaggcgtccaccttgtccgcactggccttgtgcgccgcgccggggcccgtcccggggaagtagaactgggggatgaagatggggggggttccctgcgcgcgtgggtcgggggtggaggtggggttcgacattgacatggggaaacgacgcggctgccaggcctggccaggggctggcatcggccctgagcgatgccggcccagcccgcctcgctaagatccccgaccctctcaccagcttggcggagttgtgggcgatgggggagagtgagaagggggaggaggggccgctcgatttccttggtgacagcgggggctgtagcagtttggagagggagggagtgttaagacagctgatgcatgctcgggacgtagcgtgacggcagtgatcctccaggagccacgccccaatatgggacggcatcagagggttgcccgccggcgcgacactgcctcagcttccaaggagcataatcacaccacagggcatggcccacgcacagtggacgaggagaaggcatgactggtgtgcgggcttgagaccttgctgggtgaggcggtgggcacgggtttgccggccttcacgtcctcgagtaattggaggacctatgggcggaggaacgagcattaatcatatgaaaattgcagggccatgccgaggagggnnnnnnnnnncgggcggaggaacgggcatcaatcagatgaaaattgcagggccatgccgaggagggaccgccgaggccgggatgcgagggttggagcatcccgtagtttgagcaccgtgcccgacactccgacaccttaccaggtgctgggaggaggacagggagaaccactgcacgaataaactatcaagctttagtttgctgcaggagaaagactgcatccccctgccgcccaggctggggctcagatcaagcatctgagggctgctcataaccccaggccggcgaagtgcggcagttcagggggggggacgactcgatccgggcgccatgaccatgtggtgcgcggaggtgactgcctcgtgcannnnnnnnnnacgactcgattcgggcgccatgaccttgtggtgcgcggaggtgactgcctcgtgcagagatgcagggcgtcaggtccgtgcatggccggggtagagtcccacacatgttgtcaaggtgatggtcctgaactgggtaccgtgacaccgtaccccctgcccacgtggatcgctctctcacaactctctgcggaacactcgtccttgtcctcatcaggcagaccccgacgtcgcaacctgggttcgcaggccaatgccttgcacgacggccttccatgtgactacctgatccgaccttgcatagcccgtcccagactggctgtagtctccccagggacctgcggtctcagcccggggtcctcgctcttcaatctggggctgcgatccatggagagggtgggtaaaatccgcacaattatggcattgtatgattgatgggaccggttctggattcgaacgactgcctctggcgtcgattcagcagtcaagccggggcgtgatgccgggctttgccgggaagagatcccgccgagctcgtccctcggcgccacaggtccattaccatggcagccattccatgccatgtcggctgcaatacatctgcaggcccccatgctcacccaccatcgcttccccccgctcctgtccagtaccaccaagtcggcaagatcggcgagggcacctatggcgtcgttttccgagctcacgatcgcgtgaccaaccgcctgcttgcactgaagcaaatcaggcgaggcgaaggggccgagttgctgcaccatcggtgggtcgtacggattcccgccctccccgactcgtcccatcccctaacctgcaggctggaggcagaggaggagggggtgccctccaccgccattcgggaaatctcgctcctgaaggagctgcagcatgagaacattgtgaggtatggccatctgctcgtggcatcctgggcctgggtttgggctgggggtgctggccatgccatgccctcgctgcgactgcgcacccgccgagcagtggcggtgcccgcctcggactggccctcggccccccagctgcccgcaaaccgcaaccccaacccttccatgcacagcctctatgacgtcgtgcatgaggatcgcaagctgtacctcgtatttgagtttctggacgtggacctgaagaagagcatggacagcaacccggccgccttcaaggaccctgcgctcgtcaaggtgcgttttgggaggctggttggcgcagttgccaggcctgactgtcccgtgaccatacctgcggaatccgcaaaggagtgtggcatgctgctgcaccgcgaccggcagctgctgtgtgtcgggatgggcctggagcctgagctgacactgggctccagccggaaggctcgagacctggttgcaccccaaacctaccgcatccagtgacaggcgccctccttccccgacgactccacgctcacagaactatgtgtatcagatgctccagggcatcgccttttgtcatgttcaccgtatactgcaccgggacctgaagccacaggcaaggggtcttgcgtagggtttggtgtgggggcgtggcattggagcccccacggctgctcctcatgtggtacaggattcccccagaagcaaccacacaatcacccggccccgcagaatcttctgattgaggagaagacaaataccctgaaactggctgattttgggctggcgcgggcttttggtatccccgtcagagcctacacccacgaggtcagagggagggagggtgaggcggggttgcaagccctcatgggcttagccactgttcgaacgggcaatctgggtcaggaggtcgacgcatcgctgacgacttgcgcgcccgctgctgttctcctccgtatgagccctnnnnnnnnnnagctcctcatgtggtacaggactccccagaaacaaccacacaatcacccggccccgcagaatnnnnnnnnnntgattgggcaatctgggtcaggaggtcgacgcaccgctggcgacttgcgcacccgctgctgttctcctccgtatgagccctccccacacctcagcacccctccaccctcattttggcgtgccaggtgattacactgtggtaccgcgcccctgagatcctcctcggatccaagcactatgctacgcccgtggacctctggtccatcggctgcatctttgcggagatggccctccagaaacccctcttcccaggcgactcggtgagctcacgttggtgttgtggggaaaaggggggtgatgggaggcgctcccttgtcaccaggatgctcggaatggatttttcgtgcgggcacttgcctctgatacatgccccacaatttactgggtcatacctggactgtgaggtccctgcaagcacccttggcctcagagtccatgcccaccagtgccaagcctcacagactcgcccttgaccgccgcctccccgcaggagattgacgagctgctgaagatcttccagctgctggggacgcccgacgagacggtgtggcccggcgtcagccagctccccgactacaagtcgatcttcccccagtggcggccgaagccgctcgcgcccctcatccctggcctttgccccgcgggcatcgacctgctcagccggctgctggagtacgaccccaaccgccgcatcacggcgcgcgccgcgctggaccacgtctactttgacgacctgcgagcggcgcgaggcaggcccgcgtgacgggtcccggcgtttcccattttctgtgtagaatcacccttctcttgcttgctggttcctggcaccgtcaccgcccgttcaaccgaacttgtcgcggcctggaacgggggtgttgcccctgcaaaccctcgaatagaagctgctgccaaccaacggattttcaaatcgcgatttgaatcgcgcgcgccgtgcctgacgggcctgccagatgcatcggacattcggcatgatcgaaccgaagatcagccccattatttttgggttacttgcaatatatagaatcaatctgcgatacaatgtcagacatgacagtctatgagcgcgagcgtcaggcccgcattgcggccaaccaggccaggctcaaggtggggttggcaccgggttcggcacgctgaagagggagaccatcagtttcacgatgaaacaagtttcataagagggttctatatgcctggatctgcgggtcgcggtgcaccccactgtgctcatctgtcacgccagggttgccatttgttaggccatggcccctcagcagcccacgaccccacagcagcctgcaccccgcccggttagcctgacgccccgtgtgctgttcattccctcgcaggagcttggggtcgtggaagcctgcaacagccttgctccacgtgtgcctcagcctcagcagtgccaggccccccaacggaaacgccgcgacgacgctccccaggtcagccgaggacatggggggtttgcgcgggcactggcaaccatgcatctcttgtgctttgagagagcaagcgcagcgacccccgactacgtggcgatgctggctgaagcatgggcctgctgtgtgtggactggctgtcgacgcctggctggtcccaacaggtcctctccaagccccgcccccctcctcctcccatcgccccaggaggagcgcagcgtgcgcaggtccggccgagtggcaggcaagccggccgagttttacgacgaggacaacctgtaccgcagcctcggcatcgaccgcctggacgccttctcccggcgcggcacgcgctgcacggtcccggaccccgagcggctggccgccctgcgcgctgcgcgcggcggggccgcgggtggggctcccgaccacccgtccgacggcgcccggcccgccgcgccccgcgtggactcggggcggggcgtgcgcgtgcagggtgggcgtgtgtatgacagccggtacggcgtcacctgccactggtgccgccagaagacgctggaggaacacgtgcagtgcacggcgccggggtgcgggggggggcgccgcctccccgtgtccttctggtgtgtgccgtggcgtgggtggggggctgtcactcctggctctgggagggggcacggagacgggcgtggaccgctggccgtgcgagggaatcagggcatgcctgcgcagggcagtctggcggccaggcactcccaggccctgcccctggcaggaccccgctgtggctgtgagggggcacttccctggtggagtcggggtctccactccccacgctcgcaccatcatgcacccacgctcacactcgcacacgccaagtgaacccgcctcctcgccctccctcagcacaatgtgcctgctgaaccggcacggggagagcnnnnnnnnnntctccccacgctcgcaccgcatgcacccacgctcgcacactcgcccacgccaagtgaacccgctccctcgccctccctcagcacgatgtgcctgctgaaccggcacggggagagcatggcccaggccctggcctccgaggcctgggtctgcccgccctgccgcggcggctgcggccccggctgcgccgcgtgctgcaactgcggcccgtgccggcgagcggccggcctggcgcccacccaccagctggtcggcgcggcgcgggcggccggcttcggcgacgtgcacgactacctcgtccaccgcgccacgggggagactgcccaggccatctccgcgcggaagcgggcccacgcctggggggcctggctggcgggggcccccccnnnnnnnnnncctgcccaggccatcgccgcgcggaagcgggcccacgcctggggttgctggctgggggggggccccnnnnnnnnnngggctgccacctgcgacgcccccgtggctctggaggacggcttgctggagccggtgtgcacgccgccggagcannnnnnnnnnaggctgccacctgcgacgcccttgtggctctggaggacggctcgctggagccggtgtgcacgccgccggagcaggaggccgcgccgccagccatgcgccggccgaagggcggcagtggcaagctcacctcactcttcgttgccaccaaggtgggatggcggggggtcttgtgcacttgttccgaagcagaatgccacgctcgtgcctgatctggaccccaacatctccccatcctcacagggtgccctagagcaactcccagcgatgggaaaggagggcccggccctgtcgaggaaggagagaatgctgcagcgcatgggtctgtctcgagcttgatgaagtgctgagacccgggggagacccttgctacaccaccccagccctggccagccaccaggatacgtacccagaccatgcaaccaagccgaccacccacacactacgatcattgctgatgacgctttccctgtcagtgcttacccatctacttccaaaacttgcacaaggatcttttccaggttgaccctgacccacccaccgactttgcaacttgtcacaagattgcttcatacaggatcgacacagcaggacgacaagatacaagtcgggttcacatacctcccggccgtgaccagatctgccctggcagcctgcctctctgtccgtgcacaacacctcgattcccacccttgaccctcagacccaccacgctctcccaacagcactggcttgtttacagggtgttgcgtgcgggtgcgcgcccgccatggcagacgcgcatcgaaagcgatcatcgtctcaagtactgcgactccgtttcttcagggtcccctcccagctggccgggaggcgctggcgccgctcaggacagctgcccgtaccacagcccggtgatcttgacctccttgggcaccttggccccgagatccgtgtcggagggctggatggactcaaagatgcccgccacctcccctgtcccggcgtccaccttggcgatggagaagatggcctcccccttcagagccttggtggacttgttgttctccttctccaactcctcggaatcgccggcggcgggcagggccacggcgttgtcgtagccggtggaggcgccgcgacccttggggtccaggaaggaggacccacggtaggagggcacggtgaactcgcccttgaagccgtcggcagtcccctgggtggnnnnnnnnnnnnnnnnnnnnnnnnnnnnnnnnnnnnnnnnnnnngcagggagacctgtgaggcaacggctccctctgcagcgagtgtatatactctcaacagcagttcctaatgtctgcacccccaaaccaagattaaaacagcaggtggttcaacatacctacctggcagtcacacaggaccccttgccctcnnnnnnnnnntagcagttcctaatgtctgcacccccaaatcaagataaagcagcaggtggttcaacatacttgcctggcagtcacacaggaccccttgccctccattccccagtccccataccttggcgtcaagctccttgatggtgaagaggaagggcacgcgctccccgcccggaagctgcacggtgactgcagcgtagtcgatgccatcctcctccttgaactccacgccgccgctgccgtcgatcttcatctggccagagatctgcagaggtagatcgtaaatcagaggtcggacatgggaagtgaaaccccaaccggctgcaccacatccatccaccaatgtcttgacagccctcaccccgccccaaaggggtcaacacacctcgtccagggtgtaggtcagacgcgtgacgagcttggtgggcacaaagtcggcctcgccgttcttgaactgcacaccagagggtgtgcattgggaaagtgagcgtggaacagcaggcgcctgaagctccttcactcatcatcacttgcgactacatcgaaccggagagccccagccgcgccctgccgtccctgaccgcattcgccctctcgtcccgcacctgtgcctcctccttgaccttgaaggacgtgggctccaggcacatcttgttgacggagtaggtcccgctcttcaggtccttgatgttggaggagccgccagacagggtggggcaggtgttggcgatgccagagcccttcacctgcaggtaggtcaggccctgcagctcatcaaaggtcagtgcgcccgcaccctacgatggaggagggggagcaagggtgtgggtgaatgggagtggtgcatgcagggcctctgcgagctgccaagcgtgtcttccttctgatgcaccagagtgggtgcaggaatcatatcctgagggattggaggaaccccagcgatcccacccccagaaacgttcatcaaaagaggagccgaccaggatgcgtgcacagcattccctcgaacaaatcaggagcaaactcctgctcaccccagacaggaggagggaggcagccagagcggcagcaccgccctttacggtcttgatgaaggctccggccttgccatcagcccggcagacgagctggctcctgctgcatctgcactccaggagcgaggatggagattaagccactggaaatcgagtgtcatgagatcctgctcgagcagacttccctgcgccatgactcaccggggggtccgcagggactgggtgaaggcccccttgcatgaaaccgactgcgcgcacacgctctgcatggcgacaaggcagcaagctactattctcaacggcgattcaagcctctgattctggttgcaaggggcgagtgtcgcgtgttgatcgattttcacctggaggctcggcaaccccccatcgctatcttcaggatacggacatacccgattgactcctcctttccagcagtcacttcacggagttcccacgccgatttcctacacaccggctttccaagtatctgtgcacatctattctgggcaaaacatgtctaatggtctcgtatagttgtcaatcgtctgatagccgctgcgcgaggatctaagtacccatgagatgggcgtgtgacccggccaccctaattccttgcgaatcaggaatatgggcatgtatgacgaccgtatttcgatttgagttcctttgaaggcatcagggacgtgagatagagtcgcaggaaatatttgatacgaggatttgactgtgctatagtgcaggggtaagttctcctctcctcgctgaactcgtcaacggtgcctttgcgacaaccaaagggtgatgagtctggcaagcaggtctcatgaacaaatataaagcagccaagcgcgtcatggggcggctccatccctttgatgcggttcttgggcgttgacgaccaagcaatttggcgcagcatccagcgccccatgcaatcacacttttggctgccccgagtttttttggagctacgacacaagtgccaataaacagtgcagtttcccggccatctctgacatgtgcatatcatggcagggtgaccacccatcttcgggggaaacgacggggtataatgtgctgttgtgggcctttcataatctaccaagttgtaaggttgaaaatctcgtgctggtcctggggcactgaaacatccagactgctgtatgtatgctggacactattttgctgaactctcatggatgaaggccagagctattccagagcttctggagcaagggctttggtaagaggggcatgagcaccctaccaccacctccgcaaggtgtttgggttacaccctgtgatggtcggatcaaacctgcgagcatgccctgaactggnnnnnnnnnnaaccaagcaatttggcgcagcagccagcgcccatgcaatgacaattttggctgcccccagtttttttagcagctacgaaaaaagtgccaataaacagcgcagtttcctggccatctctgacatgtgcttatcatggcagagtgaccacccatcttcgggggaaatgacggggtataatgtgctgttgtgggccattcatcatctaccaagttgtaaggttgaaaatctcgnnnnnnnnnnagcaggagtgcgcgaagggttgcgctggaaaacgtgcaatcgcaatacttgtcctcagtcatccccaccctctgatggtccagaatctgccagatttcccagtcatgtcgcagtcagccctccgcttgccctcattgtcacaagtcaatgtattcaatactcaaactagcagtatgtagagtttgatcacaaagtttattagaatgggtctcctgagcatcatcaggaannnnnnnnnncatttaatacccaaactagcagtatgtagagttcgatcacaaagtttaatagaatgggtctcctgagcatcatcaggaaagtcaaacggcaggagcgggagatgcgcctcctcgtcgtgtaagcctcattccgagagaaggaggccgatgatcgcatgcaaattccgtcgagcaccccaatcgcaatatgagcaccatccacacatgcgcgcagggggctggacaatgctggcaagaccacggttctgaagcagttgacgggtggcgacgtcaagagcgtgagccccactttaggtttcaacatcgagacattacagctcaaagggtgagcatggagatgaatccagtctcaagaggaatggttacatagtgcatggcagttgtcctcagtaagagtacgcatggctcaggcagcacacgtcattttgccacagacaccttcagcgggcatggatatctattgcgctgcgaatccctcatccttcccacccctaccatctcatccctgcacagcttccgcctcaatatctgggatgtgggtggccagaagtcgctgcgcagctactggcgcaactactttgagcagaccgatggcctggtttgggtggtggactccgcagaccgacggcgccttgaggacaccggcgccgagctggcacggctcctgctagaggagcggctggcgggcgccagcctcctggtcctggcaaacaagcaggacatcgcaggtgccctggcgccctcggaaattgagcaggtggcctggttgatggtggccatgttgtgaaagaggatcctcggcgggccggtgcaaagctgtgatggcaagctcaaggagcgttagagcatgccaatgacaggccccctttgttcaggccatggctgggttcgtaaagttgactgcgtggaagggggccatgcctgaaatgtatcgaagccgctgcatggctgctcagcaagctacccaacccgctccctccccaacccactctctcaccaacccgctccctccccaacccgctccctctccaccccactcaggtgctgcagctgcagggactgggacggcggcactggcacctggcggggtgcagcgccgtgaccggcagcggggtcctccccgcctttgactgggtcgtggaggacatttccaaacgcatctacatgctggactgagctccgctcgggatcggcgtttcgtacgtaactcccgcatgttgtgccacacatgcttttcgccttcactgctcccccgtgactctgggaccttggggcacacgtccaattggaaacttctctgagtccctaaaggcaaagccacttttcctcctctccatccgcctgaacagtcatcatgctggtcgggagtgtgggaggatcctgccaagcattgctgatcaaggcaaactttctcgcatcctgtcagctccttgcatcatgcgtcactaccccccctcagccctgagcgccagctggattcccaagcaaaacagggtccccnnnnnnnnnntaaggcaaactttctcgcatcctgtgagctccttgcatcatgcgtcactactccccctcagccctgagcacaagctggattcccaagcaaaacagggtcccctctggtctgacgccacatcgaccgcaatcactctggtccagctgttacacagggagcgcgctccaggctcaggcgtgcacggggatcttgtaggtgcgggcggggccctcgaacagctcgtgggtcttgcgcgcggccaggggcccgtggttgcccagcagcttggcgttcaggccgtcggcggccaggcgcccctcctgcttccactggatgtagtcctcgcggttgaaggcagtgaagccccagttccgcgacaccacgatcttctggcggccggggaacttgaacttggcgcggcgcagcgcctcctccgccaccaccacgtgcgcgtcgcggcaacggatggacagcaggatctggccgatggccacgcgagcgcacagggcaaagggcttgccgaaggcgccgcgcatgccggtctgcagccgatccgcgccggcgcaggaaagcatcttgttgatgcgcaggacgtggaaagggtgcacgcgcacgcgcaggtggaaggcgtccttgcccgcgttcttcaccatgtacttgttggcggcaatgcgggccgcctccatggactcagaggagatgttctccttctcccaactgagaagggggggggaagatggggatggacatgagcttcttgtgagtgagaagggttgcgggagtgacgtgagggttgtcaggtccagtgccatccccggccgtccnnnnnnnnnncatgagcttcttgtgagtgagaggggttgcgggagtgatgtgagggctgtcaggtccagtgccatccccggccgtccagctttgctgaagctcccagctcctcccctccacccctggtctccagaaggcagcacggtggaaagcagtcgcgcccggggctcctgaccagggttctcaagcccggagacgcgactcctaccacgcgacaaatcccaccacgcgtttgctggggggatgagtctgggctcacgtcaacaaggccgggactccctccctgacccggagggccttctctggagcccctcgcgcacctgaccaagtggacgcagctggggaaggtgtcgacattggcgcgacgcgcaccgacgtcgtagatgcggatcttggggtcgggcacaccacggcagaagcgggacttggggtatggcttccccttaatctgcctgtagcagcgggccggacctgcattggacggagtggggatattttcgggatcaagagcgacccccaggcatgtccgcgcgcctcatacatcctttgcagccccggcggagcgaggccatcgctggcgccggcaggcagcccggcgggagggcagcccaagtggtcgcgacgccccactcacgtctcgccattgtagcttctctctctgtcctactcccagcggaaagaggccggggctagtccaccttgcgccctttggctgccgagttttgcaggtggaagggaccggggtcgattggtcgagggcgccggggctgtaggccctgcccactcggctcgggtccttcgtgggcgttcatcgaaaatcctcccttgacatgacgtgatgagcatctcggtcggctcggattcacccttctgagggaataaagacaaatcaggcgcctcggagaagccctgcagcctcggaacacgaggcgcgccctcggcagcgccctagggtctgagagttggccatgaacgccagtctaccggcgcccggcgacatcaacctgtcgcatggcgttttcggtacgtgaggatctctgcacgcgatgccccgggcattgcgcgccctgcggcttgcagtggtgggtcactcgcgtgtgacgcgacctgcttaccgcgtccccatcccacnnnnnnnnnntcgggcattgcgcgccctgcggcctgcagtggtgggtcactcccgtgtgccgcgacctgcttaccgcgtccccatcccacccgcaccctcctccctctggacaggggacttcgactacaccttcactgacaaggagctggaggatgtgctcggcttcatggagcgacaacaggtcaggggcccgggggagccattccctgccccaccccaagccctgccatttctggcaccaggcaccagccaaccacccctacagttccaggtcagtcctgggggtgggcatgcatgtgcacactctatgcatggagcgcccgtgggcatgcgtgccttgcttgatcctgggtgtgactggctggagcgccatcacagccgcgtgcaggggcaatacggtctgtattgcctgccgcgcggtctgggaaggaaaatggattcagcgcaccattcttcttggactgagcatgtgccgctcttcgagcatacccccctccccctactnnnnnnnnnncaaaatggattcagcgcatcattcttcttggactgatcatgtgttgctcttcgagcatacccccctccccctactcatctgaatcccatgcagccccacctggccagcaccctgcccaccccggagaccgtgaacctgcgcgcccagccccagccctacgactacggcctgctgcacgtgggcggcgggggctacgacccaggccgcatgtcccccttcctgccctccgactcccccggcctgggcgtcaagctggagcttctggactcgccgcagcaggccccacagccccccggcatgccccacccgggcgcgatgttcagccgcggccatcccgacagcctgcccccggtcccgccgacggcgcacccacccaggcagcagcagcagcaacagcagggcggcggcggcggctcggcggcggccggcggcgggcagagcagccgcgggtccgacgcgcggtcgagcgcaccggcccccccccgccgcgacggccggcctcacgtcagccacagcacggtggagaagcagcgccgggaccgcatcaactccctgatcgacgagctgcgcgacctggtcccgccacaggctggctgcggcaccggtgaggcggccgagggcagcgactcgcgccggccaaagcacgtggtgctggccgacaccatccagctggtccgcgacctccaagaaaaggtgggcgggtcggcgggatggcggatctctgatgtgtggtgtgtggcttggggtgggcgtgagtgacggtctcaggcgggaaggtggggagtgcccatcgcgctggcaccaaaaaccgcgcgcgcgggccgggtccctcattcaccacgtctgcggctcgccataacgcactgccccgcttgcgacggcggggcgccaggctgctgcctgtgctcctgcttcctactcctcctgcccttgccatgatcgtgcggccacacctcccccccttccgctcctccccgctccagttggtgacgagcgagccccggccgcggcggcagggcacctcctccaccagcgtgtcggcggcgggggcggagcacgactcctctgccctctgcccgcccggcgagttccaccgcgagctgtcctccaacagccagcgctccgccgactcccaccccgacctgccccaggccccggacgacgcctcgcccatggaggagggggtggtggtggaggccgtagacgacaccttctacgtgaaagtgcactgcaaggaccgcgccgggctgctggccgacatcgtgcgcgccctgaagaccatgcccctggaggtgggcggttgggggcgacaggggtggaaatcagggaaccgggaggcagggagggaaaagaagcaaccttggggggtgggtgtgctgaatcatccatctgcatgggctggagacatgaatggggggttcaatgcctgatgttcctgagtttctctggggtacacgtggtgctctgcaaccccccatcctgtggccagcagagatcgggggcgctgacctggcccctgcgctgcgctcctgtactttcccctctgtaaaccaccggcaccaacccagccagccacccctcccctacctttccccgcccctccatccccccctgtcctcagatcaccagcgcggcagtgaccacgacgcgtcacggcatggtctgcgacgtcttccaggtccggctggagcgcggggaggcggtgagcctgtccgcattgcgcgacgccgtgatggccgtcatctttgactcggtggccgtgggcgagaagaagcgccgggccgaccagtgaggggttttaaagtcgctggctacggagcgaggtggatgggctccgctggggcggggaagcagatgccagcgtgcgcctgccaggcactcaggatgcttcagaggcctgtgctcagcgtggacaacccgggcgggacaggtgcgccagggtggcactgcctccacctgggcccccaagcagggagctgtggtcccacagggctgccctcaacttgttgtagaatagtgccgccttgccccccagcctcgcaacggcgccgccgcatggcgggggacccttccgtcgccctcttaccctcctcctgccctttacgcaagagcagcttgcccccccttgcgtgccctgcaccccaatttcccaacaacccacagcaccgtgctctcaacttgaaattctcttgacctgtgttgacccttgtcattcccttagcgtcgcccaggctgtgagtcacatgcctggcaggcacttggttgggactgtgataccagaagaaaggtcagagcaaggtcagaaacgtccccggccacggaaaccgccggggctggcgccccgcccgcggaagccacctggtggggaatcgatgcggatgtttgagcctggtcatgggtctgcacgcacggaccctccctgccannnnnnnnnnnnnnnnnnnnnnnnnnnnnnnnnnnnnnnnnnnnnnnnnnnnnnnnnnnnggtgtgtggcagctgaaagaacaccctcatctcacctggactccgcccccggccgccgccaaagctgccgccgcggccgccaaagccgccgccaccccggccgccaaagccgccccgaccgccgggtccgccccgaccgccccggccgccgccgcgacctccgccccggccgccagcggcgcccttgggcttgggaaggaagctgcgggcacgcaaggggttcatcgttgacttggaggagaagatacaccccattgatctctccttgcgggggctgacagggcaggcagcaggtctggagcagttcactcactagcaagtcannnnnnnnnntgttgacttggaggagataatacactctccttgcaggggctgacagggcaggcaccaagtctggagcagttcactcactagcaagtcatcacaaaggatcccccccccccatccttctcacgccacccaccgctcttgtggcaggagcttggcggggtcgatgaaaaacttgtctcccttgttgtaggatgtggcgacaacaccgtcgctcatcttcacggtgaagaactgcagggcgcgggagtgggggttgacgagaaagtcccatgtgcaccgccaagcccgagcagaagcgcgggaagggcataagcgtctacattgcagataggacagtgacatccattctccggtctacaataaaacgcagcatgggaaggcacacggccgcatatccggggcagcaaagtacacattgtaacagccccatgctgtggtcctgaggccttgctcccctacttaccacattgttgatctgtccgaagatctcctcgaccttgccaacctgggtcttgttctccaggaagatgggggcgttgaagtaggggatctgcagggggttggaggagagcacatggcatgatttgtacctcgccgtctcccacagtgccatcatcacacctnnnnnnnnnncgcagacaggacagtgacagccattctccgatctttaataagatgcaaacgcagtatgggaaggcacacggccgcatatacggtgcagcaaagtacacatttaacagccacatactgtggtcccgaggccttgctcccctacttaccacattgtnnnnnnnnnngtggcggagagcacatggcatgatttggactttgccgtctcccacagtgccatcatcacaccttgagacccctgccccaagtccacagtcaatccacccctcacctgcttggaatcagccagcttgatcacagcctcgccctcgcaggggtgctcgaaagtgcccgcctcgatgacagacgcaggtgggccttgctgctcgtacccgccccggccccggccaccgaaaccgccactgcgcccgccgaaaccacctccacggcctccgaagctactgccgccacctgttgtgatggtgggcggtgcagggttgagagcctcagccggtttgaagcgccatgcccccggcgcgccatgccccgcaaggaattcactttgcgggggaacccggctacctgctccagtccccccaccgcagtctgcatgcacacgcatttgatgataaattaattcagcgcaacccacctctactgaatccgccccgtccccgcgatggcgccctcatgttgctgccgggagtacggccctgtcagggcccggccgccagatatttgatcgcaggatgcacctcggtgtctgctccccacgacactattcagtatgaaaacgtactgcaaaaggcgaagagggctccgcgcccctcggtggtgcaggcgtgcggggagcctgcttggctcgacccctggcgcctttcgcgcatcgcatgcgcggcatgccacatgcgacaccccccatctacaagccgccctctaaagcctgcatcgtcaggatatgccaaccggtactgctgctgtgttacaggcgtgatgtcacatgtcgtaggaatggccaagaagagcgcggccactcattcctcgtcgctgctgtcctccaccccgtttggtaggagaccatcctcgtcgtcctcctcctcctcgctctccgacccgctcacgctgtcctcctcctccgcatcgcccccagccccatacacctcctccaccgccaccgacccgtcctcgccaagctgcacgcgcacgggtgcaggcgcaggcgcggcgcccgctgcctgctgcgcgcgctgcgcggtctgggccnnnnnnnnnnatcctcgccaagctgcacgcgcacgggcgcgggcgcaggcgcggcgcccgccgcctgctgcgcgcgctgcgcggtctgggccnnnnnnnnnnnnnnnnnnnnnnnnnnnnnnnnnnnnnnnnnngcgccccagcacgggctgcatgcccgggtccgccaccaggctgcccgcgtgcacgcgcagcgtggcgcccacccaggccgcaagcgcctcgccgcgcgcggggctggcgcccagccgcgccaccagcgcgcgcagcagcagc

SEQ ID NO: 31407 - DNA, 144 bp, Chlorella protothecoides
cctccctgcgagcatgggcggaggctgcgcacctgtccaggtgggttctcagagggggcccatgacagaaatgcggcctagaacatctatgagctgcagtggctgtagggacggaatgtgctgagctgatccatgcgcgcaggg

SEQ ID NO: 31408 - DNA, 89 bp, Chlorella protothecoides
gtcatgctgcagcagactgctgtgggtcagcgactgggaagccctcatcctcaccagcgcagcccatctccagcccatctgcccagaag

SEQ ID NO: 31409 - DNA, 72 bp, Chlorella protothecoides
gctcagccatctgcccttcctatatcctctagagacaaccaaaagcctgcaacgagtcaggtcgatggagtc

SEQ ID NO: 31410 - DNA, 61 bp, Chlorella protothecoides
cctcgaggcccctgcctgcctgcaggcaaggcaccctgtgctccccaccccctccgctgtg

SEQ ID NO: 31411 - DNA, 458 bp, Chlorella protothecoides
  modified_base (157)..(240): a, c, t, g, unknown or other
gcggcggagcgtggcgcgtcccccgaccgcgtggcggcgcgcgaggacgcggcgagcgcggcggtggcgcgcacgcgcttccgcggcgccatctcccccgtcttcgcgccctacctgggcgcctacgtggcggcggtggagcgcgacctggcctggnnnnnnnnnnnnnnnnnnnnnnnnnnnnnnnnnnnnnnnnnnnnnnnnnnnnnnnnnnnnnnnnnnnnnnnnnnnnnnnnnnnngcatgctggcgggggagagctgggaggcgctggccccgggcacgcccctcctccgctccgccgacgagctggtggaggctgttcgcggcgagctgcgcgactgctgcgcgcgcgtcggccgcggcgccgtcctccgcgacctggcccgcgcctttgcccgcacctactccgcctacgccgcgcgcctcttggcccgcgtgcccagggtggcgggcggc

SEQ ID NO: 31412 - DNA, 74 bp, Chlorella protothecoides
ggccgggcgcatggcagggttagcggtgaggctcctgtacattgggcgtgcatgcagcatcgaggccctctggg

SEQ ID NO: 31413 - DNA, 141 bp, Chlorella protothecoides
cgactcatgcctaaatgtgtgggaattggatgatattccccgttttgaattgccaaaccctatatccttccttgtgctcggccaacatctcagatttttgtacagtctatttggttggaaatgagcatggttagcgctctt

SEQ ID NO: 31414 - DNA, 123 bp, Chlorella protothecoides
gttgcggatgaggttgcctgacagccagtggggtgccgccccatgcccgcagaatcctctacctcccatccttcctttgcccattcctgctttcctcaggaccaggagcgcccgtcaggacga

SEQ ID NO: 31415 - DNA, 146 bp, Chlorella protothecoides
ttgtggcgctgcatgcatggagagggcagagattcagcggtgacgcgcgcggggaataaagaggcacgtgggctggagcgagcctggcagatgcaatgtggattctggcactggtggctgaaacgcggacaacaggctgcacggtt

SEQ ID NO: 31416 - DNA, 143 bp, Chlorella protothecoides
ttgtgcatgcattccacccgcaggcatctgccggacttgcttgccactcccaaccggaccccacgccgaacccacacttgcacgtacagacgaaagtggctgttcaagccggccctatcccccgagcagctgtcgcacctggc

SEQ ID NO: 31417 - DNA, 101 bp, Chlorella protothecoides
gcccgtccaggtcctggtcatgggacggtatcaagatggtggtgggtgtctggtgatgacaatgtcataacccccacaagttgatgctccccagcgctccg

SEQ ID NO: 31418 - DNA, 61 bp, Chlorella protothecoides
aggtaaggagggaggaggggctgggcaggggaagtgggtaggaaacccagagcccttgtcc

SEQ ID NO: 31419 - DNA, 111 bp, Chlorella protothecoides
gcgctgcgcgacgcggcgctgctcaccgagatcctcaagttccacatcctgccccccgagccccgcacgcgcggcctgtggaccagccccttcatggcggtgggtggcacg

SEQ ID NO: 31420 - DNA, 401 bp, Chlorella protothecoides
  modified_base (151)..(332): a, c, t, g, unknown or other
tggccttgcacccggtgtgaaccgcggccaaaggaggccgagctcgtcgaggaccggccagggtaactgaaaaatggggaatcttgcgattgcaatggactgctgcgtcttgaatatcaacgtgtacaactcaggaaccaagtgcacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccaaactagaccaaaccctcgtttccaaccccacccccccaccaacaaagccccccgtcgcact

SEQ ID NO: 31421 - DNA, 1550 bp, Chlorella protothecoides
  modified_base (152)..(223): a, c, t, g, unknown or other
  modified_base (947)..(1160): a, c, t, g, unknown or other
  modified_base (1240)..(1393): a, c, t, g, unknown or other
ggcggccgccgccctgcgcgccggactgtgggccgacgagagcggcggggcctgggtcgcgctggcagggccctgcctggaggagctgcagcggctggacggcgggctggatccacttgcgacgggggcgggggcctcggccgccggcgccnnnnnnnnnnnnnnnnnnnnnnnnnnnnnnnnnnnnnnnnnnnnnnnnnnnnnnnnnnnnnnnnnnnnnnnnggccgggggctggaatccggcgccgccctctgcatccggcgcaggtcccacgcaagaaaggaaggccatcgtctgggcactgctcgcggtgttcgaacgtggcagcgacgcggcggacgcggcgcgcgcgctgggcgcgctgtgccgctcggccgtgtgggaagaccggtcgggcgtcgtgcaggtggcgcggccaggggtgggcgaggtcacgcacgcgctgctgggcacgctggggcgggtgagggcgctggagaggcgggcgcgggcgctgccacccgcggcgctcgacctggcggcagcgctgggcggcggcgggcggcgcggcgaggacgccgcgctggcaccggtgtgggcgctgcaggacgcgctgtccacctccctggccgggctggcggacgcctacggcgcggggctgacttccgcgctggcaggtgccttaggggcgcgggggggggctggagctgcacaggaggccatgcgactcctggcgccgttcatggagtgatgtacactggcgtttggtagccacagaggcagaggaacgtcgggctttcaagcgtggaatgaagggccagcatgtttgtcgatgccgctcgccagctgctccgagtgccaaaaccagggcacctgttcaatctccccgtccagtcaacctgtctcacatgcagtgtgtctggttgacaatcttgcgggacaggggcacgagcatgtatgtttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccactctctgactgtgggaagatcctgatctcgagcgctgttcctcgggagaaagggcaaggacagacgtcacggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctggcagaccgactgatcgtcggtctgtgagcatgcctgcttcgggtaccattgggtagctgcccagcagggggccaccttgtagcaccccccggcgaatgcggcgccgggggcacagcaatcgtcctgactggtccactgcgcatgggaatgc

SEQ ID NO: 31422 - DNA, 109 bp, Chlorella protothecoides
aatgagctacaagcacagacggcagcgctgccaataggaactctcggcttccaccctttcatcacatgcggtcaacattgccaacctctcctcacctttgtccaccgca

SEQ ID NO: 31423 - DNA, 72 bp, Chlorella protothecoides
cgtaatatgagggaagacaggggtgagggtggacgagacattgcgaggcgctgaggcgggaggtgccatgcc

SEQ ID NO: 31424 - DNA, 69 bp, Chlorella protothecoides
ctgtagtgttttgctgggcacgacatgccggtcatgggatatgccggcgggtccatccactcagggttt

SEQ ID NO: 31425 - DNA, 75 bp, Chlorella protothecoides
ggaacagggcggggagtcgcgctagtatggcgggtggatcagtgctgccggcacgcagtcgacagtacgggatgg

SEQ ID NO: 31426 - DNA, 71 bp, Chlorella protothecoides
cagtcacttcacggagttcccacgccgattccctacacactggctttccaagtatctgtgcacatctattc

SEQ ID NO: 31427 - DNA, 79 bp, Chlorella protothecoides
tatcacagcacggactacgattaactatttcaggcaaccccttggaaataccgtccatggaacaacgatcacatgtatt

SEQ ID NO: 31428 - DNA, 61 bp, Chlorella protothecoides
ggcctgcacaatgaccgatatcgttgcgccgcatcgctgctcgcagggattccagcgggcg

SEQ ID NO: 31429 - DNA, 61 bp, Chlorella protothecoides
catgcgcccttcacatcagccaaacgcggtgagggagcgggatcgggacagatgtccttcg

SEQ ID NO: 31430 - DNA, 80 bp, Chlorella protothecoides
aggtcggaaatattccatgcacacagcgaaatgacccgaaagagtcacaaaaagctacgacggggacagcgaagtccccc

SEQ ID NO: 31431 - DNA, 61 bp, Chlorella protothecoides
gcagcctcatcctgtcgatgctgctgccaggggaccacatgcagctccaccctctgttccc

SEQ ID NO: 31432 - DNA, 79 bp, Chlorella protothecoides
cgtgtcctgcattgcactccaccctgcgcttaggcactcacccccccttcccccctctttccccaggcctccaagcgca

SEQ ID NO: 31433 - DNA, 163 bp, Chlorella protothecoides
ggtgcctggcgcggattgaatggtgaacgacaagaaacagagtacaagcatgccgtgtttctctctgcgcatcatggacttctttgttatgtctgctccctggcccttgcccactctgcacaccatgtgcgtgcctcgtcaggggtggtggagggcgccgcga

SEQ ID NO: 31434 - DNA, 80 bp, Chlorella protothecoides
tttccccagccgccgcatcctctcgtcacgcttgcccaacctatcctccttggcagagaggtacactgcacccccgccaa

SEQ ID NO: 31435 - DNA, 75 bp, Chlorella protothecoides
ctgattccagactccggccaggctcacacagcgccccccctcccttcttctaactcagggtttggagtgctgaca

SEQ ID NO: 31436 - DNA, 1951 bp, Chlorella protothecoides
  modified_base (406)..(415): a, c, t, g, unknown or other
  modified_base (1014)..(1023): a, c, t, g, unknown or other
  modified_base (1832)..(1841): a, c, t, g, unknown or other
cggggggggggggggcggagagggggctcaggggacaccactgtttgggtgcatagactggagcggctccccaaggtcagaggtttcccccccagccttggtcctgccaccgcgctccatgctctgctacacttgtgtggagacgtgctcgcaccgtgcccagaacaagggaaggaacggggaggagcaggcgcaggtcacacttgctggcagggggtgttgttggagggacagtggggtgcgacagcaggaggggatgggaggtcggcccgctcgttctgtcgaccgacgtgcagtcgatcctgctcaagaacagggatttccaggcacggccccccaacctacaccctgcgcgtcgccgcccagcccgccagccccccgccatccaggcctccatgcccgtcannnnnnnnnnagccccccaacctccgccccgcgcgtcgccgcccagcccgccaggcccccgccatccaggcctccatgcccgtcagacgtgctgcaggatggcgccccgcagcgccttggccgcctccgcgtcctccgccttgaagatgtacatgccgtgcgcggggggtcccccccccaccgcgttgtgcagggccatgaccaggttgcgcggcgtcttggggttccccgtcggcttcatgccgcgcaccaagggcgcgttgaccagcacgcgccccgtgtcggtggtgaacaccagaaagggctggccgccggagcggggctggcgcagcgtgagcatgccccggcctcggtcctcccacttcttggcctcggacatgacgagcagcgaggcgcgctgcttcagcagcacctggatgtcgcccgtctctatctgaacctcctgtgaggcggaggcagggaagtgatgggtggcgagagggtggaggggttgtgggagttcgtgagcatggctggcagggaatggcaaaggggtccaagcagtagccagactggggcccgacaatgagtgaggctgttgttccatgaaaaacgcggcggcagcgactnnnnnnnnnnacatggctggcagggaatggcaaggggtccaagcagtagccaggctggggccggacaatgagtgaggctgctgttccatgaaaaacgcggcggcagcgactgagtccctctgtgtccaggccagtcgatgacccacaagcacggccatcagcaggccgcctgcccactcacctctggctcctcctgcacgtcttcctcctcttcgtgggcctcaatgggtggcgctgcagagggagtggggcctggtgtgccaaaggacaccggcgctgcaccaaaattgaagaggggggtagctgccgtggcggcaggcgtgctcagcccaccaaaggcaggcaggctgggcttggtcgctggagagaaacggggaggggggaaattgaaagtgtcagcggtagggatcaggaagcgtgagaatgtgaccaggctagttgcatgagatgcggacgacccacccacaagcctctgtgtccagagttgtgccaggatacgccaggccagtatattcttccccgaggcacacctccaagtgcagacggcgcaggttgatccgccgcctggaggacgtcctggaagtcggccagaagctgcttggaatggtgcaggtagtcttcagcccccgccgtccagacctgggtaggctgagaactggcctgctgcgctatccacctaatgcacatggagtacagggggattgagctgacgaggttgacaaggctggctgggtgcaaaccctgtatgagatgccgctactattgatagacactgcctaaactgcactcatcggctcgatctcactttgcatactgagnnnnnnnnnntacgaggttgacaaggctgtctgggtgcaaactctgtatgagatgccgccactattgatagacactgcctaaactgcacacatcggctcgatctcactttgcatactgag

SEQ ID NO: 31437 - DNA, 80 bp, Chlorella protothecoides
tggggcatgggcgaggtagggggtcaaagggttggttgacccgtcacctcgaacaaagtgtccctcaaacattcatgcct

SEQ ID NO: 31438 - DNA, 94 bp, Chlorella protothecoides
gcgaaagccgggggggcatcgcccgctgacggcacacagggcccaggcggcacctttgtcctcaaggacattgtggagccaggacaaggtccca

SEQ ID NO: 31439 - DNA, 79 bp, Chlorella protothecoides
attcatcgcgatccccagtgcaatgtgagacgttggacgtgtttatccaggggtgatgtgagctgcattgcgatgtccc

SEQ ID NO: 31440 - DNA, 75 bp, Chlorella protothecoides
ccgcacgcggcatcgaagtccgacaagtctgccgcgcgggtgacaaagcgcaccccctgcccggcccactcgctc

SEQ ID NO: 31441 - DNA, 109 bp, Chlorella protothecoides
gactgccatggccagccgagctgcccgagcgccctgcatcgccagtgcatcaaccttccagcaaccacgtacccctttgccccgctgcaggatcatgcagatgctgtcg

SEQ ID NO: 31442 - DNA, 79 bp, Chlorella protothecoides
tgatcttggcactcgatgatcgcgggtggatggtgcatagccagaaaaagccaccagacactttcatctgctggaacag

SEQ ID NO: 31443 - DNA, 64 bp, Chlorella protothecoides
cttgctccagcctccttgtcctcctgcacatctgcccacatgcagtcggggccctcctcgacag

SEQ ID NO: 31444 - DNA, 76 bp, Chlorella protothecoides
gccagacgttggtgtgcgcctgtcgaggggtgttgtggttttttttgcgggggtggaagtcatctgaaggtgatgg

SEQ ID NO: 31445 - DNA, 1805 bp, Chlorella protothecoides
  modified_base (286)..(295): a, c, t, g, unknown or other
  modified_base (1081)..(1090): a, c, t, g, unknown or other
ggcccggccgccgggcgacgccagcggctgtggggcggcgagcgcggggggtgggtcgatgcagatcgcggagggtggggggcctcgaccggcggaggcagcggcgcatgaaggggtcgtggcggcgtctacggggtcggagctcgtcgacgagcccatgccggagcggcagccggccccagaggaggcggcgaccagcgagggcgatggagcattgggcggcgctctgaagaccgacattccggcggaagtcctggaggtcgatgcgggggccgatgccgcgatnnnnnnnnnncgggcggcgctcagaaggccgacattccggcggaagtcccggaggtcgatgcgggggccgatgccgcgatggaggaggccgaagcgccgactggtaccgggggagacacgacaggcccggcggctggaccttccaccaccgcggcagaggcagcaggaacgccagcgccggccaaccccagccaggcccgtgtggaaagcgcatcacaggcaggagccggcagcgcggatgcgggcgtggccgcggggagtgggaggaagaagaagcggaggaaggcgcgcgccgcagagacggccgccgatgggcaggcggaggacccttacgccgccatcgcggagatgatcgcgcgggcgggcaaggcggccgcgccgggaaccgcccctcccgcggacctgcgctccgcgatgcgcgcgcagcaggcacgccagaggaagcaggcggggaagtgagcgggtatggggcgcgaggagagccttgcgagtccagactgtgatgctgcgtgtgaccgcctctggtgttgctgcctcccaccctcctctgcatggcgagcgtctgccccgaggcagtgaggtgtgagtggatgtcgcgccttgtaacttctggacagggggtctggcagcactcggcgagcagcaggcgggttgacatgggtgcattgctctggagccgacctcctcttatccaaccagggcctgcgcctcttttccaacaatttgcatcaagccaagttatgctcctcctcggtgacttgaatgtgactctacccacagacacacacacacacannnnnnnnnnttaacaattggcatcaacccaagttatgctcctcctcggtgacatgaatgtgactctacacacagacacacacacagcgagagcgaccaggtgacgctactattcggccaccaatcaggtgcgggaagggggtgggtcgagccagtgctgccgtctggcccggcggcaaaggtccttgttatgggggaagagcattggggtaccagggaatgaacagaaaagtggaccgtgcagataacgagttgaagtatagcagggagagcattgcgaagaggaatgaatgggcatgattcgtttcaatcgatcggtctgttctatcgtggacgccccgcactgagggacgtgcatcgcatcgacgcagcagctgcgcctggctatgagggttagaggagggaggcgttcctctctgaacgagtggcggcgaggcacgccgcgtggacgccgcaaaaggagtgcagggggtctgtcgatcaggagcggacgacagacgggcgtgaagttcagagggagaggagcagggcgcacggtgagatggcagcggtccttgccacgttgcggtcacggccagaccccggagaagctgtcggagtcctggctgagggccgccgccacgccggccagggccgccagcgagcccgtgtccgtcgcgcagccgctggcagagccctggctgcgctggcgcggcggccggcgcggcacggcgcggcgttgcgcc

SEQ ID NO: 31446 - DNA, 69 bp, Chlorella protothecoides
ctcgcgcccacttattttcacgtttgcctaaagacatgagaccagaacacaaagctggatcctcccctt

SEQ ID NO: 31447 - DNA, 79 bp, Chlorella protothecoides
ggaagacgcgtccttcttctgggcggagcctccgcctcgcgttgagatcgagcagggcaagaagaagaagaaggggagg

SEQ ID NO: 31448 - DNA, 4390 bp, Chlorella protothecoides
  modified_base (721)..(730): a, c, t, g, unknown or other
  modified_base (1260)..(1269): a, c, t, g, unknown or other
  modified_base (1489)..(1498): a, c, t, g, unknown or other
  modified_base (1725)..(1734): a, c, t, g, unknown or other
  modified_base (1864)..(1873): a, c, t, g, unknown or other
  modified_base (2586)..(2595): a, c, t, g, unknown or other
  modified_base (2951)..(2960): a, c, t, g, unknown or other
cctgccacatgcatgtgtcatatgcgcggtgcaaaccacctgtcccaccgcctctttgcgccctgactctcaccgcatcggccttttgctccagggggacaatgtcccgtgtccccacaaatgcatgcggcacgaccagcacatgcgtggcctgcgagatggaccccgccggccggaagcgcaggcgagcctggctgccgacgctccagaccccggacaggaaggtcacggcctgtggggatcagggttttgggaggagtgatttgaggtcgtgactctgcgccgttcgtgccctcccgcatgccgctcgccctgctcagtcgctcagtcccagccctgccgccagcctcgggggtcccctccctggcccggcgcacgtgtatggccaggagggcatatgtagcaagctgaatgaggtaaaacccttcggtcccgatggtgaccaggcgccagagcacatatccactccacgcgacgtaggcacaaacaaagggccagaggtccagccggtcgttcctgtcatggcatggtgcgagggaagggattgctttgggaggtcacaaaagtttgatcggtggattcgtgagcagcgatgacatctggaggtgcatggttgtttctggttggccacgcaggttggccctgtcggctccgccttggtgaccctctcccggccgctcccaaacacaatttagaacactcgcacccagcatgagcaaannnnnnnnnncactttgggaggtcgcacaagtttgatccgtggattcgtgagcagcgatgacatctggaggtccatggttgttcctggttggccacgcaggttggccctgttggctccgccttgtttaccctctcccggccgctcccaaacacagtttagaacactcgcacccagcatgagcaaataaggtattatgccttccatgcatacctaggacgctgtttgaggaagctgatactggacaactccttggcctccagcgatacggcctgcgccatcgcaccgaggtgctgcagcgactcggcgagcaggcaggtgcgcgatgttccacgactatcaggggagacttctccagatgatatattagcactgcctgatcaggggttccacatagtaaggagaagggtactctgaacagcgttccttagcgcgcgctccgatctggggttcgttccacaaggtgctttggaacactgaggatcacgccaagtcaccacccaacgttggagtatctgagctcacatacctcctgagaagannnnnnnnnncacggtcctttggaacactgaggctcacgccaagtcaccacccaactttggggtatctgagctcacatacctcctgagaagattattatctggaggatattgagactggactggcctttcccaacctcgtcttgttttttatcctaaacaaggaacattttgatgagcagcactatgtctctcatcacccatgaccacctgtccaagcatacattgaagnnnnnnnnnngtttttttatcctagagaaggatcatttttatgagcagcactatgtctctcatcactcatgaccacctgtccaagcatacattgaagtgacctgattacatccttatcaacatgctacgtttactatgcagccctgctgtactgttcaaggtgtgatcgtcgttggggggaatgcaacgcatgcacggcaggggcggattcttcaaatgggcgctgtcgggacattnnnnnnnnnnaaaatgcaacgcatgcacggcagggctgattcttcaaatgggcgctgtcgggacattggtagcaatgggccatgcgcacagaacgctcctaaggttggcccagccagcgtattgcgatgctgcacggaannnnnnnnnnaaaagaacgctccaaaggttggccagccagcgtattgcgatgctgcacggaatcaaaatcttttacatgtcttgatcgcggtatggaggctgctgctgctcggagccagatgggttccggggcagtggaaggcagactcgttccggcctggtcggaacccgcgcctggcgcgagaatcgtgcgatccaccatcccggacgtctcccatgggtacttgatcctggatgaaaacaggtgggacgcagcacatgaggcctgacggggcgctggcctttgcagccctctgccctcctgatcccatgctaccacccagtccccactttgcacgctcgggcagggccgagtggcgcatcggcgggctcctgagcagcgcctacacctgcccctcccctctgatcgatgccacatggtgcatcttcccttatctggagccccacccacgcccctggctggcgctgctgtgcgccggagcgcagctcagcctatactccctggacagcgaagagcatcgagtgcccctcccccatggctacacgaccgtatttcccacacccctgggcctgctgctcctcggagtgagttgaggttgaggcaggccgagccgctgctgcgtattgtgatttaatgctgggatcgcggtgtctgccctgcataccagaaaatgaaatcatatgaggttccatcctcccagtgtgtgcaggacaaggaggcgnnnnnnnnnngcccaggcagggactgtgacgccgctggggtgcaggggtgcttgggaggtgttcatgggcatgagttggctcgaactgtgtggttcttgactcttgctcttggcaggcaagctggtgcggccgcccatgacctagactgtcaagggcctgcctccggggtgcaaaaggttacaatgacaaatgctcaaacccacagagaacggtcccatgaatgcctcacacacagggcagagcggcggtctgggagttggttggagagcaggagcagccagccggcagaggagccacgccctgcaggaccccggagggtttcctgcccggcatggccgctctgacctcggccatgccgaacaccnnnnnnnnnngttgtgatctaatgctgggagagcggtgtctgccctgcataccagaaatgaagtcatgtaaggttccttcctcccagtgtgtgcaggacaaggaggcgcaccccccgctcctcctggagcaccccctggatgttcccaggactgtccttgtgcctggaaccggccacgacatcctctgggcgacccacgagtgccactggatcgtaacctccgattcccaggcagggattgtgacgccgctggggtgcaggggtgtttgggaggtgttcatgggcatgacttggctcgaaccgtgcgattcttgactcttgctcttggcaggcaagctggtgcggccgcccatgacctagactgtcgagggcctgcctccggggtgcaaaaggttataatgacatttgctcaaacccacagagaacggtcacatgaatgcctcacacacagggaagagcggcggtctgggagttggtcggagaccaggagcaaccagccggcagaggagccacaccctgcaggaccccggagggtttcctgccctgtcccgccgctctgacctcggccatgccgaacaccgctgccggcaccccctcgacccacaggtgggcacattgggtgccaggcagtgatgggaagttgagcgtggtggtgggctcggtcacggatctgggtagtccttgagtgcgagatggttctcccatgcagcatcccctggtcatgggagttggggcagcgtttatgcagattgttgtggggaaggagcgacaggggacggctggaagcggccggcccgcacaacaccaacgccctgaaatgggagacccagcagccctctccaaccctcgcacaccgacccgccctggcaccatccagctcaccttcctccagcagcgcaatgtacttggctttggcctcgtcgccgctcatgcccttcagtttggcccaggcgtcgtacttggccctggcctcgaactggacggcccagggttggtcgcccctcacatccccctccgtggcctgcttgaagtgggcgtagtacgccaacttggtgtcgttggtggtgccgggcctgggaggcccattccggatcagccacacggccttcttgaagcgggcgtccagatcgctcgacatatcgatcgagatacaaatacaaacaatgattctggcatcgattcttccatcgtcctgggtcctggaccagccattagggcgatggttccgcgtatctcgatcgcgcgcggttcgtcgatgtcgggcgcctgatcctgatgacccaggcgccagcactcacacatacacagatccatgttcactttgattcccccactttaaaaccaccccccagggcccccatgcgactggccaacggccacttgtctcccctagcgttcaaccccggaagcagggaccgcccgccggcgtggcaggccggg

SEQ ID NO: 31449 - DNA, 69 bp, Chlorella protothecoides
tcaaggcgtcggtccagcgtgcctttgcggccgcgctggctggcgagcgcggcgcggcgggtgggcgcg

SEQ ID NO: 31450 - DNA, 150 bp, Chlorella protothecoides
tactgcctgggctctgccccaccgtccatgctcaggactgtgggatgagggagaaacggaggtcagcgtgcagctgaggatggaaaatgagcgggggaggacagcactctccatccctcaaaggcctatgcatgcagccctgatggaagc

SEQ ID NO: 31451 - DNA, 61 bp, Chlorella protothecoides
cgtccatgcatggctcttgcgccctgggccgggaggtccgtgatatggtggcgggaaaccg

SEQ ID NO: 31452 - DNA, 61 bp, Chlorella protothecoides
cacagatgtgactcacaacactcgcctcattaacaagctggccagcaaccacatctagagc

SEQ ID NO: 31453 - DNA, 62 bp, Chlorella protothecoides
tcgtcggtggaggcgacgctctgcgcaaaggtggcaatgggagcctcgggtgaggatgtgac

SEQ ID NO: 31454 - DNA, 103 bp, Chlorella protothecoides
attcagaggtggcctggggatttggagtgtagtcttgggagagggcctctggggacagagctgggtgtcaggatgggttctgtgcaaggccacctgatggcag

SEQ ID NO: 31455 - DNA, 176 bp, Chlorella protothecoides
cgcccgacatacagtatataaggctttggattgatgaattgccgcaagcattcaagctttgttgccctgcaagagcaatttgtctgctcaccctgttctgctgcagcgtattcctgctctcagacgctctccctctttgccacccccctccatcaacccaccctcctccaccaacc

SEQ ID NO: 31456 - DNA, 73 bp, Chlorella protothecoides
cacgtctttcgacttgtcgcgaatgtcgcataataattttccggcatcgcgcaaggtcacttgggagcgcgag

SEQ ID NO: 31457 - DNA, 64 bp, Chlorella protothecoides
tcctactacagcaagcctgcggacctttgagactggcaaaccaaacaaacctcccataccctac

SEQ ID NO: 31458 - DNA, 77 bp, Chlorella protothecoides
ggcaaaccaaacaaacctcccataccctacacaggagcaggcccgggactcacgggtttcgcggtggatctgctcgg

SEQ ID NO: 31459 - DNA, 137 bp, Chlorella protothecoides
gcagtggtcagggtaagttttcgcgctcattacctgtgagaaggtggttcgttattctgccctgtggacacgacagtcccttgcttgcaacttgctcaagagagctgtatgtcgcagcaagtctttcctggggtaaa

SEQ ID NO: 31460 - DNA, 61 bp, Chlorella protothecoides
tatgtcgcagcaagtctttcctggggtaaactagcagtcaaaggaccctcccacaacccct

SEQ ID NO: 31461 - DNA, 6359 bp, Chlorella protothecoides
  modified_base (4300)..(4309): a, c, t, g, unknown or other
  modified_base (4791)..(4845): a, c, t, g, unknown or other
  modified_base (5428)..(5437): a, c, t, g, unknown or other
  modified_base (5713)..(5722): a, c, t, g, unknown or other
catatcttcggctcgcgcgaagcatacgccctcacctgcctgaagctcaacccccttatcatgacgagactaagattacaagcatgcattctcaagggtgtcagccgcacgctgcgccaccacaaaagcccttcgagggttccggcgtgcgagcagcgcgggggcggcctcccgggtctggcaccccaacatccccccctcagaaggaggtgtccagggcgttggcaatgagctccgcctgctcctgggcgtgcaccgagccgaagccggtggccgtggaggccatggtcttgcgtcccgagtacttgatgcgcatggggggcgtgccgcccacgccctggatgcaggtctgcaggcggggctggacgtggaggtaggcgcccatgttctttggttcctcctgggcccacagcacctccgcgttggggtagcgccgcagctcccgctccaccaggtcgaaggggaagggcgcgagctgttcgatgcgcacgatggccacctcgtcggccttgccctcctgccgcgcccgctccgtggccagctcgtagtagagcttgccggagcagaagacgacacgcttgacccccggcactggctccggattgggggagcggtcggtggcgttctcgtccatgatgacgcgcttgaagcgcacgccctcgatgtacttatcgtcgggcttgtcgtcgaactcggtgagcggggagcgcgccagcgggtggcgcagcaggttcttgggcgagaagacgaccagaggcttgcggaactggcggtggatctggcggcgcaggacgtggaagtagttggcgggggtggtgcagttgaccacctgccagttgatgcgctgggtctgggagcccaggtgcccacccgtgaaccactccttctcgtcgatgacggggggctggtacgggtcctcgtccaccatctgcaggaagcgctccatgcgcgcggaggagtgctccggcccctgcccatcgtagccgtggggcaggagcacggtgagccccgactggcgcagccacttggcctcgccggaggacatgaactggtcgaaaataatctgggcgccgttggcaaagtcgccgaactgggcctcccacaggaccagcgcattgggcgactccaggctgtaccccagctcgaagcccaggatgccgaactcggagagggaggagttggacaccgtgaactgccctgcgcgctggtcctcgtacacatgggccagcggtgtgtacttgtccccggtggcctggtcgtgcaccaccgcgtgccggtggctgaaagtcccgcgctccacgtcctgcccgctcaggcgcacgtggttgccctccgccagcagcgtgccaaaggccagcgcctccgcgaacccccagtccacgccctgctcccccgccaccatggcgcgccggttctcgtacaccttggcgatctggcggtggggcttgaagctggccggcagcgcggtgatcacgtcgcccacggactgtgaggtgttgttttgttggtatttgggggggtggaaggggggaacggggagtgaggcacagggtagcttaaggaagggagggccaccgcagagatacatgcagtcgacgctcaggaatcaagggtccctccccctcgctctaaaaaaccaaccccccctcaccttgaggaggtcaatggggacgccggtgttgcggatgcgcgaatactggatgggggagttgaagcccttccagtggctggacagccagtcggagagcttgggctggtgctccttggccccctcaaacgcggcggccagcttggcctgcaccgtgctttgaatgtcgtccaccgtctccttgctcaccgacccctcggccagcaggcgctggacgtagagctgctgcgggttggcgtggcgcttgatggcggagtacatgaggggctgggtgaacatgggctcgtcgatctcgttgtgtccgtagcgcctgtagccgatgaggtcgatgacgacgtcggagccccaggtctggcgccactccgcggccagctcgcagacgcggaccaccgcctccgcgtcgtccgcattcacgtggaagacgggggcggagagggccttggccacgtcggtgcagtagggcgaggagcgcgacttgcgcgggtcggtggtgaaggccacctggttgttgaccaccacgtggatggtgccgcccacggtgtagtcgggcagggccgacatgtccagggtctcatacacgatgccctgccccgcaaacgcgccgtcgccgtgcatgaggatgggcaggttggcgcggcgcgagtcgtcggccgagtagtactgcttggcgcgcaccttgcccaggcacaccgtattcaccgcctccaggtgggaggggttggccagcaggctcaggtgcacgcgcttgccgtggatggtggggcggtcataggaggtgcccaggtggtacttgacgtcgcccgacccggtgtaggcgccgccgccctcgccggggcgccgccctgcgaactcgctgaacacctgctccatgggcttgcgcatgacgttggccaggatgttcaggcgcccgcggtgtggcatgccgatgaccacgctgcgcgcctccagctcggccgcggagtcgatgatggccttgagccccgggatcagcgcctcgcacccctccagcccgaagcgcttggccgcggtgtatttgttggccaggaaggactcgaagagctcgctccaagacaggcggtccaggatgagcatcttcttctcgcgcgagtacgactcgcgctccgcggtctcgatgcgcgcgcggatccagttgcaccgctcgcgatcgttgatgtgcatgtactcgtagccgatggggccgcagtacgtctcacgcaggcgccccaggatctcgcgcagcgtgcggatgggccggtcctccgccatgaacccctccatgttccaggtgcccaggaagaactcgcggtccagatccgcgtccgagaagccgtagaaagtgtggtccagctccgcgggggcggcgcgctggtccaggcccagcgggtccagctgcgccgacaggtggcccatcacctggtaggcacgcaccagcagcagcaggcgcattgactcctggatggactgggccgacaccgccgccgcggccaggggggatgcgttctccccgcgctcaaaggcgtcgtacgcctcggccaccgcctcggcggacacacccatgtctgtcgttgttgtgtgggggaggaagctggggttggggataccggagtgttgaagtttgccagggggtcgttgttagaagcatggtgttggggccaagcagggaaaggggatctcctcaccccgcgccccaggcagagcacagcaccacaggtgagggatttccggcaccgggccagacccaaaggatcacgcagcccggtgggcatgttgattcgaaaccccccgcgggaacgccatacaggcccccagtagcccacccatggacttgaagaaggaggcccaggtgcggtccacgctcgcggggtcctcccggtagcgctgctccagctcctccaggtaggtggaggaggtgccatccaggaaactgtccttcagcttagagagaggcaccggtttggggtgggcctgtcccgcctcggcgctggacttgaagtcacgttggacggcagcgagcgtgcgggcgacgcggcccgccacccgacgggacgagtgcgccaacatggctgataactctaagctgaacccctgcgattcatgcgatgggcttgctgtggtctgggtggggccaaggcccggcaattgatgagtaagtagactcaccagggaaggcaagggcgcgacgggcctgctttccacccgataatgtgtttcccatgcccatgcgcagtgttgggccggcagaggctccggagggggccggaacgaccacacacgcagcacttctctcttccaaggcgctgcatggacattgtagcgggtaacggacgcggcgccaggccgtcagcccgcgggagagcggagaaacaaggttttcgaaggtgatgtctcctggggaccaaactcgaaatgggcctggacaggggcctgaaaaatggtgtgccgggcgaatcagccttgtttatcggtccttgttccatcccgcttcctacctgggccccagaatttcaatcgggcggtgttaccgcaagtttgatgttgggcccggtggttgcagatccggctagcagggggtggggtgcccagccgtggtaatgccctgactgggccgcctcaggggtgtaacactcctcacacacatgtcatgcatgggannnnnnnnnngaggggatggggtgcccagccgtgataatgccctgactgggccgcctcaggggtatgacactcctcacacacatgtcatgcatgggatttggagatcattacccttcgcctcccagacataacacagcattccccaccgtctgctcgcccgcatggaggctctcgtgacttcatccgtccaccccaaccctgcgcaggttccctgcctggacactacgagcagagcacccagcagctgcgacacccaacgccactgtactgtatgactgatcacacctttccccagacatgactgcgagcccacccccggcagcggcagccccggccaaggctgatggcgccggcccccccgccgtcaccgccgccgccccgcccggcaccgcccccgccgacaccgcgcccgaccccgaggccgcggcccggatcgcgcgcgaggacgccgtgctggcgtccggcgccgacgtggcagggctgcgcgcccnnnnnnnnnnnnnnnnnnnnnnnnnnnnnnnnnnnnnnnnnnnnnnnnnnnnnnngcgtgcgcctacacccgcccctcgcccgagccggctcgccccttctcccactgggatgcggtgctggccgaggcgcactggctggccgtcgacttcgcgcaggagcggctgtggaaggccagcacggcgctggccgtggccgccgaggttgccggaaagcgcggcgagtttgggctgcgcccgccgccgcccgagcaccgggccttccacgacgagatcgtcgcggcgcgcgcggcggcggtcgccgctgcggccgccgtggcgggtaagcgcctgacggccgccgcgcgtgccgaggccggcgccggcctggccctggaccccacagccgaccccatctgggcggacctggccctggaggccatcccccccacgcccccgggcttcgactacgcgctggtgtactctgtggagccggagctggcgcccgcgctggaggcgaccctggagagccgggagctggagcgcgccatcgaggcggacatggtgcgtgcatggctttgggtttcaggagggaggggtgtggtggggatgctggaggtgctcatgatgaggtgtccaggcctgggcagggcctggcggnnnnnnnnnntgttcatcgctttgggttggggagggaggggtttggtggggatgctggaggtgctcatgataaggtgtccaggcctgggcagggcctggcggcggctgagccgtgggtcgtccggatgagggccccctgtgcagctattggaacgtgcagggtattcgaaatgccactccgcatcgatcgcaccctgcgaccttccctactgccgcgcctggcgccttgtgtgtcatccctcgtccagccattggcccggtctcatgcacggtcatggagtcaacnnnnnnnnnnagagccgtgggtcgtccggatgaggccccccctgtgcagcttttggaatgtgcagggtattcgaaatgccaccccgcaacgatggcaccctgcgaccttccctgctgccgcgcctggcgcctagtgtgtcatccctcgtccagccacagtcccggtctcatgcacggtcatggagtcaacccccctccccctccacaatctctcaccaggtgtgccgcggctaccgctacgagctggacgcggcgctgaggagccactttgcggcggtggcggaggccagcaagcgcgccatgcgcctggacgccgacctggccgatgggtgcctgctgggcgacgccggcgacggcgccgatctggccgacgacggcgacccctacgcccagaaaggaaagcgcggcaagggcggccgccgcgccggctacctcctggacgactttgcggagctgggcgacgcggagttcgcggagcgcgcgccgcccaagcgcgccgcctcgcggcagtacatcgaggacacgtacctgcgcaaacggcggcgcgagcgctaccgcgacgtggacgccgactacgacgtgggcgccgagccggcgacggggcggtacggcacgcgccgcgcgacgggtgcgctgggcggcgcgcg

SEQ ID NO: 31462 - DNA, 76 bp, Chlorella protothecoides
ctgcgctcgtggagagcactgggtgcctgcaatgcgaggacccccaccctggatctcccaccgctgaaggcacgcc

SEQ ID NO: 31463 - DNA, 75 bp, Chlorella protothecoides
cgcagaggccctgtgatgggagattgggaacatgcgtgatggcaaaatccaggtgtaggtgataaattggaggga

SEQ ID NO: 31464 - DNA, 335 bp, Chlorella protothecoides
  modified_base (104)..(284): a, c, t, g, unknown or other
gagatcgtgctgggagagattgcagcaaatacagacggcgcaggagcgggcattgatgccattgacatgcaattgcaatgatatagtattagcaagggacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatctggtgggcccaatcccctggagcgagtgaaatttcgcggtccacc

SEQ ID NO: 31465 - DNA, 3571 bp, Chlorella protothecoides
  modified_base (1151)..(1191): a, c, t, g, unknown or other
  modified_base (1883)..(1915): a, c, t, g, unknown or other
gaccggtctgcgccggcgcgcggcggcgcaggcggcgccagccgatccgcgcgccgacgcgcccgccgacgattcaaacacccccgtcgacaccccctcgggcagcccggcccggccggcgctggaggagagcctagttggacccctcccagacggccccgccgaggccccgctggacagccccgcctacgccaagcccgccaaggtggtgggcgacgcctgggtcagcgacgaggacgcgcgcgagggcgaggccgtggtcgccggggtcaaggccggcgacgacctgtcccgccgcggctcgggcctggacgacggccctggccgcgacgggggcgacacgcggtgggaggtggagcgcctgctgcagcggtatgagcgccgcgccgccacgccctcctgcttcctctgggactggatgttccgggcgtgaagccggccactaccaccctggaggtggccggggaggacatccaagaagtggtccccgacgctcgggtcgcggcgaggcgggcgggcgggcaggcccctcgcccgcgccccggatcccctcctccaaccccccagcccaaatacaagaaatcaaaggaagttgcgcaccggcgcggccaccccttttgcgaaattaagcttgaatataccttccaagaaccccctgctttttcgacacgtgcaggaacgacacgctatgagccccattccgtgcgcagcaccctacccctctgattgatatcagactctgcacagccttgcctaccccatgaacatcattccctgggccaccccccctcgaggcccccaagcttttccccccgtccatggccccttgcataccatcggccaccgtcggagcctgtctgcccctgtctcctcctggtgattatttctttccctttggcccgccctcccccggcgtggcggccgacgagcgccgcccggcgcggccccgccgaggccctcgcctgggagcggaggcgccgccatgtgccgcctcgtgccgcatggcccaggctgtttcgagtagtttgttaccgctcgtgtattacgtgctaggcttccgccccctgccccgacccgaggagcgacgtgtgcaggcaaaacaggggccctgccaatgtggccaagctcccccccccccccccccccccccnnnnnnnnnnnnnnnnnnnnnnnnnnnnnnnnnnnnnnnnngacgcgtcgtgccgtcctgccacgacccaagcctccattgctgcattaaatttggtgtgttatttccaggacccagattggggcacgagggttcggtacaagggtaagaaaaaggcagaagtcgtacatgtattcctcattgcatgggcccatccacatgggaggaatggggtgcagccacgacgccctgaggaatgtatgggaggggggattggcccgggtgggatgtgcagaatgtgagacgaagcggcggaatggagttctgccgggctctgccagacgcaggtggactaggctctgcgtccgcagggcatatattgcctcccagtgacccgcttgcacgcaaattttgccgcccacccccttcccaaactctcccagtccaaaatcccacctggcgcatgaacccggccaggccgcccggcccggccccgacgtccggggacatgcccatgagcatgccgtcatcctcctcgtcgctgtccggctccggggcggcccgcggggcgctggggcccgcagcgcgtgatgcgttggcggccgccgtggccctgaggctgcggttagggtcggcgggcaggtgccggggtcgcggcgtggagccccacacgggcgtgctccccattagcatcacgtcatcgtccaggtcatcgtctgtggttggttttttttgggggggggggggggggggnnnnnnnnnnnnnnnnnnnnnnnnnnnnnnnnnggcgcatgaacagcatgaggcggcgcctgacggaggaaaggagtggtgcgtagggcgccgaggggaatggaggtgcagcggtctacgaaaccggcaatggggtggtgggggaggaagcttgcccctgcgcccaacacacccacactagctttctcatctcaaagaccaggcggcagcccggtctgcaacacaggcacaaaaagggaaagaacagatgcctgcccccctctgtcatctgcaaacaccccccatcccccaccccctttggaacaaacccccacctgggccgagcgcatactgctggggcaacaccaggctctgcctcaggctgcccatgtcggacagcgtgtcctgccccccaccgccttcgttgtgcatgtgccagtagaggtgggggtcgccgccgccgcccacgctcatcatgtccaccgacatgccaaaggggctggcgcccaggctgtagccggcgtgcgcctgggcctggacccactcggggccggcccagggcgcagcgcgcggcgtcagtcccgtgctcttgcgcttctgcgcaagggccgagatgaaggggtagggggtgggatcgtggacttcaggccgggggagggcaggggaggcacagcagatgcccgtgcaggcacatgcatgaggatgggggcgacatcctccccaccccctgctctggcctctttagatccatacaagcctggcaccaccacggggaccccccctggggccccaccatacccctgaacaagcattcgctcacctgtcgccagctggacatggccacggaggagatggggggcaggccggtgggaatgctcatggcgtccgacaggcgcatggcctgtgtgggcagcgccgccagcagtgggttgctgatgagggcggcctcatccagcgaggaggctgtgggcgcgccgtggccggctgcacagccgcctcgcgcctcggcgccgccgaagccctccagcgtgaccgagaaggaggccaggccctccacctcggggtagtcgtcgtccaggtcgtcgtccatgtcctcctcctcctcggcgccgtgcgccgacaggcggcgaccgtcgccagggccgccgtcgccgcgccccgctccgtccagctgccccgtcagcgagcaggaggtggcgtcgggccctgcgtccagctccaggctcgtcgtgctggcgtggcggtgcacggcaaccaggccgccggcgccggacgctccgccggccccgcctgcggccgcggccgcggcggcctcctcctcctccggcagcgggaagttgcacttggcgtgcgcgccgcggatggcgcgcgcggccgcatcgtaggcgcgcgccgcctcctccgcggtgtcgaatgtgcccagccagcgccgcgcgcccacggtggggtcccggatctcggccgcccacttgccccaggggcgctgccgcacgccgcggtacgttttgttccgacccttggacacgaccaccggcggcggcactcccgacggcaccatgggctccggcgccgccgccgccgtcgcgtcgggcggcagcaggcccgaggccacctcgccgtcgccgtgccgggggctggcccgtagctcggcggacagcgcgccctgcacgcgcagctcgccgctgccggcgggggacacgctggccgggg

SEQ ID NO: 31466 - DNA, 78 bp, Chlorella protothecoides
ggcccccgcctggcactgcagcccccgcagggcccgatcccgaattgccacgtagaccccggccgcagaccgcccatc

SEQ ID NO: 31467 - DNA, 112 bp, Chlorella protothecoides
ctgcctcacctgggacgctctcactgcttaatttacgagttgagctggcctcgaagggtcctaagtggctgttctgaaggttgcctggcttattgacacccagattctggag

SEQ ID NO: 31468 - DNA, 71 bp, Chlorella protothecoides
ggagtgtgtgggggggtgaagggaggtgggaggggaacgcccataatcgctggggggtggggaggaggtcc

SEQ ID NO: 31469 - DNA, 108 bp, Chlorella protothecoides
gcaattgcaggatttctgcctacgacccacggcgtcctcggccatgggcaggagagctcaaaatgggggccctaccttagcaacccccatgtgcaacacccctgtcaa

SEQ ID NO: 31470 - DNA, 96 bp, Chlorella protothecoides
acatccaacgccattcttgaacccccgaaaggcttcgtactggcatagtatcccaacatatccccgcacggtaagcgttaagaaaccgaccgcatc

SEQ ID NO: 31471 - DNA, 61 bp, Chlorella protothecoides
gcgcagggtgaacaaggctgtgtccttcctgccctcaacagccaaccaggctcgacactcc

SEQ ID NO: 31472 - DNA, 99 bp, Chlorella protothecoides
gtcaggaagcagggtgggcattattctgcacattttccgggaaagcctagttgccaaggaaagtgcaggaacacaggatgcgtgggttggagtgccgcc

SEQ ID NO: 31473 - DNA, 64 bp, Chlorella protothecoides
cgccgcagcagccgccgcagcagccgcagccgcagcagagctcaagcgcctggttgagggccgt

SEQ ID NO: 31474 - DNA, 9056 bp, Chlorella protothecoides
  modified_base (178)..(187): a, c, t, g, unknown or other
  modified_base (1052)..(1061): a, c, t, g, unknown or other
  modified_base (1794)..(1803): a, c, t, g, unknown or other
  modified_base (2425)..(2434): a, c, t, g, unknown or other
  modified_base (3644)..(3653): a, c, t, g, unknown or other
  modified_base (5002)..(5011): a, c, t, g, unknown or other
  modified_base (5651)..(5660): a, c, t, g, unknown or other
  modified_base (6246)..(6255): a, c, t, g, unknown or other
  modified_base (7484)..(7493): a, c, t, g, unknown or other
gctggacgccgccgcggcggcggtcacccaccgccgggtcgggcagggcgcgcaggaggcgcgcgcgggcagggagcctgccggtggcggtgacaagggcgtgggggacggcacggccgagggtaaggggggggattcagcagccgtcgccgagaccgccgccgccgagaccgccgcnnnnnnnnnncagggggaggactcagcagccgccgccgagaccgccgccgccgagaccgccgctgccgagaccgagcccgagaatgaggaagggagcggcagcgagggcgaggccatggacgctgaggaggccgcggagtgagcctcccattgcagggtcaggttgcaaggagactacgtgagtcttgaggcagcaggcggctcttgatgcagcgaggctgtccctctgtcaaacgcaagctcgagtgccttgatgaggcatgccgtgtactgtcctgtaagtctctgcatcatgagcattgggtcagtcccttggtgcagggctgaggctgggcccgccagcggcttgatcgtccggctttgccacggttcctccatgcaacgcctcgtagcggtccacggcctgtatcagctcggcgtcggagaggtcgcaggcaccccaggcgggagagggtcctgctccgccagttcccagcccatgcgcccgggcctggcacgtcgccagcaccgcttcaggaagggcggtgacgggggagcggtagccgcggcaggcgggatcgtagcagcgctgggtccagccgccgccctgcaggtccaccacgtagaagacgccgttggagcggtgttcgcgccccaggttcccgcagtaccggcacccccggatgttgtacaggaccagcgaagcgtcctcctgcatggcccaggaccggatgccggcctgtggccatgcgccatcctgtgagttgatatgcatggtggatggagtgggtttggatggtgaaggcggctgtggggggagaaccaggtgcccacaatcgtgcataggggtctggtgaaggcggcgacgcctgtgctcagcatgtgaggctgccgtnnnnnnnnnntgtcgtgcacaggggtccggtggaggcgacaacgcctgtgctcagcatgtgaggctgccgtgccgtccatgccagaggtgcggggcaggcattgacccgccgacaggcactgcacctggctgcagaccgccgtaatgaaggcagccagctccgggaagggacaggggccgtggtgcatgcgcaggttgcctgtggtgctcgcgcgactcccatgcctgccagaaccagggtgcgagctggtgcggttgttttggcccccgtcgtccagctcatcggcctgccaagtcagcagcgtcacattcgggtcgtccacgcagatgagacttgccatgaagagctcctgggctgtcagctggctgcccccatacctgcctgagaacggccgtggagggagacagcccttggctttggggctgctatccaccccaatacgtcaggaatggaacagggcagcatcatgccaatgtcagaccagctccatgcaccctggactcttcacccaccagagcattgcagggtggcctccttccccgccttggaggacagcagcaggcggaacgctcgatttcgggagtaaacagcttcgtccacgagcagggggagcccaccctaggaaatggggagggggtatggaggtgtctgggtccatactcaagaatgctctccatgggcaggactggggcagtgcagtttggaccttggccttgacagcacactgataggctgcctggannnnnnnnnngggggagggggtacagaggtgtctggggccatactcaagaatcctctccatgggcaggactggggcagtgcactttggaccttgtccttgacagcacactgataggctgcctggaaacgcgggcaggagcaccatgcggcgttgtgaatgctgatttgctccctcacatcagcccccacaggcagcatagagcgccactctcgtcgtcatacattcaggtgggggctgtctgccacgatcgcaagaggcccgtcgggacccctcttcctggctcgggcgcacagctggcggaccagggctcccacgtgagcgttgcttgcaaacgcgtggcctgggatgcggaggatgaggtggcgggagaatttggagggggtgctggagtccagttccaccacatcggcgacatccagcgacatgccaagctcctcctggaacaggcagcccagggcttcgagcaggctctggatggcagcaggtccatccttgtcagggttcagggctctgctgaactccagatctgggaagcagcatgaagggttcagggatcttgggtatttgttgacttctggattgtacttgccacggaggcggtgatggcagggacaacggaccatcaatggcnnnnnnnnnntggaagcagcataaagggttcagggatgttgggtatttgttgacttctggattgttcttgccacggaggcgctgatggcagggacaacggaccatcaatggcgtttctggaagactcaaactcctcttctccacttcccagctcaccaaagtatatgtggcagggctggccctccctgattatttcatagtagtggcggtggtggggcagcatatcagagtatcgcctgtagaagttcgtgacagtgctgaccaggaagcgacgtttcccatctccgctggtctccatggaccacaccctgttgcagtgacaagaggagaggagactggtacagcacggcagcgctcagtgcaccctgacaggcagttggtggaatcagaattcacgctgtcggcacctcccacctggtcctctcaagcggcgagccccgctgttcgttgagaccatccgcgcaatcaaaggcggcttgctgcgtcggaaacacgtgccagatttcggcttccacggcctcgggttgcttgtgtctgacatggaccctcgtcagaaagcgcaggattcgttcctccacagcatccagcttgctcttggcatagaatgatgtggcgggcagacacagcgtgctgccaggggccccttgctgcaatgctttagatggatcatcttgcatacaaagtgcagcatcaccatgcgcagcgtcacgccttgacgccgggtcgggcagggatatcccatttgctcgggcgagcttcaccctctgcagctcagggccggcagccagcacagccgacaacaaggacgactgcccaactcgacgtttgtgcgtgtccatgtgcccgacattgtagcgtgccccatagtttcacgactgcagcctctgacctcgtatgtcagctgcccccagttcaatccggaagcctgctgcgcatgttgcgggttggggtttcgtgcatgacgatcgtggcagaccaccccatgtaatggcagtactgggttcccaacgcctcatgggccaccttaaatgctcttataaacatctaggtgtctctaattggtcatgtaggccatgactgtgcttgcggcatgcctggcgctgtcgtcactgctctggggtgtcggggcagtccgacttggtcgcgatgaggccctgtacactggaatatcaaggcaatggcccatcctttccgaatatgaacaccgtagcatggcaggnnnnnnnnnnctgcctggcgctgtcgtcactgctctggggcgtcggggcagtccgaccgggtcgcgatgaggccctgcatactggcatatcaagacaatggcccatcctttcagaatatgaacaccgtagcatggcaggtgaggcatcttcgtgcgggcttgtcatcccagctgaaggacgcaccaccggatcgcttgcccttgtcttcaaaacccaccctttcgaacgcatcccagagctggtgaagaccaaagggtacccactggaggagcatttcgtcacgacctccgatggctacgtcctgggcacctaccgcatcccacacggccgcgagggcgcctcgccaggtcccaccccttgccgaccggtgctcctgcagcacggcctgctggactccagcgccacctgggtgctgaacgacccggaccagagcctggccctcatcctggcggacgcggggtgggacgtttggctggggaacagccgggggaatgcgtacagccgcaaccacaccggcctggcccccgacaccgccgccttctgggacttttccttcgacgacatggccgccgccgacctccccgccctgacggcccacgtacagggagtgacaggctgcgccacgctggcctacgtggggcactcccaggggaccacggtggctttggccgcgctgagcacgcagggtgcgctgcgtgccgcgctgcgccccgtcgtcctcctagcgcccgccatctcgctgcgccacatccagagcatccccatgctcacccttgcccgcctccaggctgaccaggtgattgtgcgggggggcggtaccttgtgtgatgggaaagaccatctctctgccaactgtcacttctcagcatgtgatccaggggccctgcctgcacaggcgagcttccccctttgcacagactcgcaccgtcagtgcccactccccaccccccttcatagttctttgccatgctgggcgtgtttgagttcatgcccagccgggaggccaccgccgcgctgttcgaggagctgtgccaggcaacccccacggcctgcgtgtcggtgctgacggcggtgtgcggcttcagcgaccgcaacgtcaacgccagccggctgtcccactacgtgacctatgcgccctcgggtgagggctggggtttggacacctgtggggtgcttgcttggatgtttggggaggggtagtggaagtgagggacagcggggtgatgaaggaggggatgtctttgggtggatgactgatcatcgctgtgaagacaagtgaacgccttttggttttgggcaagccagcgatggcttccggtcccctggggcgctgctcccggcatccagtgagcatgccnnnnnnnnnnggacaagcgaacgccttttggttttgggcaagccagcgccggcttccggtcccctggcgcgctgctcccggcatccagtgagcatgccacaaacacaccagtccgagcctcaggatccacaggcccttctgcgccccgcgccccatcctcccaggcacgtccacacgcaatgtggcgcactgggcgcaggcggtgcgcgccgcgcaggccgcgccccggggcaccctggccctgaccatgtacgactggggcggctcctgcgtttcgcccctgggccggccgcagacctgcaaccggagggtttacggcagggagcagccgcccacctacgatctggcccggctggagggggtgccgctggcggtggtctggggtggtgaggacaagctggcggaccctctggacgtgaggcgtctgctgtacgtcctgccccaggcctccctgaagctggcagtggtgagatggggcggagtgggtcggaggttgggggttgcagggacaagggagggcctttgtactctgaggggcaatgtggaggggtcatcgtgggggctgcaccaacgattcacccagcggcacagcatcatgggaccattttgggctgactctggaaaatctctgatggggggggggggggggnnnnnnnnnnaggggtatgtggaggggtcatcgtggggggtggaccaacgattcacccagcggcacatcatcatgggaccattgtgggctgactctggagtatctctgatggagggggggttctgtaaggtcacagctggctgccacgcatttcagttcgattggcagtcatccccacgctgacctgggcctgccttctccgtacacactacagggtgtccccacctttgagcacctggactttgtgtggggtaatatgggttggagggtgcccatcgtgacagctgtgggggttcgggtgggccattccaggtaacctgcaaatgttcacgctggcttcactactgccattgaagccaagcgcgcctgccagggagcctgaacccactccctacattcccctcgcaggcgacaccgccaaggacagggtgtacccccttgtcctgcgcatgctgctcgaatgggccgagtgaatgtggggtgaccgccacaagcgcccactgtattggatcactgtacactgaactgctcctgcactcatgaaatggtgttacttgcggacctaaaaaaggggcaggagggagcatggccaccgnnnnnnnnnnactgcgcatgctgctcgaatgggccgagtgagtgttgggtgaccgccacatgtgcccactgtattcgatcactgtacactgaactgctcctgtaatcatgaaatggtgttacttgcggatcttaaaaaggggcaggagggagcatggccaccgttgccatgagtgcatgattcactgatcctggatatgaccttcttctggccctgccctgccccacccccgccatgggcgtccgtcgtgagacgcacagacgcgctgcatcaagcaatcttggcgttgctgaagtccatctccggatgggctgccatgaactgcttcaggatgtcctccttcttctgttcatcagaggtcggcaggcccagcgccttttgccgctggtcatacatcatcttctccaccgtggcacgcgtctcagagtctgtgtgggcatgggacttggccatcagagtctggcctggcccatgcatcgccacatcatgatatcccatacagcagtatcgtcattgtgcagggatcccctgcttaacgtctgccctgccctccatcaccacaaatgccctcccatagccatgctcacccagatcgccgagctgcgagttctcaggctccaccttctgagtgtcaatctcgggctggcccttcaccaccgccctccaccactgcatgcggtccacctgggaacatggggacaggggtggggtttaggtatgacacgaacccttgcacagcaattgtaccaggcatcaagaccaaactccacctcacaccttttgcagtgtgacctctagtaacttgccatccacaatgctccacaggcagtcatccagcttcacagaggcatacagctcacccgctgtgggtattaggggggagaattgagtgtatggtgtcaacacagcaggcactgcggatccgggactggccctgggaggggatgccttgctcacgtccccagagcagtcgagcctcacacagttccccgatgggcatgatccaacaggtgaatctcacgagcactggcatctcccaccaggctggcaatcacagccctccattgtggatcaggcctcggccgtgcccacggcgatctgacatacctatgacaggaagctggcccttcagtccgatgctgacagatgagggctggatgctgactgcacagtctctgcccttggtgccacgtgggatggggatggaaaccagcacctctgccagggtctgcgtccagnnnnnnnnnncctgcccttggtgccacgtgggatgggtatggagaccagcacctctgccagggtctgcgtccagctgtatgtctccatatcagcaccattgccggagtttggctctgcagggcatgggagcactggggggtgtgccggagagctgaggggtgtcggcaggttgccacagggaggaaatgcacaatccccgacccaatcggtactcactcaggccctgggatgtctccgccgcagctgggccttctggtgaggcttccttggtggatgcagcgtcctgctcaggaacctgcatgcatgcggtcagatcctcaccgaggcatgccaggcgactgggacagcgatcgggtgggataaaacttatagtgcatgcccactcacgttcactgctgccggcaacgccttctcttccgcggcgctgtgcgggtccgtggaatggtatcgacggcgtgccgcctgcatcattcccgacacggcatcctgcacaccagcttcgtggaggtaggctgacttcagggacaccaggttgaaggcttgctggagaaatacctctgcatcctcacccagctcctgccatgctttttctagatagtgctctgctgctgctgagctgctgatctcttccaccaccccaggcattctcggagagcgctcgctaagaaccaacttggtcaacccctttcagtgaaaatgtacaatttaagtgatgctgatgggctcctgctgggggggggggtctaccattgaacgatgccacccttcagttccaatgttgtcgtccaataagaaactgaggaatacgtgtcccgacaccggcccggacgtgagggtgtgcgaacaagacccacgcctgcttccccgaccccagcgacccgaatctgcgtgtcttacaaccagctgcagcagtcatcaactctcgccgagcccgtgctagcagccagagcgcgcaaggctcggggtttgccagtacccctgtccttcggacgcgttccgcggcccttccccgctcgccaacgaggtccagccttgttgtccgacctctgatttctcccctttagatcctgtccataccggcctgcccttccagcctcgtgcggggtctggaattgggctgccctatcccggacgcacatagtaacctccgacacacgctgcccgacctcctgcgcatcctgctgtagggcgatccctgccaggtgaggagcatctgctaccatgtgatgagttatttggctgtcagagcatgccagatggtgggctgcggagccctcgctgggctccttcgcgccttgcctcgggttctagaagtgtagcccaggtttgaccgatgttcccggctctgcacagatctcttgcatacttcgccatagttgattgctccgagccccttttgctcactgtggtgtcccctccgcgctctttcggcccacccgctgcccctgcatcccgcctcgcgatcctaccctatcttgtctcggcagccccgcggagcccctcgtggtgccacagtgccctctatcattgagacgatctctacatctcgcctcgtccaacaacccccccccc

SEQ ID NO: 31475 - DNA, 129 bp, Chlorella protothecoides
cgcagtagaggcggcgtgagggggcgtgtgcagccctctgtgaggcctcaccagcggaagattgccatgttgctttaccctactgatgcgccagtctcttccttgcgctgcgacacaccagtcatagga

SEQ ID NO: 31476 - DNA, 79 bp, Chlorella protothecoides
catctagtcgcaggattgctgggaacccaaggatttgaggggcggctagttccccccccagatccttcgttggatggta

SEQ ID NO: 31477 - DNA, 61 bp, Chlorella protothecoides
tgcagtcgtatcaccaaagggggcagagtattgtgtttgcgggtgccgagacttttgcccc

SEQ ID NO: 31478 - DNA, 119 bp, Chlorella protothecoides
ttgcctgtccatgtgccgcgtgggatgggcttggtggtctggaccacgccctgtggctcctggaggcctcatgcacgagagtcgggcacccagcatcccagcactgaccctcctcagcc

SEQ ID NO: 31479 - DNA, 134 bp, Chlorella protothecoides
gaatgtcgagacggtgaggcgggcactgggttggggaggtggggactgcccatggcaccaggcggcaggtaagcgtcccacctgcgcatgcgatcttgattgcggcgccgatgccgggccctgggcctggtggt

SEQ ID NO: 31480 - DNA, 360 bp, Chlorella protothecoides
  modified_base (91)..(292): a, c, t, g, unknown or other
gtctgctggcctgcaggtgggcgatgccatccagccattcccccccccccgtccccagccgatcggcaagcacgacacattgcatgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcagtacatctcgcgtcctgaggcccgcaccgtcttgatctacggccactgtgaggcagcacagg

SEQ ID NO: 31481 - DNA, 74 bp, Chlorella protothecoides
gacctcctgtcgatggcatgccttggcgtgtccatcgcgccggctccccccccgcggaccaccgacacgctccg

SEQ ID NO: 31482 - DNA, 99 bp, Chlorella protothecoides
aggtgtcctcgatcgggtgcaccatgaggtgaagtccaacagcccgggcgcgccctacaacccccagctacaagcgaccgagcccaaggagcggcacct

SEQ ID NO: 31483 - DNA, 125 bp, Chlorella protothecoides
atcaggcctcggcctgtgctttacaagcagattgaacgcgctccgttgattccaaaaaaaactgactggggcgggaacctgctagcggtattcacgttttcttcatatggttgttacccaaccgc

SEQ ID NO: 31484 - DNA, 4850 bp, Chlorella protothecoides
  modified_base (133)..(142): a, c, t, g, unknown or other
  modified_base (601)..(610): a, c, t, g, unknown or other
  modified_base (670)..(679): a, c, t, g, unknown or other
  modified_base (732)..(741): a, c, t, g, unknown or other
  modified_base (1390)..(1399): a, c, t, g, unknown or other
  modified_base (2054)..(2063): a, c, t, g, unknown or other
  modified_base (2158)..(2167): a, c, t, g, unknown or other
  modified_base (3861)..(3870): a, c, t, g, unknown or other
  modified_base (4623)..(4632): a, c, t, g, unknown or other
atgagaccctgcctgagtgaaccgtgtcggaccactataatttgagaccgcctttcttgagtagcaattaatcccaaaccctactctcagggatgcaaggctatagttcgcctcgtttcctgcattttccggnnnnnnnnnngctatactttgagaccgcctatcttgagtagcaaacaacccaaaccctactctcagggatccaggatcatagttcgcctcgtttcctgcattttccggagtggctgcccagagtgcaatgtgtagccgcgcatcatgcacagcactcactcccggggtcgacttccctggtttccattccacattgccccagctgtctgggcatttcccaagggcattatgatctcctccgtctcagcgttggttggccactgcgaacatccttccttccacactcttagtagcggtgaggtggcgctgggactgagggaccagtgctccaagctgaatgcatacatacgtgcaccgtatgctccgtttcaagacctcaccctcgccaatcccaagggctggagtatgactgacccatgtaatgcaacagaccggttctgagagagcattcagggcagagaggcctcgnnnnnnnnnncccttccttccacactcttagtggcggttaggtggcgctgggactgagggaccagtgctnnnnnnnnnncaaggatccacacctgcaagcaacgggtatgcagtagcagatttcttcccagnnnnnnnnnnttgactgacccatgtaaagcaacagaccggttttgagagagcattcagggcagagaggcctcgtacgccacctcatcctgtacgcgctccaaccgcgtgccctgcggtcaggaattgctgtaaaggatccacacctgcaagctacgggtatgcagtagcagatttcttcccaggacagcagcctgcaggagcctcccatcagctccaccaccatgtggccaagggtgtatcatccgtaacccaattcgacgagagttgctgctatattacccgtttgttctgttgctcgataggcagggtgcagggtgccgcagggaggcatgcatcccccgaaaccgctccccgtcacccaacatggcatcctggacaggagcgaacctcatgcctccccacgcagcatgcgccgcttggcggcatccgccgccttgtggcccagggagtgacccaaagggtcgttctgcgccagcagcacagcggcgaggtgccgcagctcctttgcattgccgttggacagggcaaaggcccgctgcacgatcgggatggtcggtacatctgcatgtgcgggaggggggggggagggggcaagagggtcggcgccgtcgccaggtgtcatgggcaggtctcggtgccgctcatgctcgtggacgcnnnnnnnnnnttttgcattgccgttggacagcgcaaaggctcgctgcacgatcgggacggtcggtacatctgcatgtgcgggaggggggggagggggcaagagggtgggcgtcgtcgccaggtgtcatgggcgggtctcggtgccgctcatgctcgtggacgcacgccctgcgctcacccatcgcctccacacctgtgatgacgccggtgtcgtagtaaaaggcggcggcggtggccacctcctgcagattgtagcgcgggacgctcactctgctgttcctgggcagcgggacggccagggcggccggcagccggccgccgcacgttggcgcggtcaccgtgagtccgttggcgggggccggctgctccatcagcctgaagccttgcacctgcgatggtgtggatgagtgttggagggcgtcgagggaatatggctttcagttctgtctcgtacacgcagggccatgcccgacacactctccacaaaccccgccctcaccaggcgcagctcgtccggctggagctggcggcggtgcaaggggtggacggcctcgccgtaggtggtgcggtggtacagggcgttgtagtcgtcgacggccagcaggacacgccgctgcgtctgccccgccagctcgtccttgagccggatgggcgccgccccgacnnnnnnnnnngatatggctttgagttcggtctcgaacacgcagggccatgcctgacacactctccacacaccctgccctcaccaggcgcagctcgtccggctggnnnnnnnnnntcaccccggctccggccagctccgccaggctctgcgccccgtccgccgtccggagcgcctggggcgatgtgtgtgtgtgtgtgtgtgtatgtgtgtgtgtgtgtgtgatggggagtgggggcgccttcacaccataccacaggcaaacagcacccgtacacatcgtggcatggtgaccgcaaccacccacggcctcacctgcaggtccccggcgtgggccagtagcatggactgcaggatgtagcgcgccgcctgcggcatgtcgaacagaccgtcctccccgcggttgaaggtcccgcctgctcgtttggaaggaggttggaggttcgcaggcgcgggcggcgggaatggtgggggcgcagggccgcggtggggggcaccggccatgcccacagccaaccaggcctctgcagagccccgcgccacccgcatgcctcgcaccttggaccatgctgaaggcgctgggcacgtacagggcgacccagtcgttggcgcgcgcccaggccaccagggagtagagggccacgctcttgcccgacccggtccagccctgcaggctgatgcggcgcttgcgcagggattgcgcgtgctccagcagcgtcttgatgaccgggcggtgctgcagcatgctgtgcccactggaggcgagctcgcgctatttggggaggggaaggaagcggggcagtgagcaggggagtggggggaggtcgatgcgtcctaccccgaggctagacagtcagggaggcagcttggggcggcccacagaactcctcatgcacagcaacactcctccgcatgcctccaccttgtgtgtcaaggttaccatcctgatgtacgcagggggtgaaatgtcatactccatacgccccacactcgagccaaaccatttcacaaaatatacccaccagctgcaggaacacaccccctcccccccaaatcgaggcctgcacccccagcctgacctgcaccccagtgcagccatagttgggctgggtcagaccctccttcttcaggtaggcctcctcatagaagtccgcctgtgcctcgggaacagccctggggtctattgaaaagtagcgggtggttggggcctcgtgcaaggtcgccacgctatgcccactgtgccatggtgttctgtggggtgcgatatgacttggagggagttggagcatcatgtggtctgggttttaggctgccgcagcgaccatgccagaccctggcagcacccccccccctcatctcactctttggtgtcctcggcagctacctccgcgagacccctcacgcctttgagcgtagatgaggaggaaacggcggtcaggccattcacccaggtagcacctgtgcaggcacggaactgcaggaagctcctggccgcgctgcaggtcctctgcatcgcggatgctgctgtggccaagcttagttatacatatcgcgggtgatttgaaatatgctggggattccctccttcaatcttgcatgcggggtcccgaagtaccaggcccgttcggtttacgtgccatgcagcgctgcggtacccgcgatggtggtggtacccaggcgttggtgtgttcccagtactgaggcccgctgctgcaagtctgagctgaggccgagaatactgaaaatattgccttccccgatttgaaccatctcagatcagctaacatcggcaaccatggccgccaatggcnnnnnnnnnnatgagctgaggccgagaattctgaaaatattgccttccccgatttaaaccatctcagatcaactaacatcggcaaccatggccgccaatggcatcgaaaaggtgaacattcacgtgttgagtatttgaaacttgccctgaagatctgcggggcctggtcgagtatgggaattcccagggctactctgaaaacggattttcatatgctatccttcgtagattggagttctggtggtcggagcgggacccacgggcctgggtgcggcaacgcgtctgcaccagcttgggcatcccagctggcttctcgtcgatgaggtgtgcaccgcggggacctcgttcccctcccccaccggcctcacgacgcacgatcgttatgatgggatcgcggggggggtgatcgacctgcaccgctgtattgcctgcctgcccccgtgccataccgacgaagatgcctcgattcccacaccccaggccgaggaagccggtggcctggcctgcaccgatgtcacgcccgagggcttcctcttcgacatgggcggtcacgtcatcttctcccactaccagtactttgacgagctgctggacacgggtgagatgctcctctctttcccccaggctgcgcgtggcgtcgtgcctggctgcatgctcctgggtgtggggccgagggcatgcgcctcggcgggcgggctgccctgcctcgtctactcagggctctgtcagagcgcctgctcacccatgttgcgtgacctcctgnnnnnnnnnncaggctgcgcgcggcgccgtgcctggctgcatgctcctcggtgtggggccgagggcatgcgcctcggcaggcgggctgccctgcctcgtctacgcagggctctgtcagagtgcctgctcacccatgttgcgtgacctcctgtgctcatggtgtttcattagatgcctttcagtgcttcttccccctcccccgccccctcccccacccctccctccctt

SEQ ID NO: 31485 - DNA, 61 bp, Chlorella protothecoides
cagggggttgaggtcgtccatgactctggctaggttgccacgcagctggtcgttgtactgg

SEQ ID NO: 31486 - DNA, 101 bp, Chlorella protothecoides
ggggctacacggcttgggctcgcagctgggacattggtcgggttgccaaggacacgcgggaaggacttggccacagaaagcctagcctggccttccccagc

SEQ ID NO: 31487 - DNA, 61 bp, Chlorella protothecoides
tcaaaaattgcctcatctacaggtgttgttctttttttttttttttggggggggggggggg

SEQ ID NO: 31488 - DNA, 80 bp, Chlorella protothecoides
ggcgtggaaccacacccatgcatgtgggggatggaggccattgggggccggcgtcgagcctctgcgcgctgcaccctgca

SEQ ID NO: 31489 - DNA, 142 bp, Chlorella protothecoides
ccaggcgtccctcccgaccaggcccctgcctggtcgtgcttgagcagcgcggagcaacagccaccctctcccctccgtcttcgcgattccccctgtttcccatacaaacagcgtcccaccagcgaggccgggtcgccggtca

SEQ ID NO: 31490 - DNA, 80 bp, Chlorella protothecoides
cgccggcttgccgcagaggcatgctgggtggcgcggtgggcctctgtgatgagcaaaacagggtgtaatgcatccaacat

SEQ ID NO: 31491 - DNA, 80 bp, Chlorella protothecoides
aaggaagaagcagccccacctccagaggatctgtgcccttctatcagacgttcgcctgcaagctccatacctcaacaatc

SEQ ID NO: 31492 - DNA, 61 bp, Chlorella protothecoides
catggaccaggaatgaacaggcggcttaccacccagcccgccacacccaccggtcacagct

SEQ ID NO: 31493 - DNA, 79 bp, Chlorella protothecoides
cgggctcgtgggcgagtacgccgggctcgttggcgagtacgccgggctcgtgggggaatacgccgggctcgtgggcgag

SEQ ID NO: 31494 - DNA, 73 bp, Chlorella protothecoides
gtggttttgcttgaggtttcctgctcatatgcatccattggccgctgttcacactgtaactggactgcctgga

SEQ ID NO: 31495 - DNA, 98 bp, Chlorella protothecoides
ggggagggggggagaagcggtgggctgaactggtgcggcgagcatgagggggcaggtcgatgctcccgccctgaggatcaacccacaaatacacactt

SEQ ID NO: 31496 - DNA, 61 bp, Chlorella protothecoides
ggttcaccccgaccgcctcatcgtggcgaatgtgggcgactcccgcgccgtgctgagtcgc

SEQ ID NO: 31497 - DNA, 77 bp, Chlorella protothecoides
ggtacctatgcaggcagtgagtatcggggaagggggtggctgtgcgcacatgaggtagaggtgctgaggagccagtt

SEQ ID NO: 31498 - DNA, 71 bp, Chlorella protothecoides
atatgcctccgcaacgggaacagatgtcgtacttcctgagatagggttcttacaactgtccccgatctcct

SEQ ID NO: 31499 - DNA, 117 bp, Chlorella protothecoides
cagctgaccagtgcccaggcctctctcagccaagctcgcgtcactcaggctaaggcgcagaaagacctgcagagcctggactcaggactacgtccaagcaactggtttgcctccagt

SEQ ID NO: 31500 - DNA, 158 bp, Chlorella protothecoides
tcacgcagggatgtaggagtaatgactcaaaggagctcgtttctgacgcagacctgcctcgccatctagcagcgctcccccctgaggatcatgcaggaggctctcggattgaaattcccgactggggcgcgcgcccgggggatctggcgggaggtctg

SEQ ID NO: 31501 - DNA, 61 bp, Chlorella protothecoides
cctccgacagtcgggatcgcagcctgatccgttccgatgcagtccttgggctacaaaacat

SEQ ID NO: 31502 - DNA, 108 bp, Chlorella protothecoides
atggccatgctggcagagaggggtggacatcaggccgtctgatgtagatgtttgcccctcgaacccgcgcccacccagccaaagggctcccaccacccccacctgacc

SEQ ID NO: 31503 - DNA, 77 bp, Chlorella protothecoides
aggtcatcctgccaaggattctgtacctgcgtggcacacagagggtcctgaagcgcaaagacgatgggagcctggac

SEQ ID NO: 31504 - DNA, 61 bp, Chlorella protothecoides
caagcttaccgtcaagcacggctcgaggggtggcgcagcgtctcgtggtggctctccatga

SEQ ID NO: 31505 - DNA, 68 bp, Chlorella protothecoides
gagtccccaccttccctgcatgcgtcagtcctgctccgttttacctcacccgcactttcaaggtacca

SEQ ID NO: 31506 - DNA, 137 bp, Chlorella protothecoides
tcttctttgacgtgaggcgcaggggagggggggtggagtcctcgaagggctcgggtagggaacatctggctctgagaagcgcacgacccatctggcgcttgctctgcgcttggacgtctctcctttcgtggtgcacc

SEQ ID NO: 31507 - DNA, 76 bp, Chlorella protothecoides
cggtgaatgccctgcatgccgtccctcgccgggccctctccccggcaaacgcaagccccgcgccctgcgcaccttc

SEQ ID NO: 31508 - DNA, 61 bp, Chlorella protothecoides
aacaggggatgatgtcgagctgctcgacacacccgcccacttcttcgagacccttctggta

SEQ ID NO: 31509 - DNA, 140 bp, Chlorella protothecoides
gcaggggaggagaaggccatgcagagtgagttccttgcagggcacttcacaccgtggctcagcgtcggactgtgtggcacgctcacgagaaatcacctgcaaactgtcggcagccacctcattccccacgcccacagaca

SEQ ID NO: 31510 - DNA, 626 bp, Chlorella protothecoides
  modified_base (161)..(409): a, c, t, g, unknown or other
ctgtgtctgcaaccctgtgcaagcgcagggcctccgtctgggtcctcttcagggcaaagcgggcgatttgccgcagcgtggactcgccctggagctgctgcgtggcatcgcacacctgagcatgggagtcgtggggagaacagagttggccccaagcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggatctctagatcctgatcaagcattacagagtgccagaatgactgcttcaccagtctgcacaagatcccccaaaccatccaatgcaaagcagcccgcccatatccctattcttcaacgctttgaaccgccagttccaacgtaaacttcatcactaacacctagatggtgtaccagccaggctgtttcggacgagaagcagtgaccggatggct

SEQ ID NO: 31511 - DNA, 270 bp, Chlorella protothecoides
ctggcggagatcaaggtgaggaaaggggggaatgggaggatgggtggatgtcaggcggtgcaccggtctgcggcaagggggtcccttgggtgctcggagcgggagcaccgcccgggcccctcaccaccccaccgccgccgtgcgtgccgcagaaggagggaggcaccaaggcggccggggccgtcaaggcccgggaggcggagctgctgccggtgtataagcaggtcgccgagcagtttgcgcaggtgtgagactctggggtttgggggg

SEQ ID NO: 31512 - DNA, 401 bp, Chlorella protothecoides
ccagcccaaggacatccagctggcccgccgtatccgtggcgagcgcgcttgaatgcagcaaggtctactacatcaagccatccacccaccacctggtgttattaaacaccaccttcactggaaacgaggagtttgatgtgtagagattcgataacagagcaagtacaatatgatttgttgatcgtcactctagaggaggcagcaatgagttgttctgagctcgctcaatttaacgagactctttgtaccttctgtgtggctgtgtatactatgagtcgcctagtgtgagtatgcctgctgcaacgaaatcctctgtgctgtgattctaagactgtatggccccacctccgcaatgaactcgctcaatgtttggcagagttaaaacctcttacacttgatgg

SEQ ID NO: 31513 - DNA, 562 bp, Chlorella protothecoides
cgggcgcggccgcggcgacggcgaccgctccggtcgccgcgagtacgaccgccacgacggctctggccgcgggcacgagaccgagaaacggtccggcggcggccgcggcaactggggcgccgaggttgaggccgccggcgaggagcccgccgagcgcccgcccccccctgagcccacccccgaggaggtggaggccgcggaggcagcccgccgcgagcgcgaggaggaggagcgccagctgtccctgtcggcctacgaggcgcagcaggcggccaagcgcgccagcctgaactccgccaagggccccacctacgtggtggataaggaccagttcaagggcatgaagtccttcaccaaggtggaagaggatgtcggcctggacctgcacaagaacgtgaagaccatcggcgccaacaagggcggccgcgacaaggagctgaagcagaaggagctggtcaaggacgtcggcttcaggatcgcgggcgacgacgcgccccgtgggcccccagccggtggccgcggcggccgcggcgggcgcttcgagggcggccgcggcggcggg

SEQ ID NO: 31514 - DNA, 61 bp, Chlorella protothecoides
tgtttgacgagctggcagcctccccacgccactccatccgctaccagctgcagccaggtgg

SEQ ID NO: 31515 - DNA, 72 bp, Chlorella protothecoides
tgcaggcacaaaacgcaagctcttgccaccacggctgggccgctgccgcccggcgcccagaaacgtcgatgc

SEQ ID NO: 31516 - DNA, 118 bp, Chlorella protothecoides
acagtcgggccacaacggctggcgctttgacgcgaacgtaaagccgtaccataactatgccacgggggaggcgccgccggagccggaagacgtggccacagagcttccggatcgagac

SEQ ID NO: 31517 - DNA, 68 bp, Chlorella protothecoides
tgtgtttgagagggggggttgggtgggtggggcggggagatggacgcgctgccatgcctctatcactg

SEQ ID NO: 31518 - DNA, 80 bp, Chlorella protothecoides
catgagctgggactggacggcgcgcatgggctgacaatggcacggcggttcagaggccactggcatcaaaggaggagtca

SEQ ID NO: 31519 - DNA, 104 bp, Chlorella protothecoides
agacgtctctcatccacctccctcatgtgtccgcatctaggttctcagaggcacaggctcggaagtcggaactgagcctggactacagctttgaggcatcgcca

SEQ ID NO: 31520 - DNA, 61 bp, Chlorella protothecoides
acacggagttcccggcactcaggctcgcccaccgccccgccaccacgccagccagggcagg

SEQ ID NO: 31521 - DNA, 98 bp, Chlorella protothecoides
cgccgatgacggcgtgcgggcgggcagtgggcccctgtccctggcgctgggcgtggaggcgcgcgccgcggcgccgggcgcccacgcgccgcgccggc

SEQ ID NO: 31522 - DNA, 72 bp, Chlorella protothecoides
cctaaccctaaccctaaccctaaccctgagaccctaaacctaaacctaaaacctaaccctaaccctaaccct

SEQ ID NO: 31523 - DNA, 61 bp, Chlorella protothecoides
ggatgagcagccagtcggggtgtggcggggggttgaaagcctgaccacgacgcagcgtccc

SEQ ID NO: 31524 - DNA, 66 bp, Chlorella protothecoides
gagccgcagaacgtgcacctggcggggttttgggtagagcattggcgtgtggtctgctgaggcatc

SEQ ID NO: 31525 - DNA, 62 bp, Chlorella protothecoides
gagcattggcgtgtggtctgctgaggcatcgcggcgcgtgaggggagcagcgcacagaagtc

SEQ ID NO: 31526 - DNA, 84 bp, Chlorella protothecoides
ggcaaagctgaccacaaagccattcgtccaagctcggatccgtaagcgcgggggctcaggctccatccagggtgcatcaaacgg

SEQ ID NO: 31527 - DNA, 115 bp, Chlorella protothecoides
ggggaggatcgacaccgtgactccaagaggtcgcatggatctgggcaggcaccggcgtaaattatcgttgaaggagcgctacatggacgcaacaccccgggggggggggggggcc

SEQ ID NO: 31528 - DNA, 61 bp, Chlorella protothecoides
tgtgaatgcagcagggccatgcccagcgcctgcagtccggtggaggcttgaccccctccgg

SEQ ID NO: 31529 - DNA, 61 bp, Chlorella protothecoides
ccggatgctacatatcatactttagtcctctcaggtctcagtaaacccctgatcacgcccc

SEQ ID NO: 31530 - DNA, 68 bp, Chlorella protothecoides
cacagatggcagtctcgacaggggcaagggggcaggacagcagggcaagtgcatccgatccacttccc

SEQ ID NO: 31531 - DNA, 80 bp, Chlorella protothecoides
gaccagcgtgtcccagaccagcgcctcgtctccacgacctggaaggttggaggcccaggccggagggagggtcggagggg

SEQ ID NO: 31532 - DNA, 107 bp, Chlorella protothecoides
tctgctcccaggagatggcacacaaggattttgcaggaagatctacaagtcccatgactcactggcttcggtaccattgctcaccacaaggcagagtttacccatgg

SEQ ID NO: 31533 - DNA, 61 bp, Chlorella protothecoides
ccgagcgatatccaaggccaccagggtaagtgcgaggataagctgctttcgcatcgtcgcg

SEQ ID NO: 31534 - DNA, 146 bp, Chlorella protothecoides
cccccaactccttgttcaaaaggcaggggctggctggtgcagcagtcatttccctggatgctcttcacctcaccatggtgcttgaattataggatgattggaccacagagtgcctctgcttcatgcctcagacggccagagcactg

SEQ ID NO: 31535 - DNA, 132 bp, Chlorella protothecoides
caaaagtagtcagaacaatccacttcctcagtgcgtatccttctcctttagaggtacgtctgctgaaaggaaagagacggcgtcattatggtatcgaagcctagcagcccggtcgttcgtgagacggaggtc

SEQ ID NO: 31536 - DNA, 61 bp, Chlorella protothecoides
ccttcttggcgggcttcttgccgctggcgggggtgtcactctcgtcgtccgcctcgtccgc

SEQ ID NO: 31537 - DNA, 72 bp, Chlorella protothecoides
tcagctgtacattttgagcgtcctgctcattcacaagcatctgccatccaagctggggcggaggatgcaccc

SEQ ID NO: 31538 - DNA, 61 bp, Chlorella protothecoides
gttgggtcttgatcgtctttctggcgcattggaagacagcatcggagcaaggaggttgcag

SEQ ID NO: 31539 - DNA, 117 bp, Chlorella protothecoides
gaagttggacaggtccgtcacgcagaagcgttgaatagcctggtatactctgcagtgggtgggtggggtgttgcttgttttgggggccaaagggggagggagaggtggtggcaatga

SEQ ID NO: 31540 - DNA, 61 bp, Chlorella protothecoides
cccatcacgtccagtggcagtgatgttggaaagctgaacgttccagttgtcctccgcgtcg

SEQ ID NO: 31541 - DNA, 94 bp, Chlorella protothecoides
cgggaggtgggagggaaagggcggggtggtttgagggagttttgaaggccctggtgcttgattcctttgtgcctggtctgtgctgggccgggag

SEQ ID NO: 31542 - DNA, 61 bp, Chlorella protothecoides
ctcccaccagcagctcctgcgacaagtcatcaaacgtgtgcaccccgacctgtttctggcg

SEQ ID NO: 31543 - DNA, 61 bp, Chlorella protothecoides
cacatctatgcgcagcactccacgacatcccttctgaggagtgctcccgggtcctcttccg

SEQ ID NO: 31544 - DNA, 3714 bp, Chlorella protothecoides
  modified_base (209)..(218): a, c, t, g, unknown or other
  modified_base (422)..(431): a, c, t, g, unknown or other
  modified_base (601)..(660): a, c, t, g, unknown or other
  modified_base (2555)..(2564): a, c, t, g, unknown or other
  modified_base (2692)..(2701): a, c, t, g, unknown or other
gcgaggaggggcatggcaggctgctgcaggcctttgccgcgctgaccgcgcggcgctgccgcctgctggacgcgctgggggaggccttcgagctgcagcccagcgcaggtgggcttggaaggagagagaagggatggtggtgtgggggcgaggaatgggggcggcgacggagggacgccatggctcagcacaggttgccttcagggctnnnnnnnnnnaggagagagtaggggtggtggtgtgggggcgaggaatgggggaggcgacggagggacgtcatggctcagcacaggttgccttcagggctgctgctgccggcactcatgtcctccatgtgattgtcccgcaacactgcttctcgtggccagtgcaaactttactcggaccatctgttctgttctgcccctgcactccttacacannnnnnnnnnggattgccccgcaacaccgcttctcgtgggcagtgcaaactttacccggaccatccgttctgttctgcccctgcactccttacacacggcacacctgcttcccataccccgacgaccacctcttaaaatgaacggccaaaatcacagtgatggttgcacgggagccgtcnnnnnnnnnnnnnnnnnnnnnnnnnnnnnnnnnnnnnnnnnnnnnnnnnnnnnnnnnnnncgctgggcggggtcctccgcgggcgtggcctcgcgccacacactgccgtcgcacccctccctcctggccccgggcctgacggcgcgcgaggtccagctcagcatcctggggcgcacgctggacgcgggggtgtggcgcaaggccttcctggcgggcggctacgacgccgacccgggcgaggaccgcgcggccagcgtggccgccggctacgccgcgcaggtggtgcaggccgcagcgcggtacctgggcgtgccgctgcgttacccgctgcgcctggaggggtccacctccgccatcgccagcggatacgcgccggcgggcgggtggcgccccgcccccgccccggccccctccttcttctcgggcgcgccggcggcggacccgggcgcgccagacgcgggcgcggagctccagacctacccgctgcactgcacgagcgaccgggaccggcccaggttcggcatcgcagtgtacctgctcaacaaggacgtggcccagctgctgcaggcgcacggcatgagcgctgggggaccgggccacctgctggctaatttgcacaagcttctggccgcggccaggagtgcagggctctgttgacgggctgggattgttggggaaggctcaggccaggagcccccatgccgccatggcatcattgttacccgggcctgggccccacccccgacccgcgtgttggggggcttgggccgcgggcccgcctgaggaacaggcgcctgaagcccgtgcatggctgtgtgcctttcgtcatggcatgtaatggccctgtctctgccggcttccctcgaggcagagattccggaacagccttcgacccgggaaatcgatgccggtggggttgtttggggggcgacggagcaaggaagaatctacacaacggcaggaccttattcagtagattcgcccagctaccatcatccagaccattaattgtgatctgcctcatcgcatcgatccgcagtccccggtgtaaaggcgacgctcatactcagtctcacccggccgttcgccttcgctgtgcggcgaggaagtgggtcccagacctgtgcacctctcgacgccgtgtgagacagccgcaacgcggttgatgcatacacagctcccatgggctaattgccgcctgcagctcgccagcgatgtggatgaggactccgacgggccgcaaggcatcgtgggccggctctaccacaccgccagctcccatcccgccgtccgacagaacctacaaactctaacatccaggtatgcgtggtggggtgggtgcgagacgtctcatgtcccaaagtcgcgacacatttgaccgtcatcccccatgttcccccgtaggaaactctcccttccggcactcgccgtgcagcatgttgtgaacaagcgaggtgagattcagatccctgaatgctttttaccgtgcatcgattccagggagggctcggtaggcgcaggcatgcccctgccgctcccctagccgactcgccgaccggtcggatgtcacgtcgcccgcccccaccccccaccccgtaggccccgatgcgctcatcggctgcatccccggcgagaccaagcatgcggccaagatgcttgagctctgcaccgcggcctacgacgcggacgaggtcctggtctgcaccctgcccgtggccgatgtggtgctggtcccgcgtgtgcccgccgtggcccagcgcgacggcctcttcttcgtggtctacgccaccaacatccgcgcggtagagctgtgcgaggccctgcgccgcgaggccaaggtcgccgtcgtgctggacgtggacaacacgctgatcgacgcacacgcagtcacgctgagcgagcgcgactgggcggccctggactgggtggactgcacggtcaccacccagtctggnnnnnnnnnnctgaaagggggggaggggttccctcctttggggatccatcggtggcatggcaagggtcacgcccccctggagctctgcacctccctttcactccaaaccccctcctgctcagactcctcccaaccccnnnnnnnnnnaaccactacgacccactggccgaggaggtgttcctcatgcactggcgcatgaaccaggtggactgcaccttccacgtccgcgtgcggaagggctgggccatcttccgcagcttcctggcgcaggtgggtgaaaagggggggaggggggtttcactcctttggggatccatcggcggcatggcaagggttacgcccccctggagctttgcacctgcctttcaccccaccccccctcctgctcagactcctcccaacccccactggcactcccctcccctcagaacgaggaccgcttcacgaccttcatctgctccaagggcaagcaggagtacctgcagctgctctggaccttcctggacccggacggggagctgatgccgcgctcgcgctggccgacgcacatgaccagcaccttccccgacgtgctgcccgccgcggcgcccaagaccgcgctgagcgcgctgggctgcgccagcgtgctgcagccccacgtggccacgcagctggcggcgccggtggtggcctttgacgactcgcgctctgcgtactacgaggactacgagaacagcatcctgtacgtggaggagtatcgcccctccgacgtcgcggcctcggactcggggtcggtcctgcgccaggccaccgcctgcctggacgccttctggcaggccacctgcacggaggagggggccttcgcctggcaggctgcgcagtccttcgcctcggccctgctggccaccgtgcgccgcacggccatggaatcgcccgacgccatcgcctacctgcagctgcgctgccgcaagcagggcgaggtgctgtggcaccagttcaccgccgaggccgtgtttgatggccgcaactacatccaggacgaggcggaggagggcgacccaggcgccggggcgggggcggccggcgcagccggcgcggcgccctcccccgccctcgcgccgcccatcgtcccgccctgctacgacggcgcgtcggtgctgtcggccggcgagggcgacccc

SEQ ID NO: 31545 - DNA, 8345 bp, Chlorella protothecoides
  modified_base (1106)..(1115): a, c, t, g, unknown or other
  modified_base (1470)..(1479): a, c, t, g, unknown or other
  modified_base (1897)..(1906): a, c, t, g, unknown or other
  modified_base (3441)..(3575): a, c, t, g, unknown or other
  modified_base (3639)..(3648): a, c, t, g, unknown or other
  modified_base (4082)..(4152): a, c, t, g, unknown or other
  modified_base (5441)..(5450): a, c, t, g, unknown or other
  modified_base (5570)..(5579): a, c, t, g, unknown or other
  modified_base (7075)..(7225): a, c, t, g, unknown or other
  modified_base (8119)..(8280): a, c, t, g, unknown or other
cccccaccccccccctcccccacccctttctatcagagttcgtggagatcctgtcgccctcccacgtgcgcatgctggtctgggagcgcggcgcgggcatcacgctggcctgcggcacgggggcctgcgccacggtggtggcgggggtgctggagggccggctcgaccgctcctgccgcgtggacctacctggcggtccgctggagattgagtggcgccaggcggacaaccgcatctacatgaccggccctgcggagctggtgttcgaaggcaccacctccctgaccggcgacgaggcctgacaacccagctgctgccctgcactgcgcacgggcctgatgttacaaggcccagcaccacatgctcattcaaaatcgcaggcgccgcccgctgctgtcgctgcagcagcggtcatcctgcggaggaggggcacgagggaaggcaggaaagggacaggtacagagccggggaacagagccggggaatcagaggtgctaacatgaccccaaggaaggtggggttgtctgggtagaggtacaaagggcgcgcccgccattcacaggtgccagaaagtcggcagacaggaaagtgcagggtggtcgtgctggctccgcgccacacgggtccaggccggagcacgcggctcgtcaaggaaacacgccacacagctcggctttgatatccctgtgccgagccggtcagccggccaggcccaggacggggatgcgcccctggtaggccaccttgtacaccgcattgccggtgtcgtctgagaccaggagggagccgtctgggagctggagcacgtccacgggccggcctgcgcgcttgggggggggggcctaggcaacgaggggccagggtgccacaatcggccgggcagcgtctcaccctcacaactcccctggcgtccctaccagcacaggcgcgtcaccacacatgaatgaccacacacaccgatgtctttctcgatacacgcaccatcgccccctctcccgctcccctttcctccggcgccccatgcagaaactaccaccccgcccacacccacacgcggaccccacctcgcacagcggcctggttggacttgggcgtggcggggcagnnnnnnnnnngtgccgcaatcggccaggcagcgtctcaccctcacaactcccccagcgtccccaccagcacaggcgcgtcactacacatgaatggccacgcacaccgatgtctttcttaatacgcgcaccgatgcctttctcaatacacgcaccattgccccctctcccgctcccctttcctccggcgccccatgcagaacctccaaccccgcccacacccacacgcggcccccacctcgcacagcagcctggttggacttgggcgtggcggggcaggcgggcaggcctgtgtccccctccagcagccccgacataaaggggcgcacgccctctgccgtgccgtcgccgcgcagcgccacggtcnnnnnnnnnnagtgtctccctccagcagccccgacatgaaggggcgcacgccctccgccgtgccgtcgccgcgcagcgccacggtcaccacgcggtacccggccagggtccgcctgcagagtggcgggtgcatgattccccatcatgaagttggccctgccgatccatgctgaggggccctgctctgagggagaatcagcaccagaggcccaagcccaacccagcctgcccacctgttccaggatccgcgctgggctatgaaggcggcacggtcaaactcctccgggaacgcgtaggacgcgctcgcattgcgcctgtggagtgcaaaggatgggagtagggggggggactgagtgtgattctgggtctggccagatcacatttgcaaggtaataaacccctgggcagcatgccccctgcccctgcgnnnnnnnnnnctgagtgtgattctgggtctggccagagcacatttgcaaggtaattacccccctgggcagcatgccccctgcccctgcgaggcgccccaccgagccgccgaagtgtgttcccaggaacacgggaacaacaacacactgatcctcgcacacctgtagaatgtgatgcccagcgcggccatgtgtggtcccagcgcctgcaccgctgggatgtagccaccctcgctcgctgcatggaggggcgagggaggcaatgaggggacggtgtgctacaaacacggttggaaccaggtggcatggggtacaagattgtgaggcatcttgttgtcatgcgcccagaggctgctcacacatcaatcgcatccacaaaccccacgccggcgcggcaccgtgcatctcccccaactggatgcatccctcaccgtcgcagctcagagtcttttggccggcattggtctgggggtcgatgaccggggtcccaatgccagacagccgggcgcagggcgcctctgtgatgccgccccgggccccggtgtggcagtaggggaacccatagaacccgcccgccgccctgaccacattcagctcgtcgtccgggctggcgtcggtgactgtcgcgttgctgccccccacatcgtcgcggccgttgtccgtgaagtaaaagtctcccgtctccgggtgccagtcgaagcccacgctgttcctggtgccgtacgccaccgtctcgggggtggtccagtctttgaggttgaacctcacgatgctgccgtactggaacacgggagtggaggcgttcttctggtagctccctggctcacagacgttgcagggcgccccgatattcatgtacagctggccggcaggggagacggcaatgtacttggcgccatgctggctggcgctgggcagggagtcgatgagcagctctgccttgtccgcggggtactctcccgagccgcggcgagccacagcgtcgataccagggaagcgccacaggcgctcgagctcggagacgtacaggtccccgtcgtgccaggccacgccattgctggttgtcagacccgaggccagggtgaccaggcgctcggcgaatccgtcattgtcgtcgtccaggagcgcatagatctgtcatgtcatggagtgaagtacattgtgacacagtcccatgcctgtcatgcaagcgatcggggccccaaacgtaccttgccatccttgttgttagccacgtagacgatgggtccctgccccgccggcggtggcgccgtgctcagcgtgaggctgcgggcccctgggacaccggcatcgtagtatggcgttaccgcgaatccagcgggcagggtgatgccaaggagcacggatgtggcaggaacaacaaggaacgcggtgatagcaaccaggtaccgcagactgcccattgcgagatcgacggatgctcttatttatcggagagtataatgcgacactttgtgccttacaatatcagtgtgcagtgcatgatcatgcggcacacgcctcatactccgccacgggaggctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcgcttgcaggtctcggcacgcacgtccatgcgctgcccctgcccagacatcgaagtagcnnnnnnnnnnaggacgcttgcaggtctcggcacgcacgtccaagcgctgcccctgcccagacatcgaagtagcagcagcagggtgctcctgaactggcgaagccagagtgccatgcttgcgttgcagattctgctgtcctgggcaccccggccatacatacggcctggggccccaggcagcggagaccctgcctcaacagaggccagagtctacccggtgctccggggtgtacagaggctcaatcgacctgctccactccgagtcgtacagctgcagcagccggtcggcccgcgtgacgccgctctctgcacgtgcatgaagaggggggatgagactcgtgttggcctttttggatgggtccgcggaggaccacggccaggttgctacattcaccgaagggcgcccatccccctcttcatgccggcacaggggcctcaggaccnnnnnnnnnnnnnnnnnnnnnnnnnnnnnnnnnnnnnnnnnnnnnnnnnnnnnnnnnnnnnnnnnnnnnnnaaagcagcccccacactacgcacccgccaccgcgtccaggacgtcgaggtagcgctcctcgcccagaccgcgcgcctccaagccccgccgcgcgatgttcagcatgcgcagcgcgacgtcttgcaccgtcccgtcgcggaagggggcctgcagcgccaggcgcggcacgtcggcctgcagcgcttccagctcggcgggcgtccagtctgcgaccagggcggcggcctgcgcctgcgcccccgcgtcgtacagcaggcccacccacagcgcgggcagcgcggtgatgaactcccaggagccgccgtcggcgccgcgcatctccaggaactgcttcaaccgcacgtccgggaacacggtggtcaggtgcaggtcccagtcggcggcggtggggaagaggcccgggtgcccctccagccggccctcgaagaaggcgcggaagggctgcccgcccacgtcggtgtactggccgtcgcggtacaggaagtacatgggcacgtccagcgcccactccgcgtaggcggcgaaggagaagccggggtcaaacacgaagggcaggcggccgcagcggtgcgggtccacgtcggtccagacgtgcaggcgccaagacttgtatccggagggcgcgccgttgcggaagggggagtttgcgaacagcgcgcccgccacgttctgcagggccagcccgatccggaacttctgcaccatatcctcctccgactcgaagtccaggttcacttggatggtgcaggaccggaacatcatgtcgtgccccaacgtgcccaccttgggcatgtactcgcgcatgtagcggtacctgggcgggggtggaaagtgtgggttggggggggttgggggggaggggggtccgtgatgacgagtgccacgcgtgtaccacccacagtgagctagtaggaaaggctgcccccccaacatccacaaccgcagctgggcctggccgccagctcagataggcagggccctgcttcccccattcgccgcactcctgtgggcgatcccgtgttccaatctcccccgaccccctcctaccattctaaaaaaagaccatgactgaaaccccgcaccgtgtcttgggcatgcgcggcacgtcctcaaagtcccacttggggtcgaagccgatgttcatgtagtcgatgcccaccgcatcgcaagctttccgcacctgcaagcacggaggggggcatcgacggcggggtcagcatgccgcacgtgtgccgccacgacccttcagaccaccaaaatcttccagcccctccccccccccccccccnnnnnnnnnntgtgcaccgccacgacccttcagaccaccaaaaccttccagcccctttccccccccccacacacacaacgcacctccaacaggtgctcccgcgtctcgcgggccacagcgtgcagatcgnnnnnnnnnntttacacatcgcacctccagcaggtgctctcgcgtctcgcgggccacagcgtgcagatcggggaggggcgcgccgctcagctccgtctggccgcccggctccagggtcacggtctggccgtcgtgggccagcccgatctttgccttgccctccatgatgtactcccagccgttggaggagtggatgtgggtgagcaaatccgagatctggtcgtgggtggggcgggcgtggggtggggccttggaataccccagcttctcgtgctccgtgccgatcctgggggtaaaagggggaactgggtctcagtctgatggaggagtcgcggcggggcagagcagagcggggtgagaccgccgggtcacacctccaggcggagcgtggcttgcaccccttgctcagggtgcggacgaggtcatccatgctcagatgaggcccattggagcctgccggagcgggcaccgtgtcgctgcacatgtcggaaacgagtgcgtggtgcgagggaggaatcgggaatgacaaggcgggtgcccgagggacggaccgggagggtcctgggggcacctcgggcgctgtggcccgcgagcgtcgagagttacaaggaagccgcagcacaccctcccatatgcatgcgaggagtaagtatgggaattcggtatcgataaaggatagggagcggtgggtggtgggtgcaggccaggcattcggcgcgcggcgtgggatgacgtcaaagcacacataatttttcctcggcgtgggatgcagataggggtgagggggcagggcggcggcgggccgcttctgcccactgcagcgggtgacccatccaccattgcacaccctcgctcagtacatgcaacatgcttcccgtccttcccttctccccgacatcttcagcagcctgtctggaataggtgtagattacataaagcatacatttggggtccatgccgtcgtaaaactaagcttgttcttgggtgcccccccctcgttgcgggggaggctggcgctcggccgaggccagagcatccctgagtttcgccacaagaataatggaggaaggggtattggcatgccaggcagccccctgcaaaataccgggtctccgggcgcaaggggccaggttgacggcggcacagcctaccatggccgggcatgagcatggcgcggggcaggcaagcgctctggtctgccggcagcgtgcggcgctcgggcgtcagggtcactgccacacaggggtcggagcccggatcacctcctgagcacctcacagtccgcctcaccaatcgcccccaaacttctgggcgtctccccaggaagaggacgaccggcgcgcgccgcccgagctgggccgcctgttacggtcgccaccgccgccctcccacttgttcccgccattgccgctccagcgatcgccgccgctgcggtagcccgacccggagccgccggacgcagggcggcgcccgtacccgccgccgctgccgctggacgagcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgtcgcggccatacaggtcctcctccgggggcagagtgtccggcatgtccagcgtcagcccctggcccgccaggtcggtggaggcctcggccgcggccagcagcgccggcgcggcggcggcgggcacgtcgaaggcggcgccctcctcgcgctcctccgcgctcagcgctggcagcatgcggatgcggcccagggcgacgcgcgcgccaccgggcgcggcggcgtcggccaggccaccgaccacggccgagacctgggcggggcgggagatgcggccacgccggccgctcaggcgcagcgtgaccaggccctcctcctgcgtcagcaggctgcgcggctcgggcacctccttgatgcccgacagcgcggccagcgccgcctccagcgcctcggcgggctcgcgcgaggccaggatgcgccgcgccacgggccggaagaaggcgcgcacctcctcctccacgccgtccaggcgcgtcatgacctggcgcgccgccgcctccatcacctgcaccgcggtgggcgcggtgatcagcgtgacccccgccgtccccgtctcgcgcaggatgcgcttcatccaccccgcctcgcgccgcgtgaacatggcgatggccacgccgtccttcccggcgcgccccgtgcgccccgagcggtgcaggaaggactccgcatcctggggcagctcgtagtgtaccaccaggtccacgtcggggatgtccagcccgcgcgccgccacgtcggtggccaccagcacggagatgccgccgcggcggaaggcgcgcaggaccttttcgcgctccgcctggctcatgtcgccgtgcagcgcctgtggtttttttttgtatgggggtgtaggtggtggtgagctggcgtgggtggtgttagggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcattcccctgcatgcacgagggaccgacgccacccaacccagctaggtccccacccacccacc

SEQ ID NO: 31546 - DNA, 142 bp, Chlorella protothecoides
ggggggcaagtggggatgcgtatcagtacaattttgtacaacaggccagcaggggagcagccaaatggcggtgcggggcgccctcattcaaacagggggtacaagtaggacgtacgcattttgttgtactgcaggacagagg

SEQ ID NO: 31547 - DNA, 131 bp, Chlorella protothecoides
gggagacagggtgcacccatcagggcgcttagccgtaggatgacagcccacacgctgcgagggatatgcacggcgcagccagggtgtagaccgccgtggggctctggcgaggtggtacatccacgcgtcgg

SEQ ID NO: 31548 - DNA, 89 bp, Chlorella protothecoides
gccctgtgcatgaggttggctcaccttggtaacgcgcccatgcaggcagacccaagggtgggtttggggggccaatgcgagagggtatt

SEQ ID NO: 31549 - DNA, 156 bp, Chlorella protothecoides
gggggggggcatgggggaagtgcgggtgcgtctgcgctttggttggccggtgcacctatacgggcagcacagcagccctgggagcgaatgcccagacaaggtgactcctctgcaggaccattccttcctcgtggcaggagcacaacaactcccccg

SEQ ID NO: 31550 - DNA, 61 bp, Chlorella protothecoides
aggagaacgaggtctcagatgttgtggaggggaagatcgacaaccactccgagccgtttgc

SEQ ID NO: 31551 - DNA, 176 bp, Chlorella protothecoides
ggagaactttagtcctagacaaatggagcccaccaggcacgatgaggggccgcaaggttgcgtttcagacgccggcattcaccacggttgggtaccctgtcggaaatgagcacctgacgccttacatcatgtgcttgttgctacagattgcactccttggtctggccagagatgga

SEQ ID NO: 31552 - DNA, 61 bp, Chlorella protothecoides
gcgatggagccctggctccatcattgccgtcgtaccagccgcatgtgagaatgggttgggt

SEQ ID NO: 31553 - DNA, 72 bp, Chlorella protothecoides
tcgcacgggactttctcgtgcccttgaggcgcttgagacgataatggattagatcgatcacgctgcaagcgc

SEQ ID NO: 31554 - DNA, 355 bp, Chlorella protothecoides
  modified_base (188)..(197): a, c, t, g, unknown or other
aatccaggctgtgcgtagtccatagtccatatgcttcgagcatggacggtcggccagggcgcgagatccgccgattcattcaagactccaaccatgcacgacgtgcgagctctgcagctcttcgagcatctgtgcatcctctgactcggtagcaacttatgtttcaggatgggagagcgtctgccctnnnnnnnnnncgtatcctctgactcggtttaaactatgtttcaggatgggagagcgtctgccctctcctggcagcatcctccagagggactatcgagatctccaaaccccgacacctcatcgatctgagacccttcgcctgctccagtggaacattgaacgggggtat

SEQ ID NO: 31555 - DNA, 146 bp, Chlorella protothecoides
ggttgccaaggcaagcagcatgtcacccttgcctgccactctcccatgcaccccagatagcaagcttggtgccgatattcactcaagacccattcacatcattgtaacttgttcatcaggagttgcagcctggtgatggggagcct

SEQ ID NO: 31556 - DNA, 67 bp, Chlorella protothecoides
gcaggccgccgcaaagagcgggaagctggccgagctgctccggtccaagggcatcctctgatcagca

SEQ ID NO: 31557 - DNA, 61 bp, Chlorella protothecoides
acgtgctgtgtcaaagtcatcttgcatgaacgcaatctctgcatcgtcgaaaatctcctcc

SEQ ID NO: 31558 - DNA, 64 bp, Chlorella protothecoides
gttgccttcccgccaacccgggagtcttgcgccttcgtgcccactacgacacgaccgctgggcc

SEQ ID NO: 31559 - DNA, 61 bp, Chlorella protothecoides
tgaatggtgttgcatccaaacctagatcacaccttgcggagccagtccttggaggactccg

SEQ ID NO: 31560 - DNA, 256 bp, Chlorella protothecoides
cctgcacgggagcaggccgcgcaggccggaccccagcactttgcagacgtgcgggggccggaacaggtccctgccggccccggccggccggggccgcgcatggccccggcgccagcgttgctggtgggcaccgacctggcgcccctgccggatcggcccggggacccggtacccggcggcgctgcccccctgaacccccgcctgaccgtggcggaggccgcgcgccaggctgcgctggcggcgggggaggcagccg

SEQ ID NO: 31561 - DNA, 61 bp, Chlorella protothecoides
aaacccgggattttcctcacagagggtgcaacaggcacaggcaccactctggggtgcaaga

SEQ ID NO: 31562 - DNA, 78 bp, Chlorella protothecoides
gaggacagcagcgttgcgaatgcaaaaagatacagttgccccgccaacgtcccagaccctgccacccacctcatcggc

SEQ ID NO: 31563 - DNA, 134 bp, Chlorella protothecoides
cttggatctggacagcgggaacaagggagatgtggtggatgtaaggcctgttggggactggcctgccttgtgaatacacaccccaagtgactccaacagaccttgttggacctgccaccccaagctggtgaggc

SEQ ID NO: 31564 - DNA, 61 bp, Chlorella protothecoides
tctggaaagggatcaggacctcagaacagactccctcctctcctcttcagacctaggggac

SEQ ID NO: 31565 - DNA, 61 bp, Chlorella protothecoides
gcgtttccgggtgaagatgtaggcggcggcagcaaagatgagcagcgagcagccggcgatg

SEQ ID NO: 31566 - DNA, 66 bp, Chlorella protothecoides
ctgggtcgcgctaggagccgccgtcaccgcggcggctgccccgtccacgatgagcagggcggggcg

SEQ ID NO: 31567 - DNA, 123 bp, Chlorella protothecoides
gctgcgactgcatgcttcaagagatttcagagcgctgcccagcagatactcccatggcggcaagaatgcttgtgcaatctatgcaagcaattatgtttgggtgtttggaggaggacatgggcc

SEQ ID NO: 31568 - DNA, 79 bp, Chlorella protothecoides
gatgttgggtgtgatttattgctctgacctgtggagttggcaatatgcagctgaagtgcagacccactcctgatgtgct

SEQ ID NO: 31569 - DNA, 108 bp, Chlorella protothecoides
aacggtggctgcaaagacgatggcgcggcattcgtactgcatcagatctagcatgccaggctccagaggtcctgcatcctgctcagaacgcagccctgcagtccctac

SEQ ID NO: 31570 - DNA, 73 bp, Chlorella protothecoides
cttcttgtgtggaggtgggaagttcttccttggaggaggtggtgaggccttccttggaggaggtggggacgcc

SEQ ID NO: 31571 - DNA, 102 bp, Chlorella protothecoides
ggctgggcggccgctctctgacgcggtcacaaagcagcagctgtcgctgaaatcgttcgtgcaagttcttgccttgctcatcaacattagaacaatgcgtgc

SEQ ID NO: 31572 - DNA, 61 bp, Chlorella protothecoides
tgggcagacacccagacccacgacatcgcgaccctcagccccagacgtttgctacaagggc

SEQ ID NO: 31573 - DNA, 97 bp, Chlorella protothecoides
ggaggctggggttggagaacagggtcagactgcaggcctggtgtgataccgcccgcgtgtgtcatggtgagcatgtgctcaatggccagcggcgcag

SEQ ID NO: 31574 - DNA, 61 bp, Chlorella protothecoides
gtgagcgggttcaggatgttgtggaaggggtagttccagggcacgatggtgcccaccacgc

SEQ ID NO: 31575 - DNA, 76 bp, Chlorella protothecoides
agaacgtgagtctcctggtgtgaggcgtcctgagtggggcgtgaaccaatctgctcccggggtcctgaagcagggt

SEQ ID NO: 31576 - DNA, 79 bp, Chlorella protothecoides
cgcagccgcagcagcagcagccgccgccgccgcagccgccgtcgcagcagccgtcgcagcagccgccacagcagccgcc

SEQ ID NO: 31577 - DNA, 130 bp, Chlorella protothecoides
gaaggtgtgaagtttctggtgttggtgtggtcgagcagtgggggccagcatggctgatcagaccatcgctgatgtcacaggatccactcagggttatacttccccccatcccacccctctcgccacactc

SEQ ID NO: 31578 - DNA, 65 bp, Chlorella protothecoides
gaggtgccagccccgggtcctggcgcaaatagccatgccctgggtgagcctgcgatggctcatgc

SEQ ID NO: 31579 - DNA, 61 bp, Chlorella protothecoides
agcatgggatcgctggtgtggaggcgatgcgagcacagtcattgcccaggctgttgctctg

SEQ ID NO: 31580 - DNA, 61 bp, Chlorella protothecoides
gagtcgccaccacctccgccgacggagtctgcaccaccttccccaatgacgtccccaccac

SEQ ID NO: 31581 - DNA, 79 bp, Chlorella protothecoides
cgctggtgaggatgcctgggcggtttctgaacccttggttgcagtgggtggagaacgggcggttggggatgggtgggca

SEQ ID NO: 31582 - DNA, 134 bp, Chlorella protothecoides
tgggccagaggtgagatgcggggttggggccagaggtcatcctgcttgatagggactcacgtcatcgcttgatggctttgcctggggcgccagtgtcgtgcaactgcaaaatgggcatggacctgtcatgtact

SEQ ID NO: 31583 - DNA, 76 bp, Chlorella protothecoides
ctatgaacatgaaggtattcgcttgacaggttatcaccccaagtctgctgctcacgtcagctcgatggcgagcttc

SEQ ID NO: 31584 - DNA, 176 bp, Chlorella protothecoides
agcgcttgaggggaggtgggagcggcacaggaggagggggaaaccgcttgagaggaggcggtggtcgcttgagaggggccggtggcggcgacgacttctttggaggtggggatggcacgatgacggtgaaggcacgctcacgaaactctgtcagcttgcagtcgttgaccactttg

SEQ ID NO: 31585 - DNA, 61 bp, Chlorella protothecoides
tatgagctccaactactccgggatggggggaaggagtgcatgagaggcggcaagggaggcg

SEQ ID NO: 31586 - DNA, 61 bp, Chlorella protothecoides
acaacatgggaaccaatacacaaaacgaggtggcaggcatccactcgaccaggcgcgataa

SEQ ID NO: 31587 - DNA, 105 bp, Chlorella protothecoides
gcagggctggccaggacctgcgtggccgagcgtcggtagaggggaaaggcaggctgaggggtgagctcaggtgccaggaagcatggccttggtgcaccagccaag

SEQ ID NO: 31588 - DNA, 120 bp, Chlorella protothecoides
gtcgcttgcttgggttggcgaggagtcttggcgtggttgtgatcgtgggtttcacgtcgtcgagtcaacgggcatgcctgcatgcacttgggtatatgcatgggttcgaagctgtagagg

SEQ ID NO: 31589 - DNA, 76 bp, Chlorella protothecoides
ttgctctgcgcatggatgtgcatgcagggtaaacgtgctgagcatcgaggaataactctagtcccaatttctcagg

SEQ ID NO: 31590 - DNA, 73 bp, Chlorella protothecoides
gacatgaaagcgccatggagccctgcctgtgtgactatgcacatgcgttgcccccatcacattgccctgcccc

SEQ ID NO: 31591 - DNA, 61 bp, Chlorella protothecoides
cggctcgactccttcgatactgtgggggactcacggacagtcatcaagatgctgccctccg

SEQ ID NO: 31592 - DNA, 449 bp, Chlorella protothecoides
  modified_base (117)..(374): a, c, t, g, unknown or other
tgcctcatgcggctcaaacacagtggatgtagttttcgacgcattcaccgtcgaattatcaccccaattgaatcgagcagaggcctctcaggcaaagagctcaagagctagccggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggtgtaggaggtccaggtctcgcaaccagtcggccccttgagttgtaacctccaactgcactgcggcccaccc

SEQ ID NO: 31593 - DNA, 61 bp, Chlorella protothecoides
caccaccaccggggctggtgatgagccgagtgactcacggaagtttatgtactgcagcagc

SEQ ID NO: 31594 - DNA, 71 bp, Chlorella protothecoides
tggtcaagcacgctccactgcgctcaacccgggctgcttcgactgcacaggagcggtatgagaaggagaag

SEQ ID NO: 31595 - DNA, 75 bp, Chlorella protothecoides
gctctcctccgacgacgacttctacctcacaaacacaggcctggcggtgctgcagaccaccaaccgtgtgctgaa

SEQ ID NO: 31596 - DNA, 242 bp, Chlorella protothecoides
gttgctgtccagggctgcagcaaaggacgacgcgacgttcaggaggcagaggcaaagacgccgcgcagtgtccccggcctcaagagggaacctgggtgaagttggaggaccgcagggtcaagggggtggtggaggggtgcagggaagcctcgccgtgccaacttgaccatgggaatgatggccaagccagccagccaccaatcgcggcagtgggggtatgcaggtggactggtccagcagac

SEQ ID NO: 31597 - DNA, 61 bp, Chlorella protothecoides
ctgtggaggcgcaggcccgacgccatggactccccccacgcacgacccacagctgatgggc

SEQ ID NO: 31598 - DNA, 76 bp, Chlorella protothecoides
gtgcgcatggtgaggaggtggaggggtggggtggcgtgggtgtgagactgcatcccatgcagcgtgctgcctgggc

SEQ ID NO: 31599 - DNA, 68 bp, Chlorella protothecoides
gcaggtgcgctgctactgtccacagggtgtgggccggtggcactgtccagtccttgagtgtcaggctc

SEQ ID NO: 31600 - DNA, 72 bp, Chlorella protothecoides
tcagcatcctcacctgctacgactccggggagccggggagcatgatcgactgtccctcccacgccgctctcg

SEQ ID NO: 31601 - DNA, 74 bp, Chlorella protothecoides
gagcagctggcgagcggcatcgacaaacatgctggcccttcattccacgcttgaaagcccgacgttcctctgcc

SEQ ID NO: 31602 - DNA, 122 bp, Chlorella protothecoides
cgtgccgtgtcaggcgcagcgcctgcatgacgcggcggggagtagctcaacgagggagtgcagagccggccactgctggaccactggagctctcagtccaggagcagggcgaggtgggagta

SEQ ID NO: 31603 - DNA, 129 bp, Chlorella protothecoides
ccaactgcacaaggacagggacctgcgatacagtgaagaggtgtgggccagtgcacaggggagaagggagcaggtgtctgagagtaatcgtatggaggggccagcagcgtccaaagctctggctgcagc

SEQ ID NO: 31604 - DNA, 6903 bp, Chlorella protothecoides
  modified_base (3518)..(3601): a, c, t, g, unknown or other
caggcgggcggcggctaccgccaggggggtggcggcttcggcggccccaggaccgacgggtactcgggtgagtgtgcggggtaaggggtggggggggagggggggggggaagggcaccacccagggatgagatcatgggcgggacaatgaatgcaaccgtaaggtatggctgggcggtggccgtgtgtcctgaatctcacagggcgccccatcgctgtggcttgaggatgccagggccctcccccgcgccggcgcacactctcactcgagcgctgtgcaccgccgacacaggctacacgccccccgcgctgtcgggcaggggcgtgggcggggagattaacttcgaggagagctacggcgcgggccaggaccgcttctgagcggactggcagtgcagctgagtcgcagcggcggtgtccttccttgcctccatggctgggcgcgtgagtgcaggctggccttttggtcatgccctctgggtccttgggcgacacagacacacaccggcccccctctgatgcgctgcgacgctgcttacaaaaacgcatctcgaaggccgcatggtcggcatcgtacagatatatacaggggaggtacagccaagaattgggggagtaatgggggggcctttccaccagccacaagcagaccgggacatgcctcggcgccgcttcccaaggcatgccacacgttcagcatcagccaaagacccggtctggaaagagggagggggccaggagcgtccagcagtagagcgctgccgccacccactgcgtgacgatcttgacccacaccgatgtccagcccacgtccacggcatcctgtgagtggggggggagcatgagtgtgagtcgtgatcatggcatacgtttgaaagcggggtttgcaagggaaaggggacccaggatagtggtggctggggtgaaggagcccaagagacagcagcagcggggtcagcggcatgcgggcggaggaaggctgaggaaggcgcgggccggctggagacatcgcagtttctgtctcgtccaacctcgcacatcacaggcccccagcagagcctggctgaacccaccgcgaggccggcacgatgccttctcgcactgagcacgaattcatccccgattctcctgacctcccaccctcccatcaccgccattccactcccatcacccacgaacagccacaccaatccgccaccccccgaccccactgaacacccagccgccgcatcactcgccttgggctggccggtcgcgccccagcccgtcatgagcatagcgatgtacatggaggccagcgcaaagacggcatagaactgggcgtagcagtagggcaccggcgcgtcctcctcctgcgcgcgggccggcagcgccgcgccctccccggcgccgccgcggtccatgccgcgcggggcggccggcgccacgccatcgaggcccgcggaggtgagctcggcatcgccggcgagcagcggctcggcgcccgcgccgtttcccccggcccaggcccctgcaaaggtctgcgtgttggacccggcgcggaaggcggagtagacgacggagaggagcgtgagcagcatgccccccgccagcgtggcgccgctcgccgcacccaggcgcgcgcccaggccgttgcaggcgtagtcgcgcggctccgactgcagcgcgctgtagcccatgtaggacacgtacaggccgacggcggcggcggggaagaggctgcccgcctccaccgcggggtggaagctggtcagcgccatgaccaccaccaggaccagggtcaggctgatcagggtcaggttcagggagcagtcctggctggcgggggcgaagaagtggaagcagagggcggccagggctacgcagccacccagcgcgcccagcgtggcggccagcaggccgtacagccaggtctcatcctcgtccccggcctccacccacgcgtcgttccaggcctgggtcacgtccaccacaatcaccatctgggtcagcaggaagaggggggagccgaaacgcgcgacccaggctgcggagagaaagaagaagggggggggtggggggggttgttggagatcagggtaaatcaccaaaagactctgggctgatccatccaacgaggggcatgggagacgggtggtcctcgcagagcgagactgccagggtgcaggttgacagtgcaatgtctggtgtgatcagaaccaggcaaacggaggcaggagcaagcccgccaccatcagcccaatgttgactcacagtaggcgttgatgacgctgggagggagaaggaaggggaggaggatacacaccgtccagagggcagccttgatgagccaggagccgtggtggagctgggtgtcgcgccgatcgctcgtgcgcttcacccccatcatcaccagcgccaggctgccgaagaggagctggaagggaggagcagggtgaggaggcattgtcagacgtattttataaccgttacactggctcaaaagtatccctgacggtagcaaggggctggtgcaccgcaagtggcgccaaggagactaggaatttcctcaccaggttccccaggctgatgcggtacacggcctgggccccgaaccactcatccgaaggcatggagcccttgttgaaggacttgacgatccctgcgagcggtgggggcatgggggtgctcagggattgggaccttgccccccttgggctttgccacgcgcagctcctgcaccaccctcccctcaacgcttctccccatcgttctcctcgtacatgggatcttcatgagcaggggcttggcaaagtcgcgcaggatccatgccaggatcatggacagcgtgaagaggaagctccaggccagcctcgcgctccgcaccatggcctccctcgacgcgcaggtgcacaccgtgcaagcgcatgccgcggcagtgctggctacgcaggagctcagcgatccgatgaggaacatgaggcgcagagtcccgttccgcgacgcctgcagaggcgacccctcgagaccaagggaggggagggactctccgctttgactaccgaggtatggtgctcaagtcggtgtcgcttcgtagcactaaaccttgttctcagacgtaggctgtggaactcgactccaagaaactcccgcttcaagccccaatcgttccgagcgggcctatgcccttcgtggcgggaccctgatggagaggacttgacaccccctcgactctttcattcggagtgtacatcaggaatcggcgggtgtggcacaggcggcacaggctgcacagccccagcatcaaaagattgcgctactaaaaatcgaaggcgagcgggggggggggttctcttctcgcgcccatcccagatcagggggtaaacttcgtggcgaaggcccaggcgttgtttgcgccggggtcggcaaggtggtcgttcaggttctggatggggcccttccccgttacgatggcctggatgaagaagccaaacatggagaacatggccagccgcccgttcttgatctccttcaccttcnnnnnnnnnnnnnnnnnnnnnnnnnnnnnnnnnnnnnnnnnnnnnnnnnnnnnnnnnnnnnnnnnnnnnnnnnnnnnnnnnnnnactcgccggggtagacggggtccagaccctcgccagcgggcccgccgttcacgcggtagccctccaccgcgcccatgagcagcacctggaccgccagggtggcgatgatggaccgggcgttgatcaggccggggacgcccaggtactggaggccgtcgggggagaagatctgggcgccggccttgaaccaggggacgtggttggtgccgtccaggagctcggggacgacgcagcccagcgcgcccagcagggcccagcgggcgtggatcacctcgatctcgcggtagcgggcaaaggtctcggggtcggcggacagacctgccgtatcccagccgtagtcgcctgcggcgtgtgcgtgtgtgtgtgtgggggggggtggagggtcacaggtctggaagacgggcgactggtgcaggggcccatggtgttgatcaggtctgaggacagggtgcagggtggattgagcgctggcatgacgcccaagggaaaccaaaacacatgtcatcccggcactcggtatgcatgaatgttaccatgtgtcatgatctgccccagctgcaaaaatccggcaatgcggttgagataaggccaccatactctatgacccctcccaacagcacccagctgtagtccttggccaagcagttcatttacccagcaatgtattccacaaacgcaccggcgtgctctcccgtcaggtaggagggggtcgcgccatcgctgaaggggcctgtgcgcggagagaagaaaggacggaaatcaggggatgcgacatgaacatccatgccagatcagcacagcttccgaatccgtattgattcgaccctcgactggcccgagagcggcccggcctgcatcttgaggtacccatgggccgatgatagctcaccgaggaacttggggcggtcggggccgtaccaggtggatcccaggttggagccacccttgacgctggacacggccttcttggcctgcttggtcgcggtcttcttcacattcttgagggtctggcgagtgctcttcgccgtgatcgtctgcacgatggggaggattggaagcgtgggtatcaggttggagagcagttgggtcctccttgaaaccccactgcaccgcagcctgtgctgcgccttaccaggctggactgacaggtgatggtctgcatggtgcctaaaatggtggttcgcggtcctgtaggggttgagatacgaatgaaatgcggggtttcaggcaagtgcggcccgggttgtcctcgtgatcctttcggatccagtgtatcctttacgcgctttctttcccgggatctctccttgtctttgcaatccaccgcacaatcagtcaaatcagtttgagggtgcgcagcccgcgccccgtgcagcggctgagcgctgatctcacccgcacataatgacacaaaaggggaggaaatgcggtacgcctgcgttccagactggaaccaggatgctttggccggggaacaagggggggggggtgcctacaaatctatgggtgaggggagtctgggaagggcatggaacgaggacctctgtccataatcaacacgcagtcacaggccccacagagggctgtgccccgcgccactcaagcatctaatactcggagagggctggatagcatgcgcaaaatcgaagactcagcagtaactcgtcagggtacatggcgggcgtggagggggggggtgccccacagattgctcttggggccccaggtgtgagggggaccagcagggggcggggcgccgcctcaccctgcggcggcgctgccttcccgtaggcctgtgcggcgccgcacgatctcgctcgaaaactttcagtcgcccgaggctgcgcggccccatgcacgacagcgggcaccttcctctggggaagaggagcgtcgccttgccgcttgatgctgctctggcctccggtcgccggaggacactcattaaagacttgctcggggccaggcgtccacacccgggtcccgcctcgcctggggcaggtgaccgcgtgccagtcggcaggagcatgcggacggccagcgggagggtcccagggtcgacctcctacctcagcggccccagaggccagacccccccgaggtccccaagcgcatggactccagggcagccgtgaggccatcgttggctggagagggcgagccaaacgccccgctgctggctgcatgactcaggctgcctgccgggcgcgcgcccggcgacaggatctcctcctgtgcgggtgtgcgggagggggggggttggggggggcgagcaactccatgcaggaactttggcgcggaggcagtgggtcctcgtctggagggcgtccaccctgcccgccctcgtcaccctcccataaaatagcaacgacagcgactactagcagcagagccctgcatcccccaacaccctcacacacaaacacctgtctgggcacggccgcgtcgatggcgacaaaggcccccctgatctggtgcgcgccatgtgccacgacgcgctggatgctggcctcagtctcaaaggtgacgaagccgaagccgcgatgttcgcgcttgttggcacggtcgcgcggcaggtagacgtccatgacgaagccaaaggtgccaaagtagtctttcacgtccgcctcgctcgtgtccttgttcagcttgcccacgaagatgcgcgggccggcccgcgccgacgcggggccatgcatcgaccccccgccgccgtgctgcatggaggagccgccgtgcatggagccgccggcgtgcacgctggtgccgccatgcaccgagccgccgccgtgcaaggagccgccggcgccgccatgcatggagccaccgccgccgccgtgcaagagcccgctgccgtactgcagggagccgccgccgtgcagggagccgccgccgccgcccatccagctgctggccagtgcgtcggaggcggtgcgtgccaggtcctgggagtacccgggcgcgtatgcgccaccgcccagcgcgtccaacccgtggccgtaggagccaaaggcgtcaccaccggcgccggcctggtggtggtacctcgcgccggcgtcgcccggccccgcctggtggtactgcgcgcccagcgcctgcccgctggggacgcgcagcaggccgccaccgggtcctgcgcccgcaccgccctccagcgacccgaagcttgcggagccggccaggcgtgcctggtaggcggcctgcgccagcatggcgtgcagcccgccaccggcggagccgcccatgctgccctcccgcgccagggcgcggtgcaggccgccgccgccggacgcgccgccgcc

SEQ ID NO: 31605 - DNA, 76 bp, Chlorella protothecoides
ccaagtgcgccctgagagggcagactcacatgccaaattccacattgtgctctcacaggcagtcgcaggctgcacc

SEQ ID NO: 31606 - DNA, 145 bp, Chlorella protothecoides
agcccgcagcgggtgcagcgtcaggaccggcgacgagcaccgcgtcaaagcggagagccccggtcgtcactactacgaccccggtacccagcccgccgaatctcagtccagccgtcccggcacccaaaccctggggcaagggctc

SEQ ID NO: 31607 - DNA, 61 bp, Chlorella protothecoides
tgcggctggagagggactgatggccggcgggggattcgctggggcaggcgaagggcccaca

SEQ ID NO: 31608 - DNA, 61 bp, Chlorella protothecoides
ccagtccttcctgtcctccaccttcttctttgagaaggccatctcgatggccgtgccatcc

SEQ ID NO: 31609 - DNA, 181 bp, Chlorella protothecoides
gggcaccgcggatggcctgaccggacccactaagaaagcacggcgtgatcatgggtcatgggcggggagtggacgtcccttaggttctctcgagcccgcacatcacctggcttggacagattcatgtttctaggagtgtagtatatttggaattgactgcagcgacatagagcgtagaata

SEQ ID NO: 31610 - DNA, 75 bp, Chlorella protothecoides
tctggggggccacccacaggcaggagtgtgtgggtcatgggaggcaagtggcttcaaaagtggtccacgacgagg

SEQ ID NO: 31611 - DNA, 106 bp, Chlorella protothecoides
ccccacgcagaaccacatcaggttcagcagtagcacgatgacgagcatgaggacatccagcacgctcattcccccggtctgcttgatccagaagccatggggcggc

SEQ ID NO: 31612 - DNA, 121 bp, Chlorella protothecoides
agacgtttcatgaccgagggtgctgtgcgccatcccgtgaggacgggcatgccgcccgggagggaccgcccgccgtacgaatcccgctccccgtccagagggagatcgtgccggggggaga

SEQ ID NO: 31613 - DNA, 61 bp, Chlorella protothecoides
gagggagggagcggagggagcgagggtgtgattgtattgtgtgagccgcatgttggtgcag

SEQ ID NO: 31614 - DNA, 71 bp, Chlorella protothecoides
tcatgcacatgctctgactgccttcgccccgctcccgatctgggcccctgctcaggacacggtcaccgctc

SEQ ID NO: 31615 - DNA, 83 bp, Chlorella protothecoides
cgccagacgccgcgctggccagcgctgctgcgagtgatgcggcgtcgatgctgtgccctgggatgggcagaggctggctggcc

SEQ ID NO: 31616 - DNA, 110 bp, Chlorella protothecoides
tgcatgggatgctgagtagcgacgcaggtgtaccattactgtccacaaggtgtggactgatggcactgtctggtccttgagtgtcaggctccgcggatgtcgaggccagg

SEQ ID NO: 31617 - DNA, 118 bp, Chlorella protothecoides
ctgtgcagcagggcaacctgggggtgcacaaggatgacaggtgggctgggaatgaaaaatgtttgtggtcctcaatcaaggcaagaggaatactcatgcttgacgtccagtactgtga

SEQ ID NO: 31618 - DNA, 61 bp, Chlorella protothecoides
cccccttctcgtcagtggccggcggcgcgggattctctgtgccctgccgacacaacaaact

SEQ ID NO: 31619 - DNA, 61 bp, Chlorella protothecoides
tgtctgtgaattgactgaatgcttgatgcgacctgccacaggcacgggggaacgcacaagt

SEQ ID NO: 31620 - DNA, 77 bp, Chlorella protothecoides
tgagagccaggaggaagtagcccagttccagcactgcgctgtactcctctgaatccttacacagagcacgagctctg

SEQ ID NO: 31621 - DNA, 61 bp, Chlorella protothecoides
acagccatctgagtcgcgaagatttctacgtagcggagatgggtgggccatacgccaggat

SEQ ID NO: 31622 - DNA, 69 bp, Chlorella protothecoides
cgcatcctcctgacatcctctgagagttgactcgcagcgtacgaggcagggacctgtactgcccaccac

SEQ ID NO: 31623 - DNA, 196 bp, Chlorella protothecoides
ggcaggtgagggatggagggggtgggggggggggcgaagcaggctgacctgcagggtgccagcgccgaggaggccctcctggaggccgcgcgcacgctccaggcaggacccatttccccctctgaacacaccaatcgcctgcgccctgccccgatcctgccctccgtcaggcgcggacaggcgcttcttcatgctg

SEQ ID NO: 31624 - DNA, 111 bp, Chlorella protothecoides
tgaatgtatgactttatatgttgacgagaggagtgtatggggcgtgtatggagtgggaacagaaggtgaatggtgagggaaaagggcccggtcttgtatatgtgcgatggg

SEQ ID NO: 31625 - DNA, 88 bp, Chlorella protothecoides
ccgtccccgaagggtgtcgtgcggttgcaccccggggacacatcctaagaagggctctccccctgacgcacagactcggcctcagcca

SEQ ID NO: 31626 - DNA, 115 bp, Chlorella protothecoides
agtctctggggtgcacagagtgggagaccctgagggcggtctcttgagatctcgtggccgccgcgcctacggggtgtttcagacgactctttgttttatggacgctccaacccca

SEQ ID NO: 31627 - DNA, 99 bp, Chlorella protothecoides
gctccgccccatcagtcgtctggggcaggccagcaggccagtccagctgcgaagcagcggttgtcaaatgaggagcaggatcagctgtggatgaatctc

SEQ ID NO: 31628 - DNA, 78 bp, Chlorella protothecoides
gccccgctgcgatcgcgcttgccgccggtcttcgagacgtccgggggccggggcggggggtcgccgggccggggaggt

SEQ ID NO: 31629 - DNA, 127 bp, Chlorella protothecoides
ggcaggagcgcgggggtggtgagggcccgcacaggcatgcttacaacaggaggagactccatacctccccgatgcacagttgcttgctcttcccttcgcactaccactgcaagccatgtcagggctg

SEQ ID NO: 31630 - DNA, 66 bp, Chlorella protothecoides
ggctgctctgcatcgaaaggcaacacggcttgaataaaagaccccgtcccccacacaccatcgacc

SEQ ID NO: 31631 - DNA, 61 bp, Chlorella protothecoides
caccgccgcctcggtgggcgcgggcggcgggtaccgcgccagcacccgcttcacgtgcgag

SEQ ID NO: 31632 - DNA, 76 bp, Chlorella protothecoides
aggtgcgacgagcatgatgggagcagtggcacgccggcgccgccctcgcccccacctggctcgggggtgctgctgc

SEQ ID NO: 31633 - DNA, 61 bp, Chlorella protothecoides
ccggcaggtgtgtgtatggggagagggaaaagtttcctgtggcctagtgcaaaggggcagc

SEQ ID NO: 31634 - DNA, 144 bp, Chlorella protothecoides
agggggtcgcggccaacgtcctcatcgttgggagccttttgggcgaggcagcgctgccaatgcattgattgcttgcagagaacaatccttgccaggtattcaacatttaaaacaaccagctcaccctgggcatggtctcggggg

SEQ ID NO: 31635 - DNA, 189 bp, Chlorella protothecoides
gctgtcatcaagacgagctgcaggctagaacagcctggcaagtagtcgttgccagatgttggtgttgacacgggatctgctgtatgctggtgtgcatgttgaaaccttgcagctggatgcagataggaacctgctgcaggatgttgatcgtgcggttcgatgcccggtgtcgcctcgtctccagatgct

SEQ ID NO: 31636 - DNA, 87 bp, Chlorella protothecoides
gggatgaggtgaggtaagattgaggggggggactgggatggagcgcagcattcagcgccggagacatggctggggaagtcgtcgcca

SEQ ID NO: 31637 - DNA, 95 bp, Chlorella protothecoides
cctcaaactgcggggagggtggggtggagtgcgaaacgcgcattgcctcccaaacttgagggcgtgaggtggaaggggtgatgtaggagacaggg

SEQ ID NO: 31638 - DNA, 61 bp, Chlorella protothecoides
gccctgcagcagcgcgcgagtgcgcggcgttgccacgtccaggatcagctcgtccaccacg

SEQ ID NO: 31639 - DNA, 103 bp, Chlorella protothecoides
tggcgcgtctggacgacggctgcatggcatctcaggattcgagtcgatggcatgtgttgagcagcccagtgtccctatcctctttgcagtctatagcctgggg

SEQ ID NO: 31640 - DNA, 68 bp, Chlorella protothecoides
cctttccacctgcatccgtgccctgcgacgcggctacgacgcctggcacagtgcttgaaacccaagcc

SEQ ID NO: 31641 - DNA, 65 bp, Chlorella protothecoides
aggtgctggcgggctgtgagctgctcccacaagaggttgtcctagaaagatgagaggggctcagg

SEQ ID NO: 31642 - DNA, 61 bp, Chlorella protothecoides
tgaatggaagcattgtagcggcccacaggcaccccggtcgggcacgcaccctgccgtgccc

SEQ ID NO: 31643 - DNA, 61 bp, Chlorella protothecoides
acatggtcgcatgctgccgacacctcccgttcctccaatgcctccacagggaccagtcagt

SEQ ID NO: 31644 - DNA, 109 bp, Chlorella protothecoides
cccttgagctgctactcagcttgtgtctcttccgtttcagcgcatgtgctggcgccgtgatgcaccatggtcgtggctcgccgcagacgagggcaccacgagtggtcgt

SEQ ID NO: 31645 - DNA, 73 bp, Chlorella protothecoides
acggactcggccagtggcgcgaacgccgccctcgcgtcggtggccgcccttccgccagctgcctcgcgaggtc

SEQ ID NO: 31646 - DNA, 61 bp, Chlorella protothecoides
cctggacccgccacgacgcgcccgcttcgcacgcggcgcagcgcgctcctcgccgccggcc

SEQ ID NO: 31647 - DNA, 61 bp, Chlorella protothecoides
gccttccagccccaactcctatcccatgagaccagccacaacacctcctctcacgagtgtg

SEQ ID NO: 31648 - DNA, 124 bp, Chlorella protothecoides
gagggcggccaccgcgcggccagtcccgtgcccatggaggaggatcccaaggcacaggcctgagggggcgggagggagtcccgggacgcgcggggcgggcgtgcatacatgcccttgggtgacc

SEQ ID NO: 31649 - DNA, 69 bp, Chlorella protothecoides
gcgagggggcaggggctggggaacggcaggtgcaggggtctcgctgcaccacgtgttgtccccctagtc

SEQ ID NO: 31650 - DNA, 133 bp, Chlorella protothecoides
gaaagactcgggcaacaatggatctgagatcgcatgtttgtgattacccctccaacccttccccttttcagcgcacatactggaggcaccggtatgcgaccatctccttaccggaggaaacccgcctccacaa

SEQ ID NO: 31651 - DNA, 100 bp, Chlorella protothecoides
tgcacgatttttaacaaattggacacccatcgtgatgctttggaaggaattatgaaatattttattggttaaaggaatagaaaatgggtggcatgggaga

SEQ ID NO: 31652 - DNA, 61 bp, Chlorella protothecoides
gggacgcagcgcagcggcgatcgcaaggccacagccgcaaccctccatgcaacgctcacca

SEQ ID NO: 31653 - DNA, 61 bp, Chlorella protothecoides
tcgccttgcacaggtaggcagacaaggccttggcatggtcggatgcattcttgagtccgtt

SEQ ID NO: 31654 - DNA, 61 bp, Chlorella protothecoides
ttgggccttttcatgctgcatgctacctgctctggcaacgttagagcctggataatggtac

SEQ ID NO: 31655 - DNA, 61 bp, Chlorella protothecoides
ttcagacgggcaaaagagaggaggggaccgtccctcctctggcacccctccttgtgtcgct

SEQ ID NO: 31656 - DNA, 79 bp, Chlorella protothecoides
gtgcaaaggttgaggaggggaagtggtggtagcacagatgccttcttgctgctgctgctcctgcatgcgcgggagcgcc

SEQ ID NO: 31657 - DNA, 77 bp, Chlorella protothecoides
actggaccaagcccaggccgacattctcaagccctggtgtccaaggtgaactctttgcactcacgattccagtcggc

SEQ ID NO: 31658 - DNA, 204 bp, Chlorella protothecoides
taattcgggtggtggaaggggaaagagggaagcctgacctatgaaagcaattacggcgacgaggctgtgtcgtgggcaactcctttgcattcgttgatcctcctgctgatatcatactcttgtgcgacttgacctccaggatcggtcacccgatgccatcccatctgcaggcggtacttcatcaacaatgacaagctggcggca

SEQ ID NO: 31659 - DNA, 78 bp, Chlorella protothecoides
agcacggatcgcatataccccgccacgagcttctcgctgtagggccgccgtcccaactcatgctccagctcccccccc

SEQ ID NO: 31660 - DNA, 61 bp, Chlorella protothecoides
ctccaggtatgtctgggatgcattttcagcgagtgcccgcactgcagtcagagatggcgtg

SEQ ID NO: 31661 - DNA, 99 bp, Chlorella protothecoides
cgccagctcaaggccacgcaggtgcatgacgtgatgcccttgtcaattgagtggagtacactcatgcacagcaagatttcctcgttccttcccatgcgc

SEQ ID NO: 31662 - DNA, 72 bp, Chlorella protothecoides
agacctggaagctgcaggaggcacaaatgtataggggcgcacggttgggcatttggccatgagggaggccca

SEQ ID NO: 31663 - DNA, 3032 bp, Chlorella protothecoides
  modified_base (337)..(378): a, c, t, g, unknown or other
  modified_base (561)..(570): a, c, t, g, unknown or other
  modified_base (898)..(907): a, c, t, g, unknown or other
  modified_base (1227)..(1236): a, c, t, g, unknown or other
  modified_base (1581)..(1590): a, c, t, g, unknown or other
  modified_base (1663)..(1672): a, c, t, g, unknown or other
  modified_base (1789)..(1798): a, c, t, g, unknown or other
  modified_base (2373)..(2382): a, c, t, g, unknown or other
  modified_base (2730)..(2739): a, c, t, g, unknown or other
ccctgcccatacggtgggctgacatgtgcctcccgtgtttcgatccgtgaaggtatcacttaaatgtgctcttggggtgttatcacagagcgtaagacgaagggtcttcttatccgtagcaagacaagggggcagaccaagtttcgatacctctctccaagccttggacttttgtcttgcgcacctcgaacatcctcgcctcgtttttaatattgcatgccgatgaagttgaggtctatctcccccttaacctcgccgcgtctgccttcacttgcaaagctcgcgctcgagcttgcgggcccccgcacaatacgaggattgtgaagtttcatggagnnnnnnnnnnnnnnnnnnnnnnnnnnnnnnnnnnnnnnnnnngccggaggcagatcccgagtgcgtagtacaaagagttttatagcagtaaaaatctcaagtagtacaaagccatgcggctctcttgccgctccgcaccctcgttgtcgtgatccgacaggaggtgcatctttcgtaagctgccgacatggtcctagcagctgtcgcgagcgtaccttctgcgtnnnnnnnnnnctgggaagctgccgacatggtcatagcagctgtcgcgagcgtaccttctgcgtgatcatgcaccgactttagcatgggtgtaccatccccatcgccgacacagtcccttggaagaaggtacggtagcatgaacagcaaaagtatgagaaaaggctatccacgccgtagctgcgcacggaatctctagcactggtggaagctgccctaaaaccggactccgactaccagctagtaccgtctagacagcggatggggaaccctttagcctcaaagaggcccaatcgggtttggacctgtgccatcgccatatacggacgtccaagccacnnnnnnnnnntcatcgccgacacagtcccttggaaggaggtacggttgcatgaaaagcaaattatgagaaaaggctatccacgccgtagctgcgcacggaatctctagcactgctagaagctgccttaaaaccggacttcgactgccagctagtaccgtctagacagtggatggggaaccctttagcctcaaagtggcccagtcgggtttggacctgggccatcgccatatacggacgtccaagccaccttggggttcggcctgcgtacggcgacgggtccagggggtggacttcggagcttgatctttccggtggacttggcaagtccnnnnnnnnnnatgcgtgcggcgacgggtccgggggctggccttcggagttcttgatctttccggtggacttggcaagtcccatgcgggagtctcgcattgtcccagatcgtaggttgccggatctccaggctgtgatgtaccatgcatgtaggttccaagagggcagaacataccttgttttcacacctccttcggcccattgtatctgcattgacactcagtggcagccataatgatgcatcatggttccctagccctgatcatggcatgcctgcttttcgcggcaccggccacggcaacctcgggcttgtctaggtgagtgagtggcaggacagacgccttcatgagggaggnnnnnnnnnncccttcggcccattgtaatctgcattgacactcagtggctgtcataatgatgcatcatggttccctagccctnnnnnnnnnngcatctgagtttctcgctctccgactcttccatcattactttatcgagcacgaagcggccaatgcagccttgagctgcttttgtggctgcgcggatgcgaagatccaaggtgactcnnnnnnnnnncagtctaagtttctcactctccgactcttccattgatacttcatcgagcacgaagcggccgatgcagccttgagctgcttttgtgactgcgcggatgcgaagatccaaggtgactcacgcaccctacaaccaaacaatcggcgcagaaagttactgggaagcaccagcttggccggtgtatcggatggcatcgtggagggttcaggttcgtcaagcacagctccaggttatactgcatccggaagggcctcaggctctgccttcggaaacaatgcaagggccgaggctgggctgacggcaaccagcagtggaagcggatcgagtatcaacggattcggtcgtggatcggtaggtttcggggagaagatgactttacctgaaactccggcacggcatcctatcttcgctctgtgccactgtgttgtgagagaaatcacgagcgcctcgccccttattaggacgaacaccccctgtacgtcatatcactcttctgcaggcggtcagcgatggcactgtcccggcaggggctgcaggtagcttcacgggaactgcaacgggccctgggaaagtggctnnnnnnnnnncacgtcatatcactcctctgcaggcggtcagcgatggcactcgcccggcacgggctacaggtagcttcgttggaactgcaacgggccctgggaaagtggcttcgtctaactccaatgcattcgccgagtcgctcctgcctggacctgtgagcgccgatgcatctggcacagcttctacagacacatccggtgccaaggtgacttgttactcatgaaggccagtgcgatggtggagtgatgatgtgacagtccggtataaggtcctcggactgggatcattggctcttgtcttaacccacaggcttccggtacgagtacgtccagagctcctgggaacgtcaacaccgnnnnnnnnnnccattggctcttgtctcaacccacaggcttccagtacgagtgcgtccagagctcctgggaacgtcaacaccggaacagtttcggcctcagggcctacgttggctcggacgtctgtaaacacctcgactgccacacctgcttcgcctggcggcgtgcccagtccaggagggtcccctagccctgtggcatcccctagtccctctccgagccctgccagctcgccgtccactagtccttcaggctcgccgtccaccagcccttcggggtcgccttccaccagccccactgggtcg

SEQ ID NO: 31664 - DNA, 127 bp, Chlorella protothecoides
cgcgccatacccgacactgggaagcgtgttcctggctgcaatgtcgcatccccagacacgggtataagtaagtggttaattttacagccgatgagcgcagtccactcgttgccctagctgcctctgc

SEQ ID NO: 31665 - DNA, 104 bp, Chlorella protothecoides
tgaggtttgcggcgggtgtttgtgatttttggacgaggggagatccggtgccatctgcccagttgcaatcctggggtcagactggaattttcccggcaggcaca

SEQ ID NO: 31666 - DNA, 102 bp, Chlorella protothecoides
cgttcttcctcatgtcctccaactgcagcatgatgtggggttgtggggtcagctgagatgggcagctctccaatggaaacacggcagatctgctagacagag

SEQ ID NO: 31667 - DNA, 66 bp, Chlorella protothecoides
gcggcccgcccctttcgacgaaagcaaacaacccctcaccccctcagcacctgaagaactggtgct

SEQ ID NO: 31668 - DNA, 92 bp, Chlorella protothecoides
agggctggattctgtcaggaggaagggttgggtgatcatcttttcttcgaaaagctcgcttatgaggagttcacctcggcccatattcgttc

SEQ ID NO: 31669 - DNA, 61 bp, Chlorella protothecoides
tgagcccatgcagcaagatgacagtggcggggtgatgttcccgtgactcgtgcacgattgt

SEQ ID NO: 31670 - DNA, 74 bp, Chlorella protothecoides
agaagaatcagccgtgagccgttcgagaagttgtccagccgccacccgcccgccgctttgccacacccaaccta

SEQ ID NO: 31671 - DNA, 61 bp, Chlorella protothecoides
ggccctccagggggaggcaaacaacaggcacaggacaggggaaggcacaaggccaccacag

SEQ ID NO: 31672 - DNA, 61 bp, Chlorella protothecoides
gcagagaggatcaggggacgggcagggtttgggtcgtccagatggtcgcagatggcgtcgg

SEQ ID NO: 31673 - DNA, 77 bp, Chlorella protothecoides
tgagatcgaggcagcccaggtgggaaggggagcgtgggtgggtgagaggccctgtccggccttcagtgtggcaatgg

SEQ ID NO: 31674 - DNA, 149 bp, Chlorella protothecoides
cgtatgaggatggctggggcatcaagcgggcgtgactccggggggagcagggggtggcagggtcaggcatgggtgggatggggccccatgcttccggtgtcctcacctggacacgccgacatgcaatgcccaagcgtcaatcaggctgc

SEQ ID NO: 31675 - DNA, 75 bp, Chlorella protothecoides
ccatccttgaggcttgtcgatcagcacgacagcactttcccaggcagcaatccccgatggcagagaggggggggg

SEQ ID NO: 31676 - DNA, 71 bp, Chlorella protothecoides
tgacgctcatttggcgacctcgcaaggcagccagcagaaacgcaggcactggggcgaaggcggcgttcgcg

SEQ ID NO: 31677 - DNA, 1138 bp, Chlorella protothecoides
  modified_base (207)..(381): a, c, t, g, unknown or other
  modified_base (839)..(1083): a, c, t, g, unknown or other
atattctaggagcttgagaacttatgggaaatgggtcagaaaactgtacatcgaagtcgcttcttgtcataccctactgctcctgtcacataaggaaggtgcgaggggggtaggtagcacccccccgggatgacacgactccagcttgttcctgttacggggtcgcccaggggggcgtgttgtgggggcgggctggcccccacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggaaaacccacaacagggggccactggtgtgtccccaagcatgcgtggctctactgatcgagacacccagacacacatagtgacaccgtgtgcccgcgctatcacaaactgtaggtgctcggtgactacgcgacaacgtccatcaagacaacatggaacggcttccgggacctctataaggagaagaagacgaagaaaaagaagaagaaggagacgaaggagaaggcgcagcagcagcagcccgtgttggatgcgcttcgaccgacagtggacgatgtcgtggccgtcgtcaccgagttgcgcaccgtcggcgacctcttcgccaatttccacgctatccgtatggtggaggagtttgagcggcggaagcaggctggccgggcgggcgcggacgcggccctgcaaccactcaaccggatatttctcgccaggtgggtctcctgtgtgttgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgggcgccgacgcaagggcagcattctcaccgctggccgactccgtcgcccgc

SEQ ID NO: 31678 - DNA, 75 bp, Chlorella protothecoides
ggtgtacaccacatccacagtcactgccaggcggcagggcgggcacggcatccgagtcttctgtcggcgccagag

SEQ ID NO: 31679 - DNA, 61 bp, Chlorella protothecoides
gatgtgagcggcagcctgggtggtgctgccaggggctgcgctgcctgtcaccacctcaaga

SEQ ID NO: 31680 - DNA, 508 bp, Chlorella protothecoides
gggggcgcggcgccgtcggcggccgcgggccccgcgctggccgccccggccccgcccacgcaggacaaggcgctggcgctggtggagacgcagctggccgaggcggtgcgccgactgcaggaggagcgctccaagccgcgcgcggcgcgcaacagcttcaagtgccccaagtgccaccgcgtgacgcaccccgagggcagcccgctgctcctctgcgacacctgcccccgcgcctaccacgcggcctgcctgggcgcggcctgggccgagctccccacgggcgactgggcctgccccaagtgcgtggaggccacgcaggccgcactgcgccgcgtcgtggacttggaggcgcggcggcgcgaggcgctggaccgcgccgcggcgcgggagagggaggccgaggagcgcctgctcaagcgcctgctggcgcgggaggagaaggaccggcgacgcggcgacggcgtggggccggggtcgggggccgcgctggccggcggcgcggcggggg

SEQ ID NO: 31681 - DNA, 119 bp, Chlorella protothecoides
aaatcaggatcgcgtaaatgaggggatcatcgtcagggcggggactgcagggtcctttgcacctccaagccatcctcatgtgggattttacgttcctggcacacctgatgcccattccc

SEQ ID NO: 31682 - DNA, 97 bp, Chlorella protothecoides
cgagcggtgcaagatgtttgtcgttccacttatcaacccctccgttcgatcgagagtgagcgcgttgggccagggagcgaagaaggaggatgaacgt

SEQ ID NO: 31683 - DNA, 62 bp, Chlorella protothecoides
ttgttgtcgccaacattacggtcgccgcgattgccgctgcctgcagcagtgggacatgagtc

SEQ ID NO: 31684 - DNA, 2308 bp, Chlorella protothecoides
  modified_base (257)..(266): a, c, t, g, unknown or other
  modified_base (560)..(569): a, c, t, g, unknown or other
  modified_base (633)..(642): a, c, t, g, unknown or other
  modified_base (1574)..(1583): a, c, t, g, unknown or other
  modified_base (1676)..(1685): a, c, t, g, unknown or other
ccgcagggcgcaggcgctcgacctcgcgccagtcgctgtccggggcgcccacctccgcgggcggggcgcgcccgcagggcgcggtctcgcccccctgctgctcccggcggtggcgatccagggccgccgccaggttgcccgccagcccggcatgccacctgaagcggtggacagtgacctgcccagcggtgtgcgggggggttgggttggtgacataggagggttcggtccccggcaggctccaaagatcatggacnnnnnnnnnnggtgacctgcccagcggtatgcggcggggttgggttggtgacataggagggtttggtccccggcaggctccaaagatcatggaccagaggtcaaagattgctttcgagaaaagaccaccgcccagggtgcagggcgtggatacattccaggaggctgcatcgtccaagtggtgggcggggtccagcggccgacgcaggtgccgtgcatgtgcgcttcctgtcccccagcacacaatccaatccttatcctcccagaccacacccccaacctggagcattcccccccccccaacnnnnnnnnnnacacatacacacacctgggcgctggccttgtgccggtcccagaggtaggagttgcctgtcatgnnnnnnnnnncaaagagacacacatgcccacacctgggcgctggccttgtggcggtcccagaggtaggagttgcctgtcatgaggggggtgcggtaatacttccagtaggcgtcgtagggcgtgagcgggtacaggtcggagcgcgtgcagcgggcggcctggtcggcgctggggccaaagtaggccttggcttccgttgccgggagcaccgtgaggtccgccgcgtccgtcctcaggtacccctgcgagcgggttgggtggggttggtgggcggcctggcgagcgcagacgctggggggatgcgcacggcaccgcttccacgtggctccacggggcctgcgcagacccccgccgcccggcctcgccccggccgcccatgccatcccatcccagccacctcatctggccccgcccatcccgatcccgccggtaccttgtgtgcgacgacgacgcgctgaggccggccggtgatgccccccaccacgtcgcactcgaaggggaactgggcgaacatggggcgctgtgcattcaccgcggccagcacgccgtcctgcgccacccggtctgcgatcctgccctccacccagttgatgccctgcatgtggatgcatgtgttgttgtgtgtgtgtgggggggagaggtggtgggaaagagggcagtgacctacgcagaaggcaccccaggggagccgctggcgacgtacggcgccctcatcgccgtgcgccgcgcacgctggcgccccccccaaacctcttcccacactcctcccagcgccacgcacctccacgtcgcgctgggcgaggtactgcgcagcggtcaggttgccaaagtcaaagaagtcggaggggcccgggagcaggacccagtcctggatgggcacccggcgcaggacctgggaagggcaggggagcggacactcctttgggccgctcgacgggcgnnnnnnnnnncacggcgccctcatcgccgtgcgccgcgcgcgctggcgccccccccaaacctcttcccgctttcctcccagcgccacgcacctccacgtcgcnnnnnnnnnngccgggcgcagaggagcgcaccgcctcccatggcggtgcctgccctgccaggacccgcaccttcccccccgggctgctgcaccccttgtcgccaatgctggctcccaaaatctcgcgccctgggtgcatgcgccgccccccccttgcccttaacacacgcacagctcccgtcaaccgcacacatccgcacatccaccactctgcacacctgcagcctgagctggaggcgcgcctcggcgtccaggggccccagccacaggcggctgtccacgccccaggcgtccagctggcgcgccaggtcggcggccgcggcgcggccctcccccgcatcccggcgcagcgtgaccagcatgcgctgcaccggcacgcccagccggctgtagtgctccaggaagtggggcaggagggcgggcgcggcggcatcgcccgcgtccagcacaacgtgcagccaggcctcggggcggcgcgggcgcagcacgtcgcgcggcagcgtgtcctccggaccccagatcagcagctgcccgccgtctgcctggtccaggaagaagaggtgcggctccggcgcggcccaggccgggggcgccgcgtcgcgccacgccgcgctcgtcgcgcccgggtcgggg

SEQ ID NO: 31685 - DNA, 61 bp, Chlorella protothecoides
tgtttgcttgtgcacagaactgggtccttgaccttcgactgacgtatcgatgctggcatct

SEQ ID NO: 31686 - DNA, 267 bp, Chlorella protothecoides
acgcctgccacctcgccgtacgcctgcgtcgcagggattcgagtgtgggagtgggttggtagatcgaggaatgagaggcgaggcgagggcccaagcagacctcgcaggggtgccgctggacggtcaagtggggggtatcgccagcgcacgcgccaagcgacgcagactccgccccaggcgcgggaccccccttgactccacccagagcatcccaggaactccctcccagccaccccttgcctcccctgcacacctccgccatcatgt

SEQ ID NO: 31687 - DNA, 75 bp, Chlorella protothecoides
tgctcccccctccaccgcctagaaccatgaacgacggtttgacatgaccaatacgtacatgcacttctgcagcac

SEQ ID NO: 31688 - DNA, 110 bp, Chlorella protothecoides
accgagccatatgtgtatcgcaataccagtcttccatcgatctatgtgtgcacttatcatcctcccacattgttaccctttgacctgacacccacatggtcgttttccct

SEQ ID NO: 31689 - DNA, 123 bp, Chlorella protothecoides
aggatacatgatttctacacatgcaggtggaaaattggacgattcaaaccttgcgatctgtacacctgcgaaggggaggcgcagttcaccctcccgacacccacccaattgcacctctgtctt

SEQ ID NO: 31690 - DNA, 80 bp, Chlorella protothecoides
gggtgtggggctgggagcaggcgggagaccatgagcgcggtagactctgccggggatgccacgtgggtggggctctggcg

SEQ ID NO: 31691 - DNA, 101 bp, Chlorella protothecoides
ctcgccattccctgcagcgccgacgtcgtttcgaggggcgtgtgggagggggccgtgccggcaggcttcatgcccaagggtgtcttgttagggagctcgcg

SEQ ID NO: 31692 - DNA, 114 bp, Chlorella protothecoides
ggactgccgcgagctgcgggagttttgcatccccgaaatacatgcggcctacgccctttgcaccggaggccgactggccgagccacccatcgtgcactcctccagccacctcct

SEQ ID NO: 31693 - DNA, 128 bp, Chlorella protothecoides
ggcattggggcagcaggcatcctgcacctcgccatgtacgccggcaaaaccccccacttctgaggcaaacatgtgcgccagagatgctggccatccacatacatgacgaacgacactgtcccccatag

SEQ ID NO: 31694 - DNA, 61 bp, Chlorella protothecoides
gtcagagaaggggagaacgggagtggggggggtgggtctcgccgcgggaaaatgatagtca

SEQ ID NO: 31695 - DNA, 134 bp, Chlorella protothecoides
tcattccaccaccctcagtcgcgagagctctcctctatcccccaaccaggacgacaacagcacaccaagtcgcaccgtggagtcccgctgaggcatccaggacatacgccagcgcccgcgtccgctcgacatgc

SEQ ID NO: 31696 - DNA, 65 bp, Chlorella protothecoides
tcgatccacgagggccaacagtattcaaggtaacaactttccaccacagatttcctctgagttgc

SEQ ID NO: 31697 - DNA, 73 bp, Chlorella protothecoides
gcgggtgggtggcggtgggtcctctccggggagggaggtgggggcctgccctcacatggatatacctctcacc

SEQ ID NO: 31698 - DNA, 61 bp, Chlorella protothecoides
ggggaagaaggcgaggcagtacgaggcgggacggcgccatgccgccgcccgcctcgctgca

SEQ ID NO: 31699 - DNA, 61 bp, Chlorella protothecoides
agaggaagaagaggcggtggagaggtccaggggcgtggcggtgggggcaacagtggcgtcg

SEQ ID NO: 31700 - DNA, 99 bp, Chlorella protothecoides
tgaggggggtggggggtgagaggtctcataggagaggggaaaccgggggaggtggcgatcaatgccccgcccggagcgcagcattgcactccggcgggg

SEQ ID NO: 31701 - DNA, 73 bp, Chlorella protothecoides
ttctccgaaagcacgcatgggatgaagcacacaatagtgcagaggcacagacaacgagatatgccgtgcatgc

SEQ ID NO: 31702 - DNA, 61 bp, Chlorella protothecoides
ggggtcgcaggtgcaggacaaagctgcgtgggcttgtggcaggggccgtctctgacccctc

SEQ ID NO: 31703 - DNA, 85 bp, Chlorella protothecoides
gaccctcaaagaaattgttggcgggctggctgtcgtgcctggggtccaatggtgaggactcgcagcagcacatgaccctcgcagc

SEQ ID NO: 31704 - DNA, 87 bp, Chlorella protothecoides
ttgcacctgctcgcctgatggacgcctacaacatcgcgcgcgcccgatggtgtttctgcgcgcgggagcccgcatgcactgtccaac

SEQ ID NO: 31705 - DNA, 61 bp, Chlorella protothecoides
gtgttccttcatcccagaccgactccctccctgcatgccccgatccatgctcgtcctcggt

SEQ ID NO: 31706 - DNA, 68 bp, Chlorella protothecoides
gacccagtcctgaatactgatactaatatattctattaagaaatgcgagtccgacggcgagaatcgcg

SEQ ID NO: 31707 - DNA, 121 bp, Chlorella protothecoides
gggaggcaggtcctcgtacaacctgggccgcggcaacacccgcaagcagggtaggctcggcgcgcatgggcctggaggaaagcggggcgggtgtggttttggaagtgacgtgcatgcgcgc

SEQ ID NO: 31708 - DNA, 61 bp, Chlorella protothecoides
atcgtcgcttcccggcatgcatcgggtgccaccccggccatgctggcggccgggagcggtc

SEQ ID NO: 31709 - DNA, 61 bp, Chlorella protothecoides
ccgattgctgctacatcaccccacagctggtcagcaagcgtattccatcttacatctccca

SEQ ID NO: 31710 - DNA, 693 bp, Chlorella protothecoides
tgcgcccggagctgcgaacccccgccggcgcccttgtggccctggccgtggtgatggccgtggtggtgcggggcctgcccgccggcgccgaggccgccggccacgggccctgccaggccgtggcgcaggcccggcgaggcgcccgagtcgcggaagtcgggccagggcaccacctccagcacctcgcaggagaccaccagggcatcacggtgcgcggggcccgccgtggcgtccagcagcgagcccaggcgcgggaactggagcacgccgttgttccaggagcgggtgcacaggctggcctcgcgccactcggtcgcctccggcgcgcgctggttgaccaccgacaggcggtaccgcacccagtggttggcgggggggtcggggggcgcggcgccgccgccgccgccgccaccgggcgcggagaagggcgagggcgcggccaggtcgccctccaggtagatgcacagggactccagcgagtcgtacagcccgatgcgcagctggatgggccccacggggaagaagcgggagaagatcttgcgcgtctccaggatgtccttgaacgccgccaggttgtccacgcgccacgtcatcagcgtcttcaccgggcacgcgccgtcctcgcccgtcagggggggcgcagctgcgcgcagcgccgcgggcggccacgcctgccccgcggccgtcgccgtc

SEQ ID NO: 31711 - DNA, 79 bp, Chlorella protothecoides
cccgcgcctgggctcgctgctggacgccacagcgggccctgcgcaccgcgatgccctggtggtctcctgcgaggtgctg

SEQ ID NO: 31712 - DNA, 77 bp, Chlorella protothecoides
ttgctgtggcagcgacatggagcagtgcatatagatgtgaagggttccagaaagtagatgtgccaaacgtatttaac

SEQ ID NO: 31713 - DNA, 70 bp, Chlorella protothecoides
ggaactccgctccacactctccattgctttgtacctcacccccacacccactctccccaaccactgcacc

SEQ ID NO: 31714 - DNA, 79 bp, Chlorella protothecoides
tccacggcaatgtactcgcctgtacacggggggggggtgggggggtggagagagcggaggagggtcagtgccaggggga

SEQ ID NO: 31715 - DNA, 73 bp, Chlorella protothecoides
gagagcggaggagggtcagtgccagggggagggtcagtgccagggggaatgggcagcctgaatcctggtgcgc

SEQ ID NO: 31716 - DNA, 217 bp, Chlorella protothecoides
gggtgagggggatgggggtgggatgggagggtgggaacgtattcagacagactctcaacccacaccagccatcacacacattgtcagcgggtaccttcccgacaccacaagtgggcccctgtacgggcatgctggcaagctcttccagtccccccttccggctgccaatctggaacagccgcccgacgcaccgccagcaaacctctgcccctcggcc

SEQ ID NO: 31717 - DNA, 136 bp, Chlorella protothecoides
aaatagggtggacagctggtgtgaagctgcgtgactgctccaggtggagggtctgtgcgacccacaggtcgggctgtgcttgaacccctcccccttgggcatgagccttccaccccggtctctcgcgcgcggcacg

SEQ ID NO: 31718 - DNA, 115 bp, Chlorella protothecoides
attgggtgggtgggtcggtgtgaaggggcccctgggtggtgcccgacgataggtagtgtaggcaaagccccattcaacaacccctgtaggccatgtgccgcgctcacattctgga

SEQ ID NO: 31719 - DNA, 96 bp, Chlorella protothecoides
ccggcggtcgcgggccagggccgacgcgcgctcctcggccatccgcgccgcgccgcgggcctggggagaaaggagggagagaggggtcggggtgca

SEQ ID NO: 31720 - DNA, 74 bp, Chlorella protothecoides
tcaccacggtatgcaggaccgctgggaccatgctatgacatgcgaaggccggtgctctggcatgcaaggcgcag

SEQ ID NO: 31721 - DNA, 77 bp, Chlorella protothecoides
agtgccgtgcccgtgagccagggcgaggcgaggccgccagagtcggcgccgcctgcgccgcctgcgtcgtcggcccc

SEQ ID NO: 31722 - DNA, 69 bp, Chlorella protothecoides
ctgcggaaatgacccaccagcctaaagctattggaattattggctcccagtgttgatgaatcctggtaa

SEQ ID NO: 31723 - DNA, 97 bp, Chlorella protothecoides
ctcatcttcgtgggctggagcgtcgtcggtgcgatgcagggaggggagggcatgggcgtgaagagggccggcagaggcgcggttgtcgggcgtgccc

SEQ ID NO: 31724 - DNA, 61 bp, Chlorella protothecoides
gcaccaggtgggtgtccaggggcttgtcggtgatgttgcgcagggcatccaccaccagggg

SEQ ID NO: 31725 - DNA, 97 bp, Chlorella protothecoides
tgggccgcgcgcaagcgggcgctgaggctgcgcgcccctgcggggcaggacgggtgctctgagggggccggcacccatgcgggcagcctggactgga

SEQ ID NO: 31726 - DNA, 64 bp, Chlorella protothecoides
tgcacaccgctggatcttggaggctggatgcgtatatgccccgtggagggattctaaagtgtgc

SEQ ID NO: 31727 - DNA, 70 bp, Chlorella protothecoides
cagtgctgtcggttgtggcagcaccatatgtagaggcctccacgggtcctgccgccgaactgacggccgt

SEQ ID NO: 31728 - DNA, 125 bp, Chlorella protothecoides
ctggggggtgggagtcgatgccgtgttgcgacccgggcaggggggcacagtgccagccctgtcgaaccaccgagcctggttgggacgcaccagaacccagatgcacgagctcaagcaggcttgtg

SEQ ID NO: 31729 - DNA, 26879 bp, Chlorella protothecoides
  modified_base (292)..(301): a, c, t, g, unknown or other
  modified_base (676)..(685): a, c, t, g, unknown or other
  modified_base (1180)..(1189): a, c, t, g, unknown or other
  modified_base (1720)..(1729): a, c, t, g, unknown or other
  modified_base (1804)..(1995): a, c, t, g, unknown or other
  modified_base (2803)..(2812): a, c, t, g, unknown or other
  modified_base (4006)..(4015): a, c, t, g, unknown or other
  modified_base (4777)..(4786): a, c, t, g, unknown or other
  modified_base (5493)..(5502): a, c, t, g, unknown or other
  modified_base (5754)..(5763): a, c, t, g, unknown or other
  modified_base (5926)..(5935): a, c, t, g, unknown or other
  modified_base (6412)..(6421): a, c, t, g, unknown or other
  modified_base (8021)..(8030): a, c, t, g, unknown or other
  modified_base (8085)..(8094): a, c, t, g, unknown or other
  modified_base (8168)..(8177): a, c, t, g, unknown or other
  modified_base (8343)..(8352): a, c, t, g, unknown or other
  modified_base (9181)..(9190): a, c, t, g, unknown or other
  modified_base (9932)..(9941): a, c, t, g, unknown or other
  modified_base (10299)..(10308): a, c, t, g, unknown or other
  modified_base (10865)..(10874): a, c, t, g, unknown or other
  modified_base (11312)..(11321): a, c, t, g, unknown or other
  modified_base (13120)..(13129): a, c, t, g, unknown or other
  modified_base (13272)..(13281): a, c, t, g, unknown or other
  modified_base (13504)..(13513): a, c, t, g, unknown or other
  modified_base (14079)..(14088): a, c, t, g, unknown or other
  modified_base (14596)..(14605): a, c, t, g, unknown or other
  modified_base (15643)..(15652): a, c, t, g, unknown or other
  modified_base (17608)..(17617): a, c, t, g, unknown or other
  modified_base (18216)..(18225): a, c, t, g, unknown or other
  modified_base (18572)..(18581): a, c, t, g, unknown or other
  modified_base (19083)..(19092): a, c, t, g, unknown or other
  modified_base (19533)..(19542): a, c, t, g, unknown or other
  modified_base (19771)..(19780): a, c, t, g, unknown or other
  modified_base (21578)..(21587): a, c, t, g, unknown or other
  modified_base (23288)..(23297): a, c, t, g, unknown or other
  modified_base (23391)..(23400): a, c, t, g, unknown or other
  modified_base (23494)..(23630): a, c, t, g, unknown or other
  modified_base (23763)..(23772): a, c, t, g, unknown or other
  modified_base (23922)..(23966): a, c, t, g, unknown or other
  modified_base (24200)..(24209): a, c, t, g, unknown or other
  modified_base (25557)..(25566): a, c, t, g, unknown or other
  modified_base (26227)..(26236): a, c, t, g, unknown or other
gccggtcgcgcgcctccgcggccgcggggtgcgccgcctccagcgccaccaggcaggcctggcagccgcccagcgcggccgcgtgggccgcaagctgccccgcccggttgcgcacgcgcaggggcgggtcggcgcgcaggaacaggtgcagcaccccctcacgccggtgccgcgcagccaggtgcagcgctgtgttgcctgccttgtcctgcacgagggggaggaatgagggaaggggagaaggttaagtagcaaaggtactttttttttgggggggggggggggccggggnnnnnnnnnngcgccggtgccgcgcagccaggtgcagcgccgtgttgcctgccttgtcctgcacgagtgggaggaatgagggaaggggagagggttaagtagcaaaggtactttgggggaggggaggggggggggtgtccagaggacagattgtttgacagtgacaggcgaaggctttactgacgaaagaggcacgggtgcgaggatctaatcggaagaaggggcagcctgttccgcttggacacctcctgctcgtctccccacgagaagggcctccctcaccaacaaacaatcccctcccagactcaaacacacccacatcgcgcctggaactcctgcagcggcgggatggcaggcgcgtcgctgtcctgagcggcctcgcgcnnnnnnnnnngaaaaggcgtgggtgcgaggatctaatcggaagagggggcagcctgttccgcctggaaacctcttgctcgtctccccacgagaagggcctctctcacaaacaaacatccccctcccagactcaaacacacccacaccgcgcctggaactcctgcagcgacgggatggcgggcgcgtcgctgtcctgagcggcctcgcgctccgcccactgctggccgcggagcaagagcagctgcgccacgtccgtcaggcccaggaaagcagcccagtgcagcgcggtgcggccccagtcatccctgtacgcgcgtgcaagggaggaaagggggggatgaagagggatggaaggaagagggttccgaacgagtcggcagccggaggacgggctgagaaggggatgtgactggcgtacttgaggtccgcagggatggtgttgacctccctcccccatcgatgcagtcaatccttgcttctctttcataacaccttgacagagccnnnnnnnnnngcaagtcggcagccggagaacgggctgagaaggggaggtgactggcgtgcttgaggtccgcagggatggtggtgacctccctcccacatcaatgcagtcattcctcgcttctctttcataacaccttgacagagccgaccagcgacccccgatcatagatccatccgcccctccctctgcctcttcgacatctctcacaatacccaccccacccccaaaaagcacacgccggctcgcctctcgaaggggaccgcgcctgcgtcgagcagcaggctggaggccgcgagcgcaaaccgctcgtagctggggtggctacccatgcacacggccatagtgaggggtggggagccttcgcagttctgggtcaccctggctcctgcgtccagtagcggctggatggcatccagcttgcctgcggcgagcattgccgagggccggtgagcgccgagtgaccgttgagctgcggggagggctcgacagccgcccttccgcacccctatgccgatagtcaggcccagacggccttcccannnnnnnnnncctcacattacccaccccacccccaaaaagcacacgctggctcacctctcgaaggggaccgcgcctgcgtcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagggccggtgagcgctgagtgaccgttgagctgcggggaaggctcgacagccgcccttccgcacccctacgccgatagtcaggcccagacggccttcccaggcgccttggatgcaagctgatgcaacatgagcaggcccgggaggggcagcccagcccaagacaccagcgcaccatgcaggatggcgacatgcaggggcgtgcactcctcggcatctcgagagttgatgcctgggacagacacaggctctacaccggctccttccgcctgtcgagcgggtaatagggtagaggcatggacctgcatatcatggtgcacctacaggatcatgttgccaccattttaccatgcggatcgctcaccaccgactccccggcggagtgctgcaggagagcagccagagcctcaaggtcgcccgactccacggcattatggatggcgctgaaagttgggaagtaatatgcacctaagatcgatcatttacatgcatggtatcgtagcccatggctgtcgggtgggagcactagaaccatgagcagggttcatacgccacttacaactcgaagatcgggggcatttcatcatccgagctgtctgagccgtcgctgaagtccatccttccgtaagctgtttttttaatagtaagacgtcggcgaaactcgcccgggactcctgaccccgagagctaatcaccagcggggtgatgggttttggcgccgaacggctgtgaggggccaccccgtgccgtttggccaccccggaacacgcccaactttccatctaccgccatccgactcgacccctgcnnnnnnnnnnacggcgttcggccaccccggaacatgcccaacttcccatctaccgccatccgactcgacccctgcttaagatatgcattcgattataatgtattgcagtactgggctctgaggttcggccccgtcggcactaccaacgctggccattctatgcgaggatccttcaagcatgcaagagtaccgcacggggcaggtagtaatgtaggaggcgcatggcgatgagattgtgcagtccttgggtctcagggtccagaactccgaaggcatgccaggtgagatgccgagtggcaggtctgaaacctgcatgtaccgtgcccacgcctcccaccagtgctggccatggatgccgagatgagccatgcgtcagcgtgcaggttattggatacatcaaatccccagtatgggcgaaaagtgatggggtgactgtgtgcctctgtgatgaaagcacaatctaaggcaccgacagcaggtcggggagagtattgatatcatgcagctcatccctgattgctgcagctccctagacctcttgcacagccactcacttgcggtcaaggttttctcataggagcccatcgtgcaccagtagaagcttgccgagtgatgcccggcaggctctgggaacagccattggtggcactcctccaagtcatcctgcatgacattggccagcacagcagtgggattgaaaagaaacctggcgtgcagatgtacgcagctagtcactgaggttagcctagaactgtcgccgcaacaccactcagcgggcccatcaggaagcaagggtgatgagagtctggtgtcaacacagctgcagaggatgcagtttgtcttgctgcctcaattctggttaccccactgtggctggtgtgtggccgttgtggtacttggaacacccccaaaagcatggcgggatgcagcatgcacagttaggccgtacagagacgtgggtgtcgtgcccacgcatctgaggccttttccatcgtagacaggtctggtgattttccctgtaatctgaagactcactcgatccacttgtgtacagacttatcaccgtcagcagtctgtatgtggaccgaatttttgctgagcttgatttcagaacattcaccgttcaatgatgcagggcgcctccagcataggtggcccggcacgcaatctacttcgcgatgatgtcggcacacgggcctttggnnnnnnnnnncagcttgatatcagaacattcagcgttcaatgatgcagtgcgcctccagcacaggtggcccggcacgcaatctacatcgcgatgatgtcggcacacgggcctttggcggcactctccggctcaggcagcaggccctcacactctagtaaagaatcctgctcagtttttgattctcgataccaataatgttctctataatggtctccccttcgtgcatccggatccctggggacggattgggtgtcggcccgtcgtcccgacacgccgcgagcccggctcgctcctcggcatggcgccagttcaggcccttcctgccctgtcgccccgcaagattcccctgcccgaccgtggcctcgacctctgatgcccccggatccacggccttcaaggtgaacgtccagggcaggcacatcaccctgaccccctccctgaagcagcatgccgagtccaaggtgatcaaggccctgcaaaagtacgacaacgccgtcaaggaggtaggcgaatcgcgcattcatggctggctggctggacggggggggcatgggatcgggtgagcgttccctggtcaagggggtgtgggatatgaggagtgctggcgagggcaccatgccgcccatgcggcaaaagaggtagctgcctggcccgccacgctggccgtcctgtcagggggagtactcacggcatttcgtgcatcccggctcctggatgattttctggcccaccccaccccacccccccaacacacacacacaccgctaccannnnnnnnnncaatttctgcccccccccctccccgcctgccccccaacacacacacacacaccactaccaggtggacatcaagctgtcggtgggcgggcggggcaaggaggcgcaccaccagcgccagcagaccgcggaggtgacggtccgcacgctgcgccacggcgtcgtgcgcgtggaggacaccgaggacgacctgcacgccgcggttgacctggtggtggacaagctgcggcgcaagatgtccaagctgaagggcaaggccctggcgcgcagcgactggccgggcaggggcggcggcaagggcgggccctccctctccgacgtcctgccggaggacggggacgaggcagcagagaccctggacctcaatgccgagccgccggtgctaccggagatcgtgaggtgtgattttgtattctcatgtgtatttctggggggggggggagagtcagggtcggaggaagggatggggcgctggcttggcgaccccaagcgcgaatgggtagtactcaggacggccttcaaatacactcaatggccaggggtggtaagcccccatgggcggtgtgagatgagcctggcgagcagcctaaaaccctccgcattgtatgtgggggccgaggctgtgctttgtatcgtgtacctggacagcgtcctcatgccttccctcccaccccaccgatcggccgccagggagaagatcgtgttcatgnnnnnnnnnntcgcattgtatgtggggggcaggcttgtgctctgtatcgtgtacctgggcagcggcctcacgcctttccccccctcacccgccggtcggccgccagggagaagatcgtgttcatggagaagctgctgaccgtcagcgaggcggtggtgcagatggagcaaggcgagcagggtttctttgggtttggtggaggtctgcgccgccagctcgcactagcatgtgccgtgctgcatggcaggaatcaacaggagtnnnnnnnnnnaagtgtggtggaagtctgcgccgccagcttgcatcagcatgtcccgtgctgcatggcaggaatcaacaggagtcatagtcttcacccccacacccatcgcagtgggccacgacttttacgtgttccaggacactgcggaccgcatgctcaagatagtataccnnnnnnnnnnaagtcttcacccccacaccaatcgcagtgggccacgacttttacgttttccaggactctgcggaccgcatgctcaagatagtataccgcaggaagtgagtcagcgtgcatgggcaaagacggtcgcggggagttgggcctcgggaaccaacgcattcctgccagtctgctgccacaacttgatctctcagcactaaaagctcctttacgcggcccttaaccacctgcaggtccgagggctatggcgtcctcctccctcagacacagtgaacggcttgaaggatgcatgcaatcagggttttgcaccacaaggcctgaaagcgttgtgtgccctgcccgtggtgtaaggcgtgcacccgcccgattctccaaggaattaatcagctagcttctgaaagcgcgaggtgcgttccgggccggtggtctacggcaagatttcgctgatgggagcccatccaacaaaccagcatactagtcnnnnnnnnnnaccggtggcctacagcaagatttcgctgatgtgagcccatccaacaaaccagcatactagtcaaacacccgcaaatccaggcaatctccgccagcgccgtaaaaactctcactcacctcgcgagtcccctcagcacctgagatcacttgaacccgctgcctggtgggcggccacatgtccttccttccctccaattccgcggcatttgggagccaaaatccgagaggggatgtagaacaggtgcgagactcgccggcctggcctctgtcgctccctgttgactgaagggcgctgtgagcagggccgcagtgggaaattcccgttagtcccctctcctccccatggcagctgttcgccgcggagcctcctgtggccactgcatccacatcggctccaggatccgggtatcaagccccctccagcccgggagcttccgcctcgcccgtcgggtatggacccaccagcaacaccctggacgagcccatcggggacaccatcaagcgcgacctcaaacgcatctataagaacctggtcatggtggtcttccccttcaaggatcggagccagcagactgcggccctgcgcaactgggacctgtggggtcccatggtgcgagctacggaatgaatgggctgaggtggtgaagtatcaggaatgcactgggagtctttggacccttgacaccccaatcaccctgctgatggggtccaccagtcgctcaaacatccacgaaactctcgtcccatgcaggtattcacaatcgcactagccattgccctggcggtcggacctaataaagacatgtcggccaccttttcggtgcggggccttgcaagaggaaggggggtttgtctctgcggtggtgcccgtggaggcattattgtggcaactcctcgcgcctattattgatgggaagcatcatttgggaccctatcgcctatgttggagcaagttccccaccctgacccctccaacccccaacctcccacccatcacccctcctcccagctcgtcttcgccctggtgtcggtgggcgccatcgtgctgacactgaacgcggtgctgctggggggcaccatcggcttcttccagtccctctgcctcctgggctactgcatcttccccctcaccgtcgtcgccctggtgtgcatgggcgtcacctccctcctcgcgcgctggatcatcgtgcccctgggcatcgcctggtgcgcctgggccagcgtccccttcatcggcggcgccgtgcccgccaaccgccgcgcgctggccgtcttccccctggtcctcctctacaccaccctcggctggctcgccctcatatcctgaggggcaatggatgctggacggcgaaggggggcctcagaccccaggtgctggcctggaatcctgtgcggccatgaccgttgttagccgtgtgcacttgaaaaaagaaagaatggcactcaaggccctggctgagtttgtaggtgcagggagaggggcacggccaggccgacgggctgggcagccacgctcagccaggcaatcatgtagcgcaggagctgtaaggtgccctgcggggtacctcgcgcaccgcgcagcatcagggccagggtgtccnnnnnnnnnngaggtgccctgcgggataccccgtgcaccgcgcagcatcagggccagggtgtccnnnnnnnnnncctcaggtgaggctgtagggtgcatcgtggacattgcgactcagctgctgcatgcaggtaggtgccccgtggcnnnnnnnnnntggctggcgcaggggtgcacctggaaaaagggctcgtccagaaaggggtggtcctcctggctcaggaccgagtccaggggggaggcgtccccttcggcggggcccgggaggtagggcaggatgtctaggccgtgaatggtggcgccagctgtcgtgcagaggagannnnnnnnnntagcggggaggcatccccgtcggcggggcccgggaggtggggcaggatgtctaggccgtggatggtggcgccagctgtcgtgcagaggagaggggtctggaatgggcgatccaggtcttaggtgaagctgtagggtgcagcgtggacattgcgactcggctgctgcatgcaggtaggtgccccgtggcaggatcgatgccaagctagcaccttcatcaccccccggcacctgaatcatgcgcggtgaagtgcaggacaggaacccggtaagaaggactgtacaggatgtggtaggtgaagaaggccaccgagccgccctctcctcgcacaggaacacgggccagctgcaggtagccgccgccctgtgagtcatgaagatggggatggcaaggcgtttgctgcatgcactgcgtttaatatggtcgagatttcctgtatgcctcccagggatgcaccctggcccaccttgctggatgcaaaagcagtcatttgtgggacccattcccacagggggccgcctgggcagacctctgcccaagcccgtgcgagctcctgggcgccgagcttgaactccacggggtccaacataatcaaagcatgaatgagcgatagtgctgatcaactgtgcacgaatgcggaaggaatattgtagtccagcctcatggcccgactgcactgcaagggtgtccaccggcacgccaaagcctgacctccctgcaaagatggatgccaagcaatcggatgtaatagttagtgtcccgacggaagagttatgctcacgcatccttgctaccatcaagcacacagcgtgacgagcattaggttttcnnnnnnnnnnactccctgcaaggatggatgacaagcaatcgaatgtaatacttagtgtcccgacggatgagttgtgctcacgcatccttgctaccatccagcacacagcgtgacgagcattaggttttcgatcaccggaatgggagcccggacgcccccccttcctgggggctcgcatgcttgctggcctctcactcaaggcaccacgattttgcatcaagccgccctccaaccgatcaagccgtcagcataccctctacttcttccatctgaattcttgggagattcttgacgaagatgcagagctgcatggcgctcttgagcttgcagccacgcctggtgcatggagggttcagtctccccaccgcagtcacaccccgccccaggcagaggaacgtgcagaccaccgcggtgcgcaatacgaccagtgcatgtagcttgcatgtatacgatgcatgcatggcgatatgacgggtggacaggcccatggcacaagggtgggctgcaccatgccctgcacccgaatccatcacaccgcgtccccatcacaccgcgtccccatcgtatccctcccagttattctcgttcctgaagctagggtccaagacagccacgaagcccaagtacgagacggtcatccctgagacgagctacgccattcctgctgtactcctaggcgaggacatggggtgggggcgacgggtgtttctcagttgggaaacgtgcacactcaatgtcaacatgccgcttcnnnnnnnnnnaaggaaatggggtgggggcgacgggtgttttccaattggaatcgtgcacactcaatgtcaacatgccgcttcccatgatattcctccagcattttcttcttcatacccaggtggagcggggttgacccaggtcacgacatccaacacggctctggcggcaggtttgggcctcctgggtgccttcctggccgtgcaagcctctcgcgtcaagtttgtctttgacgaagacgccctggaggtgtgaggttgcttgagagggcaaagggttttcgtgatcatcttgatgcacgtcatgcttccttatgcaatgcttgatctaccacctcgtgcctgcccatctccaggtgctcaccgggannnnnnnnnntggttgcttgagagggcaaagatgtttcgtgatcatcttgatacacgtcatgcttccttgtgcaatgcttaatctaccacctcttgcctgcccatctccaggtgctcaccgggaaggatgaggaagaatcagagaatgcgtttgtgggtggacgtaaccgctggagctacgacagcatcatcaactggtgagagatgatgtgcaggccttttatctgtcaagagcgtccatcaatgaccaggacccccaacacgtctttctctcagtgatttgatccctccctctccagggagttttggtttccgtccttccccatcctggtttacttcaaggaagaccagacgcgtccagagggacagatccacttcttccccgtcctcttcaacggcaagcagctgtttgaggtgatgagcgagcgcttcaacaagcccgagtctgactgaggatttgatggtaccagggtctcggcgttcgtttggggtcacaatcggggaatggcatgcagaggggccgagggggacgcgttgggtaatccatgagccctccctgctgtcgtnnnnnnnnnncggttctcggcgttcgtttggggtcacaatttgggaaggcatgcagaggggccgagggggacgcgtcgggtaatccatgagccctccctgctgtcgtcatgatgtaaggcacgcatgggggcagggacatgcaaccaagggccaggcactgtcagaggtgggagggcacggggccagccgccaggctgagcaagctctggccctggacaatgatactgccctgatcctgggcggcgacgtcgtcggtgccagccaggtccatcacaagggtctcgctctcggtctccagcctgagtggggaggggaagatggcgtgaaatgtggtggggttccaggagcatgtggcatgtaagtcggggcgtcggcccggcgctcgtcgctctcacggggcacactccttcttccctcagcctcatgacacgcaccacttgaggtccnnnnnnnnnncggaggggaagatgggggggaatgtggtggggttccaggagcatttggcatgtaagtcggggcgtcggcccggcgctcgtcgccctcatggagcacactccttcttcccccagcctcatgacacgcaccacttgaggtccggggcagctcgcccaggctggacggagggtggtccaaacagggcagaagggtccaggctggcccgtgcagctcggatggtgtccaggggcgccagctccccctccttctcgccgtccaccccggcactcatgctgagccggaccagggccctcttgatctccacctccagcgcatcagccaactcatcgggctgcagagtttggcggtgggtgtcgtacgcgctgggctgccgcagctctggatcctgtgccccaacccaagcccgcagagcacatgcccagcacaggcaccgcccaccttctttgctgcgccgggggaacgggctgtgccggacttggagtttacagagccctttcgcgcgatcatggtgggttggaaggagcactcctgggggggggggacaggatgggaagggaaatggggagtcaggtaaggagcttcatcaaatgtctggacctctggccggcagggaagcattgagaggatgcaggctggcacagtggcagcacctcccctctcaccccgaaactccccaccttcaggcgcgccgcctccgcggcggcgcgcttgctttccagcttgcgctggatcagcccggcggtggcgtacagcttctcgtgggcgggcggggcgccgctcctcctccgcgtggccagtgcctgtcgcagaggtggggtttcgcacgccgcggcgttggtcggtgggagcacatggtggagtggagggtgcggtgctacaggagcctgccccacagcacggccccaccgctcgctccagcgtccagcgtccggtcagcggctggactgcgccgtttcaccttgcctcccacctcagaaccctccgacccatgacccacctgggagcgtgcatcgatctggggctggaaggtgggctcctcaaacttcttgcggctgggtgccaggggcagcaggtaggtgcgcgcgatgcctggggcaccaaggagtagggtgggggtttagagtgtgcttctatgtctccaggcactcttgggggatcatggaccgtcagagtctgggcatgcggggggtccgccaatgtcggtgtgctggtggctgcagacctgcactcatgctgctggtccgggccggacatcccacccccccatcctcacacaacccctcgccgcccggcgtggctcacccttggtctgcgccagcacttcctccatcagcacgcagaaaagctccagggagacggggccaagcgcggaccgtcgctgcggtgcggcgttcggggtctgcagctccctgtcggggctggcggggctggcggccagcgggtgctgcccatcaccttggctcgccgtgtcctgatcatccgccggcctgcaggttcagagggggctagggttgcaaggagctcccattgctggtgatcagggaggatgggagatcaccgtgccatgtgccgccatgtgtcctcacagagccgctccctcgcctgccaacactggctgtgctgctgcccgccaccatcccaacccccacatgctatcacagcccattcacccgtcgctctgggcggctgtctggaggagccgggccgcgtactcgacgtcggccctcacctctgggtcgatggtgtccatgaactcctcatcctagcaagagaaagagggtgttgcattggaagtgcgnnnnnnnnnntgcgtcatccccccccaggtaggcgaagatggacccgaatcgttcccgcttcagcgcctccaccatgcgctgcgagggggaagggggttggaggaggggggaagggggttggaggaggaggaaaggggttggatggaggtggnnnnnnnnnntggagttcaataagatctgtggttctccagtgatggcatgtgtcgtcccaggtgcacatctgagccgggtgtgcaacccagccgccggcgccccgcaggcctccatgccgaacggggcacacgccccgatccctgtcccaccggaccatccccaccgttccgcgccgcgccaccccccaccaaacaaagactacccactgcgccacctgcacgacggcgcagnnnnnnnnnncggaattcaataagatctctggttccccagtgatggcatgtgtcgtctcgggtgcccatctgagccgggtgtgcaacccagccaccggcgccccccaggtctccatgcctcacagagcacacgccccgatccctgtcccaccggaccagcccaaccgttccgcgccgccccaccccccaccaaacaaagacgacccactgcgccacctgcacgacggcgcagaggtccaggtcagcgtccgccgcgtcatcccccgccaggtaggcgaagatggagccgaaacgttcccgcttcagcgcctccaccatgcgctgcgggggggaagtggttggaaggaggaggaaaggggttggatggaggtggtcatgtggaggacagggttcggtccacgctccctcgcaccagcaagccacgcagcgtgacatgctgggaccctccgacgatggtgcctggggattccctgggtcggcacaccatcgaatccacccatgctgttcccccccttcccacattcccagcattcttcgccccccctttggacaccccaacagtcacacacgcacctnnnnnnnnnntccccccttcccacattcccagcactcttcgtccccccattggacaccccaacagtcacacacgcacctgggaggaggcgttcacaaaggtgctggcggcgtcgcgctcggcgcggcggcgctctgcctcggcctgggccgcggcgcgctttgcatgctgcgccgcgacgccgtagaggtgctccccgatgctgctgccgcgcacaccgcccaggccgcctcgcggcgggcggcacgtctccggcacgaacagccggcgccccgtggcggggtccagggccgagcgcgccgcggcgcgggaggcctcggcgcgcgcggcgtagcgctcgccgcgctccagcaggcgggcctccacgcgcggcggccggcccaggcaggtggccgccagttcggcgtccgcacgccctgagttcagccggcgcagcacgacgctgctcctcaggatctggatgacgcgtgattttgttggggggcaagtataggcgtggaggaagggacaaggggaggnnnnnnnnnnatgattttgttggggggggattataggcgtggaggaagggacaaggggaggtgtgggtatagaatgctgagctcaggactaggcgctggcgagctggcacaccttggtacaagaatccgacctctcaagaccggtagaccatgccaccttccttccttccccaaactcaatggaccttgggagcaaaggtgacttgggcgggaagctctaaggccgcggcctccagcttgtgccgccggcgctccgcctccaggtacagcctgtcgtagtactgcacccccgcctcctgtgccggggtgggtggaaagaatggagcatgagtctcagggaacgcagcgaggagtccagcctatcaagctctcgaattcacccagcaccgccagtccccactcaccttgagtgccgaggatctatgggaggtcaggttttgagacctcctgttcagggtcggcgcaaaggtgcactccttgacctccgaggcggccttggcgcgcctcagctcggccatgcgcgactgcttggtgccatttgtgattgtggctcgaggggatggccagtacgtgagcactccctcgatgcagggcgactaggtgtcctcaccccacatcctctggaccatcaccctggtgcccgcagcagcatccatgtaccaatacacaactctaatggcctcctgctcagtgcctcacctcgaacttggaggacagggtcggaccatgtgacctctggccctgggagcccatgcgcgcctcacgatctcgcttcgccgccgcggtgagggacatttcggggacaaacgtgcagccctccagctgcgcggcctcctccgcctcgcgccgccgcgcagcctgaggtgttgaggtatacagccaggtggcgtgagtactgatgaaggacggatcgtattcgtggcacttcgaaaggggcaagctcacgcgcaaatgcattcattcattgcatggtcccctttccaagttcgcccagcctaaaacgggcccctcccaacggtagcccccgagcaacgcaccgcctgctccnnnnnnnnnngctcgtggcactttgaaaggggcaagctcacgctcaaatgcattcattcattgcatggtcccctttccgaggtcgcccagcctagaacggccccctcccaacagtagcccccgagcaacgcaccgcctgctccctcttcagcgcctcaaggcggccctccacgtacagcctctcgccgtagttggtgtagccgtcaggcgtgcgtgcggccgacaggctctggctcacggggtcgaggtgcacctgggccatgcgcagctggagctccaggtcccgcagccgcctcgcctcctccagcttcagctgctgccggaagtgctcgtggtacagccgctcatgcacgcaggaggtggttccctgcggcggcgcgctgctgccggggccccacgccggggtaaccccgccggtgccccgcgaggcgccggcgtcggggtgcggggggggggagccctgcccgggagggcgggcccagtgcagatcctgctgggaaagggggtcgcgcggggtctgcgccggcacgtccccgtccgcccaggagatggcctgggcgggggcgacgctccctgtcgcggcatcctgtgggatgtccaggcaggattcatcttaattttctgctcaaacaagcatccaagtcgacgtaatgccgcccccgctcccgaaccctccaagcttgtggcagccttatgcggtgccagagttcaaacactccacaaacctgctcgctgggcgggcccagatccaggttcgactgtagatgggcagccaatggcagcacaacggactcggggaggccgttggtggcgcagaaagctcgagctgcgtcctcggggtcgtcaccgagccggacctcgaccctgcctgtcacaccgtccccaatgtccaccgtcgtgacgaggagaacggggcgggggtcttcgaggctcttggtctcctcggattccattctgtatggtgttgtgcctctccgctgagccgtgcgaacctcctaatgcacgtcctggtcgtgtcggactcccggtgggtgtgagtcctcgaggttagcaacttcaatggccctcaacatgcgagtgctgcctcacagatgccggatttttgggtatgaagggcctgggaattcgtgagtccctgcaccatgggttgatctcgaggatgccgaacctggatcccagctgcccgagggcagttcaagtggtggggccagcatccgcagcatgtcgagggagagacagaacatttgtcgcacacctgtgcgaactgcatcttcacatgtctcatgatctggccgatctgtctcgcacacactaagaattttgaaggtcgcgcagcctggactacatgcagatatgctggtcctgcgagcagaccctcttttagcgagaaccagcgccaagcccttacagcttctgggacggtacggcacccagaatcgtgtagcatggcatccgaggcatgccacgaaagtttgtagtctgagtacaacaaataatggagctgcagggcctttggatgccatactcgtgctaggagggggcctacacgaggacggcaaggtgcctccctgggctactcggcgccttcagctggcagcagacatctggaaggatcagagacggcatgtccgtgatcattatccacccgtgctgctcctgggtgccggcacgccacacaaaccggcggtagtgaccaagaagggtgcagtagttcatgaagcgacggcttatgcagacgagatgctgggcctgggtctgcctgccaacagcctccttaaggaatgcagcgtgagtcagtgatgtatagcagggaagggtgtgtaggcagagttgtttgtggctgagcactgagtacatgcaggttgcggattctaatatacaagcagagcccggctccctcaatggtaatagagacagccccacccaactcccacgactgacagagctacgacacggtcggcaacgnnnnnnnnnnctacaagcagagcccagctccctcaatggcaatagaggcagccccacccaactcccacaactgacagagctacgacacggtcggcaacgggtacttcagcctgaccattcatgccattcctgccagatggaggtgcgtgcattgatatctcacaccgcagaatcggccagcacatgtgattggctgtcttgtttctgtatgatcccatggttgcagattctgcctgctctgccccagcatcaaggtgccggaggatgttcttcttcatcaagcgctcgaacgagctcacaggccccaggctcactttgcaccttgcggcatatggcaccctttccacccctgccgctacagatgcctggccgtgatcaccagcgcattccacatgccgcgagcgcgtgccatatttgacacgacctacggcctggcgaccaggtccctcctcggcggcccctttgcgctgtcctaccacgaggccagcgacgagggcctgtttgaccccgaggtgctggccacccgcgtcgccaaggagcaggctgctgtcgcaacctggcagagggacacctcggcctttgcccgcctggcggacctgcacgcctggnnnnnnnnnntcccgaggtgctggccacccgcgttgccaaggagcaggctgctgtcgccacctggcagagggacacctctgcgtttgcccgcctggcggacctgcacgcctggctgcatgccacgcacctctgctatgcagtctcccgtcagcacgaggtggctgccaaggacgaccccaaactggcagccacatactgagcgacgcagaggtttcttctcgggaaggactgtctcggtcaaaatcgccatgctctgcaaagtcttacccacgcattcccagcattgcaaggtgccactgttttcctgcttttcaatgggtccccgacctataaatgaactgcagcatgctctgctnnnnnnnnnnttcctgcttttcaacgggtccccaacctataaatgaactgcagcatgctctgctccctgtggaccgtatattctgattgccaaacgcttcattgctgtcgttgagctactcctcatgattgtagattgtcgtgtcggtcaggttccatgtgctgcatgctccccacattcatgcctccatgggagttggcacggcagcaacctcgttgtacatgtactgctcctggtattcttgcaggtactgtaaatgtagatggaggggaggaaaagggggggggtcagctaacggaatggggttgaggcaggagtgtggccctgcactctccatctagcaatgagccggacctcaggacgggagagagctgcacccactgatgcaccctgcaagccaaagcactgtgcatagtgttgaacctcccatttgctacactcacactgcctgcatgttgacctctcccccggtccccacccgctgggccgcaaacagcacccctggcatgaannnnnnnnnngtgatacaacctacaagccagtgcactctgcatagtgttgcacctcccatttgctacactcacattgcctgcatgttgacccctcccccggtccccacccactgggccgcaaacagcacccctggcatgaacaaccccacctgcgtcgagcgcttgacatccaggaagagggtgtaggcgcgggccacgtcctccacatccacggcagaggccttgcgccgcgcggcgatgagcgaggccgccgtgatcaggtggatggcatacctgtggagtgggcgcagcatgggcggggtgggccaaggggtgtgggatagggcaggggctcagcggcatgcgctgtcttggcgggacggcatgccttactgatacagcactcgggtaacattggctcccaagcaggcaccggtcgttgcgagattcaatgtccaaccgtgcagcctnnnnnnnnnnagatagggcaggggcgcagcggcatgcgctctcttggcgggacggcatgccttactgatatagcactcgggtaacattggctcccgaacaggcaccggttgctgcgagattcaatgtccaaccgtgcagcctttgatgtgaggggggagccatgcatagtttgcaagcctgcggaacccccattctcccactccatctcaccagacaactccccacctcctctcccccnnnnnnnnnncgatgtgaaaggggagccatgcatagtttgcaaccctgcggaacccccattctccctctccatcccaccagacaactccccacctcctctccccccaccacgcagtcacacacccacccactcgcctgaggctggtctccaggcctatcttggtgagcagggcatgcgcatcccctgccagctccacatcctcctcctccgcccggatctggatgatgcgcgccaggtcctcctcccccgggggcgaggtggagatgatgagcaggcggtccaggaggtccagcgggatgccgtggggcgccgagtaggcggtgccccggatgcgcgtgatgccgcgattggaagccaccaccaggatgggggccagctctgactccagcgcgcggttcaggtaagagaagcactcaatgtccagcatgtgcacctgggagtggtgttttgtttggtgggggaaggggtttcaacctggggagccggggtgaagagatcatagtggggtgagctccgcccaacaagggtcggcaacttcaacacccacacaagcatcccagcccgcgcgccagacccacctcgtcgatgaagaggacgccgggaatgatgtcggccttgccctcctcgcgccaggttgcgaccttggagtcgatctggtcgcgcacctcgctccggatctcgcccgtgtccccggcgaacagcgccaggaagccctgctgccgcgagttgatcacgtcgatctcgtgcagggtcaccacgtgtgtcacctcacgccgccgctgcagctccccggaggggcacaccacgaacttggtggcggggcctgagggtggggcagcggaagaggtgagacaggaggttggtgctgggcagtgacagtgggtgaacagatgtgcacagggatagcctggcgatgatgctgggcctcctaattacatctacaacaagcatgcgactcaaccatgccccatccaattcatcaggaccgcaggcacggcaatcccctccccgagccctcacccatggcgtcaaaatcccgggacctcgcaaaggatcgaccaagcttggtgacctgaaaatgtggaggcggaggtgggtgcgggagaaggtacaccgccatgggcatgcaaggcagctcacatgccccatagacgggtggcactccatgatctcgttctcgacaggtaccctcttagcctggatccttggagcctcatcattgcatgagctatgcgcacggtcccaccctcacccacccaccttgccgctggacttgtcgatggcaatcacgtcgccagcagtgaccttctccttctgtatcgcctctatcatcttcgcgccgagatcgtagatggtctccatctccgtcgtcttcatcgtgagcttgccctgtgacgtgcggtgaaaagggctccacagcatgactactctgcccgccagtgtacccgactgcagccccgagggtgccactcagatgcaaatggatttgactctggcacgccgcgtgcattcctggccacggttgctgcttgccctggtcccccacccgtaacaccatgccacaccgtcttgctggcagaaccggtggcaggccggtcaatctcaatctccaccacctctccctcaatgagctcagactcctccttgatcctgcaatgtgtgccagtgtatgaggactggtcatgggtgatgcgggatcgggcgggagatcttagttcaggctctgactagccaaggagcgcctcaagcgattctagagtaaaccaattagaagaaagaatcaaggacgacttcaggcagctggagnnnnnnnnnnccaggctctgactagccaaagagcgcctcaagcgatcctagagtttatcgattagaagagagaatcaaggacgacttcaggcagctggagtaatgtcatgcagatattatccggtggctgccagcaggctaatcctctgtgcaggagaatacaccgcacccaccggccctcgccagcacccacctcacgccaatggccttgcggaacgcttgtgtcagggcctcggtctttgacatctccatggagaatatctcggaggccgcaatcatggcaaagggggtctcgtcccctagtgactttgccattcccatggcaatggcggtcttgccggtcccaggctggccggccaggagcacagcccgaccagcgatacggccatcctttatcatctgagtgattacaccagcagcctgcaggggtgtttgaggccgaggtcggcatcaacagcctcacactgtatcccatcgactgtccactctaagtctgccacttcccaccttgcgcgctgatgcctggcccaccaggccttgggagacggcgcgagcctccagagagtcatccaagccaaggcctcggatgtgagagtgggcgccaatccgttcgatgcgtgtgagatctttttcctccgcattgacccgtaggtctgccatcgtcttagcacactcttccacagcggttcaggggatcacctctacacaacttgaggatatcatcggtgtatttatcaaatatttgtatgtcttgttcacttgttcatccccccacgattaaaaaggtgtctcccaggcatgagcgcgccatgcatggtgtttctgttctctgctttccagaggtccggtctgcttttaaacccctcccgacagattttgctgggaggccgatcacagtggcaagaggggcgatcgttcctgtcagcgcacatacatcactaccatttactctttctgaaactcaatatcgttcaccatggctcccaagaaggctgacaagtcgccgaccaaggccaaggccgcgaagggaggagtcgagaagccagcgaagaaggtcaagaaggtcaaggatcccaacgcgccaaaggtaaataggcatagcacgcctgcgactgaggtggctcgcgatctgattgccaggagccgaagggggaggtgtccgttggaaggccgacagctcctggcaataccgggtattgtatgctggggcttccgtctgtccatctagtcgctttgcgtgtgctcgatccgtctagtcatcgcacctccttgaacttttccactacgcagaggccactgtcggccttcttcttctactcgaatgacattcgtgagcaaggtaacaatggcttccctatcagagatgcagcttgattgagagacagtgaatcacaagctgggggtgcaaccacagctcacaatgcctgcacgatcgtccttcctgcagtgaaaagcgacaaccccggcattgcgtttggcgagatcggcaagaaggttggagctctgtgggctgccctctccgagaaggacaaggtgagcgtgtgggagctttgggtgtgaccattgaataaagaagctagctcatgatgatccggtgaaacagcctcccacattccctcgctcaatccctactctctgtctgaagtagccacgcttcttttccctcaacaggcaccgtatgagaagaaggccgaggccgacaaggcccggnnnnnnnnnntgacgacagtgccccagccccacgcaagaactcatgctgggatgcatgacccaaccacaacctttctgacaatgtgtaacgacctgaccggtgnnnnnnnnnncgacgacagtgccccagccccatgcaaggactcatgctgggatgcatgaccccgaccacgaccttctgacaatgtgtaacgacctgaccggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggccgctcaccaggcctcgtcttcgtcgattggcgcagggatggcatgtgcagcacacaccatacttgctccgcggtcccttacccccctcccacccaaccctcacccacaccaagctcaccagaagccnnnnnnnnnntgcttcctttccctcaacaggcaccatacgagaagaaggccgaggccgacaaggcccggtatgaaaaggagaaggcagcctacaccaaggcgtagggtgccggtgtcctgttaccccagggtgccagtgccagaggttcctgcaggactnnnnnnnnnnnnnnnnnnnnnnnnnnnnnnnnnnnnnnnnnnnnntggacgagcccagcagctcttgtttcccgggcagcgcgggtgcgagaaacaggcgtctgcctcgaagcacaccccttcacaccctctgccgcgtgacgggagagggccccggcccaccttgcggcggcccgaatcgcagcaccagcatgtgcacgacgcggtccctgcgtcaaaggggggggggcggggagcgttgacggctctgtatggcccgctgccctgccatgcaggacnnnnnnnnnntggcccaccttgcggcggcccaaatcgcagcaccagcatgtgcacgacgcgatccctgcatcaaaggaggggggccggggagtgttgacggttgtgtatggcccgctgccctgccatgcaggacgcacatgggggcgttggccgctcaccaggcctcgtctccgtcgagtggcgcagggatggcatgtgcagcacacgccatacttgctccgcggtcccttgaccccctcccacccacccctcacccacaccaagctcaccagaagcccgtgagggcaaaggtgccgcccaccaccgccgcggcgcgtacgaggaggtgcaggagacccggccgtcggaactcgacgtccatggcgatgggggaggtgtcgtagaggaagaagatgcccggcagcaggttgctggccttggtgtccaccggcgcatagtactcggtgacagagtactggtgcgtgcgcacgtcgccgcgccaggcgccgcggcggtagcgcgtgggcactaccttgacaaagtacttgtcgatgccggtggccttgcggtcgatgcggcgcacgccctccagcgggtaggcctgcccggggtagcccttctccccaaacctcagtgtgtggatgacgtggctggcgttcagggccgaggcgtcgggtgtgtgctgcattgcgtgtgtatgttgatgggggaaagggtgtggggaaagaggggtggtgtaaggcaggcgaagacactcttcgccaagcagtgcatgttgttgccggccgcgagacattgccctgcagggggcgggggtcccagaccgggtgttaatgccacgcaaacctctcctgattcccaccagccccacccccccaaagccccacctccacattcaggtgcatgtgccttgtgaggagggcgccgatgatctccgcctcgttcatggacatgaagagggcctcggggcggaccgagaagtggaggttgcccgccaccttctgcactgccacccagccgtggatgaggcagccctcgtgcgccagcatcgccttcctcctagaaagtgtgaaaagtgggttggcttgggatggcagaacatcaggcttgggcggcgcactgaatcgttcgagcactggggcgaggggtaacccagggctaggacccagtcccaggtgtcgacacgcctgcttttcaaaatcactgcatgggtcgccccgtccaagaaaacaggccagacgatggcatggaggacaggcggcctggggctgacaccgagttcagcaccaaaaccctgctcacatgttctccaggttggccgagcccagattgaaggacatggcaaaggcggactcgtgtgcgtttatccgtggcgggnnnnnnnnnncgatcgctgcgccggccctcagcatccagccgccacttgtgcagctccccgttcctggagcgggggcaggaagtaggaatggacggagtggccaagcacatgcccatattgtgcgagggcaatgatctctgcacagcccgatgcgttctcggggaaagaaggcacacgccacttgcatcccaagatcacagagctccccacctggccacggcaacccccagctccgagtggtaggtgccgctgacgtcgcccgtgtccattgtcagagaggagcagggcagcgcagggaaggtgatgttgaagtgtatgtgcagcagctcgtcgcgcgtcgtgtccaccttcatctgcagcgggagtggtgcagggacagcgggtgagggaggcctgccagcacctggttgaagaccagggcccctggtgcccatgcagatggatgctccccctgcctcccagcccacgcaccgtctgcaccatgtggtagctcaagcatcgatgcgcctctcccgcgaacagcaccacggccagcaggatgccgatgatggtcactgcaggtgttgcatggtcagtcagcggggtgccggggtggcactggacccagacgcaggcaccatccacgcaagcagagcagtcccccctcgcacctatccctccatgcacggtnnnnnnnnnntgcaccatccaagcaagtagagcagttccccctcgcacctatccctccatgcacggtcttttctctcagatggtcctctgcccgggtgtaggcgctgatgcgggccaggcctttggcccgcgccatccctcccccggagcaccaagccggccggcgctgggctgcgacgctcgcgagaatctattcagactccccacctctcagatactgaatgagtaacttgctcatggatagcccaacgcgtgtgcagggccccactgcactgggctgaatgtctgtcccagctctttgaatgcgtcggtcgtgatttacagccccgggggggacctggacgatgccctggccacgcgccacgcgggacagccccacgggaagatgcccctccagccacacacacccccctccaaccattcttgcggtccgcagctgccggcggggcgcaggcgccccctcaccgcgcgcccgggggcaggtaccccggcagccccgcccgcgcgccgcgcagctgctccagcagggcctcgcccgtggcgtggaaggggttgggcgcctcccgcgtcggccgctcgccggggtcctggccccgctgcgcggcggcccacgcctggttctgcagccgctgcgccgcctccgcgggcgtcag

SEQ ID NO: 31730 - DNA, 73 bp, Chlorella protothecoides
ccccagagggccccttcaccatggccgacagcagttgcgtcaaggccacagtccacggcacctactacaataa

SEQ ID NO: 31731 - DNA, 104 bp, Chlorella protothecoides
aggcaggccacatacgccctccctcccaaatagtaaaaagacacctgctagaccaataacaacgcacctgatgaggcccgtacacgttgtttccccgagtgacg

SEQ ID NO: 31732 - DNA, 66 bp, Chlorella protothecoides
cccggatgagcagcctgcgctgcatgatgctgctctctgactcgctttgggggaaggatggcgtgc

SEQ ID NO: 31733 - DNA, 464 bp, Chlorella protothecoides
  modified_base (158)..(408): a, c, t, g, unknown or other
tgtagttttaagtggggacaagcaggatggcaacggaaagtatgcaggcagagaaaccgggggctgggcagcagtgacgacaccaaaatgtgtgtgccctcactgttgaccatatgctgtccagcaagaccgggtgccctcccctcacctgtgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcgatcctcgctctaaatctcacccccccactcacttcatgtaccgcttcacc

SEQ ID NO: 31734 - DNA, 75 bp, Chlorella protothecoides
gcaccagtgagtggtgattggtttgtggagatagtgcagggacaggccccacaggggcaggcactgtgtcacgac

SEQ ID NO: 31735 - DNA, 104 bp, Chlorella protothecoides
gcgaagagacacatgtgcaggacccacatccaggatgtcgacacccagatgttatatgaatggcttaatcatatttatgtattgcactatgcgatgtgagcacc

SEQ ID NO: 31736 - DNA, 61 bp, Chlorella protothecoides
acggattgtacccagcacgcttgcatgaacatgctgtggtcgcaggcttgtaatgacgaat

SEQ ID NO: 31737 - DNA, 111 bp, Chlorella protothecoides
cccaaacatgtcgaggatgtcagtgctcccattgcgcatggtgcaactccatgccttgcccaatgtcctccactgtactttccaggtgtggagaagaagaagagcaagcgg

SEQ ID NO: 31738 - DNA, 69 bp, Chlorella protothecoides
ccgcagctcactgccgcggttaccccccaaacacacgcatcacagccttcacatggccatgtccttctc

SEQ ID NO: 31739 - DNA, 80 bp, Chlorella protothecoides
atcccaagcagacaggcacatccacttccagccagcgcaccagaccccggccccgcccctccccctctctccacacctct

SEQ ID NO: 31740 - DNA, 67 bp, Chlorella protothecoides
taggtgtttgctgtggagagggagtttgcggtgcgccagcgggctttaatggcagggcgacgccgat

SEQ ID NO: 31741 - DNA, 99 bp, Chlorella protothecoides
agccgacgggaagaggtgacaaaggtgtccatgcaagcgccagggaggcaggaaccagcgcggccccggcccaaggcacgcctgactggcagcgcccct

SEQ ID NO: 31742 - DNA, 80 bp, Chlorella protothecoides
cagacagatcgacatggatggggttgtccttcttgtgagttggtatgcttcgtcatgacccgtttccacacttctgcacc

SEQ ID NO: 31743 - DNA, 110 bp, Chlorella protothecoides
gtgccgtcgtggcaccagctgagaggtgcagaagggaggatacccgttcacgaggttgccatgctgcccctggagggatcaaccagtcctacaatcatacagcatcccac

SEQ ID NO: 31744 - DNA, 483 bp, Chlorella protothecoides
ggcccgctgggcacgctgctgggccctggcgcgggcgagggcggctgcgccccgcgtccccgggcatggctcgaagcggccacgctgcacgcctgcgggcggcacgagcaggccgccgcctcctacgctgccgtcctggggtccggcggggccgggctgccccaggccctgcgcctggcgctcgaggagctgcacgcggaggtctgcgcggagctgggcgacgaggccgggctggccactgcgctggaggtggggtggtcggggtggaaaggggggcgctcacggctgggctgggcccggcctccgtgcggcgcgggtccacggctgttttggtcggtggccccaggccgactctgcatgtcacagcatggggtgagggtgggcctggctcgcctccgcccagctccccgatcttgctcccgactcgcgccacacacccccctgcatcctccctggccaaacctggcaggcctggcgggagcg

SEQ ID NO: 31745 - DNA, 61 bp, Chlorella protothecoides
gcacaggcgagcagcagtcccacccccggggggagggcacagcagcccggacctcctcgtg

SEQ ID NO: 31746 - DNA, 76 bp, Chlorella protothecoides
cctggcagggcggaggcgaggattcgagggtgattgactgtgcgaggggtccctccaggagccagcacaggaccaa

SEQ ID NO: 31747 - DNA, 61 bp, Chlorella protothecoides
acatgctgctcactcattcaccctgcatgttgactcttgtctcgctatgtcttgagccaaa

SEQ ID NO: 31748 - DNA, 159 bp, Chlorella protothecoides
gtcagtgacgctgtgcagtggtccgcacagtaatttgccttctttcctaattgatgccctgcatcagtgccccatcgctgatgacactggccgagtgcccacacatcttaccgccccaccaacaatgtcacaccacccacatcatcaacctttcctccc

SEQ ID NO: 31749 - DNA, 72 bp, Chlorella protothecoides
cctgtctccttgtgaatctgtgcgggagcatgtccgaacattgattccatgtgacactcgggagctgctcgg

SEQ ID NO: 31750 - DNA, 62 bp, Chlorella protothecoides
ggtaggaactcgcctcaaccaccgcatcacagaaccacactccccgcagcgcgccctgcgcc

SEQ ID NO: 31751 - DNA, 133 bp, Chlorella protothecoides
cggaggcggagagggtggaggcggagaggggggaggagagaggggggaaggtagaggaagtgatctcactgatggtggtggaggaggagacatgttctttggagggggagagggagacgtcttgttgggggga

SEQ ID NO: 31752 - DNA, 78 bp, Chlorella protothecoides
ccgatgtcgtgtgcgaaagaacgcaaggcaccaagcgcttgcagtattgaccttcagacctgggtgaaccagacccct

SEQ ID NO: 31753 - DNA, 61 bp, Chlorella protothecoides
cctgttgttgatgcgtgtggtgcagcggttccacatagccacctgctgctgcccgcagaag

SEQ ID NO: 31754 - DNA, 61 bp, Chlorella protothecoides
gacggcctgcagagggagcaacgaagggccccgtcagggtgcgcagtggcgcccacggctc

SEQ ID NO: 31755 - DNA, 61 bp, Chlorella protothecoides
tttttttcttttttttttttttttttttttgtttttatttttttttttttttttttttttt

SEQ ID NO: 31756 - DNA, 99 bp, Chlorella protothecoides
caggcacggcattgcatcatgcacactcaacacacaggaggggaaaggggatgcaacaccctgccggcgccacttggctgggcagcagccatcaacaca

SEQ ID NO: 31757 - DNA, 69 bp, Chlorella protothecoides
gttggacaggttgggaggagaggttggacaagttggttcggatgggggatgcaggctgtcttgcgaatc

SEQ ID NO: 31758 - DNA, 93 bp, Chlorella protothecoides
ctgtccagctgcgaggcctctcggtgctgggcctgcaagggggccaaggtccccccctgctcttgtcaacagaggcaccgccaggagctggga

SEQ ID NO: 31759 - DNA, 185 bp, Chlorella protothecoides
taaccctaaccctaaacctaaacctaacccaaaccctaaacctaaccctaaccctgaccctaaccctaaaacctaaccctaaccactaaaactaaaactaaaactaaaactaaaactaacccgggccccggaccctaaccctaaccctaaccctaaggcagggagattgtgggccgtttgcttga

SEQ ID NO: 31760 - DNA, 174 bp, Chlorella protothecoides
tcgaccgccggacgtatcggacttgcggacctcgacttgcagaactctatacacgctttcaggaaggacagtggctcttatggcgagggctcagaggtggcaacgtactccaaccggggcgcttcggtaggcccccggttggctcttgcgtgtacactggcgggcgatccgagg

SEQ ID NO: 31761 - DNA, 87 bp, Chlorella protothecoides
ctccatcagatacacgcctggtgaagcagcgcggcccctacctccccctctctcgacgccgcccgcacctggctgtcggcgaagagg

SEQ ID NO: 31762 - DNA, 84 bp, Chlorella protothecoides
aaggagaagtgccctgcctgccaagcactactctgtgctcgcaaccccgcagggggggtactgctgcggggtactgctgtgaga

SEQ ID NO: 31763 - DNA, 174 bp, Chlorella protothecoides
gcgggtggactgacccaccgtggaggtggtatgggttgcacgacaccttgctgcactgcgcggctgccgttcgtcaacaatcgccgcctgcggtgcgctcatgtactttgagtctatttaatttcgacgttgtgcaaaccgtttgagactggaaggccggacgctcgcgctgct

SEQ ID NO: 31764 - DNA, 86 bp, Chlorella protothecoides
cggggcagggcgaggaggactcctgggtcaaagaagaggtgcaggctcagggccttgaccccagctcccaggctgtcagggagctg

SEQ ID NO: 31765 - DNA, 70 bp, Chlorella protothecoides
cgcgcccgagcgcgtgatgttctcgctgccggccaggtctaccaggtacagcttgcccacccggatcacc

SEQ ID NO: 31766 - DNA, 9627 bp, Chlorella protothecoides
  modified_base (569)..(578): a, c, t, g, unknown or other
  modified_base (873)..(882): a, c, t, g, unknown or other
  modified_base (1353)..(1362): a, c, t, g, unknown or other
  modified_base (1436)..(1445): a, c, t, g, unknown or other
  modified_base (1498)..(1507): a, c, t, g, unknown or other
  modified_base (2139)..(2148): a, c, t, g, unknown or other
  modified_base (3618)..(3627): a, c, t, g, unknown or other
  modified_base (6250)..(6259): a, c, t, g, unknown or other
  modified_base (7644)..(7653): a, c, t, g, unknown or other
  modified_base (7758)..(7767): a, c, t, g, unknown or other
  modified_base (7958)..(8012): a, c, t, g, unknown or other
  modified_base (9182)..(9252): a, c, t, g, unknown or other
cggcggcgcaggcggcggccacggccgcgcaggtggcggcggccgacccggcggccgccgacgccgcgcggtatgggctgctgggcctggtggacgtcatccgcacgccggagtccgacgcgtcctccctggccctgggcttcgacctcacctccctgggcctgagcctgaactccgcagagcccatctggaaggagtttgggtcgccctggggcgagcccgcggggaaggtggacgccgagttcaaggtgaggacgggcgcttttgttttggacgtgggactgccggaaggtggggccttggaaggggtgttctgcggtcgatggactgtggcgccccgggtttcttgtaacggccactcagaagaggccgacctcccaatcccactccatcagcacccctcgtcccccgctgccctgcatgggcttgtatgctgcctcgccctccccctttcctcccccgtgctccgacagtccagccgcaccctccatcccccacttcccaccagatccccgcctgctaccagcacaacccgttgaggctgtcccaggcctacttctccaagtttnnnnnnnnnnacaccctcatccccccccttcccaccagacccccgcttgctaccagcacaacccattaaggctgtcccaggcctacttctccaagtttcagccggacacgctgttctacgtgttctatggcatgccgggcgaggacgcccaggtcctggccgcggaggagctgaccaacaggtgcctggtctttggctgtgatggtgttttgtgtgttggaaggggggaaaggggtggagcagtgggcctcgacgggcctgggcctctgcgggggaggaccagtggccatcctcgccggtcgcannnnnnnnnncaaggggggataggggtggagcagtgggcctcgatgggcctgggcctctgggggagaggaccagtggccatcctcgccggtcgcacctgcccctgtgtttgcaggtgtcttgggccacctggccccctcaggctcgccgcgcctcaacaaagccgtaccctcgtcacgctccccgctccctccaccgttcccaggggctggtacttccacaaggagctccaggcctggctgacgatggtccctggcactgatcccacccagaaaacggaccggtgtgttgctgggtcggggaaaggagctttgttgccgggatgtccacggcagggcttgcgggccgataaaccggcgaggggtacggtggatccaggcccagaggtggatgctctgagaggcgctcgggcgtcccctccgcccatcagacccacggcgttgacaggggaaccactcccatcactctccctgacacccacnnnnnnnnnnggaacccacccagaagacggaccggtgtgttgctgggttgggaaaaggagctttgttgccgggatgtccacggnnnnnnnnnnccgcagcccggcctgcaggccagggcttgaccgctgcgcgctcgcaggctgcnnnnnnnnnngcggggcgccttcttcgtcttcgagcctgccacctgggaggtgacgcgcaaggacaactttgtcgtgcactttgagcacctggagcgagcgcccccgctcccgggcaggtcgcagcccggcttgcagacccgggcttgaccgctgcgcgctcgcaggctgcgagcgccgggcacctacgcgtgcccgggaccatgcgagtgcctcctgcatgactgggaagtgcatggaggtggtctgatgctctggactgcccctatggggctccagagtgcaccttggctggtgctgcaacccaatcctgtggaggggcgataaatctcacgcgttccaccgagagcgcgatgaaatgacgaggggccgtcaccagatccccaatcgcagtcaagtcccgcctcccagtgctccaggagcgatcattcacccgtttaaaaggtctgacattctgaaatagtgtcgcaaaccttctgattgacctcacagggcaagcgacttctcggctacaggtgcctcatgtccaacgcggagcaggtgtgctcgcgaccatgctcctgggtgcacccctcgttacattcaagacgaagagttgtatatatccatcccctcctgcatcgtgcctccccgccgcagtggnnnnnnnnnnacgaccatgctcctgggtgcacccctcgttgcattcaagacgaagagttgtatataaccattctctcctgcatcgtgcctccccgccgcagtggtttcggatcatcgacaaggaccgcagcgggtcgctggacgtgttcgagctgcagaatgccctggccctgggcaagatcaacttcagcctgaaaaccgtgcagtctgtcatgcgattgtatgatgcggatgggaacggcaagatgggcttgccggagtaccaccggctgcactccttcctcagcaacgtcaccctggccttccggcgctacgacaccgacaacagcggcaacctggaccaggcggaggtcaagatcgccctgcgggatgcaggcttcaatctggacgatcccgccttcatagccctgttcaagtcctttgaccctgacaagtacgtctgctggttgtgcaggaacgggatggcgggatgggcgccagtgacgagaacatcgactctgttcatgccttggccgacgcccacgtccatggatccccctcactcccctcccccacctggtagcaggtccaactcgctgtgcctgacggagttcatggggatgaccatcttcctgcagagcatcagcgcggccttcacagcatttgaccccaggcggaccggccaagtgtccctcaacttcaaccaggccgtctactttgtcagcaattgtacataatatgacctttggtgccttgttgactgtgcgtcccacccttgacatgtcgtcatcgccgcccaggctctctgcttcatttggtcccgttccgtccctggcgctggctgtacctctactggcagcgtggccttgcttgcctatactcctttcctgtgctgggaaggacacctgaccaccacccacctctcattgacgtgcttgctggcggctagcagactcctgcgggctgtcgaaacctttttgtaggaacaaggatcaaccataccaaacagccggtacatgcgcagatagcatctcaacgctcactcagcgactctttcctggcaaacatgtcgtccactcgggcgggcagtcgtgccggggcccccaccatttcttgtccagggaggggaaggtggaaagcacgagccaaactgtgcagcaaggcgctctcgttcttgccccgcacatccatgcaggccatgagtccaggcacgtcggcgcaccccgcaaaggtttcctgctctgcattcccaagcgagtgcaggagcacggcgccatgcactcctgcatggcggttggtgggcagggcgtggtaggcggcaggggccgagcacccagccacatgcatgaaggttgaagctggcacggagtcccaacaggacctcatgcaggatcctggctctgttcggcaagacacaggcagggtgttctccagcccagtcgccaccccaataccccccaacacgggcttggtgcctaccggggtcaaccagcatggaccnnnnnnnnnnccgagcacccagccacatgcatgagggcggaagctggcacggagtcccaacaagacctcatgcaggatcctggccctgtttagcaagacacaggcagggtgttctccagcccagccgccaccccgataccccccaacatgggctcggtgcctaccggggtcaaccagcatggacccagaggctgtttggagcaccctgcgcccctccctgtccacgccgagcgccctggcacggacttggaaggggtagaccggctctgacggctgcgagctgcttgctccagaggccgcagccgcagcctcggcacgagcccgggcctctgccacgagcgctgcctgctcctccagggtcatgctcctcccatcgcaactgcaatattgcgtgggggggattagcatgtggttgggtctggggcaagggatcgtacaccgaggcgttcgactccctcccaaaagccgagtgtctgctcagaacggcacctagactggggcatccaggattcaggcccctccacagcctacctggcaaccagcacggcgatttcttggtcgcgcgcagccaggatggccgcgcgcgtggccttcctcgcctggtggcggtagagggatggggagagggtgacacggctgtgaccgatgtcccatgcaatgccgaggcgcagccacacgcatgcggggcgtgcaggcgccagctgcctggccagcggccgcctccaccccccggaccaacccctcccacctgtgccagctcagccttgcgctccttgctctcctccgcctggacctccatcttcttctcaataatctccctgtacgcatgcagagagaggtgttttccgccactccagcagggtctgctcagccaagtggcagtgtcgctccgtccggagcagtgcggcaggctctcgtcatgcgggcgccgacaggcttgaaaactcggccccttccctcccaccggaaccgacctgaagcgccaggtgtccagcgcgtcgtgcaccagagcatgcagcatggcgacgcgggtctccgccgccagtccccagtaccccccggcggggtactcggtgagggcagggggggtggcgggggcgcacgccctcgccgcccacggctccgcacccggcggcagcgtcgccaggtggcccgccacggcggcgggggcgtcgcgggcggcgctctgcgagggcgtgtccctccaccgctccaggtaggcgagcatggcgggctgccaggccgtgggtgcgacggggcccttcacctcccacgcctcccggacctggcacagggagcagcaggaggggccgggttgtagaccccggtgattccctcattcgtatcgcgccaaatgagaggagatcgaaggtgggccaggtctcccgaaggaagacatggccacctgctgagccccttcaccagcccccatctccaagggtgaagaattggcttcgccaatgccgggccacataacaaaagcaagcgccgcgacccaccgtctcgagcaggcggcagtgcaacgcggcgcactgggaggaaagggtgtcgggggccgtggcggccgtggcgagcagcagctcggcggccaggaggggggtggagaggccgcgcagcttcaggccgcccgaaaaggcctcgacaaactccagcacctccagcagctggggcaggcacggtgcagcggggagctggaggcgagccgggaggctggcggcccaaccggcgccgccccgcctggccggcgccttgtgaccctggcggccaggcgccagggcgacgcacagcgccagcacttcctgggcggcggtggtggtggggtggacggtgcaggggttggtcgtgcggcgggctcgtaggtggtttgcgtgcccttggaaaggcaagggctgctggcatgctgcatgatcctgtgcagtcaacgggaggctccaccagcggctgaagctcgatcaagggcccgaatgcatgctcaccggcaggggatcgggccggggccccagctcggtgtcgtcaaggagttctggcgtggcagcggtcatcgcagcagccccggtcctggccctcttcacggccggcgccgcgccgcttccctccctgcgccgctccgcactgagcatgctgaggcccttggcggtgggattcttggccaacagctccgacacagattcgaagccggccgtgcgggccacggaggccaagatcccggtggcctccagcccttgcttctgcggggtgtgtcatggtatgtgcttggagcatgttggggaacagcctgggctggtaccgccttccaaacagatcctgtctaggggttctggcctgccagcaccgacaaacatgccagctgtgctgcgcactgacaaagagttccctggcgcattcaggatcgtgtgctgccctggtgcctccccctgttacgctggggattacactgcccttaccttgcggcagttgctgcagttgcagatgctggtgcagcgtgggcactgccagtctcccagagcattgacctggaggtgagcagggaagtgacgcacttttcattgcgtccctgatgaaggatgcactgccgagagtcaatcgccttgatcattgctggtctagttctgctggggaatgtggggcatgcnnnnnnnnnntcctgatggaggatgcactgccgagagtcaatcgccttggtcattgctgttctagttctgctggggaatgtggggcatgcgggttgtcccaggccaaggggcaagcatccctcatcctcccaccaagacctcacctcagccacaaactgcttgtatcgattctccaagcaccgaggacagaagtagagggtgcatttcgtgcactttgccttcacctccaccgtcttctgccggcactgcagcggaaagttacggttgcaggtttggggtccgcgaacaccatcatctcaccagaggcaccttccccaagcgaagatgcccgtcacagcctccgggccagagtccatctctgttcagacttagatgcacaattcagaagcagagcatatcctcccagccaccagatcacagtacctggtggcaagtcgtgccgttctcgctgtcatagattcgtccgccctggtgcctcacccctgggttggccgttctctgcttctttgccacaggggcctctgcaagtagggacagagaggaaccactcggaggctcgatttcatcctcttggtgtgcaaggtcttctgagcctgctcgcttgccagcttccagggctgcaccgccctcagcacacagcttggcaagccagccaggctatagcagcacttaccaggaggaggagcagctgcttcaaccacagctgctgcaggtgccacccttggcattgttgggtatcgaagcggccgaggcgctcccagtcacgccctgtgcttcgtgaggatttgactggcagctgtcgctgggtggcgcccactcgggcagtcgaatgtcagccaatgaaactcaagcgcacaagaaatagcccattgaacacccgatctcaaggtggcataacatgcactttgagctgggagtcaccatcgcgagatccgtgcggcctgtcccgatcactcgagcgcagtttgtatgtctcccgccagtcgattctgggcgcaggctcgtcccatgcggcactgacaagcgatggcgacatcgggcctgctgcagcgctgtggcactttgaaacaaagcatgcattacatttgaaggtattaagatcttcgcgatttcgactgcattgggtcctaggcaccactcggtcatccacgctcgctcaggtcatttgtcgactgtacactgaccatcgaccagtgcctgatcgccagcgccctgtgcgcagctggctccatttgcgcccgatgcagctgcgggctcatgcatgtctggtggcgtgcctcctcatctcggctgtggttggggctgtggcggtgaccagcgaaacccctgtcgccaagaccaggtctctggcctttccgtttaacgtcaatttcaagcctcaggacacttgggcnnnnnnnnnngcattcctacgaatgtcttctggaggggctcaggcaattgtcacagtttcgccttgccaagacagatggaaaagcaccccattcattcactctcccactctgcannnnnnnnnncgtcgccaagaccaggcctctggcctttccgttcagcgtcaatttcaagcctcaggacacttgggctcccgaggcggtctttggcgtgtttgttttccttttcctgattaacatttggcgtgggaggcagagcaatgagcgccgagcaatcttctgggccacccaggttggctggatgtcctggggcaagnnnnnnnnnnnnnnnnnnnnnnnnnnnnnnnnnnnnnnnnnnnnnnnnnnnnnnngctcatctcggcggagagccagctgcctgacaactttgccctgatcggtcccggcaactctggcgagggcgaggtgctggtccgtgagagcatgaacatatactgcgtgcatgtctccggccgccgctactgcaaggtgtgcatgggtcatgctctcatgtgcctggatctggcgtggccactctctgggcgcggcctgcagcggtcaggggggcaggtttgcctggtcaactggcagccacgccgaccatgcgtcaacaccccctccccacttggacgcaccgcagagtggccgcctgaccttcttcttccggaagcgacaggacctgctggcctgggcggtgagcggcattacccggtccccagatgtcctggacatccaaatcgacctcagcccagggtctatcccgcctctggtcctgctgatcgcaagggctggccatgccaagacactggccaaggagcaggccgatgtcaaagtgaggaggagcatgcttcgggctgctttttcttatggagggggtggtgggcgagtgatttgtgaattcatctcatgaaggagttcagtgtctgtatgcagaagcccctcgacagtctggtgtgcccacgatgacatcttgagccaccaagcctggctgatgtcgggatcttctgtgacaatccggcacattctcctgctggctgtcgcccagctagtttcacgctctacgaccccacccaatggacagacgttcaccaagttgctggaggtgaagaaggaccgcctggcggcatggccatccatcgacctggcagtctacgccgagcaggcatccgccttctacgacctcatgacgccctacctcctgagccactcctttgggcaaggagcctgggaggagttggggacctgcttccgccacctccacatcaccagcgagggccagggtgacgataccaagcaggcgagacgtgcgggggtgggattgtggtggggggagggttgaggtgatggggtggtgtcgcgagaatggtgccatcactgttgctgaaggggccaatgctggatcatctgctgtgccaccctggaccctgcttccctcttcacattatgttgctctcacccccagctttggaaacccagaccacatccacccttgcgacgaacagttcatcaatttgtcgctggannnnnnnnnnnnnnnnnnnnnnnnnnnnnnnnnnnnnnnnnnnnnnnnnnnnnnnnnnnnnnnnnnnnnnnagtggctgagggctgtcatcatcctgatcgattccttaggcacattcaagttcacaccaggtacctctcgctgcattgttctggggaggggaaggaactcggtgggacagaggagagtcagagtggcaattctatggtatgtccacgcgactgactccagcgccctgagaaattgggactagagttattcctcgatgctcagcacgtttaccctgcatgcacatccatgcgcagagcaagcaaagcgtgcggcagagaacagagcgaaaaaggaggttctggccctgaaagctgctgagcagaagcgacaggaagagctgatggcacggcgagagaagaaggctgagcaggatcaggtgggatctctcggggggg

SEQ ID NO: 31767 - DNA, 77 bp, Chlorella protothecoides
caccaccaacagataaaagattccatggccagggttcagcacacccacccacctcacccacccacccaccttgcgac

SEQ ID NO: 31768 - DNA, 156 bp, Chlorella protothecoides
ggacagtcgcagggctcatgcgcgtgacgccaggctattggacctggacctccacctcaagcgtcccacgcagtcactcgtaagccccacctgtcccccttgcaatcatacccaacccccggaacccccgctcaggtgatctccctggcggcagac

SEQ ID NO: 31769 - DNA, 108 bp, Chlorella protothecoides
aagctctgctctggaagggtggcaagacactcagatggcctctcacacgagcagctgatgctagtggccctcatcgagaggtgtacatggctgtaacaattctctggg

SEQ ID NO: 31770 - DNA, 62 bp, Chlorella protothecoides
cattcctcttgcacctgcggggacggagagtgacggcaggggtcggggactttccaacagga

SEQ ID NO: 31771 - DNA, 401 bp, Chlorella protothecoides
  modified_base (115)..(338): a, c, t, g, unknown or other
ccagggggggcgcggaactgctccgccagctggttgatggcccgctccctgccgacataggcctggtgccggagcttgcggaatggcttcccgtccctgtgccaggccaggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaccaagttgatgtccaacagagactccacgaggtcaacggcccaccgggacaggcgcagac

SEQ ID NO: 31772 - DNA, 61 bp, Chlorella protothecoides
ggaaagcatccacctttggcataccatgcatatttgctgcaaacgtaacgtgttttacagg

SEQ ID NO: 31773 - DNA, 101 bp, Chlorella protothecoides
atcgacaggcacaggttcataccgagcaacaagcttgtacatggcacattcagccttacgatagagcctctcagttcacaaccgccccaccccgacctctt

SEQ ID NO: 31774 - DNA, 93 bp, Chlorella protothecoides
ggggtgggagctcgaaacaggcaggacaatttacttgtatgttaatgaacgcatgcagacgtggagtttcacagttcccatgaccgtgaacaa

SEQ ID NO: 31775 - DNA, 68 bp, Chlorella protothecoides
tgctcgcgtcggcgcagccgtcccccagccggcgcgccatccccaccaggccctcacagcgaaggcga

SEQ ID NO: 31776 - DNA, 61 bp, Chlorella protothecoides
acaagatcacaggcatttgttacgttgattgcgagaacaccgcctgctgtcagctgggtag

SEQ ID NO: 31777 - DNA, 147 bp, Chlorella protothecoides
tcaaagtgaggagatggggtggtgtttggatgttcgggcctcaatttttgcctgggttggtctgtcacgataagcgggaagggggcctcctctcctgggaatggtgtaccagttgctggcttctccatggccatccaggcaggctcg

SEQ ID NO: 31778 - DNA, 80 bp, Chlorella protothecoides
tcagcttgtcacgtgcagtgttggcggtccccctctccgcgaagaggtcagcatgaagcctgcatctgtcgcattcgtcg

SEQ ID NO: 31779 - DNA, 74 bp, Chlorella protothecoides
caaacatgaactggcaacacatgtggagtaatgcaggaacagacgggctaatatgtgtaggcaagggcgtggac

SEQ ID NO: 31780 - DNA, 146 bp, Chlorella protothecoides
tgtcccaaatccctgcatagagggccttgggcgtcacatgagaacagaacatgcacccacattttgtccatgaacctctcctgacctgggagtatgacgtcctgatggccacgaagcattacaaagcccacggaggcctctgaatc

SEQ ID NO: 31781 - DNA, 117 bp, Chlorella protothecoides
ccgacgcgagcctagatctggaggtgggtcgtgcatgaggccgggccgtacgggactggacatgtgcaacgctgcccctgcacctcgttcacctccgccccttgccccttgcagagc

SEQ ID NO: 31782 - DNA, 65 bp, Chlorella protothecoides
aaacctggaggccctgggaccattttccggtcaattccctcggtgccggagccgagccctcctcg

SEQ ID NO: 31783 - DNA, 61 bp, Chlorella protothecoides
tctccctgctacaaggggatcagtgggaggtgatgctcatggatgcggccgttgggatggg

SEQ ID NO: 31784 - DNA, 112 bp, Chlorella protothecoides
agcggccagcctcacgcccgcatcgatgggcgtcagagatgcaggcgaggggagtgcagcagggattcttggcggtgaccctgccctgcccccgctgctcgagtccgcccct

SEQ ID NO: 31785 - DNA, 108 bp, Chlorella protothecoides
gcgaggtgtgggatcctgcggaaaggtcaaagggggtgaggtcggtagagggggtaggcgaccgtgtacagcgtgcccctcgaccacaccgacccagctgctcgaggc

SEQ ID NO: 31786 - DNA, 138 bp, Chlorella protothecoides
tggccaagtacgttgcggagcatgagccccggaccctctcctatgagctggccatcgccgatacagaccccacactgatgctcatccacgagaggtgcggtgggggggccacatgggatacagtctccttgcccttga

SEQ ID NO: 31787 - DNA, 110 bp, Chlorella protothecoides
ccttgccaatcgagaatggaaacatacggacccaaaacgtaccaatgtgtatctcttcaatcaccaatcattacctgaatagtaagtgtctgggcttgggataaggaagg

SEQ ID NO: 31788 - DNA, 62 bp, Chlorella protothecoides
tctccctgaacaagcagggtgcccctccacaggtcgcggcaacgcgcatgctggctattttc

SEQ ID NO: 31789 - DNA, 117 bp, Chlorella protothecoides
ggggaggtgttcagggggctggcatgaatgcgactggggtcctgggcaggggcaggggaataggcccgctgccggtgttgatcgatgcatggcagctcacatgcccgcacagcgatc

SEQ ID NO: 31790 - DNA, 61 bp, Chlorella protothecoides
gggagaaccggcccatcacatacaagtatactgaccgcacctgcttgggagcttcctgcag

SEQ ID NO: 31791 - DNA, 132 bp, Chlorella protothecoides
gccgtcgtcctcctccatcccaggccgctcgtcaccatctcatgcatggcccggactcggcatgaggtccgctggcggtgcgcctaggcgccactccatgaagtcccagtttcattgccagatcagtacgtg

SEQ ID NO: 31792 - DNA, 92 bp, Chlorella protothecoides
tccaagggtcggctacgaggaatggagagggggtgtcatgtgggttcagccaagcaagggcggttaccttcagctggcacttgcgcttccat

SEQ ID NO: 31793 - DNA, 430 bp, Chlorella protothecoides
  modified_base (93)..(102): a, c, t, g, unknown or other
  modified_base (157)..(313): a, c, t, g, unknown or other
gctcctacaacatgactcaccccataccactatccccctgtacacacatctgcaggcggggaccccctccagaggatgccaagatacacaagnnnnnnnnnncgacatcctgctcatccaaggagctccacgccatgtcggggtccaagcggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccctccacacaacccccacctccttcccacaggtgccccacctataagacagcgagcaccgaggtgctcctgtcgcgggtcgtgtggatcgtccccaccttgcgagagggcctgg

SEQ ID NO: 31794 - DNA, 101 bp, Chlorella protothecoides
tttatgagtatttcgagaaataaatattccttgcggctgaatgcgtgagattttcagcaggtatgagctgcatggtcaccatcaccaacctttcttgatgg

SEQ ID NO: 31795 - DNA, 113 bp, Chlorella protothecoides
tcacgtccatgtcggcctccgtgccctccggccccccgttcagcagggagtcgaaatcgtcttccgccagcggtacgcccacgggcgcgccttcctccatggcctcgtccgag

SEQ ID NO: 31796 - DNA, 61 bp, Chlorella protothecoides
gtaatgttcgagtggctggggcagggcgggggtgcatcggtgtgtggctccaaaccccagc

SEQ ID NO: 31797 - DNA, 78 bp, Chlorella protothecoides
ctctcgggggacgacacatatcttgggccctccctctcgatccctagcactcaccccttgatagcatcctcgccctgg

SEQ ID NO: 31798 - DNA, 72 bp, Chlorella protothecoides
gtggccatgcgttgtggtgtgagttgaaggtcacggatgagagccgagggcctggctcgcaatgggtgagtg

SEQ ID NO: 31799 - DNA, 142 bp, Chlorella protothecoides
gggggtgagtttgattgtgatcatgacggattgatgtccgatggcatctctgcggctggccgataggaagggggcgtcgcggtgcctgcatggccttttacctgcaaactcctcaccacaggatctggagaagaaaccattg

SEQ ID NO: 31800 - DNA, 105 bp, Chlorella protothecoides
cccaaccccttccggccaccggatggggaactctggcaagcaccgtgcaggacttgaccacttccacttgccaaaaagaccatcgcataccggtcatggagagct

SEQ ID NO: 31801 - DNA, 61 bp, Chlorella protothecoides
cacttgtcatcagatcgggaccttgtgaacatcccgcgccctcctccggccatgccatgct

SEQ ID NO: 31802 - DNA, 61 bp, Chlorella protothecoides
cccctttctgcgccgtgtggggaatgcagtaggatggtgtgccctgggaatgccagggaag

SEQ ID NO: 31803 - DNA, 75 bp, Chlorella protothecoides
cctcctgtgagttttgagagtgaggtaggggttccgttgatgtcagcatcgggcttccgaatgagcaatcggcgc

SEQ ID NO: 31804 - DNA, 61 bp, Chlorella protothecoides
tcgccgatctccgtccagaggctgttcgccacgcccgccctggatgccatgccgcaccgac

SEQ ID NO: 31805 - DNA, 61 bp, Chlorella protothecoides
tggcgctttgatcgctggtgagcggctggggtccggcacctgtcttgccagcctggcacgc

SEQ ID NO: 31806 - DNA, 71 bp, Chlorella protothecoides
cgtcgtcggtcacgagctggccctttggggggacctaataacgtcgccgatcgggcgcgagagaggtagcg

SEQ ID NO: 31807 - DNA, 77 bp, Chlorella protothecoides
ggatgagggggccaagcgcgactgagacacaccaccttctttgtgccgaggaacgtgcctgcactccagcctgtgac

SEQ ID NO: 31808 - DNA, 79 bp, Chlorella protothecoides
agcgatgtgagatgtcgtgacacagtgcccacccctgtggggctgccatttcgcaatggtcttctcccgccgcttggac

SEQ ID NO: 31809 - DNA, 74 bp, Chlorella protothecoides
aggcgccgagaatggtgctttgccaggcgccgagaatggtgctctgccaggcgctggcaacggtgcctcgccag

SEQ ID NO: 31810 - DNA, 345 bp, Chlorella protothecoides
ccggaagtgccggcaggaacattggtgagagggtgcatcgtgcacttttgactgtgatgggccgggatgctctgggagaccacgtcatgtagagcgtggacgtctctgcctctgagtacagaccctccatgctcaaaacttactgtaggccactgtctttgcggtgtatgacgaggccaaggacctgcagtacattggcttttcaagggatctgaaaaactcactccgcaccgtgttctcccgtcgccctgagaagactcatcacatcaggtgggtgacggggccaagaggaaaagggaggaacctaattcgaggactgtatgatccactgtcacaatctaccag

SEQ ID NO: 31811 - DNA, 238 bp, Chlorella protothecoides
tactgtttgcgattcactctccctgcgacttccgacaacaccctttcttcacttgttgacaaaacccctcccagcatgttttgccatggaggagcctctgatggagtattgattgaaaggtcttaaaagcacgaaatagtatagtgatgctgtggcacgccatttgttaccacgcaattcactcttcctgcatctaccaccctgatccccagtggggactccaccatcagcaggacaa

SEQ ID NO: 31812 - DNA, 203 bp, Chlorella protothecoides
gggtgatggcaaccactgaagacccgtcagcgttgcccagacccctcttccgagcaggagctccaacgtgctcctcggcccctccgccgcgtgtggcgccggcgcagcgacaccgcgcccggggtgcactgggtgccgctctccgtgcactcctgcacccgcgtggccaccgcggtttgactccactggcgttccccacttcc

SEQ ID NO: 31813 - DNA, 76 bp, Chlorella protothecoides
tgattcttgaatgtggccatggaggagttccggcgtgaggtatgacaaggctcgcaggaaaactgcaccattggcc

SEQ ID NO: 31814 - DNA, 104 bp, Chlorella protothecoides
atgaggagccgtgggatgggcgatagggagtaagagtagaccttgaagtggtttcacacgctgccgaaccccgagcgacgaagggtgcacacgccacacctcat

SEQ ID NO: 31815 - DNA, 61 bp, Chlorella protothecoides
aggatgagggaaagaagcagggaagcagacaaatgcacaagcctaccgtttcctcactttg

SEQ ID NO: 31816 - DNA, 80 bp, Chlorella protothecoides
caccacgctgatcgaggtctgcgcccgcactggcgacgcggaccgcgcgttgggcgtctacgcgcgcatgctggccgcgc

SEQ ID NO: 31817 - DNA, 129 bp, Chlorella protothecoides
gggtggagcagggcgccagggcgcggtcgtcggctgagtatctggggttgagacgttgcagtccagcgaaacaagtcgattgttcaccctccatcaagcgtgtatgccccaccaagaggtccattcgag

SEQ ID NO: 31818 - DNA, 105 bp, Chlorella protothecoides
gtcggggccgacgcctagtggtgagtgtgtggttttggggggggaggggggggtcgttgatggggactctcaggaggggtgactgtcgaacaagccatacttcat

SEQ ID NO: 31819 - DNA, 76 bp, Chlorella protothecoides
tcgccggccgtgatgcagcgcaggcgccgcaccgtgccccctaccccgcgctcggccaccagacgcaccgcgttgg

SEQ ID NO: 31820 - DNA, 61 bp, Chlorella protothecoides
gcgtggggggtttaatgggtggcggggcggtgtgtgcctgttgagaggggagggaaagctg

SEQ ID NO: 31821 - DNA, 70 bp, Chlorella protothecoides
ccgggcccgcaccggcgttgggcttccgtgactggatcgcgcaaggacccactctcccgtcgggtgggca

SEQ ID NO: 31822 - DNA, 61 bp, Chlorella protothecoides
ggcgtgtgcgtgtgtgtgtgtgggggggggtggagggtcacaggtctggaagacgggcgac

SEQ ID NO: 31823 - DNA, 70 bp, Chlorella protothecoides
gacgcccacttgaacccttcgcatcgatggtccaggcactcacccatcaacacaggcgatggtgggcatg

SEQ ID NO: 31824 - DNA, 67 bp, Chlorella protothecoides
aattgatgtcacagctctgatggcacttggctctgaccattcgacctcgcgcaatgctcgccaggca

SEQ ID NO: 31825 - DNA, 61 bp, Chlorella protothecoides
cagcgaggggttcctggccctggcggcgctggccggcgtgcctcaggtgcggatgcaagct

SEQ ID NO: 31826 - DNA, 159 bp, Chlorella protothecoides
ccccatgctcgtcaggtgggcggtgccggcgcggcgccaccgcagtgggtctgggcaggcttgcgcggcccgccggggcgatggcaggagcccacaagggcgccgtggtgtcctacctggagggaactctgagggatcccagacctccgctcccatcac

SEQ ID NO: 31827 - DNA, 235 bp, Chlorella protothecoides
cggaatgacggtatgttgccgaggctacatggtcctgatcctgtggacggatgtgcctgcactggtgtatgcaacaacatcacgaggctttcatcaagtgcatgtggccctcctggtcgatcccacgcccaaacccaatagaaatccagcgacagatcctggcaggctgtctcaccccttccatccactgagcacatccccctcgttcagggccagctgcaggccgtctggaggc

SEQ ID NO: 31828 - DNA, 61 bp, Chlorella protothecoides
agttccgtccacgacacaccgcatcactcccactgtaccaaaccccctcctcaaactcccc

SEQ ID NO: 31829 - DNA, 61 bp, Chlorella protothecoides
atgtccagtacccatcgatgcaccccttccgcccaggagctggagcgagaactcaagttca

SEQ ID NO: 31830 - DNA, 71 bp, Chlorella protothecoides
gggggcggccacccgccctgtgccccattggccatgcacaaaggcttgcgccaccagtgtgcccccccccc

SEQ ID NO: 31831 - DNA, 61 bp, Chlorella protothecoides
aagtttccctgcgtcttggtcatggcgggggacttgtaggacaggaagcgcttggcgccct

SEQ ID NO: 31832 - DNA, 16055 bp, Chlorella protothecoides
  modified_base (571)..(580): a, c, t, g, unknown or other
  modified_base (1371)..(1380): a, c, t, g, unknown or other
  modified_base (2351)..(2509): a, c, t, g, unknown or other
  modified_base (3741)..(3819): a, c, t, g, unknown or other
  modified_base (4035)..(4044): a, c, t, g, unknown or other
  modified_base (4173)..(4300): a, c, t, g, unknown or other
  modified_base (4572)..(4581): a, c, t, g, unknown or other
  modified_base (4710)..(4799): a, c, t, g, unknown or other
  modified_base (4986)..(4995): a, c, t, g, unknown or other
  modified_base (5280)..(5289): a, c, t, g, unknown or other
  modified_base (5672)..(5681): a, c, t, g, unknown or other
  modified_base (9264)..(9273): a, c, t, g, unknown or other
  modified_base (9445)..(9570): a, c, t, g, unknown or other
  modified_base (9702)..(9711): a, c, t, g, unknown or other
  modified_base (12197)..(12325): a, c, t, g, unknown or other
  modified_base (13068)..(13077): a, c, t, g, unknown or other
  modified_base (13405)..(13414): a, c, t, g, unknown or other
  modified_base (13494)..(13503): a, c, t, g, unknown or other
  modified_base (13568)..(13577): a, c, t, g, unknown or other
  modified_base (13790)..(13799): a, c, t, g, unknown or other
  modified_base (14024)..(14033): a, c, t, g, unknown or other
ccccccctcgcacacccctgcagcttcaacttcctggagattgtggagctgctgaacgtcgtgtactgcatggccatgctcctggagtttgcggccttcatctggctgcgcatcaagtgcgaggggggtggggagaggctgggaggcgtacatcatgtgtggcatgtgtggggcccctcggacatgtccctggggcgcctgtcgctgcgtgaagccatcaggaatgcgccgtacgattgcagggcggtaaggatgcccaaaaaccctcctcctcatctcgacaccccaggtacccgagcctgaggcggccgtacagggtgccgctgccgctgtggggctgcgcggccatgctcctgcccgccagcgccctgctcctcattctgctcatcgggcccataatccaggtgaggggcagcgggcaagggtgctgctaagctcagccaggctctgacctggacggcgggttgagctcatgatatgtcatcatggcctgctcattggggcggtgcgccatctgccgagagatccctcgcgatcctgccggcaccgcccacccccacccctgcatccnnnnnnnnnnccatgggggcggcgcgccatctgccgagggatccctcgcgatcctcccggcaccgcccacccccacccctgcatccagggcaagacgtcggtgatcctattcacggcgggggcgtgcgtgctgggctgcactctgtaccccctgctgcagaccgcgcgcgcgaggggctggatggccttcagggggacttcgcccagggagttccgcgagatcctgtactccatgtacagcccggtaccggaggcgcccgccgccacagcaccacccacctggttggagaatgaatgacttgcgcactgaataacaaatcgggcgcgcgcacgttgtacacccttaccagcagcagagctgcggtaaaggtcgatggagttggaccccgggcgacgagatccccgtcggcacagtgtcccggcttccgacactctccgacaccgccatggaccaccgccgcggtgtcgcatggtcgctccagttttcgccgttcatcgcatcataaagatagtctcccggtccaacacgacagttgcgacgttggcttgtcaagcgcgacagtaggatcgccctttaatcctacgtatgcagacggagggtgatgcggataaacaccccggttaggcatggggtgtacgcaggatataagaagtacgccagtcccctgatcgaccgattattttaacacaacccttaatttgtatactcgcattctcacccatccctttcggcagcttcactcctcccgatggctgcccctcccgaccaccccagcgagggtgtgctgagcggcacctccnnnnnnnnnnctataagaagcacgccagtcccctgatcgaccgattatttttacacaacccttgatttttatactcgcattgtccccccatccctttcggcagcttcactccttccgatggctgccactcccagcgagggtgtgctgagcggcacctccccctccgacaccatgcgcgcctggttgtcctccctggacagcgccctgcgtgcgcgtgacgccgtgaccgccgcctccctgttcgaggaggagggcctgtggcgcgacctggtgtgcatgacctggaacctgaagacgtgcgagggtcggggcgagatcgcggccatgctgggcgcctgcctggaccaggcctccccccgcgactggaccctggagggcgaggccaccgccgcctcctcccccgtcaccggcgacacggtggagggctggatccggttccgcaccgccgcactggagtgcaagggttacctgcgcctgcgcgcgggccgcgcctggacgctgctcaccgcggcgcagggcctggtggacttccccgagcccagcggcgccaaccggcccatgggcgcggagcacggcgcccggcgcaaccgcaccacctggctggacgagcgccagcgcgaggcgcgcgagctggggcgcagcgtgcagccctacgccgtgatcgtgggcggcgggcagggcgcgctggcgctggcggcgcgcctgcgccaggcgcgcgtgcccaccatcgtgctggagcgcaacgcgcgccccggcgacagctggcgccggcgctataagccgctgtgcctgcacgacccggtctggtacgaccacctgccctaccttcccttccccgacacctggcccgtgttcacgcccaaggacaagatcggggactggctggagatgtatgccaaggtcatggagatcaactactgggccagcaccacctgcaagaaggcggagtgggacgaggccgcgcaggagtgggccgtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgggccaacaattccaccccgcaggaccccagttcagtcatctcctcaagacccttggctcaccccatccaccgccctacaattccctcagaggacatcacgctgcgccccaagcagctcatcatggccaccggcatgagcgggcgcccctccatgcccatcattcccggcgcagagaccttccagggcgactaccaccactcctcccagcacccgggtgccgagccgtactgcggcaaggactgcgtgatcctggggtccaacaactccgcccacgacatcgccgcagatctgtgggagaacggcgccaagtcggtgaccatcgtccagcgctcctccacccatgtcatccgctcccagaccttcaccgacctcatcacggggccgctgtacagtgaggaggccatgaaggcggggatcaccaccgagaaggctgacatgctcttcgcctccatcccctacaaggtgtgtgtgtttatcttttttggggggggggggttgctggaagggaggatgggccctcacaggcaaaggggcccacactcgctcctcttcaccagagagccaacctctcttcccttcgggaccctcttccaaaggtgctgcccgccatccaccgcgcggtcaacgaggtggtgaaggagcgcgacgccgacttctacgccgcgctgcgcgccaagggcttcctgctggactttggcgacgacgactccggcctgttcctcaagtacctgcgccgcgggtcggggtactacatcgacgtcggtgcctcgggcctggtcctgtccggcgaggtgggcctgcgctccggggtcagcatcgcgcgcgtcaacccgcgcagcgtgacgctcaccgacggctccgagctccccgccgacctggtggtcctggccaccggcttcggctccatgaacggctgggcggaggagctcatttccaaggacgtggctgaccgcgtggggcggtgctggggcctgggctccggcaccaccaaggacccgggcccgtgggagggggagctgcgcaacatgtggaagcccaccgcggtgcccgccctctggttccacggcggcaacctgcaccagtcgcgccactacagcaagtacctggccctgcagatcaaggcgcggtacgagggcctgcccacgcccgtgtatggccaggccaaagttcaccatatcgcctgagcggcgaatagggagcgttctggtccaacaggacacccatnnnnnnnnnnnnnnnnnnnnnnnnnnnnnnnnnnnnnnnnnnnnnnnnnnnnnnnnnnnnnnnnnnnnnnnnnnnnnnnggcagctgcccgtgtgcaaccgccgcgacaaagttttccatagcctgggtccatcgcccctcgtgccctgtaagctacaccgatctccaagattggatgaacagcgtggtccacaagcatgcatgccgtcacatggcgttcaagcccgggtaaggtcgtacaaacggcgtggcactcggtcaaatggtgcatggggtcgccaaggctaggatagannnnnnnnnncccccctcgctcacagagccccaaacccacagtgcggggcaaccgttttcatattggtggcgttttccctgcggcgtctaccccgccgtgtccaccccctttgttttcaacaccctccctccctgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatccccatcattggatgaacagcggggttcacaagcgtgcatgccgtcacatggcgttccaagcccgggtaaggtcgtacaaattggcgtggcactcgatcaaaaggtgcatggggtcgccaaggctaggatagatggcctgctgaagtgtggtggatgtgcttgggccctctgcagccaagtgggcaaggtagaaactacaacttgagccactccatgctacctcgatgggcaccaccgctggcctccccgtcagcccacaagtacagnnnnnnnnnntccccctcgctcactgagccccaaacccacagtgcggggcaatcgttttcacattggtggcgttttccctgcggcgtataccccgccatgtccaccctctttgttttcaacaccctccctccctgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgaatctgtatcgtacatggtggactcatgttttggatggaaatgcggtgtgagtgatttggaatcccctgtgcccgttcaccgcttccagatgccagggatcaacggaaccacccctgacctgacccaacgcacgtggaggtttaaccggtaattggtgtggtccagtctggccccaaatcaagnnnnnnnnnnaaatttgagccactccatgctaccttgatgggcaccactgctggcctccccgtcagcccacaagtacagacagaatgagagttcttgtgagctcgtgccatgagtccacaacgtccacaggcatccattagccaagcatgctcagcagcgcctggtgaatcgacgtgagcgccgcaggcaagctgctgaggctggtggggggccctcgtgaccgaggagcatcccaaacaagtaatcccattcagaaagagcaacatccgcttcaagcgtgccaccagctctggnnnnnnnnnnggctgaggctggtggggcccttgtgaccgaggagcatcccaaacaagtaatgccattcagaaagagcatcatccgcttcaagcgtgccaccagctctggccctctgtgaatcaatgaatctgtaccatacatggtggacacatgttttggatcgaaatgctgtgtgagtgatttggaatcccctgtgaccgttcaccgcttccaaacgccagggatcaacggaaccacccctgacccgaccctacgcacgtggaggtttaaccggtaactggtgtggtccagtctggccccaaatcaaggagcgcgaatgcatatggtttcagcgcatttaactcctcagacggcggggagcgctcgtacaccgtgtttctagctgaggattnnnnnnnnnnttttcggcgaattttactcctcagacggcggggagggctcgtacaccgtgtttctagctgaggattcctcgcgcaacagccccaagcccttgggctgcgagacctacaccaagagggggggagcttgcgcgatgtgcgcctggacctcctgaacgctggcatccatggctctcaacgatgtatgatggggcgcgagccttgcatgtaaagatgcagccccgggccccgccctcatttgccctccccctccgcaggtcccggactgggcgcatagcaagctcgagcgacgagccaacaaggccgtactcttcctgcagcagcttaccaccatccaacagactggagaggggctcaaggttcccaccatgcccaagagcgctgtcgtcagcgctgaggtgggtttcacgggaggggccggtgggttgggctggtaggggcatcctcccctaatcggggccccacacccgcccatcagggtcagcatcccctcgcgcaccctccaccatggatgcttgctcgcttctacagaccggcccctggcctcgtgtgaagatactgggcccctgcccattagacaccccatctccaggacaatcccgagaatgctggtgtggtttgggcaaaccacacaaacacacaattaccaattctatatcttctcctcacgacccttccccttctccaccctcaagggcatcgccatcaagtacaagagcaagtacggggccctcctcacccgcaccaccgagcgcggcttcgtcatccgaaagctgacgggccccggcggcgagatccggtggtccgcccccgtcttcctccagggctccgccatgggcgtgggcctgtccggcggctaccgcaagtcccgtacctgcatcgcgctggccaacgaccaggcggtgcagtcggcgctgcgcagccagagcgagtttggcccctgcatgcacttcctgctggacatgaatggcacgcgcatcaagcgcgcgcactttgactcctccgaccaggccagccagaccgctgtgagccaggaccgccacggcggcatgaccgccaagtactaccaggtcgacgcggccatggttgacatctcggtggaaggtgagggatggggtgcaggactatggaattccgttggttggggtctactctccaaaccaccacatgcttggcacgcccaccgttcctcgccggctgcgcgcccgcaggcggcagtacgtacgtggacaaggacttcaacgccgcggtgtacgggcagggggtgacggcggagggcatcctggcgggcgaggtgcccccgcccgcggagttccagctgctctacaccgtgctgcagcagtttgtggacgagacgcccagcccggtggtcaagcgggagctgggcgccagcgggcacggcgcgcggagcatccgcagcgtgcgcagcattaacatgaagtcctcgcctgaggagggcacggcgctgccgggcgtggcgctgcagcggaggacctccgccacgcccagcgtggctggcatcaaggagtgaggggccggggcgccgccgccaaatgttgattttatcctgcgcggctccgtggcacagccgcccgccgcgaggcttgattttgtaagctcctccatccccgtaggattttttggctgccaagccagaggagcagtccgaacgcgcgcgcgcgcgaggtcacagtgttcggggatattacatcgcgcatgatacaaagcccgcatgcgacgcggcaacaggggagggcaatcgtggatccgcgcatgccaggcctggatcaggggtgctgcctttgttaacccttcagggcacaccaccccgggccactgcccaccagcggtggctttttgcgctgtcccgacggggaccccgccccgctgcgcaccccctctcctacaccatgcaggcaagggtgtatgcatggaaagttttacagagcctctggcatgggcaccgtgccgagggctgtagccacgtcacccccttatcctcccccgtgcacaggtcggtcaccgcgccatgccccgcctctacgccgtgggcatgcgatccggcccggccctccggccccagctgccccgacccctggcagtgaggtgcctggctgcaaaggccaaaccccgctccaaggaagagggtgggtgcggtgggtggcctgcagtggcccatggcctgcctctggttcttggcgcctcctgagcacaggacttcccgtggaaacgcggcgatgcctgcaagcctgtgcatgcgccagcccagcttctgacccttgccgtcagctcgtgcaccgcctgcaggcctgtacagcagtacggtcaacctgcccaccaccagctttgatatgcgtgccaactcggtggtgcgggagccccagatccaagcgttctgggaggagaagggggtgtaccagaagctgtcgcggaacaaccctggggtgggtggcgcagatccgggggtgcttggggtactcgtgtggcacgatgatccggccgcttgtctctgcagggtcgcgcctgccggcgatggtccccgcacccagcttgattgccccaggaagtgtatgcagcccaatccccccgacaccctctgatggcaggaagtgtacacgttgcatgacgggccgccctacgccaacggcgacttgcacatgggacatgcactgaacaagatcctcaaggacatcgtgaaccggcatcagctgctccaggtttggcgagcagagcaggctttgcccatcacatgaagccttggtggaagaagacggagggcatcgatttgtgtgtctttctggtcctttgacgcctgctcaacactgagatgacatcgtggtcaaagtccgcctgattcaccgaggttgatcgccgccatacagaccaagcacggtgcatgccccactcttgccaccccacccccgccccattacaccatactcttccgcaggggaggaaggccatctacgtccccggctgggacacccacggcctgcccatcgagctcaaggcgctgcagtcgctgagcgaggagcagcgacgggacctggagcctctggccctgcggcggcgctgccgcaagtttgcgctcaagaccatagatgcccagcgcacccagttcaagaggcatgtggcatcggaaacaggaggagcagattttcttgtgtgaagtatcgaaaggcggcgcacacgagtgtttgcgtggaaggttggaggtctttgctgcattgcaaagaacccaacccaaccccccgcccccccttcctcctcaaactgcagatacggggtctggggtgactgggcaaccccctacgtgaccctggatcccaagtatgaggccgcacagctgcgtgtgtttgggaagatggtgctggacgggcacatctacaggcgagtgtgaggtcgtgattttcccggttgggacatggggtgcattgcgtgtgggacagggttgagagcgcatgacagttctgggttggagatggaagttgggttgtgaggaagtgttgtgagcgagcatcgaggtccatgcaatttgtgcccttttgctagacacctgtcctgtcggcatccatgcatccactcnnnnnnnnnncggttgggacatggggtgcagtgcgtgtgggacagggctgagagcgcatgacggttctgggttggggatggaagttgggttgtgaggaggtgtcgtgagcgagcatcgagttccatgcagtttgtgcccttttgctagactcctgtcctgtcggcatccatgcatccactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaacccccctcaggaccccacatctttgtaccttttgccctgtttcccagggtataactacacacagcatgctcagacacactcgtcacccattttcttaaccacaggggccagaagccggtgcactggnnnnnnnnnntcaggaccccacatctttgtactttttgcccttcttcccagggtatcaacacacacagcatgctcagacacactcgttacccattttctcaaccacaggggccagaagccggtgcactggagcccgtcgacaggcacggccttggccgaggccgagctggagtaccccgacggccacgtctcgcccagcgtctacgtctccgctccattgttggaggcgggccccggcgcgtcgcccgaccagacgcgcgcgctggcgggcgcctcgctggcactgtggaccaccacgccctggacgctgcccgccaaccgcgcggtggcggtgagcgtgggcatggagtactgcgtggtggaggagcgcgcaggggcgcgccggcgcctggtggtggccaccgcgctgcgcgaagctgtgctcgctcggctgggcggtggcgaagactgcgacgtgggtgccacctggtccacgctgtgcacgctgccgggcaccgcattgctgggcagccggtacgagggccccttggccggggacgacggcccgcgccccgtgctggacggcagctcctttgtcaccgccgactccggcacgggcctggtccacctcgcgcccggccacgggcacgaggactttgcgctggcggcagccgcgggcgtggcggctgtctcccccgtggacgacgcggggcggttcacgcgcgaggccggccacggactggagggtctggaggtcctgggcgagggcggcgaggcggtggcggcggccgtggcggccgccgggcgcctgctggcgcgcgagccctacgcacaccgctacccctacgactggcgcagcaagcgccccgtcatcgtccgcaccacgcgccagtggtttgcctccgtctctggcctgcgcagcgccgcgctggccgcactggacgacgtgcgcttcgtccccggcgcgggacggcgccgcatcgaggccatggtgggcgggcgcagcgactggtgcatcagccggcagcgcgcgtggggcgtgcccatccccgcatttttctaccgcgagtcgggggaggcgctgatgaacgaggccaccctggaccacgtgacgcggattgtggaggagcgcggcgccgacgcctggtgggagctgcccatcgaggacctgctgccgccgcagtaccgcgcaggtcaacctttgatcgtgctgatgtttgggggtgtctggggaggaaggcggtgatctggactgaaggcggagtgaagtgatgggtgggtgggcaaggggagatgctggcagtcgcgtgctgcgccactcggcaggccatgcgcccccggaaaggttgctgaggagtggaatgacacctaggaagatcctggccccccaggctgcaccgccccgctgcctgcaccccactccctgctccccgcccttcctccaccccctggtcatcagcaccccacccccccttcctcaccccaacactgcagaggctgtccagctggtcaagggctccgacaccatggacgtctggtttgactccggcaccagctgggccagcgtcctttccgagggggggtctgcaaaggacggcacccccccctcgccgcgctttccagccgacctgtacctggagggctccgaccagcaccgcggctggttccagagcagcctgctgacggcggtggcggcgcgcgggacggcgccgtaccgccgcgtgctcacccacggcttcctgctggatgaggcggggttcaagcagagcaagtcggtgggcaacacgctggacccgcgcgccgtcatgctgggaggaaaggatgccaagaaggagccggcctacggcgccgacgtgctgcgcctctgggtggcctccgtggactacaccgccgacgccagcgtcgggccccgcatcatggcgcaggcaggcggggggactgggaaggggggttaggggggggaggaggaaggggcgagatgtgtgatttggctctgctgaggatactgctctggcacgtgccagcccccctttctgccctccattcctggcgctgtagagttcagccagcccccataaactaacttgccgtctgtcaatacccaccttttaattaattcatcgccaggtcagcgaggtgtaccgtaagatccggctgacgctgcgcttcatgctgggcaacctgtccgggtttgatcccgggcaggccgctgtcccgcacgcccagctcggcctcacagaccggtacatgctctggcgcgtggcggcgctcatcgacgagtgtcacgcagcgtatgacgagcaccagttcttcaggtgctgagggggtgaggggttgtttgctttcgtcgaaaggggcgggccgctctggtcatcgtgatcggtttgccatgcacgcgtatctcagtagcaggtactgaaggggagcctgcaatcctctgcccccctcccgccacctgccccatcaacacccccctctccccaccgtcattgccaccacctctccctccccctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacctggacgccagcaaggaccggctgtacatcctgggcgcggcctcccccaaccgccgcggcgcgcagacggtgctggcggccacgctgcgcgccatgctggcgctggtggcgccgctggccccccacctggcagaggacgcgtgggcggctctgccctggcccgcgcccgccgagtcggtgttcggcggcggcgcagcggcggccgacccggcctggcgcgacctccccgccgccgacctggggctgatgcgcgctctgctggccatccggggcgaggtgaacgcgctgcaggagcgggcgcgctccgctggcctgatcgggtccagtctggaggcggcggtggatgtgcacgtgagcgacgcaggcctgcgcgcacggctggcggagctgcaggccgcgggcgatgcgcaggacaccatccagcacgcctgcatcgtgagccaggcggcgctgctggacgcggcgccgggggccggcgagggcgcggtgtgcaccgcggcggctgtaccgatcccgggggaggagggcgccgagctgcgcgtgcgcttgcggcgcgcggcgggcgcgcgctgcgtgcgctgctggaactacagcgaggcggtgggcgccgatgcggagcacccccacctctgccaccgctgcgtgccggtggtgcgcgcgctggggcagccagcccccaagcaggcggtggcctgaggtggtggggggccctggtgggtggccggtgggagggccactgnnnnnnnnnnggcgctggggcagccagcccccacgcaggcgatggcctgaggtgtgggggggggcctggtgggtggccggtgggagggccactgccctcgccagtcctcaccccgtggtgcctgcgagtgtgccatgccagcctgtgacatgcaattttgggagggtcacagtgtatccaggaggttttagaaggatgtctgaagggtcctggaagggtcctctcgttgtggcgggcatgtgctgatgtggagctgcactggggcccgcctggggacagctcgagaggcaagccactgcgagtggccctcctgcaggtctcgatcaacctgaactgannnnnnnnnnatatctattcagaggtttttagaaggatgtctgaaggatcctggaaggatcctctcgttgtggcgggcatgtgctgatgnnnnnnnnnnagcctgcacaccagatccccagaccttgctgcttatttgttcagatcgtgaacaatagaggagtnnnnnnnnnnagccgcctggggacagctcaagacgcaagccactgcgagtggcactcctgcaggtctcgatcaacctgaactgacaaggggggaggtatcctcagtctgggttccaatcttatattacctgtgtgctcgtggccttggcgaccttgtttgcagggacagacatgaaggcagatgctgcaagggatgaacacgccctggccagcacagcaaccnnnnnnnnnnctggcgaccttgtgtacagggacagacatgaagtcagatgctgcaagagatgaacacgccctggccagcacagcaaccaggcttgcacaccagatccccagatcttgctgctgatttgttcagatcgtgaacaatagaggagtccttcgggatctacaaagtatgccaattcgccggagaggtttggctgacttcatatccccttctctcagccctgtaggacannnnnnnnnncttccaatttgccggagaggttcggctgactccatatccccttctctcagccctgtaggacacacatgcagcgaggatgctgctgtgggcccaggtgttcccatcatgatcactcatggcttgattcgcccctagattcttgttccctgtagactccaatcacggttgatctgcgttgaacttctcctaccctgtgatttgattcctgatgaggccaaagacatccttctcggccattgggttgatctcattacagttctcgcacccttttgaaggcttagaaatccttgcttttgacggggcaacgctcttgtgtactgtatgatcacaaacacgccaaaaatgcttcttcgaggtgtcggaaaccgctgttgtccttccagttgacatgcacacgtgacagctgctgtgccggacgtgcacggaggattggaggggtcggagcggtcatgctaaaccgatgcagtctgcgtgggaacaggatctgacaacatgtctgtcagactctacgagctcagtggtttgatcactttcttacatggaacctgcaaagcttgaaactcatcgttccctgagtcgtatgcaacagtgcatttcatgaccggcaagcgtcctccggattcccgccatggaatctccgccgccatacgcatcgcccgaacctgtaggtcatagtataagatgacgctacacggagccagggtgccttatatgtaagatcttggagctcaagagcaacacaggagtctgagcgtgtcattaagtagaggctgtatcctactcggacagcaggcgaaccaaacaggcagaagggtacaattgcggcaaggtgcaggatggctccagcggccaggaaccccgctatcctgagttggatggtgctgctgctcgccagatgggccttcgcggtgagcctgcgagcactagacaagatgacgactccgcgtcaactgcatctacttgccccttttttcgcgcatcccacaaccttcccttttgagagcaggccacctgcagctccacattcgtcccgttacccagtgtcgtgtgagtcaattggtgtggttataggggggttatgtgagcaaatctaacgatggtcccatccgacccctgtcatgcacgtgatgccggtgggcagccgtcggacccaatttctgtgggaccccgcagatttgctccccttgtcaggcatgcaaatatgtgcattggtatctgcttgcttattaacggccgtactctgtcatatctccatggttctgcacacactcgactcctcgcagtcttggaccccacgtgcatttcgtgacggaggacagcgcagatgccatttgcaagtgagtaacgctcgtgagtttgtgcatcaagtcaagtgtttgcagatcagtgcgccgccagcccagagtaagcaccatctaggtagacctgatagctcatgagaaatctgactggcgcatacaacccaaatccccatgacatgcaggcacgaaggcttcagcaaggcggggacagtccgcaccacgaccctccatatcatggggctgtcgatgtcggccgtgcaggtgagcaccctggagatcctgacacccagatcgacgaagatgatcgtgaatgtggagtgcctcaaggccggccagaagccttgcacggcagacagtgacggcaacatcggctccggcaacaagggcaagaacaactttggcaccaacaacgttgggaactacaacattggtgagcaaggactggagtgtaatctcactttcaagatgggtacagccgctgcaatccttggtgaaacaggctcacatggaaaaccgtgctgcctgttgcagggaactccaatgtgggcaccgccaactggggagacaacaattccggcacgagcaattgttgcttcaataagactgggcatcgcataattgtgaatgactgcagcctgctcgtattccgcaagcgtgcatgggtgcttcactatccaccgcctcctgccatgaagtcaccgccgcctcccgccaagaagtc

SEQ ID NO: 31833 - DNA, 61 bp, Chlorella protothecoides
gccgcctgcctgcgccaggtggtggccggggagagggggcccgtgcctctgcgctgcccgc

SEQ ID NO: 31834 - DNA, 119 bp, Chlorella protothecoides
tgcgacggcctggcggagttggatcaaggctgtggtgttagtgctaggaatttttaacgtacatagtatccattctagccccagagcgggccattgcatactatcaaagtctcgcaatc

SEQ ID NO: 31835 - DNA, 70 bp, Chlorella protothecoides
gcggttgcacaccagggacacatcctatgaggggctccccccccggacgcaccgactcggcctcagccac

SEQ ID NO: 31836 - DNA, 90 bp, Chlorella protothecoides
cgactggcacccacagggctctggggagttaacctgacgtactgcaagctccagagcctggttgtgtgatgcggggggcaccaggttggc

SEQ ID NO: 31837 - DNA, 61 bp, Chlorella protothecoides
gtgtgcacgtagtgacggtgaatgactacttggcccgccgtgactccgagtgggtgggcca

SEQ ID NO: 31838 - DNA, 118 bp, Chlorella protothecoides
caggggggtacggcggcactttcgcatgaatttttgggttccaccttccgcttacctccggcacgacacccctttagcaagagggtgagccaaactcttgtgcggctgcaaaatctga

SEQ ID NO: 31839 - DNA, 61 bp, Chlorella protothecoides
agataggtaagccgagtgtggtggccggagggactgacagaggagtgtgggtcccgtctgt

SEQ ID NO: 31840 - DNA, 77 bp, Chlorella protothecoides
agggacaggtcctcgctggcgctgccgtcctgcagcgtcaactgtgcaccggcctgagccgcgattcgcggtgaccg

SEQ ID NO: 31841 - DNA, 170 bp, Chlorella protothecoides
cagcactatcgagccgccccgggctcgcgtttatgtctgactcatggtcttcccatgagacagcttgcattgcatgaccccaactcttccaaacgtccgttttctgtgctcgaacaccgcattcctccccaccacgctccaacatgcacctcagcgcatcatgcaccgtc

SEQ ID NO: 31842 - DNA, 61 bp, Chlorella protothecoides
ctcgtctcggccccgttctcgaaatggcggtggccatgagccacgacgccgcgtcatgcct

SEQ ID NO: 31843 - DNA, 74 bp, Chlorella protothecoides
gtggaagcagacatcgcacgacttggcaactccagataccaaccctgtgcgtgacgcaccaaccttgtagtcct

SEQ ID NO: 31844 - DNA, 88 bp, Chlorella protothecoides
gaagttttgtgtgagggtgagcaaggtccctcgcactgcatcgtctcctctacagctccgaacccatgcacatacccaactgcatgca

SEQ ID NO: 31845 - DNA, 80 bp, Chlorella protothecoides
cgtcgcggttgacaacatggaccttgcaggtcttgttgacgcaccgcttagtgtcccacacgtccaccagcttctcctca

SEQ ID NO: 31846 - DNA, 162 bp, Chlorella protothecoides
ccgtacatgttgtaggtcgtgcatggggtgccattgtggctcaggtaggcggtgggcactgtcgcatcctcgtccaggtgggtgctgcctggataggcggcacgggtgcgggtgacggcctcctcggggcctcgggggagggtcggggatggatggacctcg

SEQ ID NO: 31847 - DNA, 61 bp, Chlorella protothecoides
tgaatgttatcttctgtttgtgtgggcaatgttgcagatggctggattcaccctttttgtt

SEQ ID NO: 31848 - DNA, 71 bp, Chlorella protothecoides
acaccttgccccaacccctctcacccaacatctaccagcccggtgaccatccgcaacctgaagcgggtgga

SEQ ID NO: 31849 - DNA, 61 bp, Chlorella protothecoides
ccccactgggtcgccttccaccagccccacagggtcgccttccaccagccccagccctgca

SEQ ID NO: 31850 - DNA, 157 bp, Chlorella protothecoides
cttcatgcagagggcccgacttctcagccgcagtggtgtggatgccaaaggccctcccaacatcaccccaggggaacctccctcctccagaacccccaggcggtgtgcaagacctccaatttcggccctgttcatgccgtcccttcccctaagagac

SEQ ID NO: 31851 - DNA, 75 bp, Chlorella protothecoides
tcacctgctccacaggcttcctctcgctgggtcacagactgcaggcacccagcgaatgcacacgcctccatctgc

SEQ ID NO: 31852 - DNA, 750 bp, Chlorella protothecoides
  modified_base (138)..(147): a, c, t, g, unknown or other
  modified_base (633)..(642): a, c, t, g, unknown or other
gaggcgacttctttgcaggtgggggaggcggcttcctcacaggagggggaggcgacttcctcacaggtgggggaggcggcggcggcgacagtttcttgatgggcggtggcggcatatgtttgggtggaggtggtgaannnnnnnnnngatggtgggctgggagggggaggagatgggggtgggcttggaggggtcctgggaggggttgacctcggcggcgggctgggagggggtgaggtcttgagtgtgggactaggcagggaaggagacactctgtttggtggcgggggtgacagcaatgctgtctgagatggggaccgctgcatgggaggaggaggagacttcctgacaggtgggggaggcggcggcggcggcagcagtttcttgatgggcgggggcggcatatgtttgggtggaggtggtgaagagttgtaatttctgaaggcatatcgcctgagctctgacacgctgcacgggttcccttgtcccttccggactccaaccgcattgttgcaacggagattggatcctgtgtttttgtcgccccagttgtagttacccttgttggagttacctgtgaagtgtaggccagtggagatggttgaggaaggacggtagtgattccatcgcttnnnnnnnnnngtcgcctgagctctaacacgctgcacgggttcccttctcccttccggactccaaccgcattattgcaacggagattgtatcctgtgtttttgtcgccccagttgtagt

SEQ ID NO: 31853 - DNA, 108 bp, Chlorella protothecoides
tgggtgagtggggtctggctgctggctctgggtgaggtgccgcaggagggtggaacaggagcggcgtgctgcggcatgcgggaagcaggagcatgatccccctgactg

SEQ ID NO: 31854 - DNA, 108 bp, Chlorella protothecoides
tggaggtagccgggcggcagctgccccgggttgggcgcggggcgggcctgctgggcacggtgcagcgccgcgagccgagcctgctgtgcctgctgcgcctgcatgtgg

SEQ ID NO: 31855 - DNA, 82 bp, Chlorella protothecoides
tcgctagaaacttccgtcctggtatgtagtactggcacacagcctcatccccaaaccatgcagatctctctgcccctgactg

SEQ ID NO: 31856 - DNA, 61 bp, Chlorella protothecoides
ggcttggctgcatgaatgggggacgcatgggtggacatgcatggacatgaacagagccgcc

SEQ ID NO: 31857 - DNA, 189 bp, Chlorella protothecoides
tcaggtgggaatgaggtactatcggttacactaaagtttgaaccacatcacatcttgctgtacagcatggcaagtatcgtaatggtacggacgaccaccttcactcttgctccctccatgtcggctgaacgcaagaactggtccctcatcaccatgcgaaatgcatcattgccaggggtctcctcgtca

SEQ ID NO: 31858 - DNA, 71 bp, Chlorella protothecoides
cagttccaggccatgcccctagagcatgtcgcttacgtagtacaagtagggcatgcaccgtctcgactgcg

SEQ ID NO: 31859 - DNA, 80 bp, Chlorella protothecoides
agtaccgcctggcgcagcaggtacgtggcttttagcttgtgggtggggagggggtggcggggtggccggttcgagagcgt

SEQ ID NO: 31860 - DNA, 61 bp, Chlorella protothecoides
agcacctgggatgggaaggcaaagttggggtgggggtgaaaacattcaggagcaggggagc

SEQ ID NO: 31861 - DNA, 249 bp, Chlorella protothecoides
ctgtccctaccaggtgactcagaggggcaggtttcggtttgtaggggtttccgcagtccgcccgtctggtagtgccagcgtgtggcgcggtagttgtgcggcgagggcccagcgctgtcctcccctccctgcagctcctgatgccgggcgggcccgccccctgttgcaaccgattgttggtcgggaaaatgcccgccttgctgctcgacaccacccccaatcttttacaaccctgcgcccaccccctcg

SEQ ID NO: 31862 - DNA, 75 bp, Chlorella protothecoides
ggacctgctcaccagaactgatatgaccattgcatgagattgacgtgtgcagcgattcgcctggcgcaggggtgt

SEQ ID NO: 31863 - DNA, 61 bp, Chlorella protothecoides
tgatggaggtgcccagccacgtgttcgagctctatgcgcgcgacgtgcagggcctggccct

SEQ ID NO: 31864 - DNA, 101 bp, Chlorella protothecoides
caacttccctgccgctgggccgacaaacgatggtattcatctcgtcgcggaccagatccacgcttcgtccgatcacaatgtcgcgattcagctccagaagc

SEQ ID NO: 31865 - DNA, 117 bp, Chlorella protothecoides
ccccccggtgagcctgctgtgtcgggcgtgtgctggattggagtgaggggtctgtggcaagggtcagatgaagggtgttggcgagtatcttctgaggaactccccaaacatcagcat

SEQ ID NO: 31866 - DNA, 124 bp, Chlorella protothecoides
ccatgaccaacagggttcactgcagtggaagcagcacggtcctctggcactgctcaggagcactgctgacctgaaaccaaagcaagcggccatcacctgacccccctctccgctcggccctccc

SEQ ID NO: 31867 - DNA, 71 bp, Chlorella protothecoides
ccgcttgccccagtcagccctctcacccccgcttccttgtctcctctcgatgcccaggtggcacaagccca

SEQ ID NO: 31868 - DNA, 68 bp, Chlorella protothecoides
cccacggccgcgcacgacgacttcgtggcgcgccagctggcgctgctggaggccaccgcggggccccg

SEQ ID NO: 31869 - DNA, 67 bp, Chlorella protothecoides
ggcgctgctggaggccaccgcggggccccgcgccgcgcaccgcggcagccagggcgtgctggcccac

SEQ ID NO: 31870 - DNA, 79 bp, Chlorella protothecoides
agcaggagcatggcgtctgtgctcggagggtacctggcacggtgcatgtaaattatgttcttcagggagccaaaggcac

SEQ ID NO: 31871 - DNA, 138 bp, Chlorella protothecoides
ggggggggggggggcgggagagagcgatggtgggaccacactggcaggctcatgccctcggcgtgcctgcagccactcgtgggccccagtgtgcaccatcccctaacttttttaggagcttcttaagctggccaaagc

SEQ ID NO: 31872 - DNA, 190 bp, Chlorella protothecoides
cccctcccacccggccaacccaaactccctttccataccaagctgtctcactttaccgcggtccgttgcctgagcgggtgggcaggagcccccccccgcacccccttggctgcactccagtctcccgcccccttggaccctgctgcgcacgccccttcctaacttgtgtaccttccgattgttttcccac

SEQ ID NO: 31873 - DNA, 161 bp, Chlorella protothecoides
caggtccctgaaggaggcagaggtggtgcatgatgtgctggatacggaagcgacggcagcaggtctggtggtgatcgatgtccaccctcctggaaggagcacctgctggatccttgcggcgccagcagcagtttcttgggcaatcaggttgggctggtcgg

SEQ ID NO: 31874 - DNA, 66 bp, Chlorella protothecoides
ggtcgatggtgtgtgggggacggggtctttcattcgagccgtgttgcctttcgatgcagagcagcc

SEQ ID NO: 31875 - DNA, 61 bp, Chlorella protothecoides
ggagtgatgaagagtctgctagcggccgagcttattctggtcgaggtaaggacagaggtgt

SEQ ID NO: 31876 - DNA, 61 bp, Chlorella protothecoides
aaatgggtgttctgcacagggcagacccggcggtgtggcggggcatcaagcctggcagagg

SEQ ID NO: 31877 - DNA, 61 bp, Chlorella protothecoides
ggtgtggcggggcatcaagcctggcagagggaggggatatgttgatggtgcccaaccatac

SEQ ID NO: 31878 - DNA, 132 bp, Chlorella protothecoides
ccatgcttccatgcacagccgatcgatggcccggcgcgccgggccatcgacaggttcaggttatactccagccattaccatgttattcaactcacctgctcgaggtcctcggagtgcttcagatcggcacga

SEQ ID NO: 31879 - DNA, 79 bp, Chlorella protothecoides
tgacggacacagaggctgggacgtggggcgattggaattggagtgtcgcctgtgaggagcatccagaccgatctgcgga

SEQ ID NO: 31880 - DNA, 80 bp, Chlorella protothecoides
ctcatcgaaacctgagatcgagttttgtcatgcggaaacctttacatgcatgactcaaggtggatgatcagtcttcttcc

SEQ ID NO: 31881 - DNA, 122 bp, Chlorella protothecoides
tctgcgcgcaggatctgcccgacgtggatgggcggccaggtatgcgagggcgcatcaccatctactgcattgccgagtccctggacaggaagtcgctggagctgcggctgagggagcgtggg

SEQ ID NO: 31882 - DNA, 128 bp, Chlorella protothecoides
ctcatgggataggagttggggctggaaggcaggggtggtgtgttgaggtgttccatctgcgattcgaatgtcaagggatgccctgcacctgaccagccgggggtgctttcttgagaacccaaacatgc

SEQ ID NO: 31883 - DNA, 118 bp, Chlorella protothecoides
gaagtactccggacggggctgacctccgagaggcagcgccaggcacaccccgaggcagtcaacacagtcaattgggttgagtggagacgatgttcgcacgctagatggtccaaatcaa

SEQ ID NO: 31884 - DNA, 72 bp, Chlorella protothecoides
gcacaaggcgaggcttgcatccgtgcatctgcaccctggcagcacccagaaaagatcgcggaacctcgctgg

SEQ ID NO: 31885 - DNA, 71 bp, Chlorella protothecoides
aggtctagatcacttcggcgcgatctccgtgacttcgcgcgcgcgcacgcccggccaggagggtggaggtt

SEQ ID NO: 31886 - DNA, 61 bp, Chlorella protothecoides
tgtctccccacgcacacctcttttgtataatacgccctccatgtgccgtccttggcctcac

SEQ ID NO: 31887 - DNA, 152 bp, Chlorella protothecoides
actcgccgtgtacgtgtctggcatggatgctatgagctccgggatcttgtccgggcagccaggctcgatgaggaccgcgggcccgaacatggccgggagactgaagagggaagaagccgtctggcccggcgatccgtgcaggtagatcgaca

SEQ ID NO: 31888 - DNA, 143 bp, Chlorella protothecoides
gcatccaggacctgggcgccgcagacctgctctgcgctgggtgccaaggcatggctgccgggcctcgcctggcgctcccgagcccatgctctggccctgcctcccacatcgtcatcgcaggtacgagctcgccaccgagtttg

SEQ ID NO: 31889 - DNA, 64 bp, Chlorella protothecoides
gcctggaggctttggcagagggcgtcgaggcccgagaaacccttgcagcctccgttttgggtgg

SEQ ID NO: 31890 - DNA, 61 bp, Chlorella protothecoides
ggggatcagtgacagcttgaatatttgctgtctgccaagaccttgtcgatgctagtcaaac

SEQ ID NO: 31891 - DNA, 66 bp, Chlorella protothecoides
cacagtatacacatcggtacaggggtcttcatcggccccacagggtttggtcagggcagccgctgt

SEQ ID NO: 31892 - DNA, 353 bp, Chlorella protothecoides
catgcgggcatggtatccaaagtgcatggccttgttgcaaccgatccccaatttcataccaacgcatcccttttcatcaggcggtctgccttactcctggggctcccttcgcagcctgtcacagcttttgcttggtgtgcggcgttgattcgatgggcaaggaaacgacaggatgggcaccacagtgtcgggtggcgggcgtcgcatgtgtcctgctgcctggtgccgggaatcgacagtctcccaggcaccacagtccatcccatgccttccctccctcctctgatgcctgcccaggtggtaatcagttgaccgggcccttgccaaatgcctggatcatgatgtcatccctg

SEQ ID NO: 31893 - DNA, 61 bp, Chlorella protothecoides
gccggcgttgtagagcgtgaggtcggggcgaccgaatccgtccagctccgccgcgctgggc

SEQ ID NO: 31894 - DNA, 182 bp, Chlorella protothecoides
caacggcgcgcgtacacgtcggggtggaagacaccgctggtataagcccacgctgcgcggcatgtaaggcctactcggtacaagcctgcatcctcgagaaagtcacccaaactatctccagttcgaatacggatctggatgaagtctggtgttgcctctccgggtgtcatagcgcggtttgc

SEQ ID NO: 31895 - DNA, 99 bp, Chlorella protothecoides
cgccgcagcaggggagggggtgagtcggagccgagggggagaggggtgcccgagccttggagcatgggcccatgggcggttgccagtgaaaggaggtcg

SEQ ID NO: 31896 - DNA, 79 bp, Chlorella protothecoides
gattggtgttacaggatgtcagggagttaagaggtagtatgctcctcccgggtgctcacaccgcacactcatccgggcg

SEQ ID NO: 31897 - DNA, 61 bp, Chlorella protothecoides
cccgccccgccgcccgcgccgctcgtgctttgccaccagccgctccttggcccgccgggcc

SEQ ID NO: 31898 - DNA, 61 bp, Chlorella protothecoides
ggcgcggggccaggcgcgtcgggtctggggtaggggattgcaaaggcgaacgacggcgcag

SEQ ID NO: 31899 - DNA, 62 bp, Chlorella protothecoides
ggagaggatggacacggatggatcgggggcaattgactttctggagtttgcgacgtgcctag

SEQ ID NO: 31900 - DNA, 748 bp, Chlorella protothecoides
  modified_base (100)..(164): a, c, t, g, unknown or other
ttcttcgagaccctggccaccaaggacgcggggcgcgaccgcgagcgcggcctggacggcggcgccggcgtcgccacggacgccgcggccggcggcgccnnnnnnnnnnnnnnnnnnnnnnnnnnnnnnnnnnnnnnnnnnnnnnnnnnnnnnnnnnnnnnnnncgctggacatggagggcgtgggcgacgcctggggcgacgacgaccagctcctcgcctccggcgacgagggtgagggggggtgcggggtcgggagcgtatgattggtatcttgcgagggctggggggtgccgggaaggggggtccgtgatgagtgagggtggcctgggacaggatggggcgtgggcgacggccctggccgttccgaccatcgcggtcgccctgtctgggtgggacttcgaccagggcaccccccgcaagcatgtgcccccacgacccgtcgatttgggaagccctcctccgatcccactcacactgctcctcgtttgccccacgccctggccccctacaccctcacattccccctgagacacacacacacacacacacacacacacacactcacactcacacacacactcacactcacacacacctacacacactcacacacactcacacaacaacaacaacacaggtgctgtgtacgacgacggcgaggccgcggccggctccggcggcgagggcggcggctgggacctggacgacgacctggacctgcccagcagccccacgggcggcgcggg

SEQ ID NO: 31901 - DNA, 61 bp, Chlorella protothecoides
ttgggtagctgcagccccgtcagcttctccccgccgcccggatggtatttttcgtgccgcc

SEQ ID NO: 31902 - DNA, 69 bp, Chlorella protothecoides
tatagtataactctgggtttcgctcaaagttcaagcatacgggaagggtagcggcgcgctgtgccaata

SEQ ID NO: 31903 - DNA, 61 bp, Chlorella protothecoides
ggcgtcggcaccctctgcagcatcttgggcactgtcggagtgtgcggcccacagaaaccat

SEQ ID NO: 31904 - DNA, 79 bp, Chlorella protothecoides
ttggcagtgctgagaggcggctgggcagggtactggcttgcaagcggtgcggggtttgtgcaagaccgtagctttccaa

SEQ ID NO: 31905 - DNA, 76 bp, Chlorella protothecoides
tttcacactgcgcctggtcgagtgaaacccaggagtggagagccgatgtactttgaccccatgctgggacaaaggg

SEQ ID NO: 31906 - DNA, 106 bp, Chlorella protothecoides
agttctccagcgccggagcgggtaagaggatgccttcggatgttgtcagaggggttgccctcacgtatggcggcatgcaaagcgagacgcgtgggtagctggcctc

SEQ ID NO: 31907 - DNA, 63 bp, Chlorella protothecoides
gaccccgccttgttcgtgtcctcatggcccgaaccccgcctcacccttgccagccgccacatg

SEQ ID NO: 31908 - DNA, 61 bp, Chlorella protothecoides
gggtccagggcactcagtgctgtgtgagacactccgagccagttccagctcccccaacatc

SEQ ID NO: 31909 - DNA, 61 bp, Chlorella protothecoides
tcaaatgctcaaggccggagcccctctctttaaaaatttgagcatgctttgggtcatggct

SEQ ID NO: 31910 - DNA, 61 bp, Chlorella protothecoides
atctctatcaactgaggcacctgtgggcgttggaaggtcatgcagcggttgatgggggggc

SEQ ID NO: 31911 - DNA, 65 bp, Chlorella protothecoides
atcgcggtggggccctccccggccgacataatattggcgttgctgtggctgtgtgcgaggtgggg

SEQ ID NO: 31912 - DNA, 138 bp, Chlorella protothecoides
tctgtcgccgacgaggtcatcagggatccccaggtgcatgggggggcgtggatgcgtggtattacgcatgctgttttcggcatggggaggagagctgtgcaggactcatgcttccagcctcccacatgctcctgggtc

SEQ ID NO: 31913 - DNA, 102 bp, Chlorella protothecoides
caggtagtgccttggctcaggttatctgtagctggaccgccaagggtcttttacctgcctttcctttcacgtccacgtcaaacacccccccccttctcccca

SEQ ID NO: 31914 - DNA, 166 bp, Chlorella protothecoides
ccagcctgtcaggagcgttgcgcaggcgcccgaatgtcgggagagctcagcatgcaggtcactaggtccacaacaacgacacatccgtcgcaccacgttccacttcttggaaaccggaatttcgtgtttcgtcaagatcacaaccggtgccgctcccatgcctcca

SEQ ID NO: 31915 - DNA, 78 bp, Chlorella protothecoides
ccccttggatgtgtcgccgctgcaccactctggccaaactggggcgttgccgtcacacacgatgcattgtgttccaaa

SEQ ID NO: 31916 - DNA, 117 bp, Chlorella protothecoides
gtgttgcccatccgattgagcatctggatcgtgtgggagggagatataatgtgtttttgtacacattgcaagcgcccatgggccctcttgctgctgccagggcccggcagtccccgg

SEQ ID NO: 31917 - DNA, 61 bp, Chlorella protothecoides
cgccgtacgtcatcttgtgtgacggctacacgagcaaacacttcatcctctgattgcagta

SEQ ID NO: 31918 - DNA, 89 bp, Chlorella protothecoides
agcgtatgccttgcttcgctggtttgcagaaatcatggggataggacgcgcacacgctcaccgtgaaaacccacaaggatgactaccag

SEQ ID NO: 31919 - DNA, 126 bp, Chlorella protothecoides
aatactccatccatcacctcttctcttggcaggctgcccaggagctgacgctctgcgtcacatgggggtcctaagaatcggtcacacgtgcgctcgaagtcgtactggggagtcagacaacacgtc

SEQ ID NO: 31920 - DNA, 128 bp, Chlorella protothecoides
catctcggcagcgatgagaactggcagatggcacaaaagtgctgctcttttccctactcccgggcatctcatgtccatcgcacagcctcaccttttttacatcactccaccactcattcctccccttg

SEQ ID NO: 31921 - DNA, 158 bp, Chlorella protothecoides
cggtggcccgtcgcggcaccggctgctgctgctgggctgcaaggcagctgctgtgcggaggccatgtgaggccaggcacacatgctccaccactcactcccccttcccgccgcccatgcagggtgccaaccatcgacgggcgggcggaggtgacggtg

SEQ ID NO: 31922 - DNA, 61 bp, Chlorella protothecoides
gccctgatcagaggagtctggcgtggttggtgtggactcttgcttccatgaccctggtgac

SEQ ID NO: 31923 - DNA, 61 bp, Chlorella protothecoides
ggctgctggccgccatacgcccctggctgccggacggcgcctgaagtacgcatcgcgcccg

SEQ ID NO: 31924 - DNA, 97 bp, Chlorella protothecoides
cagcattgggcatgcattcgtctaccactaaactgcaggggagtgatatattgtaacgcttcatttgcccaccctgcctccctgcactgccccaatc

SEQ ID NO: 31925 - DNA, 187 bp, Chlorella protothecoides
atagacctctggcgagggaggaggagaatgcgctggagagggggaggccgcggggctgctcgccggggatggtgacgtcgcagggctagtcgtcggggatggggaggacgcggggctggctgctgggggaggggaggccgcagggctgatcgccagggagggggaggacgcagggctgggtgttgga

SEQ ID NO: 31926 - DNA, 61 bp, Chlorella protothecoides
taccgcggcgtggtggcgggcatggaccccacctgcctcgcctcccctgcctggatggcgg

SEQ ID NO: 31927 - DNA, 71 bp, Chlorella protothecoides
ggagggccaggttgtgaggcgtcagcaggcagcgccgatgtttccatgggggtggcgtcgattgacatgct

SEQ ID NO: 31928 - DNA, 590 bp, Chlorella protothecoides
  modified_base (266)..(510): a, c, t, g, unknown or other
gtcgagaggctagggctgctcaggtaggcccgggtccagggcagaaaaccctgatggctcttgcggagacggaaggggccggaacacaggggatataccgacgccgacggtgtcccgtttcatgctgatgcctcgggcccagatgtcatccctctcaccctttttcgcggccttccgacacccaccgcctcccccacatgggcctctctcgatgcacccccgcagcaaggcggaaaaggcgggcctgaccctgaccaagatcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggaaccggccgtcacaccgtgtgccagttgttgcgtcaaggatcgcatggcctggagttgtgcaggcagaggcaggag

SEQ ID NO: 31929 - DNA, 182 bp, Chlorella protothecoides
tccccgcagttcaaggtaccagcagccaccagcgccatcatcaccaatggtgagaatggccatgcagcggcttccactgcattcttgtgcagaggatctacaagtacagcatacatgctcgacccagcctgtgccatgctgcatgcctccaaaagcatcccccgacatctcatgcaaccctc

SEQ ID NO: 31930 - DNA, 263 bp, Chlorella protothecoides
ttgccgattttaaggatacattcatgtgtcgaagtcgcggcgcgaatagcggactatgcgcctctttgtacttcctgcggttgggccagtccctgctatgatacaatatccttcggcttgcctgccgcgttgataagtggcaccgttgttgcatgcctctatagaagcctacatgtcatgaatcgcacattgaactttctgcatcgcggcatacatgcatgggcagctcttacaggaacgccggtcctcctgggagtgccttg

SEQ ID NO: 31931 - DNA, 61 bp, Chlorella protothecoides
ggggctggccaggctcgaggtgcggggacgacctggctgctgccgttcgggaatctggtgc

SEQ ID NO: 31932 - DNA, 72 bp, Chlorella protothecoides
ccctgccagtttcgatggagacaggcgagcaaattcaaatggtgcagagaatgtctgcgtgccgctgtgctt

SEQ ID NO: 31933 - DNA, 61 bp, Chlorella protothecoides
ggccgctgtgactgggaacaagggcctgaatggggcagaggatttggccaaggaggccaag

SEQ ID NO: 31934 - DNA, 75 bp, Chlorella protothecoides
acccatggcctggccaaggtgtgtgctgggcctcgagttgagtttcaagggctccgggtcctacaaactcctcca

SEQ ID NO: 31935 - DNA, 61 bp, Chlorella protothecoides
tcaagttgccgtcatcctcaccaatggcactctcaccgaggaagttcaaggtcctgagatc

SEQ ID NO: 31936 - DNA, 82 bp, Chlorella protothecoides
acccgactgtaatgcctcggtgagtcccggcgtgcgctgggaagtcgtaatgtaggactaccgcggagttgggctgtcgtct

SEQ ID NO: 31937 - DNA, 80 bp, Chlorella protothecoides
gtgcacagcttgcctttgatgttgggcagacgtgcagcaaagggaattggtgcctcccaagggctgctggacacttcacg

SEQ ID NO: 31938 - DNA, 61 bp, Chlorella protothecoides
tggagggcatgaggcactcacggagcctgttgcccgcgcctcgcgcgtcatgcatgccctc

SEQ ID NO: 31939 - DNA, 93 bp, Chlorella protothecoides
aggcacgacagcccagacgcttctcctccaaggagaagagtagtgaggcataacagcccagacgcttctcctccgaggagagcagcagggagg

SEQ ID NO: 31940 - DNA, 61 bp, Chlorella protothecoides
ggcagcaggcagcggcagcgcggcggtagggggcagcagctgatggtagccgcctccacat

SEQ ID NO: 31941 - DNA, 79 bp, Chlorella protothecoides
cctcccaatcctcagcccccgccgccgactccacctcccagccctgcatcatccccatctgacgattgcttagatgcac

SEQ ID NO: 31942 - DNA, 61 bp, Chlorella protothecoides
gattgtgataaacctgaagcaaaaaaggctccttgggcttgaagggctcggtttaccctga

SEQ ID NO: 31943 - DNA, 73 bp, Chlorella protothecoides
acgatctcaatccgtgcctcctctgccagcttgcacccctgcaccgcaccggaactgtatgtcgatggcgcct

SEQ ID NO: 31944 - DNA, 70 bp, Chlorella protothecoides
tctactacctgatccaggtgggcggggaggcgggtactctggacttgcatgaatagacctgcagaattgt

SEQ ID NO: 31945 - DNA, 80 bp, Chlorella protothecoides
actagagtacagaggatcaagcggcgtacacgaggggactgctgtatgaaggggcgatgtcgtggcctgcccgggtcacc

SEQ ID NO: 31946 - DNA, 89 bp, Chlorella protothecoides
gagccatgacctcagcctagccctgacacaccctccacataagccagtcactcccgcccagcctaccataggtccaggtggcgaggatg

SEQ ID NO: 31947 - DNA, 155 bp, Chlorella protothecoides
cgtggtcgccgacttccccgccttccgacagagggtgcagggtctgctggaccgtgcggaacggctggagggaggcccacactgggcgacgctgacgcgtgcataccgagaactggaggaacgactcctggcgggggcgcacgcgccggtcggtc

SEQ ID NO: 31948 - DNA, 65 bp, Chlorella protothecoides
gctactcgaacccttcggagggccccttcaccattgccgacatagtggccgccaaggccacagtc

SEQ ID NO: 31949 - DNA, 70 bp, Chlorella protothecoides
gggccgccgctcgttcgtgcctgacgggaaggaacggagcgtgtgtgtgtggtggggggggggggggggg

SEQ ID NO: 31950 - DNA, 143 bp, Chlorella protothecoides
ggacctgcaaaggtgggtgtgatggaaggaacgcctgggcgggtgtgtgtgtgtgctgagatcctgcggggtgctgcgcacaacgttcaaggagcacccacccctcatccgctctgtacatcaggatcgcaaagtatggcgac

SEQ ID NO: 31951 - DNA, 61 bp, Chlorella protothecoides
tcgaggccgaccagccagtgtctgccatctgaaggtagacaatgccagtcagccccttttc

SEQ ID NO: 31952 - DNA, 75 bp, Chlorella protothecoides
tgacagggactgctgacaggctggatcaagatgcctgtgacccagtgtgggaagcgattctgggctgtgctcatc

SEQ ID NO: 31953 - DNA, 430 bp, Chlorella protothecoides
  modified_base (224)..(344): a, c, t, g, unknown or other
gaccgaccaggtggaggtgggcgggtttccacccgggttctaggggcgccgaggcggttgagggacgcggcacaccgagcgcagcttcccaccctctgcttgcttgtggcgacccatgggtcctcagcccctgggtcggccgggactctgccagcccacccaccctgtgctcgatgtcgagacccgagcaacgaaaacaatcgaggacaaggcaggggcatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggacctgcagggatacgcctgttccctgctggggaggatgcacttcatcatcccaacatcgtctgctcatggcaaggccagcc

SEQ ID NO: 31954 - DNA, 79 bp, Chlorella protothecoides
ccatccgcatgggcacgacggtgtgtatggtccgcggatcaccaatgttcggctgggtgggggctcagagcagggtgcc

SEQ ID NO: 31955 - DNA, 71 bp, Chlorella protothecoides
catgtgggaggagggctgtcgggctggctgacagggtgagggggaaggaaccctgtgtgatgcacacaacg

SEQ ID NO: 31956 - DNA, 171 bp, Chlorella protothecoides
gatgcggtgcgtatgtgaagtgcggggtggcggggcaggagtggcgaggtggggttggccagctgccctgtccattatgtcgtgaggcgacggcactgctgccctgccccgatccgagccgctttggcgctcctgatccgggtccctagccccattgccggccctactcac

SEQ ID NO: 31957 - DNA, 71 bp, Chlorella protothecoides
cgaggaggtacccggcagccggcccatcgttacaacacacccgcgctcccaccttggacacgttgctgcag

SEQ ID NO: 31958 - DNA, 2654 bp, Chlorella protothecoides
  modified_base (95)..(104): a, c, t, g, unknown or other
  modified_base (1179)..(1188): a, c, t, g, unknown or other
  modified_base (1762)..(1771): a, c, t, g, unknown or other
  modified_base (1848)..(1857): a, c, t, g, unknown or other
  modified_base (2190)..(2199): a, c, t, g, unknown or other
  modified_base (2472)..(2481): a, c, t, g, unknown or other
tctgacaggcagaggcggaggtgctgtggggcttggcggcaacgtgggactgggctgaggcggtggtgacacacttggactcggcctcggaggtnnnnnnnnnntcttggcggcgacgtgggactgggctcaggcggcggtgacacacttggactcggcctcggaggtgatggacttggagctacaggtctgggatttggtgagggtgcacttggaggaggactggaggcggacggggattgagatggtgaggggcctggactaaagtgaggagagggtgccgcggctggagagggtgcttgggacggtgacggaatggagtggggggaggggaaaggtggagtcccaggtggtggaggaagctgagatggtggggaagggaggggtggtgggcgggtggagggagagggaggtagtggcaggggatccaaaatgagcgtctcatcggtcttcaggtcggaggctttgcactgtgtttgacctccgtggtctacactgttgcacacgatgttgtcgccccaattgttgctccctatcacatggttgccatggttgacgttgcctgtatggcagggaggagtcaggagcggtcgagcaccatacatgccaagcagcccaggaatatacacggcagccacctcttaccgagattgttgctgccgtgattgttgcgacctgtgttgttgtacccattgttcctgtgtccaatgttgccgttgacatccggtgtacacctctgcagtccagcgggcaggcactccacaatgctgagagcccagcaggattgcgtgtttgagggagtgcaggtcgccctggactctgggtctatggtgcgcatggagaagtgcgcaaagggcaagctcggggtgatctccaactccccgctggttccagcggattcataccctttgagcctgtgtggtgttcagaggggatcagaggtttttgtgggctcatgctgaccccaccttcactacaagtggcctccagccggatgcgtgcagggaagtgacatacccaagcgcactcctgccaaggtctccccaagaacccacctccacttaccagcagaattcatcggtagagacggagctggtcaggtacagatctcccaggtacctggagagtgaccaggcgtggttcagtcaggcagtgcacgacgaggcatgggggaccacnnnnnnnnnngacccacctccacttaccagcagaaatcatcggcagagacggagctggtcagatacagatctcccaggtacctggagagtcaccaggcgtggttcagtcgggcagtgcacgacgaggcatgggggaccaccacctggcttgatggtcacatggtgcaagcacaaacgagccagggactgcacggtcacacatgaccgacacacacccatcccgactcactcgatggtgggaagggcgaagaaggtgattctgggatcacacgtctgcccaggtggtggtggcgaactttgcggcggaggcggtggtgcaggggccaggtcgagggtctcgctggttttcaggtcagccagagtgcactcgtggtgatctgcatggttgcagacacgaaggtcgccatgtatgccatttccgacgtttccatagccccggttgccgttgcctgctcaggggacggatgggaatcactgagcagggcacttgggtcgcaaggtccgccatcccaggtcatgagtcacatgcctcaccgaaattgttgtctccaatgttgtcatttcccacgttgttcctgccgacnnnnnnnnnnacacgccgtggacttggtaggttcgcagacggtgtacgtcgacggatcaatggtgttgatggagaaatcgatgaatnnnnnnnnnngggaggcattcagggactcccgctgggaggcactgtatcatacccacggcctcgcatgccgtggacttggtaggttcgcagatggtgtatgtcgacggctcaatggtgttgatggagaaatcgatgaatggatcacgtggacgcagttgtaaggtgtgggcgatgattcctccgccagggtatcctttcagcctgcgtgaggggaagcactgctgttgccagggacagcgccgcactcaactgatgcagggggggatgaaaactccctttcactggcttgaagacgatggcaaacgaactcagcatgatctggatgtggagcaaggagactcnnnnnnnnnngacgccgcactcaactgatgcagggagggatgaaaagtccctttccctggcttaaagacgatggcaaacgaactcggcatgatctggatgtggagcaaggagactcacatgcagtatgcagccggcgcagcggcgctgagcatgtacagctggtcctggtacctgattgggacgaggagtggatgcttgggagttgcaaagatgatccattgttttcataggctgagctgtgcgtgagcgggctcgacgcatgcaagctgacatttggggacnnnnnnnnnnaacgatccagtgttttcataggctgagctgtgtttgagcggtctcgacgcatgcaagctgacatttggggactcactggacggttgggaggccgaataaggcgatgcgaggatcacagccacctcttcctggggatggaggaggggatggggggggcggggggggcggcggag

SEQ ID NO: 31959 - DNA, 82 bp, Chlorella protothecoides
ggctggcgccagacaccgcctggcgcgccctgaagcgctcggcccccgcgccggggacgccccggcgccggccaccggcgac

SEQ ID NO: 31960 - DNA, 73 bp, Chlorella protothecoides
gagccagcatgcacctccaatgcctctggcccacagtccctataccctttggaagaagggatgtctggccgta

SEQ ID NO: 31961 - DNA, 139 bp, Chlorella protothecoides
cccagccctccagccaggtgctgaggactgtgggtcaggccagggggatatcggcatcaagcccttcaacgatcatcagggaaactcgaattgacgatttcattgaaaacctcagatcagaatacagcaagcctccttg

SEQ ID NO: 31962 - DNA, 76 bp, Chlorella protothecoides
gaaggagatgccaaacccgatgaggccgctgagcgccgccacggccatgaaggcggggttgcccaggtcgggctca

SEQ ID NO: 31963 - DNA, 61 bp, Chlorella protothecoides
atgaaggcggggttgcccaggtcgggctcagaccacacacgccctgcctcgcccgaggcgg

SEQ ID NO: 31964 - DNA, 157 bp, Chlorella protothecoides
gatgtggccttccctgccctcagtgctgggtgcctcgtgttgcaccctgcaatcactgttttgtgttcttgataggtggtccatccgagcccacctctccattcctcctttctcatgcatgcagcgtgcaaagtgcagcgaggaggagcgggcgtcg

SEQ ID NO: 31965 - DNA, 61 bp, Chlorella protothecoides
attgggccaggcatgcttcgaacgccggagtggacgggatccttcccaacttgcatatagc

SEQ ID NO: 31966 - DNA, 39089 bp, Chlorella protothecoides
  modified_base (110)..(119): a, c, t, g, unknown or other
  modified_base (521)..(530): a, c, t, g, unknown or other
  modified_base (4001)..(4112): a, c, t, g, unknown or other
  modified_base (4231)..(4240): a, c, t, g, unknown or other
  modified_base (4359)..(4368): a, c, t, g, unknown or other
  modified_base (4524)..(4617): a, c, t, g, unknown or other
  modified_base (5906)..(5915): a, c, t, g, unknown or other
  modified_base (6864)..(6873): a, c, t, g, unknown or other
  modified_base (9007)..(9127): a, c, t, g, unknown or other
  modified_base (10056)..(10065): a, c, t, g, unknown or other
  modified_base (10526)..(10535): a, c, t, g, unknown or other
  modified_base (10948)..(10957): a, c, t, g, unknown or other
  modified_base (11388)..(11397): a, c, t, g, unknown or other
  modified_base (13659)..(13668): a, c, t, g, unknown or other
  modified_base (15993)..(16002): a, c, t, g, unknown or other
  modified_base (18677)..(18686): a, c, t, g, unknown or other
  modified_base (19588)..(19597): a, c, t, g, unknown or other
  modified_base (20335)..(20344): a, c, t, g, unknown or other
  modified_base (20827)..(20836): a, c, t, g, unknown or other
  modified_base (21809)..(21818): a, c, t, g, unknown or other
  modified_base (22444)..(22453): a, c, t, g, unknown or other
  modified_base (24757)..(24766): a, c, t, g, unknown or other
  modified_base (25690)..(25699): a, c, t, g, unknown or other
  modified_base (26378)..(26387): a, c, t, g, unknown or other
  modified_base (26454)..(26479): a, c, t, g, unknown or other
  modified_base (27769)..(27778): a, c, t, g, unknown or other
  modified_base (28389)..(28398): a, c, t, g, unknown or other
  modified_base (28558)..(28567): a, c, t, g, unknown or other
  modified_base (28901)..(28910): a, c, t, g, unknown or other
  modified_base (30072)..(30081): a, c, t, g, unknown or other
  modified_base (30461)..(30470): a, c, t, g, unknown or other
  modified_base (30858)..(30867): a, c, t, g, unknown or other
  modified_base (32436)..(32445): a, c, t, g, unknown or other
  modified_base (33422)..(33431): a, c, t, g, unknown or other
  modified_base (33903)..(33912): a, c, t, g, unknown or other
  modified_base (34837)..(34846): a, c, t, g, unknown or other
  modified_base (35351)..(35360): a, c, t, g, unknown or other
  modified_base (38719)..(38728): a, c, t, g, unknown or other
ggggtggggggtgggggggggcgacactgcctgagccccagtatactacaggaggggcagccccaccagccaacccccaacccacttgtggtgcgtcaccaccagcaggnnnnnnnnnnagcatactacaggaggtgctaccccaccagccaaaccccgacccacttgtggtgcgtcaccaccagcaggaggaagaaggtcaacaccgcctgagcttccgctttgtagagggactctgcacggttggagggaggggtgtgaacctggtctgaggagcgatgcagcgtggagggggggcgagcctcgcggccgcccagaaccagccgctcacctttgaacttggtctttgtctcctccagttccttgggtcggtcgtcgctcttcttgtaggccggcactttcagcgcccagcaggccacagtctgccaggtaggattgccgtgtaatgttgtgctgcaatcatgggacccacccaacgacagtctgagaggggttcccctcctccagcccagcaccctacnnnnnnnnnnagtaatgttgtgctgcaatcatgggacccgctcaacgacagtctaagaagggttcccctcctccagcccagcaccctacctcgtgcacggtgcggtccatgatggcgcgcacgatgggaaagcacagggccaagcacgctgcgagcacatagtccgcggagccccccttcaagaagggggtgtcggcgaagacggtcgccaaaaccctctcgaaccagcccccatcagccatgggtgctgcagagacctggagtgctcgagagtggaagccttgaggggggcaacggatcgtcaggacatccgttgtgtcctcacacaccccacgacaccctcttgtcgaggattcaaagcgcgcccagggctccgatctgggactggggcccagcatgcgccgcacgcggtcatgcgtgcagttcaatgcagtccaacctgttgcccccgaagcacccccatgtgcgtgtattccgggagtccccaccctccacgatgcattccaccaccacttaatgttctactgaactattttgagaccacagcgcccgcatcaccgccctcctcagcctccgccaacacctcctcgagcactgctccaaggccaccccacctcggggcgcgcaggcaccatgcgccgctacggggcgctcgccctcctcctcgccctgtgcactacatgcagtagggtccaggccgacgccgacttctcaggtatgcggagaagggtgcgggactcaaccgcccggcaactgcctgtgggcccggttcctaagccccgtccgccctcgctcccccctcctcacgcagagctgtcacagaccctggaggagttcctgacctccggcaactccttcaggaacatcaccaacctggcgtccctcctcggctcctccgccgccaccgccgcgcccagcggatcgtcctcggccatcgtcccagcgaacagcactaccatgagcggcagcgacgccaccgccggcctcttctcctccttcctgggctcctccggcggctcccctggtggctccccctccggcctcttctcctccttcctgggcccatcggcatctgcctccgcctcctccttctcctccctcctgggcaccaccaatgcctcctccgccctgacaacctacctgcagagcctgaacccgggcacggtcctgaagaatctggccaaggtggccacggtgtccagcattgtgaagaagaccgacttctgggaggacctgaaggacaccatgtacggggcggagtcgctgttcacctccctgtccctgtcacacacccacaacctgctggccctcgcctccgacttcatgaacggcacggcggaggtggcgcgggacgcctggcacggggtcaaggccctggagaaggagctgtgcaccgacggctttgccatcgagaaggcggagctgcccaccgcctgcgtgggttacaatctgaccctggccattgggggcgggttctgcatcttccaggaggacaagtccatccgctgccggaagcccaccatccggctggtgaagacgcccagcgagtgcttcctcaagcaccaccaggccaccatcatcaagtccaaggagtgcaaggtggtcaagacctggggcaagaccaagcagggcttcctcaagccggaggaggggcccaagacctacaacctcaccaaggcgagccacggtggtggtgtttccgggggcgggggaggttcggggaccccggggccaggccaacacctcacatcataatgggaatcgtggaccaagcccaccgtccagattcccagctggcactcaaacccccacccccaccaacccacacaccgatcccttcagaccctggatgactcgggcgtgctggacgctgtggcgcccatgtgggacggcgtcttctccaccctcacctcccggctggcgaagcaatacaacatggtacaagacagcatcacctcggcgacagacaacctgcaggcctggatcaggcgcaaggttgcggtgcgcatcttcagctgaactccctgacgccgcgccctgccggcctgctgcgggcacactgggagggggcggccggtcgccgcattccctctgggaacccccgcacctcgccagcggctgcctaccgagggtgatgcagacagcaccatcccctttcccgttcatttcatttgcattgatgcatgtttcggagcccccctgcacctcccagcccttgctcggttgggtgcaggtggggctcgtctcgtgacgcactgtaacatcaccctgagccccccggtggcgtcctgaggggagaccggggaaacctgactcccatgatggggcgaccaaggaggatgagaaaacctgcatcctcctttctcgacaaaacttcctggccaagacaccccccttccttcctcgcaacagattacaggatgactcgcgcacgtgtgtgtgtctccaagcaagtgaatcgacccgctggcccccgctcagatggccgcaaagtactccttgctcttggtggggttcatggtcttctcgcccggcttccagccggcggggcagacctcgtcggggttgtcctggacgtactgcagggcctgcagcacacgcagtgcctcgtccacattccggccaaaggccaggttgttgatggtggagtgctggatgatgccctcccggtcgatgatgaagaggccgcgcagagccacgccgtcggcggacagcacgccgaacttggtggagatctcgcgcttgaggtcggagaccagggggtacttgaggtcgcccacgccgccctccttgcgctctgttggattggcggtagtggggaggaaggtgggaatggggttgggcctcagagtccgtgctcgtcgctcctcatccctgggcgccggtatccagcaggcaagccatgcagcgggtggcagagcccccggcgcatgctcaacactgtcaatcgcaacaaaaccacggcgcacccgtctggatccaggccaggtgggagaactgggagtccacagacacacccaggatctaaagaagcgagggatttaagggggtcagtgggtcggtaggatgacgccgggcaagcaggactgagggcagtgggaaggagtcagtccactcgatgacactgattcagggttgagaggtacattgccttgaagtgacagcacacttgcccagctgtaacaggccatgagaaagtgtggtggcccaacaaaaacaaccccatggcccccacgggagtccccaccacatcaacaaccccccacctcggtgttcaggtcggcaaactcctggtggcggtcggagaaggcggtgatctcggtggggcagacaaaggtgaagtcgagggggtagaagaagaggaccacgtacttgcccttgtactggctcagcgtgatgtccgtgaattcctggtcaaacacggcagtggcctcaaactcgggggcggggttgcccaccagcggcccagggttgttcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggatgcgaagggttctgcatgtcacagatggctgcatcaaggcacaggactgacagggcctgctccaacactccctgccccgactctggcgcccacctcagcgcggcacctcaggcnnnnnnnnnngggtatgcgcagggttctgcatgtcacagacggctgcatcaaggcacaggactgacaggtcctgctccaacactccctgccccgactttggcgcccacctcagcgcggcacctcaggcnnnnnnnnnnctcctggtcaaagacggcagtggcctcgaactcgggggcgggattgcccaccagcggcccagggttgttcagggtgtgaatctggatggggaggggaagggaagggcgcggggtggaggtgtgtgtgatgccaggatggactattacatgggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatgcgcgacgagatgagattgggagcttggcacccatccccctggcctgtggaccggtggcccggcatgtgctgcagactgtggggccggcacgggggagggacctggtggcccccgccccgacgggcgcggcgctaacggcagacagggcagcgatcatggctgaatcggagtgagacggtgtgtttgtgtcatggatgcatcggggtggcatgagttcaaggccgggtgggagcttcggggtggaggaattatctgcccacgtgggtctacctctatctgttttggtggggcgacgggcctgggagggccgaagtctctgcccaccggccccaatgtttctcaacctgtcgggagcatccatttaccttacatcaagtctctatgcgtaggcacagtgcaggccatgagccagcggcgcatatttatgttctcatcgggggcgctggcggcaagggctggcaaaggtggagcggggggggctcgagtccgaccttctgagcgcagggatgcaatttgtagtaccaagtatctgagcggggcacacaggccgtctgtggccgccaaaggggcaaggggggaccagagagtgggcagcaggcgcccgggaagtgctaggaatgggggattcacggcggccctgaccccgccgcactcacacgctggcggtctccggggccgcctggcagaagaggcgcatgagcggcgtgcgcgagacggggcactccgcgctgccgaaccaggattgcgtcgccggcgcgtcggtctgcccccaggccccccggaaccagagccagggacagggctggtcggtggtcacgagggccgaggcctcgcgcgccggcacgccgcgtggggtggccggcgccggctccggcagcgtgctgccccggctggggcagacctggaggcgccaggtggcgggctccggggcgtggggcccctccaggggacgcgacggctccggatcccggctgtagggcagcaggaccacgcgctccgggtcccaaaccaggccggcgtcggaggtgtggtcgttgcccaggccgaagaggcgggggatggtgcccacctgtgtgtgtgtacggcagggtgcggggcctcgtgttgctgggctggagagcggggtgaccaggagggtttggggggcggaacggtctgggcaggggttgtgccatgcaatggtttgcgatgtgtggagcctggcgctgcgctcagcaccaaaatacggtcgcctctgcacggcaggcacccgcaggaagcgaatcgccagatcacagcagggnnnnnnnnnnacttgcgacgtgtggagcctggcgctgcgctcagcaccagaacacggtcgcctctgcacggcaggcacccacaggaagcgaatcgccagatcacagcagggcatgggcagcggtcggccagcgtggtgcctcttcaataggggtgtatgaactgccctccctgatatcccacacaagggtacaagtcccccttcccagcacccccccttcccccatccccacgcactcgtggataggtgccgtggccgtgcagggcgacgtaggcaaggatgcggccgtcgccgggccggcgcggcacgtcccgtgccggcacccactccccgtcccggctgcggtgggcgttgtaccagacgcccagcagctggccggaggggcagcggcagcgcacggtgaggtgctcccagtcgccgtcgtgcgcgccgcagcccagcaggtaggggccgttgtaggggaagagcgtgacgtagctcagctccagcacctcgggcgcacgcgtcgcggggcaggtctgcaccactttgggcaccacgtagaaggggacgcgtgggagccagctggaagccgggccaggacgcgctgcggggtccagggacagcaggagtggggcatcggggggctggccgcgctggcgctccagcagcgcccagccgtccagctcgccgtggcgcgacagcggcaccgcgtccgcctcgtgcccgacccgccccgccagcagcgcgctgtgctccaggaagtactccgcgctgctggggaggaaagggtcgcgcgggtgcaggtgcagcacggggcagtgcagggccacaagggccttgagcaggctcaggtccacctcggtggcgtgggccatgtaaggaataggctcggatgtggggatgtgacggagcagccacgttccgtgtaatagcaggatgtggggataggtggctgggacgccgagcgcaatgactcnnnnnnnnnnccaggtccacctcggtggcgtgggtcatgtgagggatagtctcggatgtggggatgtgacggagcggccacgtcccgagtaatagcaggatgtggggaaaggtggctgggacgccgagcgcaatgactctcaggctaggactcagctttctcgcctttggatttagcccccgggccagagaactgggtgttcagccactggactgggcctgtgacctcgtttttgccctggggtgtggaggggtggggggaggtgaggggccctggagcactcagtccatgcgcctcagaccccgatcgccagcaggctgcgacttgtgacaaccgggaaccagaatccttcagatccagccactcactcgcttggtggtgtagcactgccagaaggcctggttctccggcaagcagcacccgacgaaggattcccacagggagcactgacggaagcaagtgaccagcctgtctgcgagggagagtggtggtagcgatggtcatcgcggaactttgaattttgttgcgacgtgcatgccaacaaaagttgcgcacgaaacccctggctcacagtgctcggcagcgcaggcctctagggcctcctccttgctgacggactgtcgaggatccgatccggggatctccatgccccttccctccatccgacggcaagatggtacggtgggccaacacgggaggagccatgcgaagctgatgtggagcttcgccccagtatgaatcatagagcgtacaatggggagccccggggctctcatgctgcgcgcgcggtcgccggaaggaattcaatcgacatggggacaggccccggccccagaccccttcaccacctctagccgatgcctcctgtaatggcatagacgccttgatatcgaccatctccaccctgataatgcagtgagagtggtcgcaggggattctccctgcacgctcccaggcgtggatggccccccaaggccacgagttcctcgactttttcgagcagctacaagccaaggtctggaactctggcccatccccttcagatgaatcctccagagctgcaatatcgcgcaggacagactctggtgagggggagcaggcgtgtctgggagggctccggagggctttggaaccctgacacgagtgcgtactcccggatctcatgggaagcagcgggctggatgtcttcttgttcatgcatgggtacccagtctatgtacacggtatcctcgctcatgaggccgcctgcccagcaaacacccatagcccatcattacaccccttgttaaaaggactccacccgcagccctccatcccctggatcattctcaccccagaacggtttcccctgcctccctgcagttccaccccccgccctaacagaccccgggtcaaatgacaccacgggcctggacctcagcgagctgctggaggcccagcgccgtatcggcccctgcctcgccgagctgcgcgcccagcagcgcaacgcgccgcccgcccagcgcgagtcctactccctggagcacgtccggcgcctgtacatgttccgcccgcgccggccctacacccgcgcgcgcgacacgcgcctctgcgcgcggcaccacccccagccctgtgcggcggggtgccggacctgccacttctgccggcagcgcctggtggagcccaagaccgcctgcgcggcctgcgaggggcggaacaactactacggcgggccggggcgcgggtactggtgcggctcctgcctctggttgcgcatgggggagaatctggacgaggtccggagcaacccggcctggctctgccccgcctgtcgcgacatctgcaactgctccggcgccaactgccagcgcctgaagcgcggctggttcgccaccaaccagctcgcgcacgaggccgccgcgcagcactacgcctctgtggcgcactacctcatcctgacgcacgtcggggcgcaggtggccgccgcgcccatggggggcggcgggacggggcgcggagcgccgccgcgcgcgcacgctgtcgccccgctgccggcgggggagggcgccgggctccccgccccgcccaagcgccagaggctgctggccctggcgccaagccggcgccaggtgctgcaggccgcgtcggcggggggccccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcagcaggcccgggggggaagcacgttcttgggcctactggacgctgagctggcagaggaggatgatgtttcgattggtggtgagttgatttttacgtcgtgagttccccaagggggggtatgactggggttgaggtaggtctctggtatttattcacagcatgtaggaacagcaatgtgacagaggcattcagctctcccttgcgtgcgccacccgatcctagggagagcaggccttggcccccatcccaacaccctttgattctcctccgccctggcaggctccacgccgagccggacgatgcagacgaccctgcacagcatatggcctggcggccggaccccggtcgcagccgatgcggtggactccgtgcacaccccggactggcgagacccagcgccccgacgccgcgcgacccccgacgccacgccgcccggcccgggaccggcgccgctgggcatcgagtggccctccgcagcgggccctcatatctcgcgtggggcgtggtcagcgggccccttccccctaccaccagcgtctgaggtgctggacagggccggcactgtgtggcggcgcgaggggcaagcgccccagtggcccgcagagggggccgattccagacacgcgacgagaagggggccgcttgccgcgcccggcgttcccgacggcccgcatggcggcctgcccggcgcgtctggcgcaccgcagtcccatccccctaggagggctcacctgggtgacattgcagcgcccgcccgccacgggtacgtccgggccagagttccctccagggaggcctctgtcgctcctggctttggactccccgagcaggagcacgaatggcagggtaggggcccggcgtcccctgcgccggcgcatgagcctggcacctcgacagtgccgcaccccgccgcgagtggcgtannnnnnnnnngccggcgtcccctgcgccggcgcgtgagactggcatctcaacagtgccgcaccccgccgcgagtggcgtatctgagggagggccccgcacgacgctcgcccgccgcgccccgtcagctttccttgcgtcagcgacgccccctgccagcctggcgagcacggcggcgggggcggggccctgcgctccgcccgggcccgagccccgatttgaggatgcggcgcgctggaacgagctgtgcgtcgcggcggagctggcggtggctgcggtgcaggacatgtaccgcttccacccagactccccggcctgcgaggggcgcgtgcccggcgtgtccgatgcacaggccaggtccacctatgcgcgcatggtgggtgctgtgtgggctgcggtgggcccagaacgcctgcaccggggttggtcaggacgcagcaatacccgcatgggccctggcttgccactgtgcnnnnnnnnnntgcccggaacgcctgcgccggggttggtcaggacgcagcaacacccgcatgggccctggcttgccactgtgctgtgaccctgacctgtggaaagggcctgacatgctccgttctgccgcacaccacagcacgaggcttgtgtggcaaggctggaatcgctgctggacaccacggccggcatgctgcgggaacctgtcgcgtgttgcgagggtgctggcaggcctggcaatcccaagctgtacagtcatgcggggctgcgtaggtgggtgcgcagctgtttgtgagataaggggtggcatggattgcttacatccatctgtctgcttgtcagtagatccctgtgcgggtaggagagacatcagtaggctgtaattatgaggtggagcaaatctggtgccatggacccctgccannnnnnnnnnttgcgggtgggagagacatcagtaggttgtgatcatgaggtagagcaaatctggtgccatggacccctgccacgatgctgcatgcaatgcttttctcacctgcagatacgaaaatccagggcctggaatcaatctcaccctcccattgcccgacccctgaacagagccgtgtcgctgctcaattttcttgcctacctcctaccaccagacatggtgctcaccagggtccagcccttgctcctgcccaatgaggtgattgggatgatcaggcagcatccggcgtgcaggggtggatagacacatcttgaggtgcatgtgccttgaatctctggggtccccgcgcctgaccatactagtttgagcacccactgggcgccctcggccagcacactgccacgccccgctctcttctccatccaggccggcccctnnnnnnnnnnatccccgcgcctgacaatagtagtttgagcacccactggccgccctcggccagcacactgccacgctccgctctcttctccatccaggccggccccttctgcttccctcggtgtgacgcacgggcgcgcatcatcctgctacgaggctgcatcgacctcctccgcactctgcactggcggcagctgtccttggatggtgtggtcgccaccctggccgacctgcgtgcgtgctcgacatggggttgtgtctgttcttgtggggcagggtttgagactgagggccttgcctgtgacgcgtaacgaaacatgccaactggtgcaaggaatcgccatctcaacacccgatccaaccctaaccccgtgcatattcaatggctggcgcagttgcaaacctggtggaggacctctccatggcgctccccttgctggaagggatgctggacgtgagtgaatggaagatgtgcacagcgcctggagggccatgtcatgttgcagcggcctccagcccatcgctttgctgagatccctgtcctcctggcggccaccactcggtgctgaaccatggatctcctccacacaatctcaattcgccgcagagcgaaagcctgcctctgggcgacgtgcgcataggaccctgggtgtccgatctgcaggcctcacaggtggagcagtttgctcagctcagcacactcttcgcggtgggtgtgggtccgaggcctggctggagcgtcgaggctgtacggctgtctttgcctgcgggacttggcatatacgtgtgtgcgctcggacactgaagccgggccctcctgctgggcgtcccttgctcatccactcttcccctcttcccccccttcctcccgcagacgacgcagcaggttgcacagtacggcctgtccaatgtggcggggttggcggcctcacacatgggccttgctgcggggaggcttctgagccccaggctcctgcaggccctcctttcctccaccacacgcctgcatcgtgacacacgccgagaaggattggccctggtctgcgaggtgagcgcatgggaggaggtccccaggttgcggatgagtatgggttctgtcgtgatgggggctcgatgaatcacttcgagtgtacccattcattttcaatctccatgccgcacggcaagcaggctgcctcccactccccccccgaccgtcccgcaggccctggacgcgacgcaggtggcagtgtcgtccggggcgctgatgcagctgggcgctgcggagcgcagcgtggcgcaagcggccctggaggccctgtgccgggccgtgaagtccacagccctgccctgcctggaggccatggtggcggcagactacccgctgcgccgcgcgcccggccgctccggcccaggccggccgccggcccccgaggcggaggaggtgcccgagagcgagcgtgtgggcggcgagaaggtgaggggcttgcgaagcgccgcagcggagcagtgggaaagggaccgtacagcaccgcagtctgccacgccagacgtttggtgtccccagcagcctgacccgaccagtcccccgcatgactcctttgctcgtgcctgcgcttgcacatgcaggtggaggcgctggcgaggtgcctggccttcctgctggatcagcggcgcctttcctgggatgcggtggagaggctggcaacctccccccaccaccccgacgccttctggcgggtggccaaccgcacgtaccgccagctggcctgcttcctgctggcccagaccctgcagcacgcgccgctgtccctgacctccccggggtcgatcgcgggcatgctgcgcatctggctccaggcccagttcgagggcgcaggtcggctggggccctggtacaccaccgcggtcctggccggcgccgccggcactcgtccattcttcctggacgtgtgcgaggaggacgtggcggcgctgcagtccagtgtggaccccgaggccagggccgccctggttgcgggggtggttcgccgcgtggccctggaagccagggcgcagctggggcccgcgctgtgtgacctggatgcggtgagctgggaagggaaggcggcggggcggccttactcaccatcaaccctgatgctggacacagatgagtggcctgccgctgtgtgcacgaggatgtttgacccctcgaacatctaggacccggtgtttgtagacatgctccgcctctggaactcacttcggcgtgcatgtccctcccacacgacagatgctggccgcccggtgcnnnnnnnnnnaggggggcggccttactcaccaccacccctgatgctggacacaaatgaggggcctgccgctgtgtgcatgaggatgtttgaccccttgaacatctaggacccagtatttgtatacatgctccgcctctggaactcaattctgcgcgcatgtcccccccacacgacagatgctggccgcccggtgccgagaggtgggcgccacggcgttcgaccctggggtcgccgcccagcggtacgccggcctggcctggcccctgctgcacggcatcctggcggagctggccgtggcggaagggtactcgcgcctggaccccgccctgtcgcacctgcggcacgcagggtcggtccgcttggcctcctgggtcgcggaggcggcgctctccctggcccgcgatggaagtggacggggcggttccagcggcgccgcggcaaacaccagcctggaggcggtgggcgtgctgcgccggcgggcacaggccacggtcctgcgccatctgccctccctctggtccctgatgctgacctggcggccccaggccacgccgctgctggaggaccacggtgtgcagcagcccctctggaccgtggcggccgccttcctagagctgggcagcggcgcggagcaggcttcgccctcggacgccgtgctggcagagactctggcccgctccctggcggagccggggccggggctagattcgaccgcgctgggcgagctgcgcggcgcggtggtggccggcttctgcgcgcgcgctctggcgcgcgtgtccatccgccacgtcagcaatgagcgcgtcgccgtcgtcgcgctgcgcctggtccaggttatctgggttcgagttcagggatggttcaattgtggggtgtgtgatctggcgggggaatggtgcgggcctcatgcggatgtcagagtgtggggtccgcaaccttttgcggcggaaagtgtcaacatgagggtggtctaagggtggtcggggccctgtgtgtcgcggcaccgtgccactgcaccattcacacgcctggctcccttatcccactctctgtccgccctcacctcataccccatgccccccccccccaaaaaaataaccatctcacaccttccatcgcaggccctgctgacccagcccagcatgcgcagcgcggcggcaacactctccgtgctgcagcccctgctgcgcgtcctgctggaggtgctgtgccccgcctccgatgtccagtcagtgggcacgcagtccgccgccctggagctcctggcgggggtcctgccccgctgcgcacgcgcgccgccgagcgacgacgcccgcgcgctggccgtgttctggcgcgctgccgcggagggcgcgctgctggccgtggccgcctgcctacccgtgcagcacgcggcggcgtgcgccgcgcggctgcggtccctgccaggcacgccgccgccgctgctgcccgccacccctgcctctgccggcgcggccgccaacgcgctcctgcagctgctcccccgcctgccgggcacggcggccgtggaggcgctgtaccagcggcacggtccgccctgcggcgccgggcacgcctcacactcgtcgggccagcccttccggccggcaggctttgcctggagccgggcggaccgggccgtggggctggtgcaggccatggtgctggccgtggcgcgggcgcacggggaggaaagcggggcggggatcgagcgtcagcgggtcgggtgcggggcggtgtcgatgcagcacggggtcgccatcgacgaagaaccctcgctgggggcaggcatcaaccccgcgggtgacccgccgctctggcccgtgccggagcacagccccgggtttctcgctttcccggccatgcactacctgatcgcgggcggcggggtggccgccaagcccctggccccggcctaccgcgcgctgcgggcgagcgtggcggggggcgcctccggggccctcctgctggccagcctccccctgaagagggtaggtgggaccggggagggcgcgacgggtgacggcgaggagcgagggccgggtggggccgggggcgctcggcccgtgctggcccggaagcagggcctgaggagcgagggcgaggcgggcggcgtgggcggccgcctctgcggcaccccgaccctgaaggtgcgtgtggtgcagacgtcaggcgtggtgtcatgggggaggacacccaggcagatggcttgggcgcaccgaggcgccacgtcccccagccagcgctgcagctgctggacacgtgcagactgcctggctgggtcaccccttgtctgtgcatcggtcatgggcacgctcccaagtggcatgctgnnnnnnnnnngagacctcaggcgtggtgtcatgggggaggacacccgggcagatggcttgggcgcaccgaggcgccgcgtcccccagccagcgctgcagctactgggcacgtgcagaccgcctggcagggtcaccccttgtctgtgcaccagtcatgggcacgctcccaagtggcatgctgccggtgtccagagtccaaggacggacgccgccagtcccctcggtcgcccacctggacttttgcctggcatgcgcccccacccaccacgcacccagccctcagcaccccccctcccttccctccagacgctcgagaacggcactgcagtgctcctgttcctgctcacggaggacgatgggcagacctgcaggtgcctggtcaagaacgagcccctgctgggccagctgcgccggagcctgcgcttgtgagtcacggcgagggagggggggggtgttttaatgtgtcccgtcagatggcagcctcgcccatgcagctgagcctgggaggcttggtgctctgatatctgctgcccgaggtgcatgccgctttcgcctgtacagaactcatgtcccacctctccacctccctacctccccgtttgccatcgcagagagggccctgcccctgcctccatggatatcaagatcagcctctgccccatgaagtgtatcaaagtggagaacggggtgtcgagcctgcgagacctccctgacacagagtatggcgggaggtgcttggggctggaggggagacttggatcccaaaccatccgcggtttgtactctggaaactcactgaccaacaggtggcacagggaagctccctgggccccgcgccgagccctgccagacactcggatgactgcagcagaatgcccgctcattaccacacctcatccgacttcatcagggtggagattgcctcgtgcgatgcagccgccagggtcagaacggatgagacggctccttccatctccgtggcgtgcagccaggctggccctgcgcgcggcacgcccagggcgagggagtcggagcacgaggtgtacagccaggtcacccctgccttctcctgggcgccccggggtggggcggctcccaccggcagcagtcaggcgagcatgcagcctgcaagtagtctgggtgggcggaaagggtcggtggtggagaggctgagctccgtgctggcccggctggcagaggagggcgtgcccaaacaggaaaggaatgcggcccttaaacgtgcgcagcgagacagcgagtggagggagtggagcgaggccaggctgctggaggcggcgcgggcggcactcgattagggagaggtcgactgctgaatattactgtatgaacccctgagcatcgtgttcctgactgagattgtcctctgggctctgttgcactacattgtttggatgttctgcctttcctgcgcgaatgcttgaattcatcactcgtctgtaagccttgctggccgtgcatcccaaattccactgtgcgcgagtcaccatgggctgaggtccgagcaacgcttaatacccgcatgcaaatcagattacatgcacagaacctcttgtcggtatcgtgggtcctacctcaccgcccatgttctccgagtccggcgctgagggtagcaccggagctacgaccgcgaactgcgcctcgcacaatcccctcacagcctctctcctgaagcattgcgcgttactgggtgtatctccaccccaggagtatgtcgatgctctgctgcatgtcccttcaagcttggtactcgaagcacctggcagaccacctcaaggtgcatctgtgttttgagtgccatcatcatgtcagatgcagtagccatggcattggcaaggccaagcttgaaaccaattaggatcgaaaccaaatatcattccttctggcagatggaggggcagcgctgcacctggcaagtatccccgtgacggaggagcagctaatgggtctgctgaactgcctgctcgcccccctgccccgcctcctcctacgccacctggacctgtcgagatgcacggtgggttgatgcctgataaatacaaacgcgtggttgacccataaactgctccaaaccaaagtttgttcccctctgatttcacccctcccattattctctttcacttggccaggtgaatacaagggtgatccagcagctggtgggcatggtctcatctgacccggaggcctcagcgtggaggctcgagggtctcgggctgcgacaatgccagctcccacctggtaggaacctgtatggctggtcatgcgggattcctcatggaatgttctccattctctttgtgctgaaattcaaggcaggggtagtgttcccctgctcctcctgctgatatccaaaccattgccacaggggccatgtccttgctgactcaaccaaaagcccagagactgctcagccacctggcatggctggacctgtcccagaatccagagctcctgcgcacccccctggagagccaggattggatggccctgtggcgcctggcacccctccgccacctggacctcacagtcacaggcatgacagcgggttgtgccactggttgaaagactttctggatttatgtgacttgcaaggcttgccctcgatgtgtgggtgcaaagctgtgatacattcattcaagtgtgatgtactttgacaggttcaccatnnnnnnnnnntaaagactttctggatttatatgatttgcaaggcttgtcctcgatgtgtgggtgcacagctgtgatacattcaagtaagtgtgatgtactttgacaggttcaccatgggtacagtcgcatcttcgaggattgaagtcaatttccaccgtcccgcaggtgcctcgctttcttgcttggcccaggccctgcactggctggtgcattccgcccccctgtcggccacggctcgttgcgccgagtacaggcacgatggggccctggcctccctgcgcagcctcagcatcagcgtggctgccagtgctgaggctgagggcagggacgaggaggagctgctgctgggtgagagctgggggaggcctggatgccttgcacacacgactgtctgcgcctggctggctgtgcattggatcgaaggggtactggggaaaggcatggtttattttcatgcattgatcagtcttgactcattcccaattgcagggcgtttgctggctgcgtttgtggcggcagccccttgcctggtccgccttgaggtccaaggcctgacaagtgcggcggcgaacgatgctatttgtgccgcctggcatgtccgcttctcaggaaccgaggcctcgaccctgacggatgccgccgggacactgcacctgtcctctgggtcggcccaggaaagcagcgccgcctcaagagccccatgccagcacatgctgccgtcgccatccacaccgcctgcgggagcgttcggggatcaccaggccctgggatcggcagcgaccgaggtggggtcatgctatgcttgccgtcctcttgaagcccgatgtatggtgcattcgtacgaatacctccctcacccgaccctcacatattctctctcccccgcagcatgctgaggtggcaccaccccnnnnnnnnnntgaccgaggtgaggtcgtgctatgcttgccgtcctcttcaagcccgatgtatggtgcattcgtacgaatgcctccctcacccgaccctcacatactttctctccccgcagcatgctgaggtggcaccacccccacccttcctgctccccggggtggtggcctcccggcagaggcacctgggtccccacagtcatgctcccagctccagtctgggtccgctggagggtgacatgttccatggcggtgagtatgggagttgactgaggctctgcgcatgccagaggcactctcaggacggtgcccacctgcgacgatgcatcctcgattcatccctgaaactcatccccgacccatctcctacaccctcttggcacgcagatggcgggccggccccagccgccctgccccccttcctcccctcccagcgacccgcggtgggttccaggcggtcccgtgacccgggtgcaatctaccgagggagcgaagccctgcctgactttggcatggatctggagggagagcggtctgctgagcacagcgaggaggaggaggaggacagcgatgtctcgggcagcgcctcatcggacggtggggagtcggatgcagacatcgacctgggacggccgcaagctgcgcctgccgtggctccatcacctcaacctgcgaccatgcccccagacacccaggctctggagcggcggggcgcggagggtgcaggggcctcggagccgccggcgnnnnnnnnnngcggctgcaagctgcgcctgccgaggctccatcccctcaagctgcgaccatgccccgagacacccaggctctggaacggcggggcgccgagggtgcaggggcctcggagccgccggcggccgcgcagcagagccgtttcaggcaaggcaggaaggccaaggggtactgtgaatgctcagagccacgatcacccctgtgatccagtcagcatgtttgcgcagccctcgcaacagccctgtcgcccatctgattccccaagcacccgtcacaggatcgaggacgggcagctggatgacgatgatgtggcagcgcggaggtacgcaaggcttgtaccccagatgataaggtgagcggctcagccatactattatggcgcaagctgccttcagaagcatgcgagagtcctgttggaacgggggggcctttctcattggcactccaggttgaatgcacagggcgtgcatgcccagaggtgtccaggtnnnnnnnnnnatattatggcgcacgctgccttcagaagcatgggagagtcctgttggaagggggggggctttctcattggcactccaggttgaatgcgcagggcgtgcatgcccagaggtgtccaggtagtcctcgtgtctcttgagcctgcagcaacctcactgctgcgctcaggtcgatcccagatgaggaggactgcaagcgtgcaaggcaggcctaccgacactggttcaacatggcctcggatccctgggacaggtgggtctggtgacacggcggtgggcccaagctgtcaacgctgcgctgcctctcccagcatgtcctggtggggccacccagcaagttccacgttcaggctgctccctgcctgcatgcaggcggcgatgggtgaaccccaggatcgaccgggaggactcccccgagctcctggggctcctcaatctgctatacgatctgcttgaggcgcatgggctgcacctggacttcccctttcccctgcggaagccaggcaagctggagacgacggttgatatgagcatgatgcgcctgacccaactcctcagcgctgccgccacagacagtgcgtccctgccacaatcgacctccgcaggtggcgggaagggcgccttcctccctgcactagagaggagcttggaacaggttcctgaaccggcatcaccgccgcatttgagctctgcagcgcccgaccaaggggacccctcacccctgagcgcaccgaccgccacgcaaacgaccaggagccaggctcagaggggggcgcgcaggatcgcagacagtgaggatgaggatgaggacggcgctcccgacatcttccccgacaggtactcggggtgtgctaaagtttggtaggacatcgtgcgcacatgtacctgtgccccacaagatctgaggagcgggacccaatcgggaaatgtggaaacacgtcggtatatgagccatcgcgtgtggctttgcactcaannnnnnnnnntgggacccaatccggacatgtggaaacacgtcggtacatgagccatcgcgtgtggctttgcactcaagcacctggttccctaccttgcagtcaacccgaggatgactgagaggcagcagcttcctccttcgaaggcatgccaagctgggcaaaacgtgttgggtggatctggcagctgagagtgacgaaagtattgagagcccaacccatactagagacactgcatgcatgtttaccctgtcagtggtcacagacaacaacttggttcaatcaagtgtaggattcaagtcgtcgtctctacagtgaggccgatggcggagtggcaaaccttcagagaagtggagacttcaacaccttgatactcagcgtgaacccagcccctgcgtcggtgctgcgctttccattccaaaatcagtgcacctatacctgaactcctccctgggataccctgaatagagctttcctgtgttgtccctgaatggtacagatgcttcaatattcttccttggcacacgcaaagggtcaaagtgcactggatgctgggagtccctgaaccatgccctacttcttccacgtgggatcatccttccccgtggcccagtccctcagcctgttgaacagcttgnnnnnnnnnngcgcagagggtcaaagtgcactggatcctgggagccctgaagcatgccctacttcttccatgtgggatcatccttccccgttgcccagtccctcagcctgttgaacagcttgctaggcagggcgggaatggactccatggcatcaaaaatctccttgatgtcagagttgggatcctgcattcccgcctgcaagtgctcgaggggtgtggcgatccagcattgggcatgcattcgtctaccactagactgcaggggagtgatatattgtatcgcttcatgtacccaccctgcctccctgcactgccccaatcccacctttgtcgggatgcctctgatgggggcgaggcgctgtcgaacgccatccatattggtaagcagaatcttgcgctcggcgatgcgttgcttggctgccgccttctcctcgggcgctgcatcgccccgctgaaggatgctgatgtcctcctcgattcctccactgtacccttgaaccctaggggttgtgggcggggggtgaagagggtcggtgacagctgccaggacgtgtcatgagcaaatcatgctccaggcaggcctaagaggggggtctgatgaagccagcagcaatgttcattggttccgagaggcatgaagccccctcacctggctctcaggtcggacatgagaagctgcaggatctcatactcattctccacagatatgatcacgtcgcgctcaaaatttacctgccggacaatatgaaggtgggaggtgttacagttgcaaaaggtagctgcccgcaatttcctaggcgagtgcaatggacacttgattaaaacttccagactaaatgaggacaatactgtacaaggcatgtcttggtctggtgctgatgtcctctctggcatcctctgcagcaggttgttcccgccatcccctcatgcgatgtttccaagagtcgctgaaactcctcaccttggcaaactgcgcggtgtcctggatccgagacaggcggaggtaggccaggtgttgcacggagagtgagtcatgtcgtattgggaacatctgcttaactcctgcggagtatgggatccatggtgcagcagctccttgagggtgggcctccacggagccttatgactggcagactgcgcctgcgaccaggccatcaaagcggctcactcatcgacaagaacattgcctcaaacaccaaagcgccggtggctcacccagccccacggagtccaggatctccttcttcaagccatacaggcggtctgtgatgaccagcgaggccggcacctcgaggaagtcgacatcctgcccggcggtgcccccgcccagcgcaaacatgagctcgcaagagggtcgctcgtccctcaggaccaggtcctgacccctcctgtgatggtgtggtcagggaggtgcggagggtgtacacatggcgcaatgccatcccctttctgttcatactagcgaacctcgccacccgttctacaggtgccaggcgcctcacttgatgccggtgtcggcccgtactattaccgacgaggaaagggagtcgtagtccacgaccgcccccttctccccagaccggtcccagtcgcgaagctgtggcagcagcgcaaagcactctgcgctctggaggtagaagacactgcgcagcgtcgccgccatggcttcgatgaacttggtctcgctgaatttatctgggggtgtttgtgtgtgggaggtaaaggggtgtttaggatggcactgtgagccagcaggagctgttttctctgtattggggggctggtgcagtatcatgcgctgcatgacccagcccagacccacatgctcagcggaccgagtgatgcagtggccaccatcatggctacaaaacccttgcgtacacctgaccagggcccacctggaggaaaggccgctggatcatgctcactgatcaactttgagatgtctgcccactcagcgatcagggcctgcttcctctccacgaccatgtctctcaccggcgagccctgcaagagctcatccagtcgctcctgcgaccagagcagggggctgctggctcgtccctcgcccggcctggccagcatctccacagccgatgcctgggagttaggggatgagcatgcaacccagctgaagtgagcagacgagcttacatctgttgtgttctcagtaccatcaaaggcaccaggccagagatgtgtggaggtgtgctgcagctgtcctgcccagggccatggcagatcatagactgtgcaagcggtcgtcatggacagtatgaaatcgactcacctcctggtgcatcagccagagtgnnnnnnnnnnggatttaagtaccatcaaaggcaccaggccagagatgcgtggaggtgtgctgcagctgtcctgcccagggccatggcagagcatagactgtgcaagctgtcattatggacggtatgaaactgactcacctcctggtgcatcagccagagtgcaatggccacaagctcgctgcgagactctaacaaaggctccagggcctggatcgactgggcatctgcccttgtgatggcgtcgctgtcgggaatctccaggacgatctgcacagggtgccatggagaggttgccaacaggaacatgccaggacaaagaagcttgcagtctcacaagatgcaccattccccgtccagcgaccctgcatggacgtcatacctctcccgtggcataatctcttgcagcgcatggacgctccccattgctgctcacgaactctgatgccaggctcggctgcacggcagaactcgcagccgataccttgtgtcgggaccggtcacgtgcatgtaatggagtgctgcatgaggaggaaaacctgggttggcacatctggccgggcatgggagcgaagcgcaccccatgctcccatgcaggccgtccatgcaaagcaggcgaggctgcagagcgcaacatgttatcgacgtatgtcacacttgcatcgatgtgattgcttgacaagcttctcatccgcccggcgctgtcatgcggagggtctcggatgtccggcactcttcaagatcgtagaggggcactggctggaaaggacgaggttgcacccacatggtccttggagctcgagtacaggttttaaggcctgcgactcataacacgttcaggagagacctaaaggacatcttctttgggagcattgtagggcctcgaatatcgggacgctatttttaggaggtgccctgactctcacacagtttacannnnnnnnnnctcaggagagacctaaagaacatcttgtttgggagcattgtagggccccaaatatcgggacgctatttttgggaggtgccctgactctcacacagtttacaaaccgtacgcttggaaactcttcgtgaaatatattcatgttacagaatacggactcgatacatatctccccgtgactacccagagtgtctcaagtgtttctgctcaagagcaacccagagctaatgctgcagagtttgtgggatttgggtggctgagcttgtggtgtgatatcctaaccagcaggggtgcatcgtactagcccatacgtagaactttcagtacttggagtcgaggaaggtctattgtgtccaaacaaggcaggggtggcgtgcttcgcacgagttcctctatcacatagtcgtcggggtcccgctctcaaggattccagacatggggaggcttactccgagagttcgctggatgaatgagtgccgtgcgcgttgtttgtttgagattgccgataggcatgtatcccagccgacgaggtgtccacggggaacaacaagcaaatttgtactgcgtatgtatattggcggtaatactgggaatgtcatcaaagaacgacttacccgtcctggttcatcaggagcagtagatctgtaggtccccagttcgatcctgggaggccggattcccnnnnnnnnnngaacaagcaaatttgcactgcgtatgtatatcggcagtaatactgggaatgtcatcaaagaacgacnnnnnnnnnnnnnnnnnnnnnnnnnngtagcgacagactgtaatcattcccttttatatccttgggtttatttttatgttaaagtctggttgctggtctggatgcaaaattgatgcagtgtgccgttgtttgtgccggcatccactgccattttcttccatctagctttgtacctctgcagtcacaaattgctacaacaaacgcagtgccccagcaggattcaacgacacattcctccaagcatgcatgcatcactctagtttttcccgttttgtcagctcaaacatcactgacggcaggcggtagatgttgatgagcgcccagtacagttcctcctccaggccgagctccccctccgcccttgcaatgtagatgtcctgtggacatggaaggtggcgggacagtgaggacagtggggcacaacaccaggttcaggttgaaggatgcagggatcaacccctgtgggcgcggaccgcctgtcgctgcgcatccagtgccagccgccgcgctgacctggcagagggcaacgaggcgccgggtgttgggcaggtcctcgtacggtattcgcatgcggatgttggtcatggacaggcgcaggaagcgcccgatgccgtacacgaacacctgcgcgagggaaaattgttgtgtgtgcgtgtgtgtgtaggtggagggtgtgaaaaggggcatgggccggggtgtcaagaggaagcctggctgcgacgcatgatcttcgagtgcccgtgcaggaacgcttgaaggtagcaacattctaggtcgaggccgactcacggtgtacagccctgcaatgccgaatttggagagggtctgtccgatgaacccgccctgcacacgatccaggaccgacaccagcctgcaggatgatgtgggggagcatgatgtttggaatttgcgtgcggaaaggggtacaccactgaaacatgttcccgcacagaccccggcagctgcaagctgccattgctctttccttcccctacttgcacgtcccttccccctccctctgtaaaacgcactggggacccaggaaggacttggagcagtggtgggcgtcgtgctccgcaaagggcgcgccccccgcgtccaccagcccacagtcgaagcgccaccaagccgcgccgcccatgccctcgccctcccgctctcgtcccaggctgacgttgcaagccacccactggtcgtcccagccctgcgacccgggcatctgcagggatttaagagaggggacagaggggggggggagggtttgtttgttgagcagtgacggtgtgcaaggtcgccagttgtttgccacatgagcnnnnnnnnnngagagaggggacggagggggggaagggggtgtttgttgagcagtgacggtgcgcaaggtcgccagttgtttgccacatgagctggggagaggtgtcctgctgcagcccttcctgaacatgctcaaccgccgccttcgccctcccatctcattcccccatccactccacacaaagcacaccagcttgcacccaccccgtcgacgttggaggccaggggctggctggagcagacgtcgccccgcatgtgccagaagcgggggtagagcgcggcgctggcgccgggaccctcccctgcgccggggtcgttgctgcgcagcagcggaacggggtcgctcgggccgtcccgtaggagggccaggagtccttgccgcgacgactccgccagggtcacggaggtggagcccacgcagagggggccgccgtggtcggagaggggcggcacgtcacgctgcaccgtccaaccaaagctgtcatggaattttgtgtgtgtgggggagaagaaccatcggtaatgagcacgaccgcgggagagctatcaggaatacccaagtacacccacagatgctgctccctctcgcgccatggtctgacaggggcttgaacagcgtgtnnnnnnnnnnggggggagctatcaagaatatccgagtacaccgtcagatgctgctccctctcgcgacatggtctgacaggggcttgaacagcgtgtcctgcgcacaccttctcaagggtaagcctcctacccagtacgtgtccatgcaccaatttcctcacctgagctgnnnnnnnnnntgcacaccttctcaagggtaagcctcccacccagtacaagtccatgcaccaatttcctcacctgagctgggcctgggtcccgttgtcagacagcatgttgataagggaccgccggccaggggccggcagctgccagtacgcgtcggcatcctgggagacaggtgggaaagatggctgggctggacacgagtcccggattcctggaggccccttctcgccctacaggggccacgtgcgtgtcaccactgccccaccgtggtcatgccaacatgcaggcatcaccggcaaacccaggaactcgcatgcacccaccggcgaggcgcagaggagctgnnnnnnnnnnaaaagatggctgggctggacaagagtcccggattcctggaggctcccttctcgccctacaggggccacctgcgtgtcaccactgccccaccggggtcatgccaacatgcagacatcaccggcaaacccaggaactcgcgtgcacccaccggcgaggcgcagaggagctggaactgggaggcctcgtagtcggtcatgcccggccctagcatggcctggtcgccaccccactccccagccactcgccggtcgcccgcggcgaagagagggaagctgcgggtgctggtgcggtgcttcgcattcgcccccggcacgggcttgccgaccagagtcacgttgacgccaaagcccacgacggcggggacctggtaggtcgggttgcccgaggagaagaccagcagcggcacccagagcaggagcagcaggccgacgaagagcagcgtgccctgtggtgtggagggagagagggagggatgcggtttgctacaggattggcgctccacacttcagggtccatgcgcgaggcgttattttgagttccacaaaccatcccggcatcgcacctggaagaacttggagtagcggggctggcgctgcccgggcggttttgcagcccgggagcggcggagcaccgtcacaaagtacaggctcatgttgatgtcctccagcttcagccagtccatgaaactgacagaggtgcagtgtgcggagggcagggagacgtgagccagagcggggccattgtcatcagcagagccacacgctgtgctgcatgattcttgggaacagtttctctgtcccccatcgttcttcaccagccccctaccctcacccctttcaaccagctcacgtgagggtggtgggggtgcaggaccagtccagcagttgcctgagctcatacacaaagggcaaggcgacaaagacctggaaggcggcggagctgtagatgttgatccgccgcatgaagacaaaggtgtgccggcccatcccgttccttcagagatgagggagtgtggggcggggtgaggggctgggggctgggggctgggggctggggctggaggtgacgcagtgtcgctgaatgaccagcccacagtgttgcatccttatgcctgttgtgtgccggctgtttacccactccaccctcacagccccgcacctgnnnnnnnnnnatgcctgttgtgtgccggcttcccacccactccaccctcacagccccgcacctgtagctggcgggcggggggtagccggtgcgaagctgcagcgccgacatggcaaaagaaatgcacttgagggccacgagcgtgcgcaggtgagcatgcgccctgccagatgtggcaggtgaccagaagagggacaggcagtatgagaagaagacggccatttgcctgtagggatggcgggaggtgtgtgggattagggggtgtggtgatggggatagcttgcccctgacagaagtctgcgcctgctccggcatttgccctctggctcctcgtgtcaaccagcatccagtcgagtccagctcaaaacacacacaacccaaagcccagcnnnnnnnnnnggtggtgatggagatagcttgcccccgacagaagtctgcgcctgctccggcattcgccctctggctcctcgtgtaaaccagcatccagtcgagtccggctcaaaacacacacaacccaaagcccagccgcccccctgcgcacgtgcagtggagcatggccttgcccagcggactcccgacggtgtagaagaggcggtccagcacgatgagcatgaagagggtgatgagggtgaccaggtagcccagcggcaccacatgctcgtttgtgatctctgcgcggcgcagaggcgtgcatgggggtgagctggcagcgcggagacttctccatcggagaactgtgtcatgcagatccgcagagaaacgaaggcacacggcagacggcgatgtnnnnnnnnnncgtgatctctgcgcggcgcagaggtgtgcatgggggtgagctggcagcgcggagcctcctccatcggagaactgggtcgtgcagatccgcagggaaacgaaggcacacggcagacggcgatgttcttgcaagtgcatttccaagtgggccctggcctcccctcacctccatcccgtacctgagaggctgcgggcggaggccacgaccttgttgtagaagagggccacgtagatgaaggccacgaaatcgatggcggccgtgatggcgtaccaatcccgcgactgccggctgtggtgctcggcggccagaacgaccggggtctcctccgccacggcccccctgccagagccgcgctccgcctcccgggccagcacggccgtcacggcggcgcccggggacagtgcacgcaggggccacgtcctcccgcccgcgctgtgcgtactgtgctggggcacgacctccatcagcaccgccagctggtccggtggcgtgccggccggcatgttgagcacagccacatacctgtggttgtgtaaaggaggtgttttgagggggggaggggtgccgactgtgtagagtaccgcgacagtggtgagggcatttggtcagggacttggtcacggcgcagaaagactatgactcaaaagacagtgccccacattgcgttcatattcatgacccatgacccctgcacatgccaacacgccggcctacaccacctcaaacgccccaaaaccactgtcacctcaaaaccaggggccccatcgctgccaggagcggggcgtcggcaggcacctccgccggctgctcctcctcgttcacgtgcgcgaggcgcagtcgcggggtcccgctgccggcggcagccggcacggaccgcccggccgcggacccgcacacctcctccgcgcgccgcgcgtccagcaccgactgcaagaaggcgcacgccgcctcccccgccgcgtcatccgcgctctcgctttcctcccggcccacgcgcagcgcgcgtggcacgcgcagctgcacgatgacgtggtgcggcgggcgctcgcacactgtgcaggcctgcagcgcgaactcggccaggcaggccgccgcggacgtagccgccagcctcaggcggccccaggcagagggcgattggcctggggtggaggtgtcgggggcctgcgcagggatctcgccccttgcgcccgctgtgccgccggcctccaggtccgtggaagtgtgtggagccttgccctccgcgcgagacaccacgcagacgggtggaggtggggcttgttctgtggcgccgacactcccacgtccatccacggggccgccgaggatggagggactgagcccatggcgtgtggtcagtgtgtagctgtgcatcagggtgaccaggtacacaacgaagagggggatgcaggccacagagctggcatggatgccaatcacctccatactgtgacggggaaagaggagaagggggaacaggtgcgtgggtgtcggtggttagggttgcagaggctgcgggggaggatcgtatacgtgttatacctccagggacttccctgcccaccagcnnnnnnnnnntgggttgccgaggctgcgggtgaggatcgtatacgtgtcatacctccagggacttccctgcccaccagcggcaagcaatcctcgcgcaaacagccgcacacgggccacttgcactcccagccaggctcacgtgaactggagctgcggggtcacaaaggagcagcccaggcgggtgggaatctggtaggcatactgcacgatgatgaggagctcgctgtacaccagtgtcacctgcgcagggagtggggttgtggggtcttttcttccagatgttgtcttcagagcaaaggatggcggctggcatgtggcacttactttgccacagcacctggcccgctgtcctgcctgcctcctcacacacacacacacctcccccaaaaagaaagaaaggaggaaggctcaccctccagtagcgcggcgtgggcttgacggagcagagcgcgtagacaaacatggagagcgggaagaagagggccaggagggagtagtcggccacgaagacggccacgtacgcgaggtaggcgaccaccgactcccggtccaggcggcgcaggcggtgccgcaagtgctgcagtgcccggtgcagcagacttacaggctgcgaggctgcggctgccgtgcccgacgccgactccgacgccgtcccctggcccgcgccgggagaaccccggcgatcgacagccatcccacacgccctggcctcctcctcctccaccgccgacagctcgcgctcgtagtcggtggccggggtgtgggcggggcgactgcccagggccgggccgggcagttgctgtggcggcgaggcagcgggaggtggggaatcgcgtgcctctgagcccctcctcgccgtgctctcctcctcgctggcagaggccggctccacggggtgggacttcaccgccgcccggccaccctccccccttccaggtgcccggccggccggcagaccctcctcgccgctgctgccagcgctgacnnnnnnnnnnccaccgccgcccggacaccctccccccctccggatgcccggccggccggcacaccctcctcgccgctgctgccagcgctgacgtagtccgagtcgggtatggtcagggcagagtccgcgcgcctggcggccccagcggcgacgctggttggtggcgacgctgcaccctccacacgatcttctgtgggttcagcagccacttggtcgccagccgtcgtctcctccaccggttcctctgccggtggccaagcctccccttcctcctcctcgtcttccttgacttcctcctcctgcgtctctccctccaggaaggcaaaatcgagggaggtaggggacactccgacaccaaagctggcaaaactcgagccaacgccctcctgcaatgcaggcagggagcgagaatcgtgagactctggcaggagaagggcttactgtagtgcggggggcgttgctgccaagcaggtgccatctgnnnnnnnnnnacgaggatcgtgagaccttggcaggagaagtgcttactgtagtgcgtggggcgttgctgccaagcaggtgccatctgagacctgaacagcaagtgttccatgaccaggacctcaggtcaacctcctttcgccgtgccttgagtcgcgccaccctctgcgctcgtgcggcgcgctggcggctagcctccacggcggcggccgcctggcgcagcttccaggcagcctcctcatcactcagcgtctgctggtgacgtttttcctcctctgctaccacgaccatcaccctgatggtcaggcagaaggggggtgtggaggactgggagggccaggtgcgtgcaaatgagcaagggcagcggcctgcatgcctggacgggcctttgacaaagcctcttcgtcaacaggtacccctcgccgctccagcctgccaagagaataatgatcacaatacccacttctggtatgtcgtcgtcgcaaagaggtgtgtctggaaacggatgaggacccagagcacgacgtccgcggcggcgccgcggtagccgccgcccaggagcgagccccccacgctggtcttgtaaagacccaggaggtgggccaggttgcaggcctgcacatcagggtcgatttgccagctgaaccaggtctcaaaagggatctggtagataagcgtgatgacaaggacggccatgttgtacaggggcagccaccagaagagcctacttgtgaggagtaggggaaaagggaagaggggtgttgatccagaagctgctgcctgtactcatgcatctagcgaccaagtgtcacacagggccgactccagcgtccctgcacaggcactcgtcctcactgcagcgaagctacacggatccgcttgtacccagacaactccacaccgccaacctcagtgccacccacctcccaggtgcannnnnnnnnngaaggggtgttgatccagaaattgctgcctgtactcgtgcatctagcgaccaagtgtcacacagggccgattccagcgtccctgcacaggcactcctcctcactgcagcgaagctatgcggatccgcctgtacccagacagccccacaccgcaaacctcagtgccacccacctcccaggtgcagcacgcagggcgatgcgctgccggaagaagaggagggccagggccaggtagccggcgtggatgacgtcgttttccagcgtacacagcgccaccaccgcgaccagcaggaactccaggtagtgcctgggaggagtgagggacgcgagtgcaggtgaggtgtggctgaagctgcgaggcgtgggtattctgccaaccatgttcttcacagcgagccagggtcagacagcttgccaacagattggcccggttaactggcccatgccgcccacccacacgctgtcacaccccgctcaacctcctcaccacagccgaggctcgcacnnnnnnnnnnggctcaccaacagattggcccggtttactggcccatgccgcccacccacacgccgtcacaccccgcccaacctcctcaccacagccgaggctcgcacctgtacatccagaagcgcgcccagtcggcccaccgccacgcgggttgcgcggcgagggtgaggggctgccagagcagggaccccggcagagcatcctgttgcacatcaccagggtttcccatcagcagccaggaggcttccgcggcctgggcggccgccgccgcccgcccctcacgctgcgcgcgctgcgtcgagctccggtctgccagcgcgagccactcggcgtaccgcatctgcagcaccgccgtgctgtaggccaggaagaggagccacagggcgctgcggctcacgtccttcaggccaagccagacctgtgtgttgtagcggtggtgagtgatggcgcgtgcgtggggggagagaatcccatgctgacggcaatgtcgagcagcctcatgtcgggacgcacatcctcgcgatggatggcggtcctcaccaaaactgcgcctggaagacaacgctctcctcccaccactgcaaaccacctcgaaccccgggagaaagcacgaatgcgaacatgcctgacccaccaggaggtcgtgccgcgcgtcattggcgccctttaggacaggcagcggcggtggcaggcccaccaggacagagtactggccggcgagcatgacgcccagggccgggaccaggacccagcggcaggcctgcgtgcggcgggcgggcgccagggccatgaccaaccccagcagggcgacgtggaccagggccagggccgtggtggcctggaaggcggtgaggaggaggaggaggaggcacaggtccatgttccagcgctgccaggagctctccagccagtcctggagcgcgaagcggaaggcacgccactgccctgcgacgggcagcggtgggggcggggcgggggagctcagcccggtcgcgctcgggccgggaggcgaggagccccgggtcgaggtgaggggcgcaaagggccgtgcgtcgacggagcggccgcgcgtgggggtccctgcgattgtatggcgccgaggcacggcgggacctgcgctcgcctcgagcggggccgggcgcggccagtccagcgcgtccagcgcggagcgcgcccagcggcgcagcgtcgcgcgcgcctctgcagcggccgcgcgcgcgctgcccgccagggaggacaccgcggtgccctccgccaggaaggcgcggggcgagagcaggcccgccgcgcggcggctgaggcgcggcgcctcgcgcgggtccaggcctgggcgcaggctgtcctcgggcgtggggggccagaagagcgggcaggccgcgccggccaccctcgagctcctcactgctgcaggcagctggctcttccacctacacgtgtgttgaaaaagggggagattgggaggagaaaagggcaccggaggaacgacccaagaattcgggtcaaggatgctgatatctcaagcctcgccaagcagccagacaagtgcatcagatctctgcctccccggcaccagtctcttccagcgcccgcatacttgagggagcgccgcttggcagcgacggtcaccagcaccagcaccttccaggtgagcaggcgctgcaggtggccggtgtcgtgttggctggggtccccagcctccaggcccagccaggccacccaggcccgcaggctgtgcaggtcaatcaggccctgttccagttggtcagtgagtgagtcgagggagcaagagctgggaggcggcatgctaggtgccgcacagccaagcgcacatggcctgagcctggcccagccggtcaaaatgcctggccggctggacactctcacaatgcccacctggacccaggcgatttccaccgagtactgcaggatggtccaggcgcccgcgacaagctgtatcgccagcagggtgcggtacattcgggccgtctcgcccggcgccaggcgctgcgcccagaggaggggtgggatggccaccaccccacctggaaggttgggagaggtgggtttggttggatgggatgtgcggtatgggaacgttatgagtagaaaagcacatgccccaaagccagtgcaagatcttccacgtgctctgagttgcatgttttttcaggcgagccgctgctgcgtccaccattcatgcccatgcctgccgcaggcacccacatgtgcacgcggcctccacccaccaaacacacacacagaaaggccctgaagacaaccaaaccattccgcgcccccccccccccccccccccccccccgggcattactgcccccccccccccccccccccccccccggccccccccccccccccccccccccccccccccgctacaacacacctggaggggctgctccgcgtcattcccagatcaagcagctcacagatgatgagcgccccgatggcccccggcagctgcatggaggccgcgaagcaggccaccacgatgagcttggaggcgtggagaatgagcaggcgcttgaggaagcccagcaggccgtactgtgcggtcagccgctcccgctccaccccctccggccccagcacctggccctccagctgacggcgcagcgtgcccagcgcgaacagccagcggtagacggccaggcaggccagcacggccagcgggcgcagcaggcgcgccgccagttcgcgccggccaggatgtgtggcgatgcccagcacgtcgcgggcgaaggcggcccagttttcgggcacgtgccaccagggcgccgccagcacggcgcgcgccgccagctggcacagcgcgtcggccagcgccagcagcgccagcagtgccagcgggacccaccgtggaaggggggacccgtccagcaccaggtcggggccggccttgacccagcgccccttccgcggctgccacacctgtggtgttgttatgggtgggagggggagtttgtgaggctttgggtggggaaagtctgagggtcaccaggtatcggcgccagggccacgggcatggttcccccacgacaggaggttcagccctccacaccccagcagctgaggtgcagcgatggcccacaagaagctggatggtgctccacccccgcctcctcaccaggacggagaggccgatgcagaggtacaggaggcccaggagtgagaggtcgcagtcgaccaacaggaggatgtagacctgtggagagcagggggagatggtcggtggtgatgcaggtgggcggggagtgcgaggacaggaacgcagtgggcgtcccgcacagaaattcctctctcagtcacaggagggcttcagcagcgttgtctcagagaccaaccactccnnnnnnnnnnaaggacaggaacgcagtgggcgtcccgcacggaaactcctgtctcagtcacaggagggctttagcagcgttgtctcagagaccaaccactccaggcatggtgcaagcgccattcctttaacagccacccctgaagctgcctcgggacccgggcaccgccctctcacccccgcgcacagccgcaggcgccggcagcaaaccactcaccgccaggcacacaagtgcggggccgtaggccactgccgcgtgggacagccaggccgtgcccgggtactgccagtcgaggagcagggaccggggcggtcccccccccgggtccctcgacgcctccacccgccgcccgagcgcgtcgtgcgctgccg

SEQ ID NO: 31967 - DNA, 61 bp, Chlorella protothecoides
acaggcacggcactggtgctattggagcgaaccctccgtcgcaagctggtccgatccccgt

SEQ ID NO: 31968 - DNA, 68 bp, Chlorella protothecoides
ctggcaagggtggtgagacgaccagcctggggcagggactggcaagggtggtgagacgaccagcctgg

SEQ ID NO: 31969 - DNA, 129 bp, Chlorella protothecoides
gcccttccttggcatctccattgctgagctacgacggatggaggccatgtatctacacaccaaggtgacccagccgagccgaaggagcgcaccagtgcgtccccaaacacccaaacccctgcaccccac

SEQ ID NO: 31970 - DNA, 61 bp, Chlorella protothecoides
cagctcaagcagccccccctacccggtcccagcaagccctccaaccccagcaccagccagt

SEQ ID NO: 31971 - DNA, 352 bp, Chlorella protothecoides
ttcccccaagaggtcgccgcctccttcccctaagaggacgccgcctccttcccccaagagagtgcctcctccttccccccggaggtcgccgcctcctgcccccaagaggtcgccgcctccttcccccaagaggtcgccgcctccttcccccaagaggatgcctcctccttcccctgcgaaaagatcaccacctacacctcaaccctcctcacctctgtcccccgccccagcaccctctccttctccttctccttcatcacccatagcttcccccacctcaccttcccccgctcccatgccctctccttcaccatcatcactccccccttctcctccgccctcgtcacctccc

SEQ ID NO: 31972 - DNA, 123 bp, Chlorella protothecoides
cggcaggaaggggaaaggtgtgtggaaagggggccgcgactcgtgctgggagagcgagaattgcctggggcatggactgagatggcttgcgtttggccccagcagcagtgcctgcaggctgtg

SEQ ID NO: 31973 - DNA, 207 bp, Chlorella protothecoides
gtttggcatgagcttcttgggaggatgggaatgggcggcctgggcgagcatgccaagccccggaggcactggtatccttcgggagcaagctcatggacccggacatccaccgcgcgataggcccccctgccgaggacgctaacaattcagccttcccagggaggctctgcaatggctctctgcgcacccattccccctctcacctgc

SEQ ID NO: 31974 - DNA, 61 bp, Chlorella protothecoides
cgtcttcgcctgccgcgccggcaccgtgcacgaggaggccatgctggccatgggtgcgctg

SEQ ID NO: 31975 - DNA, 222 bp, Chlorella protothecoides
cagcacacccacgctgacctggcacacctgcacctcctgcagtgtgtttgttgagtgtgtgtatgggggggggaggggggatgtgagggatatgtttgagtgtgtgttgacatgtacgataccaatccagactacctacacaagttcctgaacgccacgctcggcagcctctcctgcagcaagatcgcaggcagcatccatgttcctccccccccccccaac

SEQ ID NO: 31976 - DNA, 69 bp, Chlorella protothecoides
ggccgccattggaagcaggacctggccaagcctgagatacgccctcaagggatacaagaggtgcgattg

SEQ ID NO: 31977 - DNA, 75 bp, Chlorella protothecoides
tcaggaaacgcagcaccaagccctggagacaagggtgctgctgtagccagcctcagcaagccgttgaagaaagca

SEQ ID NO: 31978 - DNA, 61 bp, Chlorella protothecoides
cggtccatgccggcatccagatggtcagagacccgccggctgcacgccgcacggcgctgac

SEQ ID NO: 31979 - DNA, 99 bp, Chlorella protothecoides
ggtgtgggataagcgatcgggctctatgatgacgtgggcgccacactctgctcctcagcccagcatcagaggcggtccgtgctcgccgacccccccgcc

SEQ ID NO: 31980 - DNA, 68 bp, Chlorella protothecoides
ccctgccataagaaggtcagggggagtctcacgaacacgaacagacgctggtaggggattccccgcgc

SEQ ID NO: 31981 - DNA, 80 bp, Chlorella protothecoides
ggcacactgggagggggcggccggtcgccgcattccctctgggaacccccgcacctcgccagcggctgcctaccgagggt

SEQ ID NO: 31982 - DNA, 420 bp, Chlorella protothecoides
gtacatcttggtccgcccagggtcgatgccgaggtactgttgtatcttggcatcttctggaggggggtcacgcctgcagaggtgtgtacaggggggtggggcgggccttccaatggaaggacgtcctgaacatgcggcccttgccttgcaggaagtcatacacgcgctccgtagggatggttgcctgcgtcaagggctttgtagtaggtacagtggactgtggccttggcggccactatgtcgaccatggtgaaggggccctccgagggttcgactagcggggggacaccgcgcattgtttgcaactgatttgatatttttagatgtgaataaacagtcttttttgggggggtggggtggtcggcgatctgtcatcgggtttttactcactcagatcctgcgcgatctgggactcctgga

SEQ ID NO: 31983 - DNA, 95 bp, Chlorella protothecoides
acctgagcactacataggatcagtactacctataatcgtcctgaatctacaccagctgcatgactcaacctccgacctgggccatcgcagtcctg

SEQ ID NO: 31984 - DNA, 70 bp, Chlorella protothecoides
ctcgcatccatgcatgcaggcgcttcccgggctgctggctgtcctgctccccagccagacctacctgcgc

SEQ ID NO: 31985 - DNA, 61 bp, Chlorella protothecoides
ctgactcttggatgtggcctcagcggcagggcacacagcagtacaggaaagaagcactgcc

SEQ ID NO: 31986 - DNA, 74 bp, Chlorella protothecoides
aagaaaccggggtcggaatgcttggaggggcaaacggggcgtcaggtggaggcggtgaagggtagggcgccaaa

SEQ ID NO: 31987 - DNA, 139 bp, Chlorella protothecoides
ttgtatacatagcgatcaggtgtccactcgcggcgtggcaggcagtgggtttgggggacaccatcaagcctccatggcctgcacggacgaggctggcgcctgctgcgactggcacagcatctgcttgcacacctatagc

SEQ ID NO: 31988 - DNA, 133 bp, Chlorella protothecoides
acttgaggggtccaggaggaccccgcctcccgaccttcgtcgcgagggtgataagcgggatgctcaccctgcgagaggcgccagccgtgaccgatactccagaagggaggacagccgcgacaggtactctcgc

SEQ ID NO: 31989 - DNA, 61 bp, Chlorella protothecoides
catcatgcaggctcgatcggctgatggaggtctgcactgttcatacgaagcgatcatcgaa

SEQ ID NO: 31990 - DNA, 62 bp, Chlorella protothecoides
gtcggcgtcgatcggcaccttggagccgttggcgctgggtccgctgggctgcactgcagcag

SEQ ID NO: 31991 - DNA, 153 bp, Chlorella protothecoides
gggagcgggggggggggggggatggtgtgtgagatttgggagcggggagtgggcagaaaattacgggagggtgagaaggtgaggggatgtatgatggtgtggggcacttggcaagccctcaggagggaggcatgaggaagcaggcgaccctga

SEQ ID NO: 31992 - DNA, 61 bp, Chlorella protothecoides
ggccatgcatcaatgcttgagaactgaaatcagccctcatcaacaaagacactgccgtggg

SEQ ID NO: 31993 - DNA, 106 bp, Chlorella protothecoides
tgccatcctgtcacttcccagcagcttccctatactgcaagtcccccatgctcatcccagcacagggaggggtgccctgtggagtcgtgctgtgcacccccatccc

SEQ ID NO: 31994 - DNA, 71 bp, Chlorella protothecoides
gcgggccagcactttcatgcccctcccgcgggcccaaaacccccctcctctcccagacctgccgtcgctcg

SEQ ID NO: 31995 - DNA, 7877 bp, Chlorella protothecoides
  modified_base (343)..(352): a, c, t, g, unknown or other
  modified_base (2330)..(2339): a, c, t, g, unknown or other
  modified_base (2663)..(2672): a, c, t, g, unknown or other
  modified_base (2759)..(2768): a, c, t, g, unknown or other
  modified_base (3646)..(3656): a, c, t, g, unknown or other
  modified_base (4550)..(4559): a, c, t, g, unknown or other
  modified_base (6178)..(6187): a, c, t, g, unknown or other
  modified_base (6280)..(6289): a, c, t, g, unknown or other
  modified_base (6560)..(6569): a, c, t, g, unknown or other
  modified_base (6966)..(6975): a, c, t, g, unknown or other
  modified_base (7196)..(7205): a, c, t, g, unknown or other
  modified_base (7694)..(7784): a, c, t, g, unknown or other
ggcctcccgcgccgcctcctgcgcacgcgccggctccgccgcgccgaggaggaaggcggggagggacggggccgggcgcgtgcaggtcgcgcaggcgcgcgcgcactgcgccaccgcgccccccttgccgatcatgtagacggggttggcccggcactcgccctgggtgtggagcgagtgggggctgtgtcgaggaacggggcggaggcacctgggaggcgtgcatcgggcttcgctgggcgcagatatgccacccggcatcgcaccccccgccaccgtaccctgggtagcagccagccctgtcgcccctttccctacgcagcttggcttccccgtcccgatnnnnnnnnnncgcatcgggcttcgcggggcgcagatatgccacccggcaccgcaacccccgccaccgtaccctgggcagcagccagccctgtcgccccgtgccctacgcagcttggcttccccgtcccgatccgcacccctcacacctttgccgcccagagctcgcactgcgggtgccggtccacgcaggactggtccagggccagggaatcgtcggcgtcgagtgcagcattggtgtcgagggcgccctcggccgacaccgcgccctgtacgtgacccaggtactcctccagctggcgcctcaggtcggggagcaggccgccggcctcggcctcccagggaggctgtggcgaaggggggtgcagaaggcagcattctcggggagctgcaagggcacgcggccgcagagctccaggtctgccgggcacaactctcctccccccacacctcacctccagcagggctcgacaggcttcgccctccagctccatctccagtggggtggcgtgctggtcgtgccgcctggtcagcgtgtagttctcagacccctcggccccctccccctcgtgctgctgctgcttccaggcaagcgtacgcttgacgcgggtctggaacagggaccaggacttcagcacgctgaccgggacctggcgcgagggggggggagggggggtgtcaggcgggcattcatctgtgagcgcctggtgtaggcgggccgtcgctctggtgtacatggttttgatgtgacagagtctggatcaaccttgggcatgaacctcacgacaagcatcacctctctacgactccaacacccgcgcccccgtggccacagcctcacctcatgcgcacacaagtcccaggcatactgggtgacggcctgcccgggcggcagggagccgtgcgcgttgacccagggaaccaaggcgtcccagacgtggagcatgagctgctggcaggtctggcaggaaagcgcagacagggctgtccccctgtcctccaccttgtggacctgagcaaggaacagcgtctctgggtgcaggggtacagccctggggtgatgggcaggaggggccgccttggagttgggtatgggcttgagagtcataaggacgtatcagacacatcgcctgctccaagccgagatcagtacgcctagggcagtgcctacgtgaatgggcccacactcgcagcctacagcaaccaaagtgcacaacgcccctcaccgtttcttggcatcctctatcatgtcagggagggtgtgatacggcccctcaagactggtgagtcccttggccttgatgcgttccgcctgctcggtgaaagctggccatgggacctccagggtgtactctgcccaggcctgcttggtccacagcagctcatcctgcgtcgagtgcacgcggcgcggcgcctgccaagcaagcacagtcgagaatagtacaagccacatcatcatcactcagcgaggaggatggaagggcatgccgggatcggcacacgtcagggcgggatcccggggtgacccttcccgttgtctgacgtcggaggatccctgaagaatattgatttgccttgatgcaggtttggaaaagaatatgagatactggtttgcgtacatcgaatgccagcttctgtggtgagtgcgatcgatgagcatttgatcgcggactttaggacattcatcaccacggcgatagcaggcgtgagttttgtgcagctggcagctcaagcagatgatcggcccctcatgggaagtggctatcagcttgaggaaaggcagatggggtgtatgctgttgatggccttgagtataatgcatgagcatggggcttgcctactctagcaggcgattggaccgaaagccaaggtgacccaaagatattttgcgaattcctggaggctctcaaatgcagacagccgcagagtgttgcctgagatcgcttgtttcctcaggacgaccagattatatgtgagcaggtaggtggtcnnnnnnnnnntagcttgaggaaaggcagatgtgatgtatgctgctgatggccttgagcataatgcatgagcatggggcttgcctactctggcaggcgattggaccgaaaaccaaggtgacccaacgatattttgcgaattcatcgaggctctcaaaagcagacagccgcagagtgttgcctgaggtcgcttctttcctcaggacaaccagattatatgtgagcaggtaggtggtctgcagtctacatcagcagagacgtacagctttacgccgagctcgccatggatgcgtctgacggcaaagcttcatggagcactttgtatctctttagcannnnnnnnnngtcttcggcacatacagccgatgttgtctcccgtactcaaggtgtagggaagctgatactttcttcgagttcggagaggccttcgannnnnnnnnnaagacgtacagctttacgccgagctcgcccatggatgcgtctgacggcaaatcttcatggagcactttgtatctctttagcatgtgcttgacacaccagcatccctagctgtcccatcaatcaccctcgtgatcggaaaggcagagatcgcgtgtacgtccacgtggtagatccggagcatcccgcggtacgtcgacgaaagtcaatcctcggcagatacagccgatgttgtctcctttccccaaggtgtagggaagctggtactttcttcgagttcggagaggccttcgacatggctgtggcgcggtcgggtctgcctctcgtgctgttcctggtcctcggcaccgcgttctccctccccattggcaagccgaagagcctgtccacggacgcggattttagcaaggaagcgttcttaaaaaagtgcggatgacggcagttgggtgctgccagcgccgctcgcggcattgtcgtattcaagtcgaccccctggccctcccatttgcaggtacggccatgattatggatatgatggtcgcattgacgagcttttcgagcgagagatcggcaacaggctgaatggaagtcattacctggataacacaggtgggcagcgcgggtccatgcggtcgcggttgcggtgcgggctcgggctgtgcggcttccgtggaggcggcttgcatggcttgcatgttgatccctctcacctgccatcaggacagccctgctctcgtctcagcagcccgtgcatctgtgccttattgccatcactaaacagcactcttgtcgtagcatggtagcttgtgcatcgatcatcttgcaggagagcactgctagattttctgctgcacatgtgcctccacccacccctctgcacnnnnnnnnnnnccactcaccactctgcacccaccactctgcacccacccacccgttcacaaacccgacagcccacatgcctgtggcctcctaccctcgttctacatacttttgcccagtgatccacttgatcggaatgtggacctcccatccatcccccccaaaccaccctctcttgttcaggtgctgcactgtactggaattcccaggtggaggccctgtctcgggacctggagacgcatgcttttggcaacccgcacagcgtcaaccccccctccctgctgaccgacgcgcgtgtggattcggcgcggcgccgcctgctggcgctgtttggcgccgacgagaccacgcatgacctggtgctgacgcggtccggcacgggggcgctgaacctgctgggggacgccttcccctggaccccggagtccacctacgcattcacccgcgccaaccacaacagcgtgctgggcatccggtcggtggcggggcagtacggcgcgcagtacggcgcgctgtccgaggagggcgcggaggcctggctggccgaccccgagatgcgccacccgcccttcctgcccggggggtcggagcacgcgggtcctcgccgcgcgcgcgccgccgcggccgagagcgcccaccggcccacctacagcctctttgcctaccccgcgcgggacaactacgacggcgtcatgtacccgctgaagtgggtgcaggcggtgcaggccaagagcacgccggggcacaaatggaaggtgaggcttttctggagggagctgattgggtcgaaggtggtggatctggggagggggttgacgagatttggacgggcaggggcgtggacgggatgcgctggcagaaccagaatttcacgcgagcctctcgtttcatggggggtgagcagtnnnnnnnnnntcagacttggacgggcagggccgtggacgggacgcgctggcagaaccggtatttcacatgagcctctcgtttcatggggggtgagcagtggtatgtccgagtgggtcccgacccctcagccacaaccccacagccggtgccatggcagtgatagaggcatggcagcgcgtccatccccccgccccacccacccaatccccacttctttccacccacccaaccccccctctcaaacacacctgtaggtgctgctggacgcggcggccttcgcgcccaccgccccgctcaacctgacggagacccccgccgactacgtcatcctctccttctacaagctcttcggcctgcccaccggcgtgggcgcgctgatcgtgcggcgggagggcgccgcccccctgcgcaaggcctactggggcggcggctcagtgttcctggccacctcggccctggactggcaccaccgccgcctgcccccggcctcgctggaggacggcacgctgcctttcctggacatcgtggctctgcagtacgggctggatgcctttgagcgcctgggcggcatccacgccatcaagcgccacgtcggcacgctggcggcccacctgtacgaccgcgtgcggggcctgcgccactccaacggcgcgcccctgctccgcgtcttcgggaagcacgaagacccgcgtcgcgccgaggtccaggccgcgacgctgaacttcgagatcctgacgccgcgcggcggcatctactcctaccgcaccgccggcgtggaggccgcggccgccggggtctacatgcgcctgggctgcacctgcaacccgggcgcctgctacgccgcgctgggcgtgcgcgacggggaggtggccgactttgccgccaccaagcacgacaactggaccgactgggagtggatcacggtgacgcgcggcgtggagccggggggcgcgccggagcaggtggtgctgccgttggggtccatccgcgccagcctgggcgcgctgagccggtgggaggacgtggacgcgctggcgcgcttcctggaggccaagtacgtcgaccgccccgagggcggcggcggcgagaccacgggcggacccatcccgcccatcgactactgctgacacgcgggcgatgcgcccctgcacgcaagtgaagtgatatatatgctgctgctcggtacccgctgcacggtatgacgtcgtgtcggcactgcgtatggagttttgtttccttccctttcggccaccccagcgtgtgccgcggcccagcgaggccaattttacgcaatgttacagcccgaccaaagagccaccaaaaaagcgcagcacataagaccggtgatctaaccgactgatctatagggacggggcactgtccctactggggctcgaacccaggacttccggctgactcgcgcgtgggtgggcagggtgactgcctcactttcctccggataaaaatgtatttttgtgtgcgctataacccgggggaaaatcttcgttgggcacaggagaggagggagtgctctctagagtacgtgaaagaggtggcttctgcaagttcaatatccattgcttcccactcattgagggggctttggccgaggaccagtagttccagcnnnnnnnnnntgctagggctaagctggcgcctacaggctgtcggacgggaggctggtgctcactgggtgaggccgttgtgccgcagacgccccactcgctctnnnnnnnnnncatttttgtgtgcgctataaccccggggggaatcttcgttgggcacaggagagggaggagtgctctctagagtacgtgaaagaggtggcttctgcaagttcaatctccattgcttcccacttgttgagagggctttggccgaggaccagtagttccagcagagaacgtgcatcagcagtttttatatcaatgcctcccaacacgtacaacaagcaccacctgttccctgcacctcgcaaatcaacctcatgcacgccttgatctcattgcnnnnnnnnnntgttccataccattgcctcccaacatgtataacaagcaccacctgttccctgcactgagcaagtcaacctcatgcacgccttgatctcattgcgaatcagggctagggctaagctggcgcctactggctgtcggacgggaggctagtgctcactgggtgagaccgttgtgccgcagacgccccactcgctctggacaggtttgagccggacaggaagccaagctgcgacattccatggtgctcatcagaagaaccagtaacaagtgcagagatgaccaccaggatgtagcaaaactgtgccttcgtgggttccctggacgctgctccccccttccactcctccctcctcctctccagtccagagtgccccccatgtgaccgcttgacgacacccccnnnnnnnnnntcttcgtgagtttcctggaaactgctccccccttccactcctccctcctctccaggccagagtaccccccatgtgaccgcttgacgacaccccccctcaccaccactcgccagatgatccaatggcgagggctttggatctcaccccagtcaaaaacagtacagtttgttgaatcgaagagtaaactcataacgtctggtcggacggtgggacgccgagcnnnnnnnnnntgagggcgttggatctcaccccagttaaaaacagtacagtttgttgaatcaaagagtaaactcacaacgtctggtcggacggtgggacgccgagcgggatggctgggtctcgaagaactgcagccaaggtgagtgcacccgccctgcgacacccctcccgcaggccggtgggcatgcaagagtccacccatcacgatagcctgttgccctgccgtgcagctcctcctgcaactcacacaatccctgacgcggggggggaggcaatccggtggacgaccctgcgccttctccaagacccccgcccggggctacaatgtctacgagggcacctccgacgtggcgatgcaggtagtgggtggtcacgagggtgcattgccgcggcaccggcctggtgtggacctgggaaaaggtggtgtgcactgaggggtggtgacctgttcctcgcgacgatcccgacggtcagcccccctctccccccctctccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggtgatacgcatgttcgagtccggccagctgcagcaccccgaggcggccctgggcgagtacgtctccgcgctgaaccgggcggggcgcctg

SEQ ID NO: 31996 - DNA, 121 bp, Chlorella protothecoides
ttgctcaccatgtacccgaagcagctgcgaccatgggcaacaggggagaggggagtgagctggaagagggaggtttggggaggggcacatggacgcgcaccaggcactgcataagaagcct

SEQ ID NO: 31997 - DNA, 117 bp, Chlorella protothecoides
tcgcatagccggtgccgtccgctggctcaacacactgaggaccatgactcccgcctactgagcacattacatgctaccatccagataatttgccttttcttgcttcttgtagactct

SEQ ID NO: 31998 - DNA, 84 bp, Chlorella protothecoides
cccgagagcgatccagggctcaaggaagcactccagaggctggcgaccaggatcacctgattgcggagaagggagtgcgtgcgg

SEQ ID NO: 31999 - DNA, 61 bp, Chlorella protothecoides
tctcttggtccgtcatggcaggtctttgggtgtttgaatggatgagtgggggcaacggtcc

SEQ ID NO: 32000 - DNA, 79 bp, Chlorella protothecoides
gacaacatattgatacagcagtctgtagataaaacaaatccaaaaaaatgcgagctccagcacgcagtgcaccgcgcac

SEQ ID NO: 32001 - DNA, 481 bp, Chlorella protothecoides
  modified_base (187)..(411): a, c, t, g, unknown or other
aggcatgaggaggtcatccacctttaagaggggagagggggaggttctcgccaccccccacccaccctccactgaaccccaccatcacacagccacccctccccccacagcaaacctataaagatatataacccccccttcctccccccttccccctcccaggtactcccacatcaagttgagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggctggtcacacgggaaggagccctccagcggggggtccccggcgtcgacagcccataccctcgctga

SEQ ID NO: 32002 - DNA, 183 bp, Chlorella protothecoides
tcgcggaggtgcgaaggtgggccggcagcatccggggcgacagctcatccccctggaacctttgctgacggaggaccatcgtcactgcaggcccagctcacggatgttgcttcgcggatctccaccgcgccttgaacccctctcaccgacacacacccaaccccctacatactacacacccct

SEQ ID NO: 32003 - DNA, 61 bp, Chlorella protothecoides
cagggttgcgtggtcgtggcggtcgaaggggggacaagggtactgtagctcatgaatggac

SEQ ID NO: 32004 - DNA, 61 bp, Chlorella protothecoides
gggggggggggaaccctcatgctgcatcgccctcctctggccacccaccaaaagccctctc

SEQ ID NO: 32005 - DNA, 61 bp, Chlorella protothecoides
atgaggattgagccaataggttttcacaaggggcgttcagaaactggccaaagtcgctcaa

SEQ ID NO: 32006 - DNA, 122 bp, Chlorella protothecoides
tgcggagacaggtgggcagcctcttcatcagcttgtgggaatcgtgaatgacttcccaccccgccacaccctgcgcctcgggtctcaactttcacgtcatgcttccacagaagataggaggg

SEQ ID NO: 32007 - DNA, 143 bp, Chlorella protothecoides
cctgcaccgcgaagcaccaggacatacacttgagaggcgatgaagcggcctatgcctgccagggaaccacacaccatgccccaatcatggataatggtgggggaagcagtagaaccacattgcagccaccatcacagctgccc

SEQ ID NO: 32008 - DNA, 10863 bp, Chlorella protothecoides
  modified_base (676)..(685): a, c, t, g, unknown or other
  modified_base (1080)..(1089): a, c, t, g, unknown or other
  modified_base (1880)..(1963): a, c, t, g, unknown or other
  modified_base (3514)..(3523): a, c, t, g, unknown or other
  modified_base (3799)..(3808): a, c, t, g, unknown or other
  modified_base (4884)..(4893): a, c, t, g, unknown or other
  modified_base (5414)..(5423): a, c, t, g, unknown or other
  modified_base (7340)..(7349): a, c, t, g, unknown or other
  modified_base (8231)..(8240): a, c, t, g, unknown or other
  modified_base (8886)..(8895): a, c, t, g, unknown or other
  modified_base (9983)..(9992): a, c, t, g, unknown or other
ccccccccccccccaaagcaaactctctgggaacagagacgtttcacaatgtggggccctgtccatacacagcaatcccgtttgcggcactcctatggacatcccaatgcacaacctcgaacccccctccccctcccaacccaacaaacacacctcttcagcttgatccagtggtccgcacgcttgctgggctcgtaccccgcccccagactcttcagcatcaggccctccccgccctgcgcaaaggcctctaacagtgcggcctggagagccgccgcacgctcctcctccgcggtggtggctgggaccacagtgccggtgctgggcgggtctgcactaggatcagcccccgccccctcagccccctcatagcaccgcgccagctccaccctgcccggcgccgccccactcagcgcctgtgccagcagcttccgtcgctcggtcagcggggaccgcatcaggctctggcccgccgccatcaggcagtcaaaggcgaacacggcgacgtccacctgcaccgccgcggcgctgacgtccacgcgggcgcgcgtggccagctcctggaaagcgcggagtcggttgccatcggcgcggtccacggccacgacctcagcgtccaggatgagggggagggcgtccaggtccacggcttccttcatcagctcgccgacgtccnnnnnnnnnnggcgtccaggatgagggggagggcggcggggtctacggcttccttcatcagctcgccgacgtccgggaaggcgctggatcggtcctcgcagttgcgagagaacaccttgacctttggaagtgtagtgaggggtgttgggggtgaggaggagtgtggacggcgtggaacagcctgatgcaagcttgtctgtcaagaatcccaccggacgggagggtccacaaggacacagatggattgcttatgccaactcttcgaccctcatgctgtgatacactgccgccctgatacactgtagagtcctccaaaaaatggaggcttacacacaactatcttaatacgcttctcaatgccctccatccgtcttaagtccctcaccccccccccccacaaaaagnnnnnnnnnnttggaggcttacacacaactatcttgatacgcttctcaatgccctccaccggtcttaagtacctcaccccccctcacacacaaaaagtcccccaatcccttcccccggagcctgtctcacctcgccgccaagcaaaacgtggatctgggagcgcatgccgtcgtacttgagctcggccaggaatgatgcgcccttgagctgggcgatggcgtcggccacgccctccgagatcttggccagcatgggcttgatgggcacgcccgccaccaggcccacatggcgctccagctcctccaccgggtggctgcgcatggcggcgcagagcaggtccaggctggggcagacgtggaaggcggcggtggcggccgcggccgcggcgtccagccgcgcgcgcggcagccgtggcgtgccctcgacgtgcatcagcaccgcgcgcgccagggcggggatgacagagcgccagctggcgccgacgcgcaagccctgcaccagcgtgcgcacgacgtagcgcacctcgccctcacggcaggcgcgcagcaggctcagcacggcgtgctggcgccggccgcctgcccccgtaccgcggtgggcggccatgtcgtgcagcgcacggaagacgccgggcacagtgagcgggtcggggcggcgcagcatggactgcgtcgcgcggcaggactgcgccacgtcgccaaggtcccccagctggctgtacagctggtgcaggcgctgacgcaaaacgcccatggcctcccggatggcggcgcccaccgtgccgccgccgacctgcaggnnnnnnnnnnnnnnnnnnnnnnnnnnnnnnnnnnnnnnnnnnnnnnnnnnnnnnnnnnnnnnnnnnnnnnnnnnnnnnnnnnnncgtgctttgggcagggaccgcagcgcatatagggggggtgagggcggcggcaagctatgtctcctcaaagaacacattcctcaaaaccgtacaggctctgggttcccgctcaaccaccagaggtaaactcacgctcagctccaggccctcgtagtcgggggcgaccttgccggtggcaaggtaggcagtggccaccaggtcatcgggagacagggccatcacctgcgaggcggggggcggggcggagggttgcgagccctgcagagcagagaggggctcaggatgggtacccaccacgcccgacggccgcacacgcacgcttctgaacatgttggtgaggatgtcgccgacacgcaggcgcttggtggtggcctctgctgcctcaaaggcccgggccaggtgcaggtacggcgtgggctcgcctgataagttatcggggggtgagtgcctggcttttcatggtttggagcatgagaatcatcagatctcccagccagagcaggtccacatgctccctgcccgctgcggtagcatgagcgcaatcccggcccttcaatccacctgcagaccagcaggcgtggagcttggggtcgtagttctcgggcagcactgccatcgcgtcccgcgctgagctgagaccagacggcgccatgtctggtgccttcttgctagactcctctgccttggcaccgggggcggcctggggctcagcgtcagctacaggtgcagggtcctggtcgccattgacatgcccttcgctcagagtaattggcaggctgtctgctgggacaggctcgccgcgggtaggagagggcagtatcagcctcttttggggtggagcaggttccttgacatccgctccttcgactgcctccaggctcgctggccgcttcacctccagctcggcgtgctcggtcaggtccaggaccggcatcgccctggccggcgatgcgccgaagaacgcggtgatgctcgcttgctgcgctgcgcccgctgccgaggccttgctcgtgccagaagtcggtgccccgcccctccgaccctgctttccaggcctgcgactcttgctggctcccagcgccaccggtgcatgcttcacattctgcgcctcacgcttcagcccaggggcgctcagggcgtcaaagtagccgttgactgctgcctgcacgtcgcccctgctggcattcagcagctgcaggatggtgctggcaggcacatctgtcccaatgatcgcctgcacctcgtccactccagcctcggcatcactcacgggggcaggctccgatgcgccgggccttaagtggtctgcaacaggttctggcttgaccgccagcatgggcagggcggtgacatcgctgtccatggccacatgagttctttccccgccgccagttgtctgtgtcgcagtagggagcagaacggaagcctccttaatgtcctggggctcagattttagggctggcccggcagaatactccgcctctgccttcacagtctgggcgtcaccaggcgtcgagacaggggggacgtctgtcgctgctaacactacgnnnnnnnnnngatgtcctgggtctcagattttagagggggtccggcaggattttccgcctctgcctttgcagtctgggcgtcaccaggcgtcgagaccggggggacgtctgtcgctgctaacactacggggggagccagcggcagttgtccgatatctgaacgtgagtgctctgcttcctccttgggcgcctccttttgccgcttacgctttgtaaaaaccgccaagaacttctcctgtggggtgattgcgccacgcacagcgtgggaagccttgtgggagacagnnnnnnnnnncttgccgcttacgctttgtgaaaaccgccaagaacttctcctgtggggtaattgcgccatgcacagcgtgggaagccttgtgggagacagcgcctgcacctgaaggttgagtggagcctggccatgctcgagacccatcccagtcccacccctaccttgtccttggtctcgtccaccaggtgcctgaactgcgcctgcatcttgcgcatggcctgctcgccggaatccccctccacgcccactgtgggaatgacctgccaccggattggggtggaggtcaggttgttagaggtgccaccgctcaggatcagaccgttcacctgccaccgatgtcttcccaggttcaatgcttccaatgcaggcattgcatgaatagcagcaagccctgcatccaaacccaggcacacctgatgagggcgcaggaactccacatactccaggagctccaggtaggaggagtgctcgctgtagggcaccaggtggatgctgcagccgcccttgcgcctcactggaaataccttgcgggccatgtcgtacgtccaccctgtgggcacaaaaccaaccacctgcgatttgagttgaatgcaggctggttgagaatgtgcgtatcgcggagctggtcaaggcaggctgctgtgggtggttcccttgacacatcggccctgatccccgctcacctcatcgactccttggctcctctggtactcctccaggttggtccagtttggccggaaaaaaggccatgactccctgcaaccagccatcaataaggaactgaatgttacggagcggccatgtaatttcctgggtacatggccatcaatccatcccaaaacgaccgagctcacccgatgaagccccagggcgtcacatgcagcggcgtggacgagaagtcggaggtgaagatgccgtcgacatccaagcctacgcaggaagcaatgagtcatgtaaaggccacaatcctctgtgaaacacagagcgcgggcccctgtcaatttagaccatcgacccagggcgaacaagaatgcagaattcacatgccctacagcacttccccaagatcagactcacatgtnnnnnnnnnncgaaacacagagcgcgggcccctatcagtttagaccatcgacccagggcgaataagaatgcagaattcacatgccctgcagcacttccccaagatcagactcacatgtgcaaagtgctcaccaacaactcccggcaaaatcatacagaggaacccccaacctcttacctggaaggttcaggcaacgcatgacagccagcttcttctcagtgacggccagccgaagcccagtagtagccgccaccgcactcaggatccgctccttgccaatgccatacgtggaaatcaggatcacgcgcctgggcccagcgggagtctttggagcaggtgcatcggctccaggggctgccgcactgtcgtctgcgtgctcggggccatctggcgcatcgggctccgcctcccccgcctgcccggccagtaatctcttcacggcggccactacataggctatactttcctcctggggagggaaggtgtgccgtttattgcagtaggtggtgtccaggaaaacggcatccgccnnnnnnnnnncctcttcacggcggccaccacgtaggctatactttcctcctggggcgggaaggtgtgccgtttattgcaataggtggtgtccaggaaaacggcatccgcccccacaaaacgttgcagatggggatcagatttgaggtggggtgcgtagcgcatgtctcctgcaggcgtgatgatgacaggggccaagtgtgagggagacctggcgagctgtcttgccagcagacaaaggaagccagggggaatggggctgaccaaatctgatccaagaggtatagagtgcaagagactcatcattccagcaagagcgaaaaagatgtgtgccggtcatcccatgcaccgtccccaggacatctcgacacatgcttaccacaatggatgtacttgcggccatcctgtaattggaaaaggaactgaacagctccagggcagtgattggcatccacgagggtgacctcgacgccatggatcatgactggcgtgtccatgggcagggggtgcaggtacgacagcctgacccccagcgcatggaccacgaatcgggctgtgacctcgctgcaatagatcgggcccgcgctccatgtatctgtcagcccaccgtagtgatctgcgaggtatacgtggccaggtgcttgggatgtcgagtggatgtgggctggatgcagcgagatggcaagcggccgacacccccactccatgctccgacacactccgcaccagcatgtccgtgcgagaggaagaacgcgctggtccccggtgagatgtgccggaaagcatcaaccacgaactgagtccctggtatggccttgtgaatgtgcctggtggcctggggtgtcggtgcgggtgcagcgggaggcatggccacaaatcacctgggccaaaccatcaagatccatgccccatggctatcgatgtaggaggatggacaagaagttcatatattgggcaattatcgtctgattaatacatcgggacgttggagcgagtattgctgcacaagcatataattttggaagacacggggtggacattgctaccctcgaaacggagagcgccactcttgtcggattcaagcagcttcgatctcagcatcatcgacgctaggtactgtgtgatgacacatttacaacaaatatgctccgtttgcgtaacattgtgctgatcgtcggtcgacatgggctagacacctgccggactgtcaagcccggcctactgagcggagggaggtcttgagaccttggcactacggatctctcaactccttctgagctttaagcccgcaaatgatatccaacatctttacgctgtcaggtctgggaacactggaggcatgttgcgtcctgtggtacggcgccgggcaggcaagcgtgcgcctgggggcccccaagatcactggcatcatgctggctggggtgctggtggggcccagcgcgatcaacctgctcaccgccgagctggcagaggacctggtgggcctggagcatgcctgcctggccctgatcgccctggccgcgggcatggagctggcagcggaggagctggccaggaccggcacccaggttgtggtgctaaccctctgcatcgccctgggctcatggctcgtcaccgcagcaggattcctgggcgttgtggcgctggtggggccggaggcgctgcacctggagccgggcctggtctggccggcggcctcgctgtgtggaacactggcgctggcacgctccccagcctccgcggtaggccgggcggagagggttggcaagtgggtcccctgactgtgcgacgaccctgccgatccactgcttgggcgccgcttccctgcgctgtcccaccgcgcccaacctccggactgtcctcggctctcctggagtgcttttgtcaccgccttccacccccccacgctcgacgagggcgcagatcgcnnnnnnnnnnaaccctgccgatccactgcttgggcgccgcctccctgcgctgtcccaccgcgcccaacccccagactgtcctcggctgtcctggagtgcttttgtcaccaatttccaccccccacgctcgacgagggcgcagatcgccgtgatccaggagctccgtgcctccggccccttcaccagcctggtcatggcggttaccgtgctcaaagacctcctcctcttcctctgcttcgcggtaaccctggacgtcctcagccaggaacccacactcgacgcccccccctcgtccctgctgtcactcaccctcgctgccggcgcccccctcctccgcctcctcgtgtccctcagcctcggcttgctgtccggctccggcctggcctgggtgctgcagcccaggggccctgctcagtggctcggccgctggaccgtggcccagcgtgcgcagcgcctgctctcggcgcgggtgggggcgaggggcagtgtggcgccggcggccctcgtcgccggcggcacctttttcgccgcccaggccctggctgcggagccgctgctctcctgtgtcgtggcgggcgtggtcgcccgcaacaacatgtgggtgcagtggcggcaccttgttttggggggaggagtgttgggaaagggctgggaggtgtgaagggaggaggcccagggctgtcgcccaccggccacaaattgcgttgatattgcaaagggctgggcagatcttcggcgatagaatggcctgcgaggcggccatagatctgctcgtgcacggcagcccctccaacctgtgagcctcccagtcgatttcctttgggattcccctccatgcgcacaccgctcctctccctctcacacacacaccgctcctcccaacgcccttccnnnnnnnnnncgcgcacacctatcctctccctctctcacacacaccgctcctcccaacgcccttccacctcaacagctacctcatgggcggcggctctggcctcagggacgtgtcccaggtgctccacgccggcctggcggccgccatgcccttcgtgaacgtcctcttctttggcctggtgggcgcgcacctccgcctgggtctgctggcggggctggccccctttgccgtgctcctggcggccgcccgcatcgcgggggtggccttcgggtgtctggccggtggggtggccggcagggtcccgcccgcgctaaggacccggctctggcagggcatggtcacgcaggcggggatcgcgctgggcctgtgccaggtcatcgctcgcaggctcccagactggggtctgcacgtggctgccctcatcgccggcagcattatcgtcaacctgctggtcgggccccttctcttcaaggtggcgggacagggcatgatgagaaggggcatgatgaggctgtgtgtggatttagggggggttggcagggggccgtcccccatcaccctcccactcatttgcgcatggcgggtgcaaaccatccagctggctcaaatagtatcggtgccttgaacccacaccaaaccatccgatgcagacggnnnnnnnnnngaggggcctgggctgggctgtgtgtggatcaaggaggggttgacagggggccgtcccccatcactctcccactgctttgcgcatggcgggcgcaaaccatccagctggctcaaatattttccgatgccttaaacccacaccaaaccatccgatgcagacggcgattcttcgcctgggggaagcagaaggaggggacagctcggaggctaggtggggtatatcatcgacaggaaatcttggcatggctgcccttgcaatgctgtgtttctttcatggatatacccgttctctgcctgcttgggcacactagtgaagggaggcgcccgcatgcattcttattgccgtgctcccaccccatgccatggcagaccgagcaagcagcgggacgcagaggccggccagccaaccgtcgagatccctgtcatcagtgcctgaggcgcagctggagcaacggagctgcccaactgataatcggcgcagctggaacaacggagctgcccaactgataatcggcgctccgccatgcagcgccatgcaaacccttgacttgacatcgtgacctatggccccttgcatttgtactgcacttcttcgcatgctctctcccacacagtccgcactgtactcccacaccagctcctggcctcagagattgccatgaggccgagctgggcccctgtgaacacacagatgttataggcaggaacgacacatggatgtagaaacaggcctggaggcgaagcacagcctttgaacgcaggctcggcgcaggagccccagcaggctcctcagaaggccgtccaggtggaggcttctggagccggagcggcagcagcctgttgcggggatgctgactttgcctgggcgctggcaccgctctcttcatctgtgggcacatgcagggggtgggtcttgcaggagtttccgggacagtgacatctggtgcactgcaaccatcagatgcgacccgacacggtgatccttggctctgcacgacctcctgcaggcaccatgccacggtctgtgcagcccccaaacatgcaaaatccctccccctccctccctcatccctcgcacccgccgcaacnnnnnnnnnncgccaaggtctgtgcaaaccccaaacacgcaaaatccctctccccctcccctccctcatccctcgcacccgccgcaacgggccctcgcggcggcgtggcgctcttgggcgagggcagggccgcggcgctgccctcggcccgcgggtccacctcgctcctggcgctgtcctcggcacgcaggctgcccccgccctgcgcgctgccggccaaggaggcggtgcacgaaggtgtgccgtcgacgaccgagtccagcgcctcggcgatggcgctggccagcaccgcagggtcgtcccctgcggcggcctccgcccgcgcgtcggtgcgcggcgagggtgcgggcgacgccggctgcagcgacgccccgctggccggcttgggcagcggggccaccgcctcaggcgcgggggcctggccggcatcggcggaggccaggccggcgagtggttgcacatcctcggcggcgtcggcgcccgacacgtcggtgggacccgacacggtctcctctgctcccgtcgcaccgcccgacaccgccgctgcctccgtggcggcggccgcggcggaggccgcaggccccagcttgagcgtggccaggcgctcgtccggcggcagcgccgacacgatggtgaacccctcatcgtcgaagccgccccactccgccgcgccagcggccagcaggccgtcgtaggcaaggggcagtgcctcgcgcttcagccccgccagcgcctcgacagggagcggcagcagcgcggcgcgcgccgcgcggtacagtgcctcgtacagcggcgccagctcgcgcagcgcggccacgacgcgcgcgccctccggctcggccgccgccgtcagcgctgcgacctcggcctgcaggcccggg

SEQ ID NO: 32009 - DNA, 164 bp, Chlorella protothecoides
ggacgaggccgcgcaggagtgggccgtgcaagtcacccgcgtgggcgaggatggcgcagccggtgggtttgttgatcgcgtggcggtgtttggacgggtcggtcgtgttttggtggggttcgtggaaaggggggttgttgtccaatggggccactcctggattg

SEQ ID NO: 32010 - DNA, 94 bp, Chlorella protothecoides
ggcaacgtgggcaccatatgcatacaacacagtagagagtaaaaaatgagctctggttggaagagggtgggtgcctcaagggagaggggggggg

SEQ ID NO: 32011 - DNA, 68 bp, Chlorella protothecoides
actccccacctcgggccagcagtgttccctcggcctcacacaccgcagtcacccacacaacaccctgc

SEQ ID NO: 32012 - DNA, 117 bp, Chlorella protothecoides
tggggctgggcccacgggctcgagcacgacgatgcgtgggagccccgtgaaagccgcaagcgcaagggaggctgctctgcatgcggcggtggcggctgtgcgcaggagggcggccga

SEQ ID NO: 32013 - DNA, 123 bp, Chlorella protothecoides
tacgagctggtcggcggcaggcacctcggaacccccatcaaccgacacagagggcgcctgttgtgatgtaaggaggggagtggagtgtgagagcgcgagcggcagaagcaggtctcgggacgg

SEQ ID NO: 32014 - DNA, 79 bp, Chlorella protothecoides
cccatcccccctgcccaccctgtccgcaactcctcctccaaatcacaattgccccaacccaacaggagcctgcgggtgg

SEQ ID NO: 32015 - DNA, 78 bp, Chlorella protothecoides
tacgatgacagcagcggcaggtggggggtgactgtgtggtggggagtgtgtggggcagaccccaggcctggggacagc

SEQ ID NO: 32016 - DNA, 148 bp, Chlorella protothecoides
tgccggggtcacctgggggatggagggggtgggaaaatgagtatggccggggctgaaatatatgtcgcattcccacttgcatgggaacacgtggcaatcagcacggccctcacagcttcccaccaccgcatctgctcacctggagtcg

SEQ ID NO: 32017 - DNA, 61 bp, Chlorella protothecoides
tggccatcatcgcagccgtgtcgacgggggtggagtcgctgcccatatctcagcggctgga

SEQ ID NO: 32018 - DNA, 80 bp, Chlorella protothecoides
gagggtcacgaggggttcagttgaaggcccctttttgtgtgtgtggtgggggggggggcataaccgggagggaggccgca

SEQ ID NO: 32019 - DNA, 158 bp, Chlorella protothecoides
tgcagcctggagggtgctcacagccatgagacatgcacgtgtatgccggccggccgtgccgctccacctcaatccaaagcacgtggccgatgcgggcatgtccctcgtgctttacacactgctgaaaaggcgtgccattgcaccctgaaaaagacacc

SEQ ID NO: 32020 - DNA, 61 bp, Chlorella protothecoides
tcgtctggaagccgaggccaggcgaggtcgaccctgccgcttccaccccgctggagagggg

SEQ ID NO: 32021 - DNA, 63 bp, Chlorella protothecoides
gtgtgctgcacctcccctgctcccccccccacccacacaccaagacgccttgctgtgaccccc

SEQ ID NO: 32022 - DNA, 76 bp, Chlorella protothecoides
gtgcatggcctggagcgtccccagcaggggatgttgcgaggcgcaccccccctcgactcacactgcatacgcgcac

SEQ ID NO: 32023 - DNA, 61 bp, Chlorella protothecoides
tgtgcagcgaacgggatggcatggctggagtgagagggagcgggcacgtctcaagcaggcc

SEQ ID NO: 32024 - DNA, 75 bp, Chlorella protothecoides
ctgcgtgcctccctgaacgtgttcgcgagggcctcctctcagatgttaccatccctgcacctcgcagctcgctcg

SEQ ID NO: 32025 - DNA, 61 bp, Chlorella protothecoides
ctgcagtgagacaggtgggtcatgggctgggtgtcctgagccactgctttgcaaagcacta

SEQ ID NO: 32026 - DNA, 79 bp, Chlorella protothecoides
accgggtagcagcatcctcccacacctcacacctctccctgctagtgcgacagacgacagcacactcagccccccggcg

SEQ ID NO: 32027 - DNA, 141 bp, Chlorella protothecoides
acccagtgctcccttcctccctcccaccgcccgagtctcccgcacatcatgccacccagtttccactcgctcccggcattcccctcacccaccctccaacaaccatcacccgacagcgcaagcagcagacgcacagcaaga

SEQ ID NO: 32028 - DNA, 11628 bp, Chlorella protothecoides
  modified_base (5312)..(5321): a, c, t, g, unknown or other
  modified_base (5496)..(5505): a, c, t, g, unknown or other
  modified_base (5649)..(5658): a, c, t, g, unknown or other
  modified_base (5980)..(5989): a, c, t, g, unknown or other
  modified_base (6306)..(6315): a, c, t, g, unknown or other
  modified_base (6856)..(6865): a, c, t, g, unknown or other
  modified_base (7453)..(7462): a, c, t, g, unknown or other
  modified_base (8264)..(8273): a, c, t, g, unknown or other
  modified_base (8390)..(8399): a, c, t, g, unknown or other
  modified_base (8557)..(8566): a, c, t, g, unknown or other
  modified_base (9214)..(9223): a, c, t, g, unknown or other
  modified_base (9504)..(9513): a, c, t, g, unknown or other
  modified_base (9962)..(9971): a, c, t, g, unknown or other
  modified_base (10109)..(10118): a, c, t, g, unknown or other
  modified_base (10235)..(10244): a, c, t, g, unknown or other
  modified_base (10587)..(10596): a, c, t, g, unknown or other
  modified_base (11210)..(11313): a, c, t, g, unknown or other
  modified_base (11475)..(11484): a, c, t, g, unknown or other
cggcgctcgatgcaggcagccgccgccgtgcaccgcgcggcctgcggccgcgcgccgggcgcgctgggccgtggcggcgtggaggccgacccctgggtcacggaagcgcggctggtacagggccaggccaggctcatggccgcgcagcaagcgggtgggtgggcgagcaggggtggtgatggcgtctttttggtggtggggggaaagggagaatgcgtcgacgggcccaggggccccgacggtgttgggatgtcaggggttgtcctccgaggcgctgcgcatcccagtctgtattgcagtgcagccatgccccatcctggctccgacctcctcccacagagcggcgcttcctggccaaggtgggggcgcaggtggagagcatggagcgggagcgcgctgctgtgctgtccacgaccctcgcggcctcggtccgcatctacgggtgggcgggatcgagttggaccgggtgggccggggatatcctgtggcagtccgtgctctggtcgacctgcgtggtgccctctcgttgtgcggctcatagcggagcagtgcaggcgctgacgtctttgtttgggacccgggcataccgctttacacctgcgtggttgaagacctactgacacgcgatgtacttccctccctccccccctcacctcccacacagggagagcctggcctgcgtcgagcgtgccgcgccgcgcctggaggccctgctggaaagcgcgaacatggacgccgacctggccgccttctgcgacacggcggcgcacagcgtggcggcgggcgaagccctggccgcccgccaggccggtctgctggccggcgtccgccgcgagctggccgccagccccgaggtcctgcgtgcgggggccatggaggcctgggacgctgcgcgcggtgtctgggtgcccgaccgatttgtgctgacgcgcgccgggttcctgcaccgccttgcgcgcagcccgggaggggacccggaggttagcatggtgcaggggccgcccacgcccgtcctggcggagagcgtggccctggcccgctgcacctttgagcagggtgatgggttcaaggggtggcaattgcatacaagggtggaggcggggggaggcgggcacatgctgtctggtcacgtgaggggcagctctctgccacccctgctgcgggtgcagcacatgtcaacatgggcggtaaagggtgcaccctgtctcccatctcttcctcgctacccttgcaggcgaggcccccgtgttcaggctggtggagattgcggccggtagcctggccaggagcctgttcctggcgccccgcacgcgcgcgcgcaccttccgcacggcttccgtggaggagtgcatggactgggccattgccctgcgggaggtgctggccgcgtgcacgcgctgaaacgagcgctgagcagttgctggaattgaaggcttttcctcgtgctcgctcgttgataggattgaggtctcgcctgaggatcggacccttgctgcaacccatggcgttgccggagcactcacgcctcggcacttcatgcccatccagtgctctgcaccttgaaaagcaacaggtctgagacagttctgggcaacattctctttccaggatgtctaaacacccacccccaagacattatctcgttgttagaaaacttgtgaactgcaaatatgatacgatctcaagtgaaacgttgaaagagaaaggctcgcgcctccaagccttcaggctgtcatcctggacccatcacatggcggcctgtagggcaggcaatgctgccacgaagataccccactgctcttgggataggctgagccctttggcaccagggcgctcctggccatccttctgcaccgaatccaggcagctcgggcgccggtgggtatttgacggcgttttggggggcatcactgatccagggggccaccctgctcggaatgccatcacaagtgtcgccctcctgacatgacagcctggctcacctcgtaccactccctgatatctatggagtgacggcccttgaaagcggagacaccggcgcgtcggctgcatggttggttgtgagggggagatgttgttgtggtggactcatcctgggcttacagcaccgtctccagctggatctgtatacccatcccacaccatgacccagtctcgcgccccacccctatgccgacccacctcgctgagagctgggcgcggcagctgtcatcccggcgctccagtcctgccgtgagctggggcgcggctgttagcagggccagcacctggtcagccgccaatgcgatgccgcgctttcccggaaggagctggccatccttctgttggggtgggtgggacttggagggagcttgtgacatgagaatccccaccactagcacagtgtcatagacgctgagatgaatttaaaggagttgccattcaaagagcacacagccagtcccttgcatgcaaccatttctcgcaattccctgggcccagggcgggcacgccgggttcaatttctttccatcgcacctcatagtactcgcgcagggacagcaggctccgccccttgaaggtcgtgacctcggcacgcttgtttgagcccagctctacgggacctgcatctgggggacgatcagccgcctcgctgactgggcccggctgcacagtgattggggctggcgagggtttggcgtgagtgagactaggacctggatgctgcgcagtcggcttagcattggaagctggtgtggggtggtccaccacagagggcccggcagcacctgaagggaaattggtgcgctttgttgatggggtgctgcgaaacattggtggtgtgttggggaggtccggcaccatttgggccctgagcaactcatccctgcctacaccgcggtcggccatatcctttccgagcaagaggcccatcctctgcatttcgccgctcacccttgcgattgagcttgctgtccagcaatggcgccgcagccagcagggcagaggcctgctcccggccgaggcgcacgcccttctttcccgggatcaggcctgcgtccgagccggcatgccactgccgcaggtccaacgcccaggtgcctgcaggtgtgtggaggacatcgcagcgcaccccggtgacaagggcacgacaaccagcagatgtcatgcgcaaggcgatcctggaggtgaaagcaagcctgtggccgtcctggcgcatcttctcgggccgccacggtgaccccctaccgcccagcccaatcccacccaggcacgcctttgaactcggacacagatgctcgctggttcttatccaactcgacggcatctccgcttgtcctggcatccagtcgcttgcagagattctgcggagggtgagttgcagtgcaagcctggtgcatcaggaccaacaagactgtaggatctaaaaccaccccccgatgcaggcgccccgcacagcatgccaaccacaaacccaccggcagagcttggctgagcaggccccagccttgcggtgacagagccaggcccttgaagccaggcttcagctgcccctccttgtctgtataatactggcggatatcgacgcccacacgcccatgccagtccctcacagctgcatacacgtcaccagaaaggggatggccattggcagcatcatttttgccatgttgctctgcacccgcacctgcaatgagtgtcatgcaggagattgatgaccttcttttcaggggggaacgaccgcgccatggttgcgaccctgtgggtccagcaagcactcccatactgctcctcccccaaactgtttaacaaacccacccttcactcgcttgcgaggctgttgaaagtcttcatcatccacctcatcgttccctctcgccgtgcagccggccaagaaggcgtcagtctgagcctgcacccggcagggcggccgtgctttgaattttcaccaacatcacacatgtgacccatgttgcaggccccgtaagacgcccgaacccaccctgatatactccttgtattcattgaggggctcccccagtctgtcttcgagctcttgttgcacagtgcgttgtgttgccgcctctaaatcggccccttccaggtactcaaagagagcagtcctgatcgcttcttttcgcataccttgcgatcaccgcccgagatatattcttcaggattcaggacatcagatggatgattgacgcgaaggaacgaagctgtgggagccttacaaattggcgatgctgatctcgactcatacgtgcgcgccactcaatgaccctcgccagacagacgagatcacgacccatggcaagctttcggcgccatgtcgcgatgtcacttgcttggaatttcatacagtgggatcattgagataatgaagcctgctgctagtgggtaggcgcggggtgcactctctaggtgcaaatcatgccagagcttccggaggtgtgtggcatcccgtcttgggggctgagtgtgcaagattcccatcacacgtcggtcgaagcttgggatccaaccaaagtgatgttaatgcttcattgaatgtgcctcttggacaggtggagagcgcgcggaggctgctgcacagactgggcgtggggaggaccattgtcagagccgtcgtggccgatgacgacagtgagtcgtggatctatcgagggatcaggtacgcttgagcgccgaaccacccctatcattcactaatccctctatcctccttgattactgcgcagaggttgtcaagggcatctctcccaagaagctgcaggctgcactacagggttcacagatcctgtccacagatcggcgcggcaaacacatgtgggcggtgctcggcccgagcaagcactccctcatgctgcactacggcatgacgggcatgcttgcagccaaggtgaggtgcctggcaggcttctgcatgcgatgacttgtcatggcccatgagtcgctgcttgcgtgctgggttgctcttaaggggtcagcatccagtggctgtgccgatgagggctgctggaagaggtggcagacatcttcacagggaggcacacgaaccctgctgagccgcagcctcccactggttacctttgccggtccgcctccagggtgaaggtgcggcaaactaccggggggagaatgtggacgccgcctcctggccccccaggttctggaagatccactttcagctggacgacggcgccgagatcgcgttctgtgactcgagacgctttgccagggtgaggtttcggggattgtgggttgaaggagggctttggggctcgggggccttggctcccatgatgaaggtttggcagagctggggcgcnnnnnnnnnncggggattgtgggttgaaggagggctatggggctcggggtggcttggctcacatgatgaaggtttggcagagctggggcgcactcagtgggcgcggccgccgtgcttgattgtggcgatatccttcccagcgtgccatgtcgttgtgcgtgccgtccgctgacctgattcaaagnnnnnnnnnnaaacagtggcggtatccttcccagcgtgccatgtcgtcgtgcgtgccgtccgctgacctgattcaaagtccggcacgccatgctcctggagcccctccaatccaccagcagcatgccaatgtgcccgttcaccctttcctgaannnnnnnnnnttgctcctggagcccctccaatcccccggctgcgtgccaatgtgcccgttcaccctttcccgaacctgcgacaggtgcagtacgtggccgacccgctggccctgcccagcattgcggccctgggctgggacccgctcaccggcatgcccggcgtaggggagctgacgcaggccctggcccgccagcgccgctccatgaaggccgtgctcctggaccaggtgggggaggcgggaaaggaggaatggggtgtgggtgaggaggcgccgagggcggcggggctggaggccggcacccaggaggcggctgggcggccaagagggtnnnnnnnnnncgaggcggaaagggggaaatagggtgtgggtgaggaggcgccaagggcggcggggctggaggccggcgcccaggaggcggctgggcggccaagagggtgtgtgcgtgccggggaatgggcgcttgcaggccttgcggacaccctgccacccctccctgcctcccatccctgcacagtctttcctggctggagtcgggaactgggtggccgacgaagtgctgtaccaggcgcgcatccatccggagcagcgcgccaacgcgttgactgaggagcaggtgcaggggttgtgtctgtggggaatgggaggaatgtgcggnnnnnnnnnncccggagcagcgcgccgacgcgttgaccgaggagcaggtgcagggatcgtgtctgtggggaatgggaggaatgtgcggtgagcgtaattccctccttggcagtcgtgcctgggcgtagcgggggggcctgccgatgattgagaattctctgggaaagagacgcatatgccaggcacccagactccacgctgccctcccactggcgccctttccaccacctgcaggcggcgcgtgtgcatggcgcggtgcagcacatctgccgtacggccagcgacctcaacgcagagtccgcccgcctcccggccacctggctctttcacgcacggtgagcgggagagacctgcaattcttgacgtggcgttggagccctgccagtgtcccctcgtgtttttggcacctgcgtggcacagcagtgcctctctatggcgggaggattactgttgggtacctgttctgcctgccgcatctgacgctgccattagcgcctgccggcactgtcatttcagaccaaggtgtgtcgctggatgacacgggcgtcaannnnnnnnnnccacgcacggtgagcaagagagacctgcaattttttacgtggcgttggagccctgccagtgtcccctcgtgattctgacacctgcgtggcacggcagtgcctctctatagcgggaggagtactgttgggcacctgttctgcctgccgcacctgacgctgccatcagcgcctgccggcactgtcattccagactgaggtgtgtcgctggatgacacgggcgtcaactcagagcgtgccctgtccacctgcaggtggagcaagggaagaaaagagcggccggaggtggagggcgaggtcatagagcacatcacggtcgcggggcggaccagcgcctttgttcccagactgcaggtgctgcaggacggcgatgcaggagtcgaggatgccctgcgggagccgcccaagcaggagccgcgcaagcggccagagccaggggggaaagagaccaaggtcaagcggcaggcggcgacgaccccaccgccggcagcaaggaagcggcgtggggcgggctgaggtcctgttccctccaaggccatccagttactgatacctccaggatgtgcacttcacctgtgagatcatgctgtnnnnnnnnnntcgtggggcgggctgaggtcctattcactccaaggccatccagttactgacacctccagtatgtgcacttcacctgtgagatcatgctgtaaccctgcccccccgctttcagatttcttgcatctgtgcactacttgcagcttacagccacgacatgccgaggaaagaaaagttcacaaacagggtcaatgaaatctgtaattaaatggtcaagcagcctggggtgcatctagtcagatcagtccaggatgtcctcgatcgcctcgatggcaggggcaaactcgtcctccagagcaggcacgatctcagacagggggggcagggccttgtcaaacttcttgaacttggagaacttagcctccagcttcttgccggtgtcatcagacagggggaagtactggttcagggggatgtcgaactctgcgccgccgatgacgacctcggcctccacgccgatggtcttgcggatggcgcaggacttgccgatgaagatggtgggggtgaaggccttcttcacgcacacaccgggctccttggtcagcgagatggaggcaggggggcagatgatctgcttcttcagctcgtcgatgatgcaggtcttgggggagtacgacagggagacggtgggaccggcacagaaggggtccaccttctcggagattgcaaaactgatgggagaggttgtgggaggggggcggtggagatgggcagttggggtggcaacgatttgctgcaaccaggaatgcccaacaagatgcattgctccagtaacttacgtgtagttcctgcagaacttggcgannnnnnnnnnggggagaggttgtgggagggggcaagttggggtggcaacgattcgctgcaaccaggaatgcccaacaagacgcattgctccagtagcttacgtgtagttcctgcagaacttggcgannnnnnnnnnggggaacagcttctccaggctgaagtctgcagtgggtagaggtggaaggtttggggatgcagatgtgagtgtgacacaggagggtcacggattgctggacccaggatccgctcacactatgcaaacacatgaagtcgtaccgttgtccttccaggctnnnnnnnnnnggggatggagtgggggcggcggaactcggccagctggctgttgtccaggaagtcatccatgctgttcttcaggtcaaaagggaacagcttctccaggctgaagtctacagtgggtagaggtgggaggtttggggatgcagatgtgagtgtgatacaggagggtcacggcttgctggacccaggatctgctcacaccatgcaaattcatgaagtcgtaccgttgtccttccaggctgcagggacgtggtcgctccagtttccacccaggatgtccttgaagaaggagtgggcgtcctgtatgttgtggatggtggattcagggcagggtcacgatgtctgatggatcttgcggtcgcagtgacatgccactgccgagcttctctgccattcaaacacacaggccccagatgctcacctccttcaggccaagcatgctacgaccatggctggtggtggactggagggtgttctgcagctcctcggagaagcccttgaacactgcgtaaacagatgagggggcgggtttgcacatggagaagtggtcagcacatgggaagggcatttcagcttacgcctggaatcccgtggcggcaatgacttgcgtcgcgatccaacggccatgggacgcaccctcggcgatggactctnnnnnnnnnnaggtgtgcacatggagcagtggtcagcacatgggaagggcatttcacctcatgcctgcaatcccgtggcggcaacgacttgcgtcgcgatccaacgaccatgggacgcaccctcggcgatggactctggggtcagaggaagagacgtcttctcggccaggaccgatgaggccgtcagcgccaccagcaggaggacaagtgcacgtgccatggtgagaccctgagagacacagggaccgatcagcagggaaataatacccgtatatttgccgatgctgcgcnnnnnnnnnntgtgagaccctgagagatacagggaccgagcagcagggagataatacccgtatatttgccgatgctgcgcttataaccccttccgaatccatggcagtccgttgtcctgcatgaatgggctctgcctcgagaagcgcagccggaattcgaaaacggacgcagcggctggtccggaggtcccattcggcactgtaagggcacccgatagtgcgcggattctgccattttgggtaccgggaagccgccctgaacccatagagttgaatcaggatcccaaagaaatggtttgttgtatacattagaagcctatagtacgtcttacacggctgcactggctgtaagcaccctgcaggcccgatgccggagctgaactctcggccgcacatacagcatgcgcaagttgcgacgatttcactatggggcctaagaccaggcctcgggcctgctannnnnnnnnnattgaatcgggatcccgaagaaatttttattatatacattagaagcctatagcacgtcttacacagccgcagtggctgtaagcacccggcaggcccgatgccggagttgaactctcggccgcacatacagcatgcgcnnnnnnnnnntaccagagtattgttatgatcaaaggcttgtaatgttaacaagagtatattaatgccccgcggtctgaggtttggttcgctatccaccagactgaagccatgccacaatgctcgatnnnnnnnnnnccccagattattaatatgatcaaagcttgtaatgttaacaagagtatattaatgcccctcggtctgagttttggttcgttatcccccagactgaagccatgccacaatgctcgatccgtcggcggactgcggccatcctgcgctgcaatgctcgttggtcgcaatatcaccaataagtactatcgcatgaagagagctggcacagagcttagtactgccgacggtagggattacttgggtgatcggcatcggcgggtttgaataaaggtcgtgcatctgggtgttttgtctgttgtgcacaattgcagtactgtattgatacatccttccgctccgtacgcgnnnnnnnnnntatgaagagagcgttggcacagagcttagtactaccgacggtagggattacctgggtgaccggcatcggtggggttgagttaaggtcgtgcatctgcttgttttgtctgttgtgcacaattacagtaccgtattgatacatccttccgctccgtacgcgttacggaaggtctttccgacaatgttgaaggctacttgactcccagcatacacaaggcaccagagattggctcgcgtcgcgctacaacaacttgcacgtgccgaagggaggggtggatcagagtagccaaagctcgacgagcgatttggtgtgcaactagagtgcgctgacttattattttggtgcgatcaagttagtaagtccattcatcatgtgctaccatctacttctgtttcccgcgctctgtgagctgccgacgcctatctttggggaccaagctgcttcaccggaagtcccaaggtgcagagtcgaatttcatacatgacgaactgtcgatgcagcatcccatagcgctgaaaatttccagagtcaggccaaactggataggtgagccgtgccacttcatgattccctcttccaatcatcctgccctccccaccaaactgctctcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttgggtgaggcatcaatgcctcatccgcgctcaaaacagagatgtggatgttcggcacatggaacacttagacaggagcagagaatctctagttcagcaccaccgggggaatctcgggctcgggctcgggtgcgggctcggcctcgaactcggtctcannnnnnnnnnatggatcgctcattggttaaagtcacagaatcatatcgtacctgtgatacactgaagcaaggaatgaaatggagttacaaatggagtggagtctggaatgatggagtcggaaaggggaagggacaacttgcaagtatcaggggg

SEQ ID NO: 32029 - DNA, 69 bp, Chlorella protothecoides
gctgctcatatccctctcaagcattgtgtcaatctcatcacggttctctccacctgtggcccattgcaa

SEQ ID NO: 32030 - DNA, 65 bp, Chlorella protothecoides
catcgcgctcctaattctgcagacataatttaaaaaccctgcccggcgtaccttcaccagcccaa

SEQ ID NO: 32031 - DNA, 159 bp, Chlorella protothecoides
gcaaccgcgctccgctgcaccatttgtgcggcgggggcctagacccggaccccaaccctgccccacccccctctgaactgcctgcgtctaaaaccattccagtcactgaatgtccttttccacagatggaacctgtgctgccccatcaggcgccacccc

SEQ ID NO: 32032 - DNA, 75 bp, Chlorella protothecoides
cttgtcgatgtgccgtgctgtagtcatccaggaatgtaccgtgccggtgtccagcggccacctttcgaccttgtt

SEQ ID NO: 32033 - DNA, 61 bp, Chlorella protothecoides
agcgcaaaccctgaagatgtcgacgcggccagatcccgtccaccgaattccagggcagccc

SEQ ID NO: 32034 - DNA, 61 bp, Chlorella protothecoides
acaatcagaaaggcgccacctggcgctcaggcaccaccctggatttgcgacccggcctgct

SEQ ID NO: 32035 - DNA, 70 bp, Chlorella protothecoides
ggcaatcgctgcttcaataaacatggaaaacgcaaggttcagaacgactgtagcctgctcgagttccgga

SEQ ID NO: 32036 - DNA, 66 bp, Chlorella protothecoides
acggctcagtcaggtcctggggggtgggggtggggaggatttgtgaattgtgtttgtgtgaatttg

SEQ ID NO: 32037 - DNA, 198 bp, Chlorella protothecoides
ctcaggggtggtgcgtcgtggtggccagagtctgggccgcaatgaaatcgtcggacgacgctgcgcctccttgcacatgaattacggcatacacatcctgaccaccattcccctcacacacacacaaagcccttctctattcaccccttcctagaatgtatacactcacagacctggtctcgtgacccgtggcgagga

SEQ ID NO: 32038 - DNA, 111 bp, Chlorella protothecoides
gcgatctcgtgaggagcgcgctggaagccgggggtgtcctcgggtcagaacgcgccggcggaatgccacatgacctccagcagggcggcctcgcgattgccaggaggatga

SEQ ID NO: 32039 - DNA, 61 bp, Chlorella protothecoides
gctggccttgcccatgtctggaaggccgtggacgtcagatcactgagttcagttcccttga

SEQ ID NO: 32040 - DNA, 75 bp, Chlorella protothecoides
tggcaagctgcccgggacaagggtggtgggggggtgggtgagtgagagggttgggcggggggacaaagcctccga

SEQ ID NO: 32041 - DNA, 3945 bp, Chlorella protothecoides
  modified_base (775)..(784): a, c, t, g, unknown or other
  modified_base (948)..(957): a, c, t, g, unknown or other
  modified_base (1032)..(1292): a, c, t, g, unknown or other
  modified_base (1457)..(1466): a, c, t, g, unknown or other
  modified_base (2253)..(2262): a, c, t, g, unknown or other
  modified_base (2800)..(2809): a, c, t, g, unknown or other
  modified_base (2879)..(2888): a, c, t, g, unknown or other
cggccgcgccggccgcgccggcggcctcctcagcctcctcggcgcgagcgcgcgcggcgtcggcggcggtcaggcacagccccgccatcagctcctcctcgtccagcagctcctccaggatctccttcatacgcgagacgcgggccaggccgcggaccagcctcgtgcgcgactcgtacagctcctccaggtcggagcgcagcacgccgcgccggatgcggtccagcacggggcgcacgccgcgctccagcgcgcccacctcccgctccagaacgcgcaccaggcagagcagcgcgccttccagcgcgcgcagctcgtagggcagggtcgcgccgccgcggatctcctccagcgtggccacgctgaaggacgcgcccagcccgccctccgccccgtccccggacccaggccaggcgcgcatggcgatgtgcgccgccagctgctggaccagggggttggccaggtccgcggggcagcgcgcggtgaggtcgccgggggcgggcacgctgagcaccagcgctttttcgcgcccgattatcaacttcaggccttccaggttcagcacgatggcctggcgccgcaccaggatggccggcgggtctgtgcattggtaggcgtgggaggagggtaagggatgcgttgctctggatgagggtggtggtggtgtgggaaggttgcgcgtggagcgggaggaggggtcatgcatgctgggactctgaacccgtcgaccaagatcggatgaaaggccaaccaactcggaaacatacatggcagnnnnnnnnnncaggcgtgggaggtgggtgagggatgcgttgctctgcatgagggtggtagtggtgtggggaggtagcgcgtggagcgggaggaggggtcatgcacattgggactctggacccgtcgaccaagaccggatgaatggccaaccaactcggaaacatacatggcagnnnnnnnnnnggaggggggatgtgcagatccatcggtgggaacactggtggtcggcacacttgctcaacttcgaatcactccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatagcgttcgtgccggccgccacctccccgacaccatgccggaccaaatctggtggtcctggacatgcagcggcagtcccagcttttccccgcaaagcttccaacggatctgcctcgtcccgtccatttcttccacccaatcacagcagtgcatgggatgannnnnnnnnnggcgacctggggctccagtgcccggatgtcgcgatgccggagggccatgtcggtgatcagggcctgcttacgcagggtggtgtagctcagatgccctggggagggggaatgggaaggtgcggagatccatcggtgggaacactggtggtccgcacacttgctcaacttcgaatcactccaaggccgccgctccagactcaccctcctcgtcgatgagtatcacgggcttggtcttggacggtggaggaatgcccccctgcgtggagctgagccccctgcgcacggagccctcccctgcccgaccccgcagcatcagcggggccgactccattcagggaggggagggccgcagccctgtatggaagagcgtgaaggctgtggttaccgaagacaccgcatgggtccctcgactggaaacgactggtgctgggaatgcggcagactcatgcgaggggggggcctcatagcgttcgtgccggccgccacctgcccgacaccatgccggaccagatctggtggtcctggacatgcagcggcagtcccagcatttccccgcaaagcttccaacgcatctgcctcgtcccgtccatttcctccacccaatcacagcagtgcatgggatgacatgcgatgtcagccctaccagggagggcagcgtagtgggagtagacgtagcgaagtgcagcgttcttgctgcattactgagattaattattggaacacagaagcaaaccccggcactttggtgtggatgagattctatctcctaggggggaagaagaaaacnnnnnnnnnngactgagattaattattggaacacaaaagcaaactccggtactttggtgtggatgatattctatctcctaggggggaagaagaaaacctgatacgagatgaaaaacacctggacggccatgcgagcaggatggcctttgctgatcggcctcacggcgggtcaccagcgggctccgcatatgcaaccagtctctccagcagctcggaggctgtgggtcgggcggccggatctgaccgccagcaggcctttatcagttctgcaatgtccaacggacactcctctggcactctgcagtggtttggggaagggtgctggcttttctgggcagagcgctgtggtgattcaccattggcgtgccagccatttggacgggtcgcagaggtgggtgcccatgcactagctagctcgcggcacttcaaccccatgcttgaatgccggatcttcccgtgtagtcttgcagcaaggccttgggcctcctgccccaccatcactcaggcacctccccccgagcccagtcccgtccacccctcacccatcnnnnnnnnnntacggcgggtcgccagcgggctccgcatatgcgaccagcctctccagcagctcggaggctgtgggtcggnnnnnnnnnnatggacgggtcgcaggaatgggtggccatgcaggagctagctcgcggcgcttcaaccccatgcttgaatgccggatattcccgtgtagtcttgcagcaaggccctgggcctcctgccccaccatcactcaggcaactccccctgagcccagtcccgtccacccctcacccatcccttacccccccccggacccctcagaaaaaaactcagcttccaccggacttcgcgcatctcattgcggatgggcacgctccccgtcacgatctcccacagcagcacgccgtaggagtagatgtctgactgcacggtgcagcgctggcccaggatggtctccggcgcggcgtgggaccaggtgcccacatgcagctcggaggagaggaaggatcgggcgaagggcagcatgcgcgcctggcccacatcccccagcttggcccggccccgctccgtgagcagcgtgttgcggctcttcaggtcgaagtggatgatgcggcgtgagtgcaggtaggccagcccggcggcgacgtcgtgcgccacgcgtgcgccgccgtcataccagcgcatgcgcccggcgcgcagcgcggagtacaggtccccgccctgcaccagctcggtgacgacgagcagcgagccgcgtgggacggggggctcgcgccccgtgccggcagcggccgccagcgccgtggggagcaccacgccctggaagttgaccacgtagcgcgagcggcaggagcgcaggaccgcggcctcgcgccggaccacgtccaacggcacgtggttcccgccctctgcgtcgggcagcaccgacagacatttgacggccaccgcctcgccgctgccgagcgccgcgcggtagacggtggagaaggtgccggagccgaggaagggcgggcgccccgtggccgggtccaccacccacaccagctcctgggtggacagcaggaagtcggcgtcgtgcgccgcgtcctcgtccccgtcggggtccatgcccgcgccggcggccgcgtcgaccgacgcggaccccggcgccgcggggcccgggccacgcgtcgcgccgctg

SEQ ID NO: 32042 - DNA, 72 bp, Chlorella protothecoides
gtggggcggggaatctacagcatcgagcaactttcctgctgtgcaggggacacccctctgacaagaaagtcc

SEQ ID NO: 32043 - DNA, 70 bp, Chlorella protothecoides
cccctgtgggaacacacatcaggtgggacgtgtgctggctggctggaatgccttgggagggtagcttatg

SEQ ID NO: 32044 - DNA, 120 bp, Chlorella protothecoides
tgcggcggcgcggtgcgcgccgcggtggcctcgtcgcgcgcgccgcgcgtgctcgtcgccctcgtccgctcgcccctggacgagctgcgcgccgcggcggcgctggcgctctgggacctc

SEQ ID NO: 32045 - DNA, 80 bp, Chlorella protothecoides
gcggaccgtcatggtgaccatccatcaggttggtggggtgtggggaacattggccgtgggagtgcatcgcctgtgttcca

SEQ ID NO: 32046 - DNA, 105 bp, Chlorella protothecoides
ggggcactgtcctaccgcagacgatcgtaatctaccctgccaaggcctgatcacaagtactaccccctcgtaccggccctctgctcacgccccacccaccaagcc

SEQ ID NO: 32047 - DNA, 67 bp, Chlorella protothecoides
tgctgttcccttaccccactccctccccgcgcccctactcacccagagtcccagcagctggctcatc

SEQ ID NO: 32048 - DNA, 74 bp, Chlorella protothecoides
tcaagtatcatttggcaggtgtttcccccctgggccctcccatctcctgaccccacctgcactccgccaaagct

SEQ ID NO: 32049 - DNA, 191 bp, Chlorella protothecoides
tggagatgtggagggcgtgaggcggtggcttgggggccatctcggcaggaggtaatgccctccggcgaggctgctcagtcccggcgtcaatgtcatggccccttccccccagtctccacccacacctaccccacacagacttcgcacacccacctgtgagaaagcaggggaggaggagcgtccagccgtac

SEQ ID NO: 32050 - DNA, 102 bp, Chlorella protothecoides
aggtgtgcgggtccgcggccgggcggtccgcgccggctgccgccggcagcgggacgccgcgcctgcgcctcacgcacgtgaacgaggaggagcagccggcgg

SEQ ID NO: 32051 - DNA, 61 bp, Chlorella protothecoides
tgggcagacacccagacccacgacatcgcggccctcagccccagacgtttgctacaagggc

SEQ ID NO: 32052 - DNA, 118 bp, Chlorella protothecoides
ccctcccaggcaaggtttggggggggggggagggggtgaaagggaaagatggcatgtgtgggcccgaatgcatggcgtgggcactgccaaggattggaatcgatgtgagtgttgtcgt

SEQ ID NO: 32053 - DNA, 76 bp, Chlorella protothecoides
accccagctgatgcgtttgagagggcgaggagggcacttctttgatgaggttgccacccctgcccctcgcgccgcg

SEQ ID NO: 32054 - DNA, 74 bp, Chlorella protothecoides
ggggctgcaggatccggatggcattccccctatctaacataatctgccaggcagaggcaactggcatgtgtgtg

SEQ ID NO: 32055 - DNA, 61 bp, Chlorella protothecoides
ccgatcgtgcctgcggatctgactcgggggggccatccccccacccccctgcgcacgagct

SEQ ID NO: 32056 - DNA, 76 bp, Chlorella protothecoides
cgtccacgggaagaagctgctagcaaccggtgcaagcccggtcgggggggtaaagggtattccgtgctttcccggg

SEQ ID NO: 32057 - DNA, 78 bp, Chlorella protothecoides
acttcctgccctgaggcagctgggctcaagcctcgacgcgatcctccctggcgctcatgcctgcgggagcgccgggcc

SEQ ID NO: 32058 - DNA, 76 bp, Chlorella protothecoides
ccacaggccgagcaggtgtacacctctggcgtcggtgcggagggcaggctgaggagggtcagtgctgggatgctgg

SEQ ID NO: 32059 - DNA, 76 bp, Chlorella protothecoides
catcacgatggccaccgcctcgtccagcattgtctgcatcggccgtggatgggcggggattgatgggggaggcgtt

SEQ ID NO: 32060 - DNA, 61 bp, Chlorella protothecoides
tctcacccacgatcttcctcctccacagggagcttgcggatatggaagcatttccaaggat

SEQ ID NO: 32061 - DNA, 78 bp, Chlorella protothecoides
tgatcaggagaacgcggcctgctcagaccttgtgtgaaatgcaaggctggccaggatgcaggcatatgatgctggcag

SEQ ID NO: 32062 - DNA, 74 bp, Chlorella protothecoides
gtctggagacgagcccaggactggacgtccaagtaaggtagacagaacacccagacagctacctcaaactccag

SEQ ID NO: 32063 - DNA, 101 bp, Chlorella protothecoides
tgttaagaaccttcagacacctcccgatgcgggcagcaggctggttaaactcacatgagaattacacaccattgattggaaattatcaagcactcctgcag

SEQ ID NO: 32064 - DNA, 61 bp, Chlorella protothecoides
gagcaggggctgcagcatggtcacgccctcccccacggtctcgcgctgcagcgccaggcgc

SEQ ID NO: 32065 - DNA, 61 bp, Chlorella protothecoides
ccgggtggcgaccgaatatggacgggggggtgggggtgggggaggcatgcctggtggtgct

SEQ ID NO: 32066 - DNA, 30115 bp, Chlorella protothecoides
  modified_base (132)..(141): a, c, t, g, unknown or other
  modified_base (2280)..(2289): a, c, t, g, unknown or other
  modified_base (2400)..(2409): a, c, t, g, unknown or other
  modified_base (4520)..(4529): a, c, t, g, unknown or other
  modified_base (5244)..(5253): a, c, t, g, unknown or other
  modified_base (5539)..(5548): a, c, t, g, unknown or other
  modified_base (5986)..(5995): a, c, t, g, unknown or other
  modified_base (11066)..(11075): a, c, t, g, unknown or other
  modified_base (12910)..(12919): a, c, t, g, unknown or other
  modified_base (13769)..(13778): a, c, t, g, unknown or other
  modified_base (13865)..(13874): a, c, t, g, unknown or other
  modified_base (14360)..(14369): a, c, t, g, unknown or other
  modified_base (14434)..(14443): a, c, t, g, unknown or other
  modified_base (15278)..(15287): a, c, t, g, unknown or other
  modified_base (15571)..(15580): a, c, t, g, unknown or other
  modified_base (15923)..(15932): a, c, t, g, unknown or other
  modified_base (17039)..(17048): a, c, t, g, unknown or other
  modified_base (18231)..(18240): a, c, t, g, unknown or other
  modified_base (18945)..(18954): a, c, t, g, unknown or other
  modified_base (19207)..(19216): a, c, t, g, unknown or other
  modified_base (20069)..(20100): a, c, t, g, unknown or other
  modified_base (21880)..(21889): a, c, t, g, unknown or other
  modified_base (22788)..(22797): a, c, t, g, unknown or other
  modified_base (23946)..(24161): a, c, t, g, unknown or other
  modified_base (24325)..(24334): a, c, t, g, unknown or other
  modified_base (24902)..(24911): a, c, t, g, unknown or other
  modified_base (25606)..(25615): a, c, t, g, unknown or other
  modified_base (26129)..(26249): a, c, t, g, unknown or other
  modified_base (26335)..(26344): a, c, t, g, unknown or other
  modified_base (26945)..(26954): a, c, t, g, unknown or other
  modified_base (27765)..(27774): a, c, t, g, unknown or other
  modified_base (28256)..(28265): a, c, t, g, unknown or other
  modified_base (28524)..(28533): a, c, t, g, unknown or other
cgcactcacacccccacccacccacctcgcacccccccaccacctcgcagctccccctgcgagtgcacgacgcctgcttcaccagcgaggtgctgggcagtctgaagtgcgactgccgggagcagctggtgnnnnnnnnnntgcacgacgcatgcttcaccagcgaggtgctgggcagcctgaagtgcgactgccgggagcagctggtgctggccatggaccacatccggcgccacccccccggcgcggtcatctacctgcagcaggaggggcgtggcatcggcctggccaacaagatcgcggcctacgcgctgcaggagcggggcctggacaccgtggacgccaaccgcgcgctgggcctgccggacgactgccgcgagtacagcgcggtggcccacatcctggccgacctgggcgtgcccagcgtgcggctgatgaccaacaacccacgcaagatggccgaggtcgcggcgctgggcgtggcggtcacgggccgcatcccatgcgtggtccccgcccagccccactcccgcggctacctggacgccaagcaggcgcgcatggaccacatcctggaccgccgtggcgaggggggggcggcgggggatgatggcgacgcggcctccgaaagccagctggacggctccttctgctactggaaccacgagggcgagccggggcccaccggcatcggcctgaagccggcggcagcggcgcggccggggccggaggagggcccggcgagggagtgatgggaggggaggcccgggtgctctcctcccgtctccctccccctcagcacctccctgcgccgcagcaccgtccaggacacccttttaccccaagtcattttgctcaccgtgaccggatgccagcacccagcaaggtcttttgggcggacgcatccgcatttcatccacgctcgagtgtgaatcactgtatcaattaaagaataggaggagcggtgcggaggggggggggggcccaaggcggacagcggtgcccgaagtctgtggggtgggcatgccggtggtgggtggggggggggaatcacagcaggaccctcctcgtcagggaccgggcgcctcgccgccgcgcgggcgccgggggaggcgcaggcggagctggtgcaggcgggagtacaccgacccgtccccgctccccgccacggcggcgcccaggcggttggggccgcgcctgagggcagacgcgtgcagcgccgcggcgaccctgggaacgaggatttcgagagagggagtttggcggtgaggtgggaggatccaggcgggcccttgggtgaagcaggcagtgtaggtgcccacggcaccctcctgcatgacggacttggaacgctgcagtcagtcatctgtcccatcttccagagcaccagcccgtgggccccatccaaatcacacgcactctttcttggcggctgcgatctcggccacaagggaggtggccgacaccaccaccaccggcgtgtcggcgccgtgcagggtgctgctggcctccaccatggtcttcaccatggcgtcggagctggccaccaccacgcggctgcaggccgggtcgcgcacccaccccgttaccgcgccctggaggtaggagtcggcctcctgcgcgccgcagaagacgacggtgacgccggagcgcgtcagcgactggctctgggatgcgcaggggccgcgcagcgcgtcaaaggccgccacgacgcgcacgctgcgccgcgagctcagcacgcccagcgcctccaccgccgcctcgcgcgcggcctccaggtcgccggccgccagcagcggcttgcacgcggggagctggggggttggaaaggggggcaagtgggtacttgagggtgcaatgacgaaggatcaggccgtcagtccatcagagtggcatgacacatcgggcagcagcgccgatgcgggctggccatacgcacgacccggaagaaaagggtgggaagcgggggcatgagtgaaccctgcacatgcgcccgcccgccacttttccaccttgtgcatgacgttgtagccatccacgaggaggacggggggcgcagccaggcggcagctgccgtaaagctgggtcagggccgcgcacgtgctgcggtaccgcgccgcctcgcgccgcaccgcgctctcctgcctgctggagggggcatgggcgggggatgctcgaggcggactgcgcggggaggacgcctgacgtgtccggtggggagggagtgcttcccacccatacatccatcgcaatcctacccaggccagggcaggctggtcnnnnnnnnnnagaagaaagggtgggaagcgggcgcacaagtaaaccctgcacatgcgcccgcccaccacttttcaaccttgtgcatgacattgtagccatccacgaggaggacggggggcnnnnnnnnnntgtgttcggtggggagggagtgcttcccacccgtacatccatcacaatcctacccaggccagggcaggctggtcaagggacagcagatggagggtatcgcggcgacgcacacaccccgccagtgcttgcctgagctcctcgggggtcttgggagggcggcggtatgcccttggcgggctcggctgtgtcggggccacggctgccctctcccgcttccgctcctgagaggggagtggccggccgagcgtggtgggggagcgcatccgtgtcccaggcctgcagctgttgcagactcgctgtgctcagccactccaacacctccactgcgttccacaaccccgcccacccagcccacccagcccaggcacccacctgggcgaggaagcgttgctgggcccgcacagagaccaggctgttggtctggatgcgggggggaggtgcctgggaggggggctcgctggcctgggggatgctgctcgcctcctgtttcggcttgcgtcgtccctgcttgtccagggcagccttcctgtcgcgcttgtccttgcacagcacgaggcatgcgctccgcccaacccttcggacagcggggccggcatgctggagcttcaacatccgcgattgccgtcaggcagcatgtgctcccggcgaaggagcattgcggttcatgcagggttcagagggccacgcagtgagcggtgagaatacatgtgatcgttgttccatggacggtgttttcaaagggttgcctaaaatagttaatcgtagtccgtgctgtgataaagagcgtggatggctgtcgccaacgagctgcccccaactggtggctcagaaggcgggggcgccatgctggggcgcatccactttgtaacgcgcgtccatcccctgggcacccacggccaaaggagtcggcaagtcacctgacatggttgggtgcttgtttgggtatcaatggaagctgcatcccactatcttccttgtcgatccggtctgcccactctcggagcagcaccccccgtgaaatcggaatcgtatctgatgcaggcatgaaggcgagcccgcccctgtgacccaccctcttctcatgtcacgactggccaccccgatgatgggctgcgccatgcccctcatcgtcaggcatcccccgctgcgacctggacttcccggtcacgacccaaggcatctgccccggcggtgcctggcacgtgggctgccctctctcatcagtgacgccatcagcccctcttccccaacccgagacctcctggcagcagcctttgcaatcacaggctccaagctcatcgtccagatcttcgacaggctggaggctgccgccatcattgacagggtgggtccatggacagggaattgtgcagcaaatgcgagtccatgcttgctatccggtgaagattgacaggccgtggtcctcaggggaggatgtcataatatgggggcacttgacaagcagctgtttggcaggcatggacacgagaccctggtctcaacccgtaccagtgcgaccccttcctctgtccccagaatttgagccgcaagctggtgcacacgttggcagggcccctcttcctcgtcagctggccgttgtttgcgtccaatccagagtccaaactcattgccgctgccgtgccattcttgaatgttatacggtgagtttgcgtgggccccaggcttgccctggtcaatgggcgtgcattgcatgacgacagtaacacccagctggaggctactcttcatctatgccctttgtatagatgacactgtcgctgaggatggcatgcagcctgaatgggactgttggattctggcatgggagtctggagcagctgctcaccattcctcccatgcaggttgacgctggtgggcaccggcctagtgagggatgagcgggtcgtggcggccatgagccgtaccggggacaagtccgagttgctgagggggcccctcttctacgtcctcgtcctgtttgctgtcaccctggcatgctggcgcaactccccaatcggtgaggggctgggggaggcagcccaggcagttttcaatgcagagatggggggaggcaatccaccccaggcagagggagggtccctccagcatcnnnnnnnnnncttttcaatgcagagatgggggggggaggcaatccaacccaggcagagggagggtccctccagcatccataggacactgacagtcatccggcttagttcctctacatctccttcccatatcgatactttgcccaaaacccaccccatctccctttttacaggcctggttgtcatagctgtgctgtgcggaggggatgggctggcggacatctttgggaggaggtttggagggggcgcccgccttccctggaatcaggccaagagctgggcgggatctgcggccatgctgggaggcagcctcatggtagctgcctcgctaatctccttctatcacttgctgggccttgttccacacagtttgcaagattctctgggaccaggcaaggagggtgcctggtatgtgcccttgcaggggcatgctgatgcagcagtagcttacaggcctgcagtcgatttgtgtgaagatccttgctgcagaccctggaggtgttgcatataacacgctctgcagtacacaaccactcccttcccaccctgcagtggccatcatcgcagccgtgtcgacgggggtggagtcgctgcccatatctcagcggctggatgacaacctctcagtgcccgcagtggccctcctcctgggcagcacactgttgccttaaccgcggcctgggaggagtgaagtcctcccgtcatgtgtaccctgcatgttgatacnnnnnnnnnngaccgcggcctgggaggagcaattttcccgtcatgtgtaccctgcatgttgatactgtcccccttggtttcgcgcttgccacaccttgaatatgttggacaccttgactatacatccattgcaagcccattcagggagggtctgcagattgcaggttgaacaagtattgtgggttggcatcacagcatatggggattcgttcagctcgaagctgttggtggcaaggagcaaaaggagcagagaaagagaaagcccccacccctgccacctcagggcttcaccccgnnnnnnnnnnctcagggagggtctgcggattgcaggttgaacaagtattgtggattggcatcatagcatatggggattcgttcagcttgaagctgttggtggcaaggagcagaaggagcagagaaagagaaagcctccacccctgccacctcagggcttcaccccgggccacttggtgtagccagagataacggcagacaggaggcccgctgcggcttgcagcgccggattctgcagcagcttcccactcttctgaatgtcggccagggccaggaaggaatctgtaagaggggggggtcaaggaggggttgtgtgtgaggcgggctggctccaaggcaaagctcatggtttgagcatgcggattgtctacaaccccctccccaatacacacaaggaagcctcaggtctctcctcacaaaaagcacctgctgcgtcctggaggatgctnnnnnnnnnnactcatggtttgagcatgcggattgtctacagccccctcccgaatacacacgaggaagcctcaggtccctcctcacgaaaagcacctgctgcgtcctggaggatgctcagcgtgcggagcgtgcgcacagcgcgcaactcgctcagccgcgcctggaccttgcgctcgtcttggggaccccaactctcatccgtctgccggctgcgggccaggtcgtccaggatcttcagctccagctccaggctctcctgctgcagcagtgtggcgagcgtgatggagccgcagtagcccaccagctcaaaccaggccgagacgtaggacagcgagtcagcgtggcgcttgctcagcagccccaccttgatcatcctgtgcgaatggagggggggcgggcagagcgtgggtgcagctaggaaacacagcattttgaatcaggggtggggagagcatgcttttgagcgactgccaagccctgtaccgagccagaaactggtcatcctccatctgaggacagcatcgccagtgttggggtgccatgcggagccctgccgagatccactcaggatgcccaccactggagctgctccatgaagaggtagacggtgtccccgacccccgccaccagcttgagagcggcgtgggaggtcctgggcgtgatgctgcgcaggttcttcacccctcccaggaacttgcccagcttgagggccttgcgtgtggtgcccagggacccctccagggccttgagctgggcccccagctccggggcatatcgcgggagggaccccgccagcagcagcctcgaggtgtaccggatcaccttgagggtctacgggtgggcatggaacgggggagatggagctgggtggcattggcatgaggaagggggcaccacactcgactctccgggtgcttcccatgacacattgccccctccctaccttgtcgatcccatcgcgcttggcaaggaagtctgtggcattattcagcgtcagcgacattcctgtcgccccgctggtctgggtgagcccttgccctctttgggaggcccgcgcgcttacagtgtgtgtatagggacgtgcccgctcgccctgcagcgctgtgcttgccggagcacctggaagcagagactggtattttcccctgaggattcaattatcccgcagatgtggtcatcgtgaccaccccctcgccaacgcgactcgacccccttcctccgacacaaaccctatgctgcgtcatgctgtgcactcttaatgtgcctggggtgttgattgtggcttttacttcgcgacccgaccctcggtcaggcaagtgttgtgcaggaacgggaattttgcagcaggtcggatgtcaccggggagaagcagcgcaggggaacaggggtcaggggagcagggtcgccaggacctagtcgacctcctccatgcgcgacccctcgtccgcgttctcctccagctcgggcaggtcgtcgcctgcgccctcccccgcgccctcctcctcgtcgatgctcaggcccagcttgaccatgcggtggatgcgggaggcaaaggtgttggggtcgtccagggagaagccggacgccagcagcgcggtctcgaacagcagctgcaccaggtcgcgcacggtcttgtcccccttgtcggcctcggcccgcgtgcgcagctccgcgatgacggggttggcggcgttgatctccagcgtcttcttgctggacatgtaccccgccatggaggagtcgcgcagggcctgggccttcatgatgcgctccatgttggccgaccagccgtactcgccggtgaccaggacgcagggcgagtccacgatgcgctcgcccaccaccaccttctccacgcggtcccccagcacgtccttcatcaggcggcacagcggctcgaacgcggccttggtctcctcccgcttcttcttctcctcctcgctgtcgtcgaactccaggccctccttggtcaccgacaccagcttcttgccgtcgtactccttcagctgctgcaccacgtactcgtcgatggggtccaccatgaacagcacctcgtaccccttgcgcttcagcttctccaggaagggcgagttctccaccgccctgcgcgactcgccggtgatgtagtagatggcggactggccgtcgcgcatgcgcgtcacgtagtccttcaggctcgtcgcgtcgtcgcccgacttggtggagttgtagcgcagcaggtccgccagcttgccgcggttggcagaatcctcgtgcacacccagcttcaggttcttggagaaggcctcgtagaacttggcgtagtcgtccttgttctccgcgatctcgccaaacatctcgatcaccttcttgatgatgttcttgcggatcacctgtgggtgcgagggggtgggggaggggaggccgagtgtgatgctggtgggcaggggggagtggaggtgcactggtggctgccggtgcaggggtggcgctgtgtgtgtgcagcacacaccaggacggggcctacgcggggcaagacccccaccggggggcggagaaccccccttcccttctcctcccccctaccttgaggatcttgttctgctgcagcatctcgcgggagatgttgaggggcaggtcctcggagtcgaccacgcccttgacaaaggacatccactcggggcacagctcctcgcagttgtccatgatgaacacgcgacgcacgtacagcttgatgttgttctgcttcttgcgggtgtcgaagaggtcgaagggcgcgcgcttggggcagaagagcaccgccttgaactccagctgcccctccacggagaagtgcttgtaggccagcgcgtcctcccagtcgttgctcagcgccttgtagaaggcgttgtactcctcgcggctgatctcgtcggggttgcgcatccaaatcggcttctgcttgttcaccagctcccagtcgtgggacacctccttcaccttcttggtcttgcgctccttggccgccgccgcctcgtccgtcacctcctcaatctcgccctccttggcctcgctggtcgcctccgcctcctcctcgtcgtcggacacctccttctccgtggtcttctcggtccacagcgagatggggtaggagatgaactcagagtgcttcttcaccaggtccttcagccgccgctcctccaggtactccagctggtcctccttcaggtgcagggtcatgcgcgtgcctcggcccagcggctcgccctccacgtcgcgggtgatggtgaaggagccgccggcctgcgactcccacaggtactgctcgtcgtcgttgtgcttggtcaccaccgtcacgcggtcggcgacgaggtaggcggagtagaagcccacgccaaactggccgatcatggagatgtcggcgccggcggacagcgcctccatgaaggacttggtgccggagcgggcgatggtgcccaggttgttcaccaggtcggccttggtcatgccgatgccggagtcggtgatggtcagggtgcggttggtcttgtcggggacgacgtggatgtacagctccgggttggactccagcaccgacttgtcggtcagggactggtaccggatcttgtccagggcatcggaggagttggagatcagttcgcgaaggaagatctccttgttggagtagaaggtgttgatgatcagggagagcaactggttgatctcggcctctgcggggcggggggagggaaggggggtcagcacgcgggttctagaagggggagggaaaaggggagcggggcgggtccacgggcacacatgcattcctcagcactcacggaaggcatatgtctcagtttctgcggccatgatgtagctcttgtgggtgggagtggctaggcggggtgggtgggcggctgatgatcaagccttgactcgtgagtggatgctcggggatgtgcccggcgatgtgctcagtgtgcgtacaggttgagggaaatgatagcagatgtgggctgggaagggatcgtgagagacttttgacctggtgacccaccgtgcagccgaggttccagaaggtcctggtaaggcgcgcaacttcctgatgtcgggccctcgaaaggggttgcctctcccggtctgcatccggggttcaacatcatctcgtaaacccagcactcttgctctgtcgaggcattgtgtatcgatgccgaggtgcacgagtgtgtgggttgcccttgcaccaggtcgcctgctgttggtgtgccctccccaccccttctcagtgatgtttctgagcgaacttcactctcggcgtgctacatgcgcttcctcgtaccattgaggcattttgggtcccgagatagtagacccggtcgccctgaatgctctagccgcagggcgctgcatgcaggcacagaccccccccccccctctttcaggaggtgatgctggaggcgagggcttgagcataggcggcaaggatgaagaaagtaaggagggacatggtggcgggccatgccctagcaccaggccactcccggtcattgtaaggggtgctctgtattctcctgatgaaataaaacagcactgctccggagatggcaagtccagccgcgctaccgatcgtttgcagagggacggcttgcagcaaggcagcagtctggaggtgacggggtggcatgaatctaatgagctaggacgaggtgtgcctctctgattgggtctgtcaaatgcgggtgactgcggcagcctgcaaggccccatgggtccagggcgaaaagcctggcatgctccacattctcgcccagatggactctccaagatgctggggtgtcagacaggttcccttcccaccaaccctcatggccacactacttgccgtggtgaggccagccgtgccaaccagcgtccacccgatggaaggccggccgggtgtcccagccgagatgctgaagccattataggctgcctcgccgcccagcacagccactgcgggatgcggggggttgggatgcagtaggatcggacgaggcgagctgggaacagtgctggaggcagagccacgccaggcatgcctgtatgcatttattgggaagccatgcccagctcccgactcgnnnnnnnnnncaggatcggacgaggcgagctgggagcagtgctggaggcagagccacgctaggcatgcctgtatgcattcattgggaagccatgcccagctcccgactcgctcaccataaatcacggcctgctgggacaccgcgagcgcagcctcgggactgatcgcggacacacgaacatcgcactcgttgctgtgttgccttttatagccaggttgcattcggcacacccgcggcaatggtgtggtgctacagattcgacccctcagcgcgaggcccgtcctagcgccgacatacagcattgccatggaaataatacacgacgaaatggagtaagaaagatgtgtggagatttgtcagcgctcaacagaatggagtgatgagcgcgctggtaatgggaattccgtctacctctccatgggtggatttcccgcatgctttgtgcgcgcgaccgtggaactattaaagtcacatacttcctttttaagcaccccttgtaatcgattcgccgcaagggtgttgctaagtgtattgggtttattgataggcaagctgccttcgctgtctctaaacgctcgtccctacaaaaacgagggtgattgcaatgctcggcatgccgctgaaggggtacgtaccacccgaccagagtgctgcacttaacaaaggctatacaaagctgcagggggaagactgtctgagccggtcttcgagtgtgccctacacgcccctgcactcccgacggggagtgcttgatggtacgtcccccatgcgtcaagctacgaattgtcttccaaaagtttacccgcacgtctcggctgccaaccacagctttcggctggattgccgtattggagcatgtctagtcatattcaatgtcgtattctcgtgccgtcatttcacgggccctccaaggacagtaacaaggaaaaaagagcgggaaatctcatggctctgtggtggaggtggttgcacagtacggacgcggacttgcctggtcttccaaggcttcggaacgcacatctgatgcacctgtagtgccatcagattgctgggtatacggtctccgctgcgcagagacccagttttttgcccgacccatccctagagagtccaaggccctgatacagggaccacgttccccccatcccgcaccctcgattcgccctctggcccctgtcgtcaattccggcccctcctaaaaagtctggtctatgctagacagtagattctcgttcttcctagcgcatccgtgaaggtgagggttggagtcgcatttccaggtctcatggtgccgtccggaaacacgctgcccgcgcgggatgcaccatccgtcggcttatccctgaggccatactccccttaacccccatgccactgcccccaggccatgaataatccggtccaggaacacagcggcccctcccagtccgccttcgccggccaggccctggccacgccctcggtctcctcctccgactcctcccatgtggccagccccaccgcccagcgcaccccacccccgctcgaggacgcccgcgccagcgtcctgcgggccctctccggcgtgtctgaggtggtcagcgcctcgcgcaaggtggacgaggaggcacgggcggcgatcctggcccgacgacgcgcccgcgtggggggacccggcgccgccccaccgggcaacggccccccctcccgctccggctccatgcccggcgcggacaccgggctgggcctaggcctgcacgcccgcctgaacagcctggcggaggggcaggtcccaggcctctccccgcacggccctgggatctacggcgcgggcctggccggcgccctgcactcggggtccgccgnnnnnnnnnnagtccctggcctctccccgcacggccccgtgatctacggcgcgggcttggccggcgccctgcactcggggtccgccggcgcctgcccctcccccctcgccgccctggctggctccgccagcgtgcccctgggcgaggcctttcaccccgccgtgccgcgcctgcacagcccgctgccgcagagcggcgccggcgggcatgccccgccgccacacttccccgccctgctggacgcgctgggcgcgctgggcgtgccgcagctgctcctgctccgctccgaggtggaccgccagctggcgtggcgcggggtgctgggcggcgccccggacatgggcttttctcccgcgcagccggcgggcggcgccagccccgacgccagcatgctgctgctggcgctgcagcaggcccaggccatgcgccagggctcgctggggccccaggaccccgccccgctcacggcggggtccggcggcgccggcgcccaacccgccgcggagcgcctatcgctgcgggagtgggtgccgcaaggcgcgcccgccggcgcagcacgcagcggcgccaatgccgccgccgccacgcgtgcgcccagcctgccggccctgcccacctcctgggcggaggacgtgcagctgcctacgcctttcgcagacccggtgcgccaggccacgatgcccgcgctgtcgccggccacctcgctgcaggcccaggggctcgggatggaggaggcgggggtgagtcgtggggaattgttggcgtgttttgggggagaggaggggaggggagttgcatccgtcctgattgcccgggcaggcgcatgcacatgccgggggggggggggggggggggggggnnnnnnnnnntgtgcatgtgcctgatgcgcggtctagcgctggcctgcccgcaccgcccccacctgaaaagacagctccatgccccggcacgctccnnnnnnnnnngtgatgcgtgcatgtgcctgatgcgcggtccagcgctggcctgcccgcacctcccccatctcaaaagacagctccatgccccggcacgctccaccatccgacgcccctgcccccaaaaccccctcgttgcagctgacccagggcatgggcgcctggtccccggtgccccagcggtccaccggcccaggcatgacgcaggagatgctggcggccgtcaccgccggcctgcacctgtttgaccccccctccggcggcctgtcccaggaccagcaggcggcctcgctgggctaccagggcgacactgggctgggggaccccggcgccgaccagggatccccgcaccgcctgcactacccgcacggccaggagggcgtgtgggacgcccccctggacgccggctgggcggtgcaataccgctgagcccgccctccgcccaccacccaccccacgacccaacaccgagcctccccctcccccccagccccnnnnnnnnnncagcaaacaccgtcctttcctggcccctggcccagagacctttacgaagccgcaggcctccaagnnnnnnnnnnaaccgctgagcccgctctcagcccaccacccaccccacgacccaacaccaagcctccccctccccccaagcccctcccagccccctcaacataccagcaaacaccgtcctttcctgccccctggcccggagacctttacgaagccgcaggcctccaagccatgcccagcttgccacgcggcccccttcctcacccgtcaagagcactgttgtccacccagccccgccttggacccccgccgccggctcacccagtacgacagcttttccatacacccctgtgctacccccttgccacctcaggcgcagcaccaaaggtacctttttgatctcttgccctgcactgcctctgttcccctgggagatacccccgtccctcatgcctgcgggcccagacccggcgtgcatgtttgcttggtctcatccccacctcggtcgtctgccccgcatgattgacacattttttaccataccttcaaccaagggctttgcagagcgcggggttgcatggggtccagatcgtgcgagggcatggtgcagagggcacaggtgcgttcagacagcgggcagggtcggcgtggcggccgcatggcattccacggccgctccaggaccctggaaggggtcacaatgccgtgtcgtcggagggaccgccgttggcgccggcgccgccgccccccctgaggtaggaggcagcggccgacaccaggccgtagttccccagcgcgatctccagcgatgcgtgggcgccaacgcccgtgcccgggaccggcggccccgagcccagctccagcgcgccgtccaacgagaaacccgcgctcagcgcgcgggggctnnnnnnnnnnaatctccagcgatgcgtgggcgccgacgcccgtgcccgggaccggcggcccggagcccagctccagcgcgccgtccagcgagaaacccgcgctcagcgcgcgggggctgacgtggtacagctggctggcgcagccggcggcgagcggcacggagggggccggcatgccctctggcggcagcagcggccgcccattcagcttcagccggcgcagcaggaagtcggcggccgcggcgggctgggcgccctcccctcccctgcccagtgcactgcggaaatttgggnnnnnnnnnncgccactgcgggctgggcgccctccccccccctgcccagtgcactgcggaaatttgggggtgggaggggtgggtgacggggaatcagaggggtcggtggtgcggtgcatgtaaacttggcaccgtccttacaagggggagcaatctttgatgaatgggtcacgtggcggcaggctcctgtctgggcaagatgatccttgtcaactccacaccacaaagcttcgggatgattgaactcaccctccccaccgcgccgccctcctctccgcatggcacacagatgcgatgccccccatcccatccaaccccccccctttccctagagctcctcacgtgttgcagannnnnnnnnnacatggcacacaggtgcgatgccccccatcccatcacacccccctctttccctagagctcctcacgtgttgcagagcctcaggctcatggcatttatctccggcccgcccagcgccggcagcggcgcggactgcgtgagcatgctgccctcccccgcctcggtggccaccgccagggtgcatgcccgggtgtggtggagggaggacaccacggagccgagccaggtctgctccggcgcgggggggctcccggcgccctcgccgccctccccctcgctgccgtgcagggtgcagtccaggccaaaagcggcggcgccgccccagaggaggccctcggccgacagggaggtgtcggggtcgcaggccgcctgcgcaaagtagaccgagcggtacccctccccgcccccgaagttctgcaggcgcaggcagagggcagggtcaaaggccggccactgcgggtcggggagggggagcgggtagcgcaggcgctgcaggccgctggtcacgccctccttcttcttcagcagcgaggccagggcccagccctgcagcgcagccgcggccgctagcaccttggggtccagcctggcgaggtcggaggccacgtggtggtacagcgagtccagccccgcccgcggctcggcctgcggacccgcagcctcgtcaccctgcaccaggcccagcgtggcgttcaggggccagaacaggccttcggagcgcttccggccgtcgcggtcgttgaggtgggccgccagcgaggcctggacctcgctggcgctctccctccacccctccaccgctgactgcaggctgctgaagaggccggtgcggttggccctggcctgcttggcaaagagacctccccagaggccttggtagatgtttccctgaggggaggtgtggggtggttgcggcaaggaaggggcttggggtcgctcggacatggcgctgggctacagggtggcgctcctgacaccgtgccccagcatcgaagggggctcctgcccgtgtgtccaggcatggtgaagccacctcatccccgccttgaaggcatagctcgacatgaaatgaagacactagcagtaaaatgtcgtactgggcgactcannnnnnnnnnccatccccgccttgaaggcacagctcgacatgaaatgaagacattagcagtaaaatgtcgtactgggcgacttaatgtgctgggttggtcgtgcacatcgcggtcgactcccatcttcaccgccccgcacacacctgactggccaatgccccagactggcacagcaggatgaggagcgcccagaaaaggattaccgctcgcatgatatccgtgtatacattttaccctgggggagtgggtgacgggggctggagggagccagtaggaccagtcgcgggagtcgttttccgggccgtgctcgaggcagcgcagatggggacagttcatatggggtggcgggaaaggccaatcctccatgcctaccacgcatgctcattgccgctccaagaacacatcaccaggtccgctccgccctccatcctgcctacctccctttttgcagctggcacggggggccatgcatgtcaccgcgactccgtcacccctggtggcgccccctcgggggttcccaccggggctgtgcttccgtgggcaccagagtgtgacactgcgcacatggacacgtccccgtcgcaccccccttcatcgatcggctgcgattaccgccgttcaggagtctgcagccccctccctggtggtgccgtcaaacgaggagctcggtctggataagacggagtcggaactgtatgccgagttcgacgccctgctggatgccaacaccctctcgttcaagtctggcgagaaggtaggatcgcgaacgcatcgaggtccttgcctgggtgtcgggagggcctgtgcatgggatacgccccctcgtgtctgctcgggcatatgcatggggtgcgccgggctgcgcaccggcctcgcgccgcctgcaccactcgatgtattgcttgtgtcgacaagcatacctccagactatctatcccgtctccgacattggtcgctcgtctctcgcgcaggtgaagggccacatcattcaggttgaccagaagggtgcccatgtggacgtcggcgggaagtctgcagccttcgtgcccaatgtcgagatggcgttgggcctcgtcccacgggtgtgtgggctggcgcttgttgttgggctggtgcttgttgttggtctggctgtgtgcatgcgagatggtggtggagcacagtggtgagcacagccggcacgcatgctgcnnnnnnnnnnactggtgcttgttcttgggctggtgcttgttgttgggctggctgtgtgcatgcgagatgggggtggagcatagtggtgagcacagccggcacgcatgctgcgcatgcagcgtcacactgggtgctgtgaagtcgcacagagcagcttgccagtttatcgtcgtgcaaaggctggcagcattgcatgtgcatgcccatgggggtttatcgtgccgctgttggatcctgtgtccgtggttcagagccttcccagacattcagtagtcctgtgcccgctgggaccctcccttcccatcctgacaccccgacataaaccccgttcccattttccacgccgcccacagtccaacgacctgctggatgctggcacgtcccgcgagtttgtgattgtgcggcaggaccaccgcggcgacatcatcctgtcgctcaagcgaatacagctatcggtcgcctggcagcgcctgcgccagatcgcggagtccgacgccgcggtgacgggcgtggtggcggccaccaaccgcgggggcctgctggtggatgtggagggcgtgcgcggcttcaacccctcctcccaaataggcattgtgcgtgtgtggaagcgggaggggtggggggcatttgggtcgagggagccgtgtgtctgccgacggggggcgtgtctctggaaggcgtgcatggtgttttcaacatgggtgacacaggggannnnnnnnnngaacgggaggagtggggggcattcgggtcgaggaagccgtgtgtctgccgacagggggcgtgtctctggaaggcgtgcgtggtgttttcaacatgggtgacacaggggaatgatatgcatgggcagtcaacagactgcagatgaggtcgcagcgccatcttcgccttcgtgtgcagccgcagacctccgacctttccccccaatgtccccacccccccttgtgtacacccacagcgcacgaccaactgggagnnnnnnnnnnagcagacctccgacccttccccctaatgcgcccaccccccccttgcgtacacccacagcgcacgaccaactgggaggagctgatcggccggcacctgcagttcaagatcctggaggtggacgaggagacggggcggctgatgctgtcccaccgccgcgtcatgaacgaggagcggctggagacattcaaggccggggacgtggtggaggggcgtgtgatgagcgtgaagccctacggcgccttcatcgacttgggcggcggctcctccggcctcctccacatctcccagatctcctctgcccgcatcacggccgtggaccgcgtgctgagccccgacgaccgcatcaaggtgctggtgctgtcccaggaccgggacaagggccgcatctccctctgcaccaagaagctggagccggcgccgggggacatgctcaaggaccctggcctggtctacgagcgcgcggaggagatggccgcgcagtaccgcgcgcagatcgcggcggcggaggctgccgcgcgcgcctccgctgagcagctggacctggaggtgctggcggccggcgcgggcgaggcctcgccttcgggcctctactgagcgaaacctgtgggcgggggttatgtggaaaagggggagaagggagccgaagagcaagcagggcgggggacctacgcctgcccggaggggaaggatgcctccgcgccctctgaggagccaccccgtgtttctgcccgccattgccccgcggctgcagctgctgcaggtcaaccatacgccctgcccatgcaacgtctgaacccaggcatacctggtgttcccactctgggaccccaagtccagccctctccccctggnnnnnnnnnnnnnnnnnnnnnnnnnnnnnnnntgtgccacgtctggcacctggaccattgtcacttgaacattgcctcggcttgtgaagcaccaggaaggtcgctgaggcatgggaaacgggatcgctgagcggctcaaggtgtgcgaggcatgcgctgctggtggacacgccttggctgccccacgcttgggcactgacgctaccagcgccgcctgtccagccttcaatattgaggagatgcactcgggacccagtgtgcagccttagggccaggccaacagcattacacctgccatgattgcacccccccccccaggcatccgtcgctcggtcagcagaacttccatcggttgttgcagttgaggcaggtgacgaaggtggtcatcggctcgtccgcgctccgggtctgcatctggtagtacgtcgtcttgcgctgccggcacttgccgcactggaactggtcggtggtgggctgcttggccgcgctgggcgcgctgtcgaacagcttcttctcgcggatccgcgcgttctcctcccgctgcgcgtcgctggccagcgcctccggcgccagcgtgaccagcaggtcgggcgcgatgcgccccgtcagcaccttgcgcctcaggtcggggttcttcctgtccttcaggttgaaggacagagacctgaacttggccttgtacccctcggtcacgccgccgtgctggcgccgcagctcctcctccatggccacggccagggcaccgggcgtggcgcaggcctcctcgtccggcgagggcgccgccctcagctcctcgaccgccaggcacagcgcggcggcaaaggtcgtgcggcacaggtcgcgcaccttgtccccggtggaggggacgggggccggggtcgccgtcgagccgccgccgcccccggttgctgcaaccgccggccgcttgggcgctggcctcgaggacgcaggtgtggaccccggcggctcacacgtgcccaccccgggcgcggtgcgcttgagcgagggtggagcggccgccgcagcgcctgcgccggccggtctctgcgcaccctccaccttcacaggcactccggcggctgccgccgaggggtggcgggccgtcgaggagggttgctcggatggagcgtcgcctgacccaccccggccctcctccgcctcccggcgcacgcactccttccaggcagcgatgacagacgcggcggcctgggagacggcgggagaggcatgcttgagcaggggccggagcagcttgccagcctgggaggaggccagctgggcggcggtgacgcggcgcgcttgcagggcctccagcgcctgcagcgccggctcctgcaaggtgggaaggagacaattctacgaactcccattcccagaatcttggcgggagtctggaggcggcggatctgtcaaggccatccagggcaggcatggggctcagggattgggagatcctccattcaggcacatgctcaccgtggggccgctggggtgagcctcaagctccttggaggcatccaaagctgactttacgagatcaagcatgggcttgacggtttccacagccatgcgtgccgcatgtgctgccgaggccggggctagcgctcgggccaggagatgtcaggggaggtgggcacaccaggacgaggctgtcgtgtatggtggtgattctgtatggaagcacagcccgagtgcagaaactcgacaagaatatcgtttactcgcaaccatgcatgccgatggcaggtgttctttgcagcccggattccactcgagcctgaaatgcagcaccgatgatgtggcagcaggtgnnnnnnnnnnaattctgtatggaagcacagcccgagtgcaaaaactcgacaagagtattgtttacttgcactcatgcatgccggtggcaggtgtaacttgcagcccggattccactcgagcctggaatgcagcaccgatgatgtggcagcaggtgtgatagacagtagctaggatgggccctgatgccaaccctactgtaggcacccctcaccacctggagcaaaaacaccgacatcgaggcgccttgaaggatcaggagtgtcggcatgtggagacgcgagcaggccggtcactaccagtcaggctgagggccgatgccccctgcgcacaatggcggggcccttccaagtcgtcgttgcccgcctgaccccggacacgccagtttgtggcgtgccccttgagccctatgtcctggccaggcgggccgacacctcgacggtcactggaggtgcgctgcacgggatcgctggcacgggaagcactgtcaggggggtgtccccatcgggacatgcacacgcggtgcctggtacttgggtgctgacgaattgtcgtgatccggcgatcgatgatcccccactgccccacctctccccgcaggtgacctccccgccgagggtgccaccgacgcccggttcagtatcaagtaccggtggtatcgctctgtggtgaccaagagtgggcaggtaggcaccccgacgggtggctgcgtgggctgggctggcgacctccccatctcacacccatgccagcagcacagggagcaaggggcagggacggcaagctggggaccatgcatctcagtatggtcatcagcccctctgggaattagcctgggaggatgccctgtccctgtgacactcaccccaccccccctttcccccccttttcacacacacactcaggtgtgnnnnnnnnnntgaccatgcatctcagtatgggtcatcagcccctctgggaataagcctggggggatgccctgtccctgtgacactcaaaccccccccctttccccccttttcacacacacactcaggtgtgctgggcgcacagcgaccgcgaggccacggtgcagtgcatcctgtgcctgcgctcacgtgtggacatccgcaagtcgtaccactgctcccccgagtgcatgcgcgagcactggcacttccaccgcgagttccaccgcggcgggcgcggcgagaacggcgcgggcggcggcgagcccgcgcgcgcgcccacgcccgcgccgcacggcggcgaggcctggctggaggtgggctgctcgcccatctacaccccctgcttcgaggacgtgggcagcttcctgaagctggagtgcgtggcgcacgacgccgccgcgccctaccacgacctgggcaaggtggtcaccacgctgacgccgcgcgtgcgccccgaaccgacgccgccgcggcgcggcatggtgcccatgccgccatcgcgccctgtgctgcgtcgcggcggcttcaccctgctcacctacaacctgctggcggagctgtacgccgcacccgaggccttcccccattgccccgcctgggcgctggcctggccctaccgcgcacccaacctcctgcgcgagctgctggcccacgacgccgacgtgctgtgcctgcaggaggtgcagtccgacgcctttgccggcttctggcagcccgagctggcgcgcgcggggtacgcggccatcttcaagaagaagacggcggagatgttctccaagaactcgtacgtcaccgacggctgcgccaccttcttcaagaaggaccgcttcgcgctggtgaagaagtacgaggtggagttcaacaaggccgccctctccctcgccgactccttccccccggaccagaagaagctggcgctgagccggctgctcaaggacaacgtggccctcatcgccgtgctggaggccctggacgtccctggtggcggcgcggagggcggcgaagggccgtcggcggggacggggacggggacggggacaggcgccgcaaacgccgccggcgccgctccggccgacgccgctctggcgacacccggcaccgcgccacggcgccagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaccacccggtgggttgaggggggggaaagttttggggccctgggaccgggcatgggagcggaggggcggcttgagctactcacaacaatcacccactctcctcccacatgcccccccccccaaaaaaaaccatgatcaggagctgagcaacgaccccctgnnnnnnnnnnacctcataacaatcgcccactctcctcccacatgccaccccccccctcaaaatacatgatcaggagctgagcaacgaccccctgggcatcctgcgcccggccgccaagctacagcacgggctgccgctggccagtgcttacgcggcgctggcggtccccggcgaggccgactcggcggggctggtgcgccagcgccggcgcctggacctggccaccgccgagccgcggtggacaaacctgacggggaacttcaagggcacgctggactacatcctctacacctccgactcgctggtgcccgtggccacgctggagctgatggaggagagcgaggtgaggggtgggggggccgacgggggcctgccctccgagttcctctcctccgaccacctggcgctggcggtgacattccagtacgcggcggtggagggcgccaagtgaggcgcgcggcgacgcgcgccttcgacacgggccccgtcgagtattccatacccccccctccccatgtccatgactcgacacggtgccgatgtaataatcgacctcgcatgttggcatcccgggtgtnnnnnnnnnntcgtcgagtattccataccccctcctccccatgtccatgactcgactcggtgccgatgtaaatatcgacctcgcatgttggcatcccgggtgtcgaggagccatggtgtcggtctgatgaggccgatggctccccaatcaggcgatccaggtgatcgggagggcatcgtcgtcggcagcaacgcacaccatgtcgtatgcccagcctgaacaatcatgctacgtctgtaacaagcacatccaggaacttctcacctgccccgagtgtaccgccgtctactactgctcggacctgtgccgggaggtgcacgcctttggtggtgggcataacgtggaccaatgcttccgcttcgcctgccagcgggagtccagatgggtgagcggtgttctgagtggtggatgtcacggtgggatgtgggaaaaagctgggagaggtgctatgttgcctgcctacactgcaggtcacatgcccttcccacactcgtcccaccctgcaggccctcctgcaaacattggacccatgcatccatggtcaagcggtgaccgacctcatcagggccgggccgcaggccacacagtgcgcgtggccgggtgtgctggacaggagtgcggcggggagtgtggtggacgttctagccctcccctgggtccgccgcctgatggacgctgctccagatgcgccagccctgcaactgnnnnnnnnnngtccatggtcaagcggcaaccgaactcatcagggccgggccgcaggccacacagtgcgcgtggccaggtgtgctggacaggagggcggtggggagtgtggtggacgtcctagccctcccctgggtccgtcacctggtggatgctgctccagatgcgccagccctgcaactggagtggcggcaggctgcaggcctcctggtggacggccttggcgagcgcgcggggcgacagttgatcgcaggatgcgcaaacctcgtcggactgtttccaggaacgagcacgcccgcctgccctaccacggccccgcaccccgtccaagattgggccagcctttgccgcctctgcggcgcccccgcagacagtcccctgcgcctctgcctggacgccgtgctgaccgtgcacggcgcagcactggcgcacctggggccggccggccaggccacacaccctgccgtgctttcctgccacttgctgggtgcggcatgggaggtggggagctggccccagtttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggtggcctggcatgggcccagatatgccgggggtggtcctggcctgcgatgctccctgaccttcaggcgcgggctgtaccaggnnnnnnnnnncgccgcgctttcctgccacttgctgggcgcggcgtgggaggtggggagctggccccagtttgccgtcctctccgccctctggccctccgttgcctggatcctggtcctggtggggcctggggtgccacctcagctggacagccggtcggtggcctggcacgggcccagatatgccgggggtggtcctgggctgtgttgcaccctgaccttcaggcgcgggctgtaccaggacatcctctttccccctggcgggggggaggtgtcatgcgcgggggatgaaggggctggcaggctgcgggaggtggacctcgtggtggctccgaatgcgggtgggtgtgggtgggtcatgctgaacatgcaggcccttgccttggtgatgtccatcaatctgcctcatcagcttgtactttggcgtaggcatgcagtctgtgagagtaccttgtgtcgtccgtgtgtggcaattccaatcatggacagccaggcctctgccaatcacatggaccccaactcttcttgaagtttctgccgtccgaggctccatgcctgcccttccctgcaggcctggcggtctacccggagtgggccggtgcgctgcgcgcgnnnnnnnnnncagtaccttgtgtcgtccctgtgcgtcaattccaatcatgggcagccaggcctctgccaatcacatggaccccaacatggactcctcttgaagtttctgccgtccaaggctccatgcctgaccttccctgcaggcctggcggtgtacccggagtgggccggtgcgctgcgcgcgctgtgtcgcctgaggaccggtcgcgcgaagaagctcaccgcccgcttcacagactactcggcggaggccgcttggatgggcggggaggcggtcagcaaggttctgggcggcgccccacgccctagtgtctgtgaaaacccgtttgcacagccgctcatggttccgcagcccgaccacgacctgcccaccctcagcaacggtttcatcatagaattttgatgtgcagaggggcgcagggagacttgctcgccagatttgagtgtccctcttgaaccgtggagggtgccgcccagggatagcgctgttgctttggaatatcaaatacctggccctgcttgtccagtttacaagtgggatgacactggggtcatgcaatgcggtccagtatgaccgttgtcagagtctgtcaggctgtttgctggacatgatggtgtggcagctcgtttgatgcaaggcacggcagcgttgccgagaatggggagagggtgtgtaggacaccggctgtaaagcaagtatgtgatgcgtcacttgtcgtttgtcatgggaaaagtcagcacgcacaccttgatgggtgtggtgcaggcaacagtgcccagtcacctgtcgtcagatggactctggggagcagggtgcaggnnnnnnnnnnccagtgcccagtcacctgtcatcagatggactctggggagcagggtgcagggaaaatgcaatgagcaaagctacctgggggctgcgtagtcaccttgtcacactccccctctcagtaaagaggaggcgcgccaactgggagaagggggcaacagcattcctcctatgtgtgcgctctcctctgcctgcctaaggagccatggctctcgtcaggacagttcctggcgatcggtggggagcaggtgggcgatggactcccgccccgcccgtgagatgcggtggcatcccgtcaggttcaggcgccgcagatttggcatggccgccaggtcggccagcacgctgtccgtgacctgccagctgtacagcaggtccagccgcgtcagctccttcaacaccgtcagcgccgtgacccctgtggtgttggacggaaagtgagaaagtgtggcttgggggtggggagtcggtcgccttttgctctgcacnnnnnnnnnncacggaaagtgagaaactgtggcttggtagtggggagtcggtcgccttttgctctgcaccatgcactgccgtgtctacatcccccgaaagcgagcagaccccgagctagatgcagtatgacccagtcccagataagttaaacgtcttgctctatcttccccaccccacctatgccgcccactccaccccaaaccacccacccacccacccgcgtcggtgatctgccaacagaactggagctccagggactccagcttgnnnnnnnnnngagttgaacctcttcctctatcttccgcaccccacctatgccgcccactccatcccaaaccacacacacacacacccgcgtcggtgatctgccagcagaactggagctccagggactccagcttggcaaggcgggccaggggccgcacgccgccgtccgtcagcgtcatgttctgcagggacagcgtggtcaggttggaaagcccggcggccaggctggccagcccctgctccgtcagcgcgcggcaggccttgaggcgcagctcgcgcagcgaggccagccgcgcgacggccgcagcgcccgcatcgctcaccgcgccgcagttctggaggtggagttcggcgagggggggggcggtgccatcgtcgccggcggcgccccaggccccgaacccgcgcccctccaccccggcgcagtcagagaggtgcagcgtgcgcagcgcggggaggcgtcccagggccgccacccctttgtcggacacgctgtcgcagccctgcagggagagcgtggccaggcacgggtgggagggcggcgcggcggccagcatggcgtccagccccgcatccagcccgggcacgccgtggcagccgtggagggagaggaggcgcaggtcgcgcagcgggcgcagcgcgcccagcgcggcgccatccagcttgcggcagccgcagaggaagagggactggagggcggggcaggcgcccagcgcggccagcgcgctgcggccctccagccccaggcagtgctcggcgcggagggtggtgagcttggcggcgccggccagggggcccaggtcctcgccggtgagcaggcgacagctgctgaggtccagcgagcggaggtcggggagggaggccaggaagcccagcgcgccgcccgccaggcggtcgcacaggcgcagactgagggactggagcgcggcgcaggcgcccagcccgggcagtgcgccgccgtctggcatgtagaccccgcggcagccctgcagagacaggcgctccaggttcctcaagcctgccagcccggccagccccgggcccgtcacctgccagcagccgtccaggaggagggagcggagggaggccaggcgcccgaccgcggccacgcccgcgtcggtcagcgcgtggcagcggcgcaggtccagggtgtgcaggccgcgggcggcggccagcgcggccaggccctcgccgcgcagctgctcgcaggcgcggaggtcgaggcgcgcgagcctgggcagcgcgcccagcgcctccgcccccgcgtcggtcagctggtgccagccgcgcagcgagaggtcggcgagcctgggcagcgcggccagcgcgcccagctcggcgtcgggcacggtggcgcagttccacaggcccagcgtctccaggctggcgcccagaggcgccagcgcgaggaggcctgcgccggtgagcgcaaaccccgccaggtccaggtcggtcaggcgggcgcaggcggagcccagcaggcgcaacacggcgtcggcctcgcccgcggcgcccgcgccgcaggagcccaggcgcaggtggcgcaggcggcccagcgcgggtcccagcgcggccaggccgcggcaactcac

SEQ ID NO: 32067 - DNA, 119 bp, Chlorella protothecoides
tcagatggactctggggagcagggtgcagggaaaatgcaatgagcaaagctacctaggggctacatagtcaccttgtcacactcccccactcagtaaagaggaggcgcgccaactggga

SEQ ID NO: 32068 - DNA, 391 bp, Chlorella protothecoides
  modified_base (100)..(334): a, c, t, g, unknown or other
ggccgagaccgatcttcggcggataccatgtcggcccagctaattcccccctcctccaccccctcccaccgacgcaccaggaaggaccttgccctctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcacgctgctctggcacaagatgtctctgcacacccataatcaggacacccgggtg

SEQ ID NO: 32069 - DNA, 116 bp, Chlorella protothecoides
gtttcctcctttgtcacagacgccttgcccctgtcatccgctggctgggtgcctggagcggcagcctcagcccgctcgccggacaagaagtcgctggtgtcctgggcctggaagag

SEQ ID NO: 32070 - DNA, 61 bp, Chlorella protothecoides
ccagcaggctcatcctttggtcctggtggcaccagccacaagccatgctgcctgtcagatg

SEQ ID NO: 32071 - DNA, 5864 bp, Chlorella protothecoides
  modified_base (552)..(561): a, c, t, g, unknown or other
  modified_base (1757)..(1766): a, c, t, g, unknown or other
  modified_base (2803)..(2812): a, c, t, g, unknown or other
  modified_base (3189)..(3198): a, c, t, g, unknown or other
  modified_base (3727)..(3736): a, c, t, g, unknown or other
  modified_base (4327)..(4336): a, c, t, g, unknown or other
  modified_base (5319)..(5328): a, c, t, g, unknown or other
cagggacgcctcggcggccgccgccagcgcgccgcgtagggcatcgaggcccgccgggtcggggcgcagcgcggcgcgcagcaccgcgcccagctcggcggcgggcaggtcagcgccctgcgccaggcaccgcgccagcgccggatactgccccgctgcggccaggccggcggccaggccgggaaaggccgccagcgagtggatctgctgcttggccagcagggtggacaccaccttccactggcccaggcctgcgtatgagggggtggcgtgtgggtgaatggccggcgggggacgatgggatggagggagacttggtgatggggcgagtcgagacccagctccaggcagtggtacaggcagacggcgcttccctcgtcgtcgagctctggagcactgggtccccagttcccattccctggtgcatccctcccatcccctcctcctcagtccaccagccattgacagggcacgatccggagcaacccctcttccaccgacctccatccccacacacaattcacccgcgcacccatggctcgacggaggagnnnnnnnnnntccccccatcccctcctcctcagtccaccagcctttgacagggcacgatccagagcaacccctcttccaccgacctccatcctcacacacaatccacccgcgcacccatggctcgacggaggagggccgccagcagggcgctgggcacgggcagcgcacgcagcaggggctgcagcgtctccagcgcgtcggcctcgctcccggcgggcccgcgcgccagcgcccaggcagcgcgctcggcctcgccgcgagtgcgcgagccctcgacctcctcccaccttgacatggtgcaggggcgggccgggtcgtcgcccggcgcgctctcctctccgcgcccctcggcgggctgcaggtcgaaggcgaccgtgcggaggatgtcgcatgggccagggcctgtgccctcgcccgtcgggcctggggccttgctgcctgctgaggggtcctcgagacgcagggcgcgccgggccgcggccgcaaaggccgactcgcctggcttcggcgcggctgacgcgccgggagcagcggcggcggggggcacggcgccgaccaggtctgccagggtgagccctgcgcccgggtccaggctcaccgcgatgcaggcgtcgctggtgcagagcgcgaggctgtcgggggagagcgcagacacctgaggggggggacgaagagggggaggggggcaaggttggaatggggcctttgtgcaggaagagggcctgaccgacacagcatgctggaccagtcatgcgtcacagcgctggcatgcccggaccctcactgagttgcctcaacacgccatgatagagagtgaaagtgcaccgaaacactgccggtctcaccgagatgggggacccggggacagggttcccagccccctcctcctcccccaggtcggtgcaggacaggacgcagccgtactgctcctggacgaggaccaagcgcagggctgttgtcccgcctgcagagtgcggggcggagcggccgggtgagggatgtgtggcactgcgcggtggagtcttaggcaatggtatggagctcgtggctgggcgagcatcgagcgtgcgcagcgggccaagggagggaaggactggaggctcagagagattcccacgcgaacaacatcatcagcacgccggttcaggggcgctctgctgtctctatctacaaagttatcgctgacatcatcgcctccacccctnnnnnnnnnngaggggcgctctgctgtctctatctacaaggttatcgctgacatcatcgcctccacccctggtctccctcggttccatgcgggcacaccgccgtgcagtgccaatgtccacccactctccacatcggagggaggggacatggggcaacccctctcgcacccagctcaccatcctctgcccagaagagcgccgcgaggaggccctcgcgcggcgagcacagcgccgcctgccgcgcgccgccggcctcagccagggcagccgcagcccccgccttcagggacgccctgcgctttcgagtctgcggcgtcgcagcgggggccgccgcctgctgtgcggacacgccgcgcagcagcaggctgaggcggggcgaaagaccgtcgaccccggcctggcccctctcgggccagtggtatgcggagagcgcgccgtccgaccagagcacggccgcgccgccgggtgtgcaggaggccgccagcgcgtgggagtgcggggcgtcgggcggggggagcagggtccagtcggaggactcctccacgccaccctcgacgaagtggtactcgctggagcgcacggcgccggggtgggaggccggggacatcagcacgtgcagggaggagccgccctgcagcgagcggcaggccagcgggcagccggcgccggcggcggcggcggccaccctgtcggcggtgcagagcctgacgccgccgccgtggggcagggtccagaccgagggtgcgccgcccacggcggggccaggcgcctggaaggacaccctggagtcaaggcggaggccactggtgctggggatggggccggcctgcgaggtgctgggccaggcggcgaggctggtctggcctgctcggtccagcacggcccacagggtgtgcgaccgcgtgtccagcactgccgggcaggcgagctcgcgatcgcccggccccaggctccatgtgatggaagaatcctgggagcagcgattggggtatggatgagatgagagggaggtttgacgagatggtccatgtgcctgcgcagcgggnnnnnnnnnntgattcctgggaggagcgattggggtatagatgagatgagagggaggttcgaacgagatggtccatgtgcctgcgcagcgggtggagacgaggctgcaggcacagcacacggcgtgcatgcatgcatgcatgtatcgcacgccgccgtaccggtaattctggggaacacaggcttattccctccttcactgagctgatgagcactttgccgtcgcccgcggtggtggcgcccaccggggtgcctccactcagacggcgtgcacccaacatgttcagccacggcgcatcgaggagccgtcgagcacggcaagaggccttcaggcggtcctgaacaagtttaggaagacacagggtggatgggatgtcaatggtgtgcnnnnnnnnnnggccgtcgagcaaggcaagaggacttcaggtggtcctgaacaagttaaggaaggcacagggtggatgggatgtcaatggtgtgctactcctagtttctcttgctggacctcgccgctcgcatcaggacaaagcgcgcgcgcacgaattggaccgtgtgagaccagatacaacatgggagccaagggagactggagaggcatgcatcttctcaaaaaccttgattactaggtcttaaaatgctgcgcatgctaattgcccgacagtgggctcagactccattgcacgcaacctgtccccgcaccggggcgtcagcctgagctccccaggcctgagaccttcgcgagttccccctacagtctgtcagacattagactgacaagccctgcctgtcatcaaagatgaattctgacctgggtctcgtcagtcacctgcagcatcagaccgtgcgctgtgccttggcctgggagggtgcccagcaagcatactctgggtggggaggggggccaggaggtccaggtcgggacctcnnnnnnnnnngggcctgggagggtgcccagccagcatactctgggtggagggggggggccaggaggtccaggtcgggacctccaacctcccgtgacgagtcaaagtcaatgcacccccgcgcaggatcgcatcaggaacgtgtgcgtgctagctcatgtggaccacggcaagaccacgctgtcggaccacctgatcgcctccaatggcctcatccacccaaggctggccggggagcttcgcttcctggactctggggaggaggagcagatccggggcatcaccatgaagagcagctccatcaccctcatgcacctggctggggagaggggcggcccacgcccggagaggacgcccgcaaacatgcgggaatcaggtgcttgggaggtttgcattctggggagggttatggcaggattggtggtcgcaaggctgcctcctgagctcggtgttgatgaggggttgcatgaggtgctgcaccagtcaaaggcccgtgcggcgctgcagcgactggcaccgctacaaccccgccgccacgggccagccatgcgcagcatggccgcccacccaaccccctcctgatgacccctctcccacccgcannnnnnnnnnccgccacgggcgggccatgcgcagcatggccgcccacccaagcccctcctgatgacccctctcccacccgcagggcacctcatcaacctcatcgactcccccggccacatcgacttttgcagcgaggtctccacggccgtccgcctgtcagacggcgcgctggtggtcgtggatgccgtcgagggggtctgcatccaaacgcacgccgtgcttcgacaggcctgggaggagcgggtgaggcttcgccgtgcgtgttggcctcggtgggggcgggttaccctacccttgcagctccaggcatgcacagcaactcgcgggatggtcgactgaagtggctgccatggagctcacacctcctgaagatggagcagctatcatgggacgtgcagtgccgattcccagacatgcaccgtgcagccctgccaggggccagtctgagtcacgagaggccgtaccctgcacagatcctccaacgcactccctctgctttcccctgctgtagctggacatggtgctggtgatcaacaagatcgaccgcctggccctggagctgcgactgggtcccgaggaagcatacgcacggctgcgggcggtggtggaccacgtcaacctggtggtctcctccttccactccgagcagttcatcagcgaggccgatgcggtgctggcgcacgaaaacacgcgcagccaggcgctgcaggcgcgcgccggcggcggcgcgggggagggtgcggaggacgatgccggggcggaggacgtgttctcgccctccaagggcaacgtcgtcttcggcagcgcgggcgacggctgggcctttggcctggccgactttgccggcctgtatgctggtgagcggggagggtgaggtggaggggggtgtccctcaggacgataggtgctttagagacgcacaggagaggtaatctgccatggcagcagaggtctcgggctcccaacaggctggggaaggtcaattcagtgcnnnnnnnnnngggtgcattagagacgcacaggagaggtaatcggccatggcagcagaggtctcgggctgccaacaggctggggaaggtcaattcagtgcttgctgtcccatcacaacactcaccacccaggcctcgcctcctcgaatcgccaccgcccacaccccccgccccaacacctcccccttccctgtggcgcagccaagctggggtgcaaggccttggcgctggagcgggcgctgtggggcgactacgccttccagcccaagacaaagcgcatcctgcccatccgccccggctccggcggcaagcccctcttcgtccagtttgcgctggagccggtgtggcgggtgtacgcctgctgcgaggcggccgaccccgccgcagagctctcgcgcctggccgccggcctggggctgggcgagcgcctgcacccccgtgcgctggccgctgccgacccccgtgccgcggcgcgggcgctgatgcaggcctggctgcccctggccgaagcggtgctgggcgccgcggtggcggcgctgccctcgccc

SEQ ID NO: 32072 - DNA, 72 bp, Chlorella protothecoides
cctgcataggcagtgcagtgcttgggagtgaaaacgcagctcaatagagagcagcctggaatcagcagggat

SEQ ID NO: 32073 - DNA, 96 bp, Chlorella protothecoides
tcgcttgcggaggggctgtcatttgcaaccagccgactcaatgacagcagtccggtttgcatgccactgctgcccatcccctccgattcgcgtgga

SEQ ID NO: 32074 - DNA, 61 bp, Chlorella protothecoides
accctcccccgcccaagcatccgtccgcctatggctctcgctcaatgggcacaggcggtga

SEQ ID NO: 32075 - DNA, 79 bp, Chlorella protothecoides
actggcatggcgagcaacacccaccccgccccaccacaacaggtctcgcacacacatacccgacacttcagcactcgga

SEQ ID NO: 32076 - DNA, 65 bp, Chlorella protothecoides
ggcgacctggcacagtcgcggctgtcggagcctggcagggtccagcgcctggcggacgatttcta

SEQ ID NO: 32077 - DNA, 69 bp, Chlorella protothecoides
ccccgccagcaagtggcgtggcagactgcaagctcagcccgggcggggatgtgccaccgcgcctagctg

SEQ ID NO: 32078 - DNA, 61 bp, Chlorella protothecoides
cgggcggggatgtgccaccgcgcctagctgcttgcatgactgaaggctagggctcatgtct

SEQ ID NO: 32079 - DNA, 139 bp, Chlorella protothecoides
cgcggccgcccgcccccgccgcttcttccctcccttgcgctcggcgaagtcggcctcggggccgctctcctcctcccctgacccctggcccctgtctgcgccgccgggtccctgccgccgcgccagctccgccggtatg

SEQ ID NO: 32080 - DNA, 61 bp, Chlorella protothecoides
gacgcccaggacgtcgccaaacgtctgcataatagtggcatggggtaaggtaaggacacgc

SEQ ID NO: 32081 - DNA, 290 bp, Chlorella protothecoides
cgagctgtcccacaccgctgcctgatagcacggagatggggcctgtgtctccgtctggtgggcttccttgctcccgcgtgggtacacattctggcaggacctggttcgtgtacgtgtaccctgcttgtcaggaacctcgagcgctatggcattgagagtattttgggggggggggagcacgggcaggaatgatgatggtcgtgagtctgggaatgtcagtggggtcgagggtgtgccagtgcgcaggcgggcgacatcctgccgcaggtccgcccgcgccgcccggtcag

SEQ ID NO: 32082 - DNA, 61 bp, Chlorella protothecoides
gaggagccgagccgcctcccagtatgcacaggcgtggctgtccacccatgacgctcccggc

SEQ ID NO: 32083 - DNA, 136 bp, Chlorella protothecoides
acgaggtacgtgactgcatcctgtgcgtttggggaaggagaagacggagggtggatggtcgaggtgccctgtggtgctctgggggtcgactgagggcagccgtgcccctgcaccccggcgctcctgccagccgact

SEQ ID NO: 32084 - DNA, 91 bp, Chlorella protothecoides
atcagcggacgcagggctctcctcagcagcggacgcagggctctcctcagcagcaggagcaggcttcgcctcagctgcaacgacggagttc

SEQ ID NO: 32085 - DNA, 86 bp, Chlorella protothecoides
gttttggagcctccatggctctgaggtgtcgccatcctcatctgtatggctatgctccccctgagggacagccttacgcccctcct

SEQ ID NO: 32086 - DNA, 115 bp, Chlorella protothecoides
ctgaagcaggtgcaggcatggtgtctggcggcgccccagacattgggtgacgacattgcggcgaggtcccgtgccacgccctcccttgccgccatcagcgtccaccatccccccc

SEQ ID NO: 32087 - DNA, 76 bp, Chlorella protothecoides
tggcagccggtcttctcagagcggcggcgcaactggatcgtccgcacctcgcgctggctggcgacgcccttttcgt

SEQ ID NO: 32088 - DNA, 578 bp, Chlorella protothecoides
  modified_base (159)..(344): a, c, t, g, unknown or other
acctgcaggtgtggggattgcctctttcagaaagctatgcaggacggctgcggggcgatgggtgttcgggcagtcgaaagttgcagcgcggctaccctgccctcacacagtcatgccatcacaactctgtcacaggttgtgtacgactttgtggactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaggcatgccatcatccttgacacgttctcaacggctatgcgcctgctgataatcgcaagcggtgttccattaatggtcgcgcccagacatccggcgcgcggcattcccacaagccacgcctttacttcagcacagatgcggcaagtcaacagggaatactgcgatctaaatgcgctgaaaaagtagtataaagtaatggcctcgcatggcggtcatcggtagcaggcatgg

SEQ ID NO: 32089 - DNA, 98 bp, Chlorella protothecoides
gcctgctgccccagctttaggagggggcagcagggtgaggcctgaaacgactgtttttctaaaatggatttctttgtgctgagtcgatggcgggagct

SEQ ID NO: 32090 - DNA, 139 bp, Chlorella protothecoides
cccccctcctgccccccaacatccatcttcagctgcgtaagagtgcatccgggcgccccctcccgccgtacgaggccccgctcctgctcgggcccggatggcggggcatgaatcatcccgggccatgacgccggacccg

SEQ ID NO: 32091 - DNA, 571 bp, Chlorella protothecoides
tgcgccgcccccgcacgcgggcctgtacggcgtgccgggccaggggcaggcggaggcgtacggcgccagcgccggccccggccccgcccctggcgtgggctttggccagcgcccgctgcagggccaggcgcagcagcacggcctggcgcccggctacggcggcatggcgtaccccggcgccggggtccacgcccccacgcccccggccatgcacatgccgcaggccgcgggtgtgtacgcgccggcgggccagccatcgcagccgccgcagggcgcggcccaggaccagcagtgggcgcagcacgcgcagcagatgcaggcgtggcgggaggcctgggtgtccgcgcagcagcagcagcagcagcagcaggggttggggcacggcgggccggcgctaggccacgggacccctggggcccaagctgcgctgggggccggtgggcaccacggcatgcaggcgcgggcgcagcagggggcgctgccgctgggcgcggccccgggcgccggcgctgggtatgccggggccgggcagcggccgggcctgggcgggtcccccggggtgctgcccccg

SEQ ID NO: 32092 - DNA, 68 bp, Chlorella protothecoides
tcagctcctttgtccacgaggcggcggggggctcggcgacggcgacggccacctactacaagagggag

SEQ ID NO: 32093 - DNA, 115 bp, Chlorella protothecoides
gtggctgggttgattgtgccgatggtgaacccggtgaatgggtccccaatagacattgtagcggtgaattcagcccacttgccgccgtatcccctcaatctgcggattggaagag

SEQ ID NO: 32094 - DNA, 97 bp, Chlorella protothecoides
gggcgcggccgagttcctgccctccgccactaccacccccgtggggccccagtccggggcgctggcggcggggcagctggccgacccctcgcagccg

SEQ ID NO: 32095 - DNA, 454 bp, Chlorella protothecoides
  modified_base (122)..(350): a, c, t, g, unknown or other
ttgattcacgcggtccggtgagagctgtcctaggtcgatagacaaggcgaagtcctgcccagatttagtaacgctcccggtgatggacccgaacgctggtggagggggaatacctcccggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggaacgtacccggatgtcactacactgcaggtgagggatacctttccggcgacgggagcgccaaactggattgtggccatcgtacgcgccggtggtggagg

SEQ ID NO: 32096 - DNA, 61 bp, Chlorella protothecoides
ccacctactagcaggggatggataccagggtgagttcggccgcggggtaattaggcaaggt

SEQ ID NO: 32097 - DNA, 136 bp, Chlorella protothecoides
cgccccgccccccgccgcgccgctggtgtccgggggcgcgcagcgcgtgcgcgccaggcaccgggccaagggctcgccacccttgggactggtgtgcaggacgccctccagttcgtccccgggacgcagctcgggc

SEQ ID NO: 32098 - DNA, 77 bp, Chlorella protothecoides
ggactccaaacctgcgacactgtcttgagtgccttggaagtgatcggtcccgagcgcaccggagtgagagcagggag

SEQ ID NO: 32099 - DNA, 225 bp, Chlorella protothecoides
ggagggggcggatgagccggctcaagcatcgccacagctcgggccatgtgggaggttgagcattgctccagcgctccagcccctggtcttccctcactcgaccccgcgccactcgacgtagcccactcgccaaaaacaacagagaccgccgttgtaccggggtcacatgcaaacctgccctcgctcctgaagttaccatcacccccgtccaccaccatcccaacg

SEQ ID NO: 32100 - DNA, 61 bp, Chlorella protothecoides
gtgggttccagcggcagcacctcctcctccaccgccagctcccccgtgcccacccctgtcc

SEQ ID NO: 32101 - DNA, 79 bp, Chlorella protothecoides
gcgacggcggctgcacaggttacatgagtctgagatggtggccgctgcgcttggccatgcaaacttgatctacccacag

SEQ ID NO: 32102 - DNA, 561 bp, Chlorella protothecoides
ttttcccccccccccctcccccgcaggaggaccccagcagcccccggcccgccccatcctccccaaccaccaaccccctccccaccccgcgcatcgacttccaccacgctttcagcgcggcgcgcagtccggtgtcccagctgcgcttcggccgcctgacgcgcgacctgctggcctggggcgacaacgccggcgcggtgttcgtggcggccctgggcgcctcgccgcgcgtgctgctggcgctgcgtggcgggcacgccgcccccgtcaccgacctggactggagcggggacaacggcctgctggcctcctgctccgccgacgggtcggcctgcctgtgggaggccggcacgggagcgctgctgcgccggttcccgcccggggtcgcgggggacgcgcccctgctgtccctccgcctccaccccgtcaaccagaacctggtgctggtgggcacgggggcgggggaggtcctggtgctgaacgcgagcacggggcagtgcacggcgcgcgcgccgccggcggcgccgggcgccgccgccgcgcggctggaggtcgccaccg

SEQ ID NO: 32103 - DNA, 61 bp, Chlorella protothecoides
aaggcactcgcaccgacggggcctcgcccgattccgcccagaacagggtggcctgctgtac

SEQ ID NO: 32104 - DNA, 101 bp, Chlorella protothecoides
ctgcggcgcacgaccaggcatgacaccaccatggcagggcggccctcgcatgctccatcccacatccgcacctctgccccttgcctaggcctggtgagcat

SEQ ID NO: 32105 - DNA, 76 bp, Chlorella protothecoides
agcgcacgtgaggaatatactagtagaaattggggaggggcaactcgtgcagatctgctcacggcacgacggcggc

SEQ ID NO: 32106 - DNA, 76 bp, Chlorella protothecoides
cgcctgctttcgagacgcggcagcatctcatactttttgccaccctacacccacacaggccattcaggagtatgtg

SEQ ID NO: 32107 - DNA, 97 bp, Chlorella protothecoides
ctggccagatgctgagcaggaggcggactcctgatgacgcccccgcacgcccgcatccccctggcgtggatcgccctgcgctgacgccgcccccatc

SEQ ID NO: 32108 - DNA, 61 bp, Chlorella protothecoides
agggcactctgccggcacctctccttgcccaggagcgcaagccaacccacagaccccaccc

SEQ ID NO: 32109 - DNA, 61 bp, Chlorella protothecoides
gtcgcagggcgttggttgagcggagtacataccagacgagacgtattatcaataccacgaa

SEQ ID NO: 32110 - DNA, 126 bp, Chlorella protothecoides
ccgtgtgcatgcagtggtatctgaagatgtacagtcgtgcttgactggtggcggtctgagcggctcggaggttgcgccaatacgtgagaataggcacctgccaccagcaacccaacggtgccggta

SEQ ID NO: 32111 - DNA, 103 bp, Chlorella protothecoides
atttgcagatgggatcgccacacacctccatgcccctccgagcccataaaaacgccacccgcaggcccgcacgcgctcatggtctcacgtccagatgattctt

SEQ ID NO: 32112 - DNA, 118 bp, Chlorella protothecoides
gtggagttagggcggaaacagatcgagatccctcgactccatataaaggaggcctcgggatgcccatatctaaacaatcgccagccgtccacatttcaagcaaggaacctcaacttct

SEQ ID NO: 32113 - DNA, 61 bp, Chlorella protothecoides
ccacctgaacatgttctcgtcatcctcgacgtaatgctggcacagcaggtcgtacacctcc

SEQ ID NO: 32114 - DNA, 110 bp, Chlorella protothecoides
gaggtgcgatcgggggattgaggttgacttatgacagtagggccgcagggtgaacagaggtgaatggcgtcacccagaatgatggccagcactgaggcggaggatcgctg

SEQ ID NO: 32115 - DNA, 79 bp, Chlorella protothecoides
atttcttggggcactctgcctccggtctcagtgattcaggtacgacccaactctgtcaatgtgcaacgtaacctacaga

SEQ ID NO: 32116 - DNA, 72 bp, Chlorella protothecoides
cctgttcccgctctgcaccgagtccacgcccccgtgcgacgtctatgaaacccgaccaacacactgcattcg

SEQ ID NO: 32117 - DNA, 185 bp, Chlorella protothecoides
gcccttacggggacggcaacgaggtggcaggtggtagaagtcgggtcgcgtggctctcgtttcaccggcctgcaatcaggacggctaggcatgtgcttggaagtgcccatacccggactgagtcgattgcgaggctgcagtgcgaccctgctggctgccggaggggctcttgcccctggggcctc

SEQ ID NO: 32118 - DNA, 265 bp, Chlorella protothecoides
ggggcttgtttccggccagtgctactgtttgtcatgttgtatagatcggcactcagagagggtgagccgcctctttggaacatggacacataaccctccatgctgagaatttctcccccccacccacccatccaacaatcccgcacaagcactctgctcacagccccccctattcccccaaataattttcaaaaggtctggcaggagtggcatcccagcgcgtctctggaggtcccatgcgcgggctccagggctctttacgcgc

SEQ ID NO: 32119 - DNA, 154 bp, Chlorella protothecoides
ccattggcgcccagtgctcggaccgcaggctgacgagcgcgttcatgggagcccggcgcgtcccgcttcgatcctttcacgcgcacgctcgcgcaaatgtgcgcccgctgacccagcctgccgtccccctgttcttccccccactcataatttt

SEQ ID NO: 32120 - DNA, 87 bp, Chlorella protothecoides
cattgacggagatcacaagccgtgggcatgtggcatccgctgtcactcacaccacttctgcacctcaagcacgagcaacccttttca

SEQ ID NO: 32121 - DNA, 150 bp, Chlorella protothecoides
cttccacctcgcaggcgagcggcattggcccggggatcgacttgtttctcagcgttcctcgaagagtggatcaagcagggggtacagtgcacccctcggggctgtggggatggaaggcgcagctcatcgagcggaagggcaaggaatgct

SEQ ID NO: 32122 - DNA, 91 bp, Chlorella protothecoides
aaggaggtgctggccactcccgcagagtgaactggatgcgcacgggtgcgggggcaagggcgggcggcggccccctgctggatgccgcggc

SEQ ID NO: 32123 - DNA, 487 bp, Chlorella protothecoides
  modified_base (297)..(383): a, c, t, g, unknown or other
ggagggcggcggcgacctggacgcgctgcgcgcgctgggcggcgtcggcgcgccgggcggggcgggcggcggcggcgtggaggactatgacgaggaggaggaggaggggggcgagggcgacggcagcctggccagcaccccctccggctcggggtctgagctggacaggcgcgtgggcctgggcgacaccgccgcacaccccgccgccccgctcacggccgaggtgctgtttgccgcggctcgcgacgccgctggggaggaccgcagcgcggtcgctctcgacgcttcgacctcccnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtacggcgtcgtcgccggcgccctcgccgcgccggcgcacccacagcaccaacagcctgggccgcggcgggtggctgaagaacgcgggcgcgcgcgcggcg

SEQ ID NO: 32124 - DNA, 61 bp, Chlorella protothecoides
ggcaggtgtggtgaaagtagtggatgtggctcgcctcgagaccagcaaagccggtaagaag

SEQ ID NO: 32125 - DNA, 147 bp, Chlorella protothecoides
cgccattatgatttcattccgagcttgatggtttgtacgacattgccagtggtacgtacatccgagtgccactcggctgggccatgcaatttgacggagcgtccccgtgctctccgttttcagggcgcgaggtctgggcctgcagcg

SEQ ID NO: 32126 - DNA, 73 bp, Chlorella protothecoides
atgcagagcgtgcctgagcatagtagcagtcaaaatcgatgtgtaggatcacacggctgtggttggctgggtg

SEQ ID NO: 32127 - DNA, 70 bp, Chlorella protothecoides
gggtgcgcttgccgctggtcttcggggcgtggggggggggcgaagggtcgaaacctgtcgggtaagaaag

SEQ ID NO: 32128 - DNA, 68 bp, Chlorella protothecoides
cacagggacagggcaatccaatggcaagattggccctaccccccgtctctgaggcgcaggtcgatcaa

SEQ ID NO: 32129 - DNA, 75 bp, Chlorella protothecoides
cacgggcagagctggggcggagtctcggccctgaccccatccttcaaggaagcgtggggcatttcccgccacgat

SEQ ID NO: 32130 - DNA, 72 bp, Chlorella protothecoides
tcgtctgcccacatgtaggcaccccaggccctccaccaaccttggcaaccgagggtgctctcagcgcctcca

SEQ ID NO: 32131 - DNA, 61 bp, Chlorella protothecoides
ccccgtcgtccaggaacgagtcctcctgcagctccagcgaatcctcgcccgcgcccagggc

SEQ ID NO: 32132 - DNA, 61 bp, Chlorella protothecoides
atgaacagagccgccacgcatgaatgggggccgcatggatggacgtgcatggacatgaaca

SEQ ID NO: 32133 - DNA, 89 bp, Chlorella protothecoides
caggagcaggtggactggatcgtcgaactctgccggtgcatgccgaagaggccgaagtggggtctgtgggaacatcatccgcacctctg

SEQ ID NO: 32134 - DNA, 72 bp, Chlorella protothecoides
ctcaccactcacatctgggcggtttgcctcgtgttgcgacgactcgcccgcctgcccttgtggcgcgctctc

SEQ ID NO: 32135 - DNA, 71 bp, Chlorella protothecoides
ccccgagcgcatgcagcaaggcagtgcacagcagctcgtggatgttctgggacatgccgggtctccttgtg

SEQ ID NO: 32136 - DNA, 76 bp, Chlorella protothecoides
aatcccaccaatccgatcgtaccctgctgtgccagatcgggtcatgaaccaaatgtgccttacatcgccgcaggag

SEQ ID NO: 32137 - DNA, 90 bp, Chlorella protothecoides
ccctcccccacccctgccaacctagacacaacgcacacaattccctcaaccctccgatcacctcttcaccccctcgccatacctggaggt

SEQ ID NO: 32138 - DNA, 127 bp, Chlorella protothecoides
cggtgagatgatcgcaccgacttgctgatgcgcagagttgtcccaagatgcccccctctgattatcttgttgtgatcagtcttcaagccatccattgatgcaggcgtacgttttgagcccaccacgt

SEQ ID NO: 32139 - DNA, 61 bp, Chlorella protothecoides
aggccgccgggatctggacccagatcgagtaatgtacggcctcctcgccgcaaatgtgggg

SEQ ID NO: 32140 - DNA, 61 bp, Chlorella protothecoides
gtggggagtgttgcatcctagcggctgggggagcatctgatgaagggggtgacccctggca

SEQ ID NO: 32141 - DNA, 67 bp, Chlorella protothecoides
tcgccctgcccccacctccaagcccccatccagccccgccgccacagaccggcgcattctggtcatc

SEQ ID NO: 32142 - DNA, 77 bp, Chlorella protothecoides
gacgacgcgcggcagggccgatgcatcacctagcaatatgtcctggaagattgacaaacctttggttcctgtggctg

SEQ ID NO: 32143 - DNA, 61 bp, Chlorella protothecoides
agattgacaaacctttggttcctgtggctggtctctgcaccggcgatgcggtgctctcctt

SEQ ID NO: 32144 - DNA, 67 bp, Chlorella protothecoides
aagaaggtcgcacgcggcatgtctgcgcgggtttgggggggcagagtgtcccagaccggcgtgagca

SEQ ID NO: 32145 - DNA, 233 bp, Chlorella protothecoides
accaactcagcacctgagcagtgccatgacaatggtgaagggtgggtggggtgggataggagggtttgggaatttgggcaccagacgtccctctatggcacgattgcattgatagcatgggcacatccccccaatctagaaggctgatatatccatcagcgcaccttgccagaagccaggtcatacacggtaccatccagccgtacctcaacagcaggcttgcctttcaccta

SEQ ID NO: 32146 - DNA, 132 bp, Chlorella protothecoides
cggggaggtgaggcgtggggaacaaagtttggggggccctccgggcaagagcggcgtctgcatagtttcccgcgccccctcggtaaactcctgagcaccctgctcctccgccacccagtgtcctgttcccac

SEQ ID NO: 32147 - DNA, 64 bp, Chlorella protothecoides
aacatcctcgcatgagttcgtggtggtatacctctgcttgaatgctctctttttgtccttggcg

SEQ ID NO: 32148 - DNA, 62 bp, Chlorella protothecoides
tgcttgaatgctctctttttgtccttggcgtgcaggttgctggagatcccaggcgcccgaac

SEQ ID NO: 32149 - DNA, 76 bp, Chlorella protothecoides
acaggctgctcgccgccaagggtgactctgcgctcgcaattgagcatgtggcaaggagcgcccgtctgaagcatgg

SEQ ID NO: 32150 - DNA, 103 bp, Chlorella protothecoides
gaggagtggtggctgcgtctcagggtctggatcctgatccagcaccgcctcccaccgcaagcccagcccaccaaggcactacagaccaaaatcattcccagcg

SEQ ID NO: 32151 - DNA, 72 bp, Chlorella protothecoides
acaaagatcgatgcagcatagggatttgttccatgggaatgtttgccttgtcaactgctgtagcagaagatg

SEQ ID NO: 32152 - DNA, 61 bp, Chlorella protothecoides
cagcgtctgcctcgccgactgcccgtctcgggcagccagctgctccggggcctgccacccc

SEQ ID NO: 32153 - DNA, 133 bp, Chlorella protothecoides
cattctctggatgggactgagatgattctgaagaaatgctgctcgacttatttggaagaacagcacctgacgcatgctttgaggctgctgtggctgggatgtgctgtatttgtcagcattgagcatctacggg

SEQ ID NO: 32154 - DNA, 84 bp, Chlorella protothecoides
acaccagtgtggccgaccacttggccttccggcaacaccacccaaatctgcaccccagagggattactcgagcaccaacaagga

SEQ ID NO: 32155 - DNA, 70 bp, Chlorella protothecoides
ggggaagggggcgtcgtcgctggtccccctcgttgcgcgttgcaatctcaagccaggcaccctggactgc

SEQ ID NO: 32156 - DNA, 71 bp, Chlorella protothecoides
gtctggccttattctcatgcagaaactacctcccccctcgtagaccctgcatcgcctgctgagcgtctgga

SEQ ID NO: 32157 - DNA, 139 bp, Chlorella protothecoides
ctgtgagcagccttaacgctgcattcttttcgagttttcagaatacatgatctcgcttgagttcctctgtcagttacccctgctccatgttcgagtcttggaaatggcaaggaagcttgctctccattctccatccctc

SEQ ID NO: 32158 - DNA, 65 bp, Chlorella protothecoides
ggctatattacatcaggcgcttcatgcaagggggaggagggggagggggggcgaggaggtaagat

SEQ ID NO: 32159 - DNA, 62 bp, Chlorella protothecoides
acacacacacacacacacacacacactcttcccaggctgctgtggttcaagcgtcgcctgcc

SEQ ID NO: 32160 - DNA, 61 bp, Chlorella protothecoides
cagtccttaccatagaatactgatacccccaccccccccccaacacacacacacacacacc

SEQ ID NO: 32161 - DNA, 167 bp, Chlorella protothecoides
gccgcctggccgtcccccagcgcaccctcgtcgcgccccgatgaggcctgctgagggaaccctctgggtgtgtgtgtggcgctttccttcccctcctgcacagctatgcacacaactggtgtacaatttgagagcgtaggtgcagaaactgcaggccagacagccct

SEQ ID NO: 32162 - DNA, 108 bp, Chlorella protothecoides
tccattccatgctgggctgagcatggctccgtccaggttttggttcccatggatttgggagaacacggcctgctccacctcctggctccacccgccctcgcacctcca

SEQ ID NO: 32163 - DNA, 107 bp, Chlorella protothecoides
tggccacccagtactcagcccgtgtaacaatccacgggacggcgcaggggtttgaggcaggcgggctggtgaaccctgggcacgggggaggggcatccttgatgact

SEQ ID NO: 32164 - DNA, 61 bp, Chlorella protothecoides
gtcttcgctcccaaggtcgacgcgctgggcacgctgcgcgcagcggcggggccgggcgtct

SEQ ID NO: 32165 - DNA, 103 bp, Chlorella protothecoides
tgtatgagtccagctccaccagcagcctgcggcatcagcagggaatgcccgtgccgggcccacaaaacagacattccacctggccgtctgccgtgcatcatca

SEQ ID NO: 32166 - DNA, 75 bp, Chlorella protothecoides
ccaccagcgcccggggccggccagggcgaaagggcacgagcgcctggggccggccagggcgaagggccaccagcg

SEQ ID NO: 32167 - DNA, 95 bp, Chlorella protothecoides
acggccgccctccaccaggtccccccgcgcggagtaatggcattctgtactccactccaacttccaccactaccctgctcccaagcacgcaagcc

SEQ ID NO: 32168 - DNA, 95 bp, Chlorella protothecoides
gcgctgcagtgattggggctggagggggggagtttatggtgtgcggcagcggtggaccagggggacccccaggctcccccgccccccactgtgcc

SEQ ID NO: 32169 - DNA, 148 bp, Chlorella protothecoides
ccctaaccctaaccctaacccctaaccctacccccctaacctaaccctaaccctaaccctgccctaaccctgaaactaaaactaaaactaacccctaaaaaactaaacctaaccctaagccagccgtttctgtgtcattcatagttcc

SEQ ID NO: 32170 - DNA, 328 bp, Chlorella protothecoides
agacgagcggtgcaacggaagatgctacatccaatcctgagccatcctcgaggctccccttaccacccaataagactgggcgagtatctcaacttcgactcaggcagggcttgaggacggaaggagtctcaacattggccgctgatgatgggcactacatcactgtgtatgaagatgaaccgacatcatgtgtggcgtatgcgttatcaacaaggtacgtgataggataaatccacgcgtgccttgcaaggtgccaagtcacatgctgctggcctttatgaaccgctagcgtaccccaccctcacaagtagatgtgagattcatattt

SEQ ID NO: 32171 - DNA, 423 bp, Chlorella protothecoides
  modified_base (130)..(338): a, c, t, g, unknown or other
cgcgagcacggcggctggggtctcgctgccgccggagctgtacggcctgctggagcaccaggtgcggggctggccgtggtgttggggaacgagctgaattcagcatggccaaaaggtgccatgaccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccggaggtatgcggcgctgcaccaggcacatgtgaatctccacgctgtgtgcgctgcccaggctgcccaactggaggcccag

SEQ ID NO: 32172 - DNA, 61 bp, Chlorella protothecoides
cgctgaggccggactctgctgtcaacttgtcgccctggagtcattgccacagctcgaggtc

SEQ ID NO: 32173 - DNA, 72 bp, Chlorella protothecoides
cattgaggccactccctttgcccatcccatgtgcctcgaccttgcaccctcctaccccttgatacgccccct

SEQ ID NO: 32174 - DNA, 61 bp, Chlorella protothecoides
aggcggtatgagtgcctgtcaactgtaaccaagcaggggaggcgagcccggaggacagcca

SEQ ID NO: 32175 - DNA, 137 bp, Chlorella protothecoides
ctttgccacaccctgcccctctccaccggtgcgtccatgtctctgtctcctgcaattcccacctgccctcagtgatgccctccccgagacccgcgcccacatgtcccacccacccccggatgaccccaccaggggtc

SEQ ID NO: 32176 - DNA, 61 bp, Chlorella protothecoides
atgctcgtctcctgttgggtccggatgccgacctgacgctctccactccgatcactcccac

SEQ ID NO: 32177 - DNA, 61 bp, Chlorella protothecoides
gcctgcctgcacctcccacgccccaactccactccgaccccccttcccccactggacagat

SEQ ID NO: 32178 - DNA, 77 bp, Chlorella protothecoides
taccattgcgccccccacccccccactcccccaatcgaaaaaaaaaccctcactggagctgcgcagggactccgtcg

SEQ ID NO: 32179 - DNA, 61 bp, Chlorella protothecoides
ggtggctctggagatactcgatgcggcgggggcctgcctggcgcacccctcaccccacctc

SEQ ID NO: 32180 - DNA, 61 bp, Chlorella protothecoides
tgtcgtggccaacgtgaaggccgacttcgtgcaggaaggagtagatgagtgagtatggcgc

SEQ ID NO: 32181 - DNA, 73 bp, Chlorella protothecoides
gattgtactgctggagacagcatggacgagcacccaaatgagctgaactttgtcagggtccacaggaccaagg

SEQ ID NO: 32182 - DNA, 61 bp, Chlorella protothecoides
ggctgaatggcgtggcggaggacggatgggtggtggaaagtgtggagggatggggattgga

SEQ ID NO: 32183 - DNA, 78 bp, Chlorella protothecoides
gatcttgatggcagcagggccaaagatctgagggggggatgggcttttgtgcatcagcagggacactaccactctatc

SEQ ID NO: 32184 - DNA, 706 bp, Chlorella protothecoides
  modified_base (187)..(196): a, c, t, g, unknown or other
  modified_base (284)..(293): a, c, t, g, unknown or other
  modified_base (406)..(415): a, c, t, g, unknown or other
cgggcagcgcggcggggcgccagccgcgctgcgggcgcggggccgccagtgccgggtcggccgccagctcagcgccgaacgcggctgcgatgcactccgcagcccagtcggcccacacctcgaacgcctcctcggccatcgacctgaatatgttgtcgggggggtgggggggggggggggggggggnnnnnnnnnnggcccagtcggcccacacctcgaatgcctcctcggccatcgacctgaatatattgtcaaggggtggggtggggggggggatggcagtnnnnnnnnnntgtaagtccatcattgaacgcatgatccaaacgaggcacagagaccacgtgccctgctttctcgccgccgccccgcttctgaccagcccctccgaccgcagctcctcacccgnnnnnnnnnnggcaagtccatcatggaacgcatgatccaaacgaggcacagaggccacatgccctggtttctggccgccgccccgcttctggccagcccctccgaccgcagctcctcacccgagcttggcctggacggagcgcaggccctccacgtcggcctgagcgccccccgcgccgacccccggccccgcgccgtcctgcacgggcccaccgcggcgggtggccagcgcgccggccacgtggccgatgactaacgcagcgtgcacgtcgcgcccgccccgctcgcgaagccccgccag

SEQ ID NO: 32185 - DNA, 68 bp, Chlorella protothecoides
tgtcggcccaatcacgtggtgacgaccgagtgttgtggaacgaaacacagagactcgagcctcgagcc

SEQ ID NO: 32186 - DNA, 61 bp, Chlorella protothecoides
cagctcccccctggcctccagcacggtgtctagctcgcggagaaggtgctcgtcccacctc

SEQ ID NO: 32187 - DNA, 227 bp, Chlorella protothecoides
ctgcgccagcagtactaatcgatggggaggttcaggaggaagggcttgagggaactttcacctgacttttacggacattcattgcttgatgacaaagggaagaggccatctctgggcacccatgtaatggagccgatagaggaagagcgaggcgatgacagggcataggcgggttgtgtgcacccaccccacggccggggctgccagaggtccccagaaagcactgc

SEQ ID NO: 32188 - DNA, 73 bp, Chlorella protothecoides
gctggcgtatcgggagcgcatccgtgcagcagtcccgtctgcttccagcttccaacccctcatgacactctac

SEQ ID NO: 32189 - DNA, 61 bp, Chlorella protothecoides
cgccacgaagtcgtcgtgcgcggccgtggggcgcagcgtggccagcaggtaggcgtcgtcc

SEQ ID NO: 32190 - DNA, 62 bp, Chlorella protothecoides
tcgtcggtggaggcgacgctctgcgcaaagagggcaatgggagcctcgggtgaggatgtgac

SEQ ID NO: 32191 - DNA, 80 bp, Chlorella protothecoides
tgcaatcacaccacccgtcgctccgccctgatccacgttaaaaatgacaaccccctaaagccgactctggcgaaccccca

SEQ ID NO: 32192 - DNA, 69 bp, Chlorella protothecoides
caaccgcgatgtgaacggggcggccaacatcctgatgctaaccaagtgcttttttgagaatgcacttcg

SEQ ID NO: 32193 - DNA, 64 bp, Chlorella protothecoides
gtgatgttcgagggatcgcaaggattctgcgacaagaattggaggttcaacctccttgcatgca

SEQ ID NO: 32194 - DNA, 88 bp, Chlorella protothecoides
atgagatcgaggaggtgggtgggtgggtgggtggttgaatatgctcccagatcaaatagcccagggtgtgcacctgtgctctcagtga

SEQ ID NO: 32195 - DNA, 1233 bp, Chlorella protothecoides
  modified_base (232)..(247): a, c, t, g, unknown or other
  modified_base (650)..(691): a, c, t, g, unknown or other
cgcggcgccggcggccgaccgctcctccacccagcgcctgaacttggcgctgcgggcgtcgcgcgcgtctgccgtgcccgacttggacccccgacgcggcgtgcggtagaagcagtcctccgtgcccagcacgtatgccacctgacatgatggtgaggtggtcgggcgtgggggggtcaggaatggtggggtcgctttgtcggtgagggcatgggtgaggatcgtccccaannnnnnnnnnnnnnnnatgatcgggcgtggggggatcaggaatggtggggtcgctttgttggtgagggcatgggtgaggatcgtccccaagagaggacaggaagttactgaatggagccacagggcatggccctggctccaaaagccacctcgagggcagagctgaggagcactgcctccacccctcttccaatccatgcagcgtccacacccccctcgactttgatcccggcgatctctcccacacatgccccccccttcgacgcccccagcctgtcctttgccctcaagcacaggccagggccccccccccagaacagagcagagcctcgccttcttcttctgctgcgccacgcagcacagcttgcactccaggccgttgaccaggacggacgggggcagggcgggctccgccgccnnnnnnnnnnnnnnnnnnnnnnnnnnnnnnnnnnnnnnnnnncgcgccccccgcggccaggctgcgcgccaggcagacgcggacgggcgcgtcggcgccggccgcgccgtgcacgtagccctccacgtactcgcggaaggctgggtcgagcacgcccaggggcacctccaggcggtcggcgtccaggaggtgcacgcgcacggcgcgagtgcccgcctccacctccacgcggaaggcgggctcgtcgtgcacgagcacgcgcgcgttggcgtggtacaccgcgtcggcggtgggcaggccgcgcgcgcactcgtagcgccagagctccaccagcttgcccgccagctcgtcggcggccaccagcgcggcctggcgcaccgccttggccaccaccttgtccagcgtgaagagctggtaggagttggtgcccagcagcgcgcgcgtcgcgtcctcgtacgcgcccggctccagccgaccttccaccagctggcgcgccaggtccaggtaccgcgcgtgcagcgcggcggcggccggcgtccaggccgcgccgcccgggtgcgggcccgccggccccaccgcaaagg

SEQ ID NO: 32196 - DNA, 129 bp, Chlorella protothecoides
gacgtcagcatcgataccaagcactacctggccccccctcccgacggcaccaagggtgacgagggcaagcgctggtgagtgggggacggattttctcgatttcctgcgccgtcctgctgcctgtgcagc

SEQ ID NO: 32197 - DNA, 107 bp, Chlorella protothecoides
tggggaaggctgtcttcctttactttagcttggtcatggatcttgttttctggatgatcacaaagactgaaatcaaacgccacctttgtacacacatgatgcaaggc

SEQ ID NO: 32198 - DNA, 79 bp, Chlorella protothecoides
cgggctcgccaagccatggatggcggtgccaagggatgggggggctgattgcactgactgcacgtgcaaagctgcaaac

SEQ ID NO: 32199 - DNA, 145 bp, Chlorella protothecoides
ggcttgccatagtgaccgcagcctggcctgcgccacaacgggcacaggggaaaacacgtggggaacatgtgggccctgcaaaattccgatcccgttccccctgctccgcgctttcctcaccctgtccccgctccccgtgctccgc

SEQ ID NO: 32200 - DNA, 103 bp, Chlorella protothecoides
gcttccttgtggacgcttgcagaagtctggggtgcctcgagccccctatgctgctgcccgcgctggagggcccgcctcctccaagttgccctgccaagccttg

SEQ ID NO: 32201 - DNA, 138 bp, Chlorella protothecoides
agctccgcggggagcgggcaggcctgcgtgcagaggcgcgcaccgggcgcggcggtttcttcctttgccgccccctcgccgccttcccgaggcctgcggggggagccggtcgcgtcatgggtcgcgccatggcccgtg

SEQ ID NO: 32202 - DNA, 61 bp, Chlorella protothecoides
ctgaggacctggggtgtgccgaagaagactgcggatttgcgagactgcgatgcagcagaat

SEQ ID NO: 32203 - DNA, 63 bp, Chlorella protothecoides
tgagaatgagactcaggcccccgacacagccatgccaaaggtaatcaaatatacgatgacacc

SEQ ID NO: 32204 - DNA, 77 bp, Chlorella protothecoides
cgctgccccggcagacctggcattaggggtaaggtggggggggggatgtttaaagaggaatgcgcagagcagcacac

SEQ ID NO: 32205 - DNA, 91 bp, Chlorella protothecoides
acgccatggcagcgccagacaggtggggttttgagggagcgaggggaataggtgggaggcaggacaatcgggtgacgatgtgcgcggcaga

SEQ ID NO: 32206 - DNA, 75 bp, Chlorella protothecoides
gatgtgctatacccatcgtcactgaccggtccacgctcttcgatcgacatgtcacaggcgtgctggaagggattg

SEQ ID NO: 32207 - DNA, 61 bp, Chlorella protothecoides
gtgatgccggtccgcgatgaactcgttgtacaccacggtggcctgcacccggctgaagggg

SEQ ID NO: 32208 - DNA, 100 bp, Chlorella protothecoides
tgggctctgacggccacctcgcaggtatgcgtaggagaggggtgcgcctggtatagtgctgatctggagaggccacactcctcggcaccagcatccactc

SEQ ID NO: 32209 - DNA, 61 bp, Chlorella protothecoides
gagcatgcgggattcaatgttgtggcaggggagcagttccatgcagcacatggcgaggaca

SEQ ID NO: 32210 - DNA, 61 bp, Chlorella protothecoides
gctggccttgcccatgtctggaaggccgtgaacgtcagatcactgagttcagttcccttga

SEQ ID NO: 32211 - DNA, 61 bp, Chlorella protothecoides
ccctgcatcgatgagccgcagccggcctgatcctccaccccctcccacccaagacctccgg

SEQ ID NO: 32212 - DNA, 153 bp, Chlorella protothecoides
gtgagagcactggtgtctcctctcctggctcagcttcctggctgatgccgccccaccatcggccctcccacccacaccccccaacccagaactccaagcacctgctccgcggcagcactggtgaaggtgggcggccccagccgcgtcacgacg

SEQ ID NO: 32213 - DNA, 72 bp, Chlorella protothecoides
gcactgcatgactgcaaggtttcagagagggcaataaatgatcatcgatgcaggaggcgaactacgtcgaga

SEQ ID NO: 32214 - DNA, 61 bp, Chlorella protothecoides
gggggggtcggcagtcacgcgacgaggagcacccccccccaagccagcctctcatgcgccg

SEQ ID NO: 32215 - DNA, 63 bp, Chlorella protothecoides
ccgtgtctacagccactgtactcccagcctgcaacccctggatccccttcccccatccaaccc

SEQ ID NO: 32216 - DNA, 66 bp, Chlorella protothecoides
cccgtgtgtagcgtactgaactcaatacaatatcagactgtattgcaaacttgtcgatcgatcgct

SEQ ID NO: 32217 - DNA, 94 bp, Chlorella protothecoides
tggaggggtgaggttggcagttgaggtcagtgcgatgaccgtttgtgaatgaagtgtctggtttcctagggtgtagaaaccttcttggacagag

SEQ ID NO: 32218 - DNA, 565 bp, Chlorella protothecoides
  modified_base (267)..(508): a, c, t, g, unknown or other
caggacagattgacaccgcaatggctgcaagagattttttgctccactgactcaccacactttgatgacctccatccctgacttgacgtcctcttcacactcacacctgactttaatacgacctttcccagttccaaacaactttcatagcaatgccaatgggcacctagagttaaccagaccttgacttgttctgtagatccatacctagctggatgtgcaatcaccgaggggggaaagcaccggggtgtgctttcacagaggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggtatctgcgtgcgagaggacataagaggcacaacgctcaccgaacacccccctc

SEQ ID NO: 32219 - DNA, 70 bp, Chlorella protothecoides
cagcgcctcgcttgctcgccccctccagcttacggcacagcaggacgatgagtcgctgcaggttgtacgt

SEQ ID NO: 32220 - DNA, 111 bp, Chlorella protothecoides
ggggggggcggcccgttctccataccagggggcaaatcaaaagcatctgggttcaccccctgcaggcggttgaggacaatggtaccgcacttgccatcggctgtcacagtg

SEQ ID NO: 32221 - DNA, 61 bp, Chlorella protothecoides
cacttgtgggttgtgagctcgctacggagcacccatgcacagcctgccacagacaatgtgc

SEQ ID NO: 32222 - DNA, 73 bp, Chlorella protothecoides
gccccatgtttggtgaggaggggcggcagatgtgttcatgtcataggattccagagcagggggtgcatgccgc

SEQ ID NO: 32223 - DNA, 743 bp, Chlorella protothecoides
  modified_base (122)..(270): a, c, t, g, unknown or other
gtggacggcgaaggcggcgaggccggtcgccccgacgccgtgcccgacgagtgcgggctgcgcggcgcggtggctgaggcgcgggccgggctggacgcggcgctggcgcgcaaggccgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggagggcgcggtggggagcatggagcccagaccgagccgggaaactgccgacctgcagtgcccttgtgatgggcctggagcttcgatcaggttgccggggcccccacaagcccacttcatcccctcaaccccccctcctcctcctccccttcccgcaggctgacggaggaggtggaggccgcgcacgcagctttcgacgccgtcatggcggccaagctggcagagtcgacggggtcagaggggggccagggcggcggcacccccgccgacttcaagaggtgcgcggtgtgctgtgatctgcgggactgcgccgtgtggtggagggagggagtgcgggagggcggttggggggaggagtttgtgcccgtgccggggctgctgggcgggggagggggtccgggagtttcggaaggcgatgcgccctcagatccaggctggacagcatgcctgcccctgtacgcccgccccccc

SEQ ID NO: 32224 - DNA, 78 bp, Chlorella protothecoides
aggctggagcggcgaggggtacctgttgacgaagaggctttgtcaaaggcccgtccaggcatgcaggccgctgccctt

SEQ ID NO: 32225 - DNA, 75 bp, Chlorella protothecoides
accttgtgagcgatgccagccgactccaggcatgttgcagtcctcaggagctgtgcttcgtttggcacctggagc

SEQ ID NO: 32226 - DNA, 75 bp, Chlorella protothecoides
tccgattcaccaatgtcagcctggtcctcatggtgaggacgaggagcagggtgtctttggatgcggaacagcatg

SEQ ID NO: 32227 - DNA, 61 bp, Chlorella protothecoides
atgggtggagccacctctgtgtggcatgggacctggagcgttcagccccatggggcgtccc

SEQ ID NO: 32228 - DNA, 61 bp, Chlorella protothecoides
gctccaccagccctcccacgacatgttcctagccctggacaccgcgctgctcatgagccac

SEQ ID NO: 32229 - DNA, 61 bp, Chlorella protothecoides
gatggaggcgcaggaagcagagagcagcggagcgatggaggcgcaggaaggggagggcagc

SEQ ID NO: 32230 - DNA, 62 bp, Chlorella protothecoides
gtcccgcctgcagatgtgtgtataggggggtggtggtatggggtgagtcatgttgtaggagc

SEQ ID NO: 32231 - DNA, 71 bp, Chlorella protothecoides
cgatgcagtggccagaatggagatgttcagagtgagtttagatgtcttcgggatcagccccatcccatgcg

SEQ ID NO: 32232 - DNA, 100 bp, Chlorella protothecoides
cacttcctccccaaatggaagccgccacaccatgccctctctgaagccctgcagaccctcagccatcccacaacattccctgcccctcactccctcgcag

SEQ ID NO: 32233 - DNA, 80 bp, Chlorella protothecoides
gttcctgcaccaagcgtgtcaccacaacccccgttcaatgcacatcccttgcagccggcaaccccgctcagctcatgagc

SEQ ID NO: 32234 - DNA, 96 bp, Chlorella protothecoides
gggggcaagcacctgaatggtaccacttcttgggccagcgaggattgacccgtcttgtcaaccccccactgcccatccagggtgggagcagcggga

SEQ ID NO: 32235 - DNA, 61 bp, Chlorella protothecoides
acagcccttcaaggacaccaaggagacacctgacaaggagtttggctggtcgccgcagcgt

SEQ ID NO: 32236 - DNA, 114 bp, Chlorella protothecoides
ggaggtcggggtggcggtggcggcagactctgcaacccctgccgccggtgcagcgacggatgggggcttggcgatgcgcagggagtgggagggcccgccgtagggcgaccccgg

SEQ ID NO: 32237 - DNA, 164 bp, Chlorella protothecoides
ccaggacaagatgggctccatcatccccgttgagatcaccgtgtacaaggtatgcggctgcgtttacaaagggtgggggaggggacgcattggcttgagtcaggcatgcggcgtcggcgggatcatgctgcattgtgacagccagaggggatcaggacccatcg

SEQ ID NO: 32238 - DNA, 61 bp, Chlorella protothecoides
ctccgggctggtgacacactcctacggcgggctcccttgtgcctctgcaccaagtcgaggg

SEQ ID NO: 32239 - DNA, 3058 bp, Chlorella protothecoides
  modified_base (436)..(445): a, c, t, g, unknown or other
  modified_base (2158)..(2167): a, c, t, g, unknown or other
cggcactagcgcggccgccgcggagggcgggatggcgcgcacgcgcggcgccgaggcggcgccgggcgaggcgcgccactcgtacgcgtgcaggcgggtgccggaggacccggcgtcgatcaccagcacgtagcgcggcgcaggtggggagcggagccagaggaggagcccgccgcccgccagctgggaagggtgcggtgcggagggagggggttggagccggggtggttgggtgggtgggcggacagccgctgaacatgaaacaggcccccaatggccatgcgctcgctctcaccagcagggccagcagtcccaggagcaggactctagggaagctccgtggagcgggagctgcgccggccaggcccatctgctcggaggcgtgggagtgcagccagggggtcgtacatgcaaccaccaccgaactcgggcaccnnnnnnnnnncggagtgcagccagggggtcttacatgcaaccaccaccgaactcgggcaccttcccatgcgcatacgccatgcacagctcacctgggagggcgctttcctcaaccttggagccttgggtcctgggctcgcgctccacatggcctcggggtgggaccccgcgtggacacgcgagagaactcacatgcgcctgctcgtccgcattccctcagcacggcatactgtacattcaggtgataaactcctaacaaacctaaaggatagccaattggtacagtgttcgtcacgggtgccccaactgcggaagtatgcagggagagtgtcgaggatgtttggcgcgcggaggagcgtgggtttaaaccaatctgctgacttcaaaatgttaacatctgccgtcaacgaggaacgcgcgcgtgcggttgagcagcagcaatcaatcctcaacataaagcagtggaacctacctccggcgtttcaaacgccctcattgcgttgtcgcgggccgtcatccccgaccttgcttattccgggcagggtgggcgaatggcgacagcagcacttgagaggcatgccaatcaatcgacgctggatgctgatgatacgatgactccaaacgatgccgagaaccctcacaacgaggcggcgatggacaagagcgcagggcaggacctccagagtcttttcgccgaaggcatcgcctgcatcgcgacccaaaagtacgatctgggagcagagtgcgcattgtctgtggaatccaatcgctccgtatatgcacgcataatgaatgtagctaagtaaggaagggcgagaggaccgtacaactggacatttggggcactgatgcgccactttcccacctgtgccttgcaggaatgacaacctctttcaagacttggagacccggacgctcaccactagagagcaggatatcataagccagagggtgggtgaaaacggccttgcattgttgccttgtctttggggtggctgtgcagagctgcacttggcacctgatcttgccccaggaggatgcaccattactacctcgtcacaggttgctctccagaggcggctctttgaggagtacgaaaagcgtgagatggttcgcaagatccaggaactgagagaggtgtgccctcagatcagcgaggctgctgcggctagggctctagagctctgcaatggcaggtgtggcaaaagtggacaagatcatggtaccagctcatgcggaatcaattctgatggctgccatcacagaccccatcccttgtgctccccatctttcccaccttcactcactcaccccccctcattacgcagcgaggatgaagcggcagcagagctcgtgggcaaccccgcctttaggagtcgagtgatgggtcccgcgcacggaaactctgctcccagcacagcaggccagaagagccaacagccctgggcagccaaaccagatcctgctgtgcggccaaagcttgtagatccaggctccctcaaccactcggtgggtggggcatggtggcgcaagaccatacgcagaacacaagcctgctgaggggggatggcctcctcgcggtgaggaatcttgtatgctaggcaacttttttgtaatgaccaaggactgtgttcgccatgccttccccacctactatttaagggaccttctggtcaccgatgcgctttcctgtgtcctcctctgcaggttttcgtgggagcannnnnnnnnnagggaatggcctcctcgcggtgaggaatcttgtctgctaagcaacttccttgtaatgaccaaggactgtgttcgtcatgccttccccacctactaggtaagggatcttctggtcaccgatgcgctatcctatgtcctcctctgcaggttttcgtgggagcattccggggcaagggctacccatcagccgggcctggatgcaaaacgacgctgagcacgctctgggctcgctcacttgcagcgacggtccccagcaccggcgacgtctctgatccagagggaaaccggggcgctttgcaggacgggtctgcgggcggggaggatgctgcagacagcgacgccaccgtcagtgacggggagggtgaggccacggccgtccaggccacagacggcagcacggcactggatgccgggaacatcacccccatgccccaagcaccaggtcagtttatttggggcggagggggagatccttggtgtttgccagggttggacttgataacggcgatccgcgttgcgtctcgacggccttgagtccccagatggcccaccaccatccgcctcccgtcgcccacccagcagcccacgacgctggagcgagcggaaacctggttgacgagggagccgacggcgcactgcggtaccggctggccgtggagagccacggcaagctgagggctgcccgagactccgagctgaaggcggcccggcatggttcgtcgggtgtgagccagtgcgatgcggtgcagagcggcccagagcccatgccgagtccagtacaaggagttgcagagcgtcgtgactcaggtctggcgcgggaaccaagtcccgcagcgtcgcgggacgccggcggtgcggctggcgcggccggcgacggccccgaggcggcgcc

SEQ ID NO: 32240 - DNA, 61 bp, Chlorella protothecoides
gctctcaagacgacgggtagcgcaaacccttaagatgtcgacgcggccggatcccgtccac

SEQ ID NO: 32241 - DNA, 61 bp, Chlorella protothecoides
caatctggtggagatcatggcccctatcttcgacatggacttcttcgacgagctcgtgagg

SEQ ID NO: 32242 - DNA, 61 bp, Chlorella protothecoides
aggcccgaactcccgcgcagggccggctgcatgcttgcaacgccccccaaaaggtgaatgc

SEQ ID NO: 32243 - DNA, 82 bp, Chlorella protothecoides
gcacacaggcctgccagcctcctggatgcgcctcgcctgattagggaagcccgatcaggccacaccgatgtacctcagcaag

SEQ ID NO: 32244 - DNA, 115 bp, Chlorella protothecoides
tataccactgccaaaacctgcttgcacatctcgtcccgtctcttctccagtttgatggtgtggatacaacagctgcgccgagccgcaccgaggagcctgagccgttgggggaggt

SEQ ID NO: 32245 - DNA, 5783 bp, Chlorella protothecoides
  modified_base (3741)..(3817): a, c, t, g, unknown or other
  modified_base (4279)..(4392): a, c, t, g, unknown or other
  modified_base (4739)..(4750): a, c, t, g, unknown or other
  modified_base (5322)..(5445): a, c, t, g, unknown or other
agggaggaggaggggagtgcggatggggagggtgaggggagggcggaggaggggagggcggatgtgtgggagggggagggaagcgtggaatgggagtgagaggggagggcggagggaaggacggaggtgaggagggcagtggaggcgagggcatagaagaggagggcggtggggggggaggaggagaaggcggaggaggagagggcggaggaggaggcggaggaggagaaggcggagggggagagggaggaggtgaaggcggacgagggggggagggagatggaggttgtgatcttgtatctagtaacggaggatgcctcttcttgggggatggaggaggtaactccttgtagggagggggaggcatccccttgggggagggaagaggtatcttcttgggggggagaagagttgtcttcttgggggaaggaggaggcatgtttttgggggaaggaggaggcagctttttggaggaaggaggaggcatcccattgtggggaggaggagccaccttatggggggaaggggacgctctcttggatggaggagggggcagtttgtagttcatacgggcatatttgcgaatgtccttgaggttgcatgtacctacacccttttgagtccctgttgcatcgttgcaccttagattggtgcccttgttcctgtccccccaattgctgttgcccttgttgtagctccctacacattgagggaggtcacaaggcgtggatgagttgagattgtttggttcacaccactcttgcctgtcaagctccatcagccccttcaatccagagcaaagacattgcttcccgagccttgctcaccaatattgttgttgcccacattgttgttgccaaagttgttcttccccttgtttccggtaccaatgttgccattcttgtcagccgtgcacgccttctgtcccgtcttgaggcattcgacgctgaccatgatctcggtagaccgcgcctccaagaccttgaatggactcatcctgatggcgctgacttggagacctagggcttcgagagtggccttcctgacagaaccggccttgctgaactcttgggacctgcagaggttgataaagagaggccgatgctggatacgatacacctatactgaggatggctactacgtgtctggtccttttgactcacgccacacatatgcaaggcccaaacacatacttgcagaaggtatccgcgctgttgagctccagcatatagacgtgcggtccatacctgttggagatggtatggggggggggggggtgaggggtcggaacacacaaaccggaggccgcgtcacgcagagaagtccgggcatccagaagcaggtccgtacactcggttttagcaggcccagacgaccaccacccgagtatgctattcgcagcttacgtggctgccgggagtgagaaaaacttggaagggcatgcgccctgtgggagggggtgggaggcttgccagagtcacacggcggtgctcgcgtaaggcaccctcccatcccttcatcaacaaagatttatataatcagaatcctcagaacatacttttgtggttacagcgaggctaaagagaaggataaatccactccagaggggtgcccgcccgcgcgacagcatttggccgtatgcacccccccccggccgagctggaatgtccttgtctgccagagattgcaacggtaacaactgtgcgcgttacaggcttcttgaatagtaacttacccaatctccgcttttcccttggggagttattccatgtctggtatctggcggagcgtgaaccggccggatattcccttagggtcgaagcaggatgacgtcggcttttaagtcgctctgttaccgtcgactaccgcagtgtccataccagtcaaggacgcaaattccgcaacaggtccagcccagtttcgtgcaacagcttatttgcatcatgaataggctcttaagcttgcaaaaaatgcggacgtgcccaaacattggttctcctcagggatgtgaacaccatggccaacctggcggccgcggaggccccagtggagggccactaccatggaaaccccacaactcaagccagaatacccacagatcgcatcggtgaattcctgcgaggtgaggggggaagattcaggacaagattcaaccacaccacccatcctgccaccaaagctagaaggtgaaatggcacccaacggatgcccgctgtgagacattccccgctcggttctcctcctcgcactcatctgagctcctcaccacagacaggactggctttccatcaaggaatatacctgcgtccgaggtccgggcaaacctgagtgggtggagaaagacacgccagacagcgtgagggcaagactagcaagaatcgtcgctgctctcacaagaccagctgcgagcaccacttctccatcgagcagcagaggtgggagccggaacagtccctcgtctcccaccacgccatcccgcactccggccgcgacagggacaccctgcagctcgtcgtgctgggcgaaagccctcgtgaagagaggctgccggagactgacgccgccttctccaacaccgacatctgcggatcgagcggctgcgatgcggcaagccggggtagactcggtgctgtaaactactcaattggacgacaggaccttcctctgatagttcccagatctgctccggaactttctgatctcggcgcaagacatcgcgcaagttgctcattgccgttactcaatattattgttgtgcactctcccgcgttccgagggcctcgtcctctgctctccccatcgcagcatcattcgccgggccaagcgatccaacccatggatgctgggcccagacgcagccacaggcctgatgaagacggtccaaacacggcgctcagagtttcccatcttcaagaacgatgacaacgagggattgacagaactcgtcgagttcaacaagaatcatcggcgcgcgactacgcgcatggcctccccgtgtggatcgacaagacgcacggcaccgacaatttcaacgtgcggaatcgatgggatgggcagcgatgcagtgcattgtgaggggaggatgtccctctgggattgggagtgatagcgattcaggggcaccctgcctccgctgtcgatagtccctgaacaatgttgttctgtcgatgtgcagcgtaacctacagactgtcaagagtacggcagttacaatgcaagtcggtgggtattcataccacgagggacaactgttgcgggtgttccccttgaccgggccctttccccaccttccacctgttcccgctctgcaccgagtccacgcctccttgcgacgcctatgaaacccgaccatcacactgcattcggggtctcgtctgtaacgttcctacttttgtaagtcatatacagcggtccaccgttgtggggtccagcccgcccccacaacagaaataggcgcacttctggaacaggacctcccttgataggccagggaagtggaaatttacaggatgaaggtccagggtgtcccgtccacgcccctgcgtcttgtcgctgtagaacgcaatggggaggaggacgagctgccgtgtagacgcaccatggtcaatcgtatggccctgatcgctccagtatcgtctcacttccttgtgcacaggacacaatgctgatgtgagctcatcaccatagggcaggcctactgatttctgtcattatgacggttctcaccaaggtttcctgggtnnnnnnnnnnnnnnnnnnnnnnnnnnnnnnnnnnnnnnnnnnnnnnnnnnnnnnnnnnnnnnnnnnnnnnnnnnnnngaattttatgatagccctgtccagcatgcttcccacctgcaatggcgggcgggcggtcatgtactgtgcgtgccctgccgccccattccaccccccctcccccccaagtccaccacacacacacacaaacacacacacacacactatctcccctcctttctctgttcctatcacttcaaaccgccccagtacttcccagtatgacaggcagaatgcagcagtgcacatttgaaaaagaatgtcaactcgcaagctctgctgggctgcgtcgccggatgccagcgtgcaacgcatgaccttaccccgccaatccgcagagcatgctcaatgatcttctcgacactctccacgtgtgaaacctgatactcgatgccatccttgaccaacaggctagtcgtcttgaatgtctgcgggggatggaacgaatcctctcaatgtgcaagggaaccccatgcggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccaagctaataatccttggccggggcccagtagaatggtacctctggaacaatctgatcaggaaggactgctctgcttgattcagtctcggtaggaccctgaagagagcggcatctgcccgtcatggcgctgttggatcatcattcttgaggtcggtggcaccgcgtgccccttgagcaccaagcagattcgaagggtctggacgcgagaggagctcgccggttgacaggtcccggtaactccaaggccggaagttaaggggtgcaacgtaatcgacctcatactcatcgtgagctgacgaatagtcgccgatcgggggggggggggggggggggcgcccccccnnnnnnnnnnnntgcacgggtcggtgccccacagcctcggtggactcacatcaggagggaaggtgccatcgtcctctgggagacagccgatatttaggccttgatcgatcgccccgcagtttgtaggggccgggaatagggcctccgaggctgctccgcctacttgaccgattgcgcaaggtgccgcaagggcccgggttctccgccgcctcagctcctccgcagcgctatgtcgccacccaagccgaaaggcgcggctgatgctgggcaaggagcactttgccacccgaatgtgcagatcacggcccctcctggttttccaaaccctgcgacaggcgcactcaaagcggccgggagagggtgggtgggtcatcaggtgcagtacaatcttcggccccaacttatgagcataggtatcgtccgcaagtctctgctgcagtctgcaggaattcaaaatgaatcgggcccatccacctgctcggtaccagaggtgagcaggtagtgcagttgcagatgtgaacggaaatccccggctgtcgcattcaaaattcacgctctgccctattacacttccgaaggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctggcgaacccccgccccaccccccctcacacgcgctctccctggccccttcccgttcccctcccggaaaacaacctgctagaacgcacactacctctataaaacgcagagggcgcgacaagacgcgggcctcctgaccagggcgaggggagctgacggcatgcgaagtcatcatcgtctggagcgcacacaagggcatgcagccggcagttcggaacatctcggcatcgtcgcaccaatgttgggcctcaggccgccttacgccgcgtcaagtagcgatgttgttaactggccacgacccgatgacaccgagatgccgggggagaactcgccaca

SEQ ID NO: 32246 - DNA, 61 bp, Chlorella protothecoides
tggcagcagggagagcatctcccatcccaattcaaagtctcacctctcagggtactcctgc

SEQ ID NO: 32247 - DNA, 111 bp, Chlorella protothecoides
acatctgcaggggccggcgcagcacctcaccggggtttcaaggacccagttgtcaacgccacccccctcctggctccaaaggggatgcccaggtctggggcgccacaaagc

SEQ ID NO: 32248 - DNA, 61 bp, Chlorella protothecoides
ctgaatcttggatgtggcctcagcggcacgtcacacagcagtacaggaaagaagcactgcc

SEQ ID NO: 32249 - DNA, 61 bp, Chlorella protothecoides
ctcggccaggcgcgcggcgtgcccgcgctcgaactcggcctccgccgccgccttggccgcc

SEQ ID NO: 32250 - DNA, 1317 bp, Chlorella protothecoides
  modified_base (369)..(378): a, c, t, g, unknown or other
gctggaggcgcgcctagccgacaccgagacccagtttgcacagttcagggaggatgcagccgccacgcacgaccttctgcgcgctgacgtgagcgggctttggttgttgtctgttgggcttggtgttttgtcctgtatccaggtggggagtggggtgtgggtgtgagcatgcaccatgaatttttaacacccgagatccaggaatcagatgcacatgaggatgaccgaagtgtcccagcgacggcgactgtgacgcagacgatgcacgctccgaagcccttcccttttccccccatccattcgccaacagttggcgagcacgcgggaagaagccagctcggcgcgcaccgcggcggccaaggcggcggnnnnnnnnnngtggttgttgttggtcgggcctagtgttctgttctgtacccaagtggggagtggggtgtgggtttgtgcatgcaccatgaattctgaacactcgagatcgaggaatcagatgcacatgaggatgactggagtgtcccggcgacggtgactgtgacgcagacgatgcacgctccaaagccctccccttttccccccatccattcgccaacagctggcgagcacgcgggaagaagccagcgcggcgcgcaccgcggcggccaaggcggcggcggaggccgagttcgagcgcgggcacgccgcgcgcctggccgagtcgctggagatgcagcgcgctcaggtcgaggacctgctggccggcaacgcgcgcacgcaggccgcgctgggcgaggccgagcgccggctgggcgaggcgcaggcggtcgccgacgaggccgtcggcaaggtgggcctgtgttttgtcggtgtgtctctggagggaggggggtcagatggtcggtgaggaaggagggagagggaatgctcaaggggcctggactgtcctgcgtcttctcacggggcagctcccaggccgccggcgtcgcagaagccgcctgccggggtggcgcgtttgatgcgccgtgctgctcgcccaggtccccagctgcagaacctggaggcttccatcttcacgcccattctctgcgccacacactccaagtacatcacctcacgccccccccaaactcccccctcactccgccgaccacagctgcgcgccgcgtcgattcgcgtggagtcgctggaggcggagcgcaagctcatcgcggccgccgaggcgcgggccagcgccgagctggcgacgctgtcccgcgacagcttccgcctggccgccgagctggagggcgcgcgcgcgcaggccgcggaccgcgagcgcgctctcgcgggcgaggccgaggccgc

SEQ ID NO: 32251 - DNA, 80 bp, Chlorella protothecoides
gcaaatgaggtgtcacccagagacacagcaaatggcttcactataattcatcgagcagcccaagtgctggagtgagtggt

SEQ ID NO: 32252 - DNA, 95 bp, Chlorella protothecoides
cgcgcccagctgaaaccgtgccgtgtggggaaccccgctgctgctgcgcacgtgctaagcagtgagagtgtgactaagtcagaagggaatatgtg

SEQ ID NO: 32253 - DNA, 61 bp, Chlorella protothecoides
aggacctggatggtgtgaggagggggggggtgggcgagctgtgtctagttgcgtgtagata

SEQ ID NO: 32254 - DNA, 64 bp, Chlorella protothecoides
cgctggaatctgctcatctacctgatgtgcaatccggaagtttcttccacgcagaggtcctcgc

SEQ ID NO: 32255 - DNA, 107 bp, Chlorella protothecoides
gtgccaggggagtcgagtggcatggcagaggcattgagaccgccgtgctcaggggaggcaacggtatcagcatgggtggcattgcggtgagaaccagggactgcaag

SEQ ID NO: 32256 - DNA, 61 bp, Chlorella protothecoides
ccgatcgtgcctgcggatctgactcgggggtgccatgcccccacccccctgcgcacgagct

SEQ ID NO: 32257 - DNA, 63 bp, Chlorella protothecoides
gactggtcatggagtccaaccccccccccccgtttcgcattccaccacatcctccatccccga

SEQ ID NO: 32258 - DNA, 61 bp, Chlorella protothecoides
ctcgctctcaacacagtactcgggaagcattgccgattgaggtgcctgcgccgcatgctgg

SEQ ID NO: 32259 - DNA, 134 bp, Chlorella protothecoides
atctcgaggcagtcctgcatcccgcaacgcctggcccagcacctgaattggtctaggaggtattgttatacgcagaggtacacccaagggtctgaggttttgtcaaggtggcatcacaggaaatatcaccgcag

SEQ ID NO: 32260 - DNA, 303 bp, Chlorella protothecoides
ggatgggggcggtggagtcttcttggatggcggcggtggagacttcttggacgggggcggtggagacttcttggatgggggcggtggagacttcttggatgggggcggtggagacttcttagtgggtgaggggggtggagacttcttggccgggggtggtgggaagctaaggacccatgcatacttgcggaactcaagaaggctacagtcgtttactatcttgcgggtaccagtcttgttgaagcagcgattgcccgtgcccttgttgttgtttccccagttggcagtgcccacattggagtt

SEQ ID NO: 32261 - DNA, 64 bp, Chlorella protothecoides
caacagctggcgcatcgtcaacaaccaggatgcagtgtgctcggtccctcgcctcatggggtag

SEQ ID NO: 32262 - DNA, 61 bp, Chlorella protothecoides
gcctaagaagttcccaccacagcatactatatggtgttattaaacaccacctgattggaat

SEQ ID NO: 32263 - DNA, 61 bp, Chlorella protothecoides
atacaacatctttctcatttggcttctgattaggcgaacctcgcaaatcacttccactcac

SEQ ID NO: 32264 - DNA, 124 bp, Chlorella protothecoides
tgggaggtgaagcctaccaacaggaatgttcctcaacagatgtggcttagggtgacggatgcaagcattctttgatacagttgcatggcttctcaccggcaccctactgccatcactgtggaca

SEQ ID NO: 32265 - DNA, 61 bp, Chlorella protothecoides
ccctgccgcccgcgctcaggcggacgacacattgaaccaggatcgcatgccctcgtcgtag

SEQ ID NO: 32266 - DNA, 120 bp, Chlorella protothecoides
ttcagagaatgtggagaagggcagggatgataggcacggaaccgtacttaggggtgaccgtcttggtgtttgacggcaacaaatactctgcaatatcacccaaatggaagatgatcggat

SEQ ID NO: 32267 - DNA, 79 bp, Chlorella protothecoides
gggcgacgcatgtcttctgggtgcctgcaaatcccccaccaccaatctgccccacccaacacccccctcctcccgggcc

SEQ ID NO: 32268 - DNA, 61 bp, Chlorella protothecoides
cgccctgcgttgccacagcacagctgagacactggatgcaggcagcccatgacagtctatc

SEQ ID NO: 32269 - DNA, 61 bp, Chlorella protothecoides
acgctctaccggctgagctatagcggaagggtgcggatcactccgccagacaggctcgaac

SEQ ID NO: 32270 - DNA, 138 bp, Chlorella protothecoides
tgcggggcagggcactgagcccctacacgccacaggaggctggctgggttcaccgaccctcttttcccagctgagtttcttttgctcatatcgaccagtgcatgaagaatacttgtacaaggtctgactggggacgtg

SEQ ID NO: 32271 - DNA, 61 bp, Chlorella protothecoides
ccagggaacccacctggtgggtggcatctctaggggatggacccccgtccgcccgatccat

SEQ ID NO: 32272 - DNA, 90 bp, Chlorella protothecoides
agcgtggaccaggtggcacccacgtcgcagccctcgccaccacccagccgagcgagcacggcttcgcgcagcgcggtggccaccaccagg

SEQ ID NO: 32273 - DNA, 4646 bp, Chlorella protothecoides
  modified_base (556)..(565): a, c, t, g, unknown or other
  modified_base (887)..(896): a, c, t, g, unknown or other
  modified_base (1115)..(1124): a, c, t, g, unknown or other
  modified_base (1331)..(1340): a, c, t, g, unknown or other
  modified_base (1736)..(1745): a, c, t, g, unknown or other
  modified_base (2623)..(2632): a, c, t, g, unknown or other
  modified_base (3195)..(3204): a, c, t, g, unknown or other
  modified_base (3403)..(3412): a, c, t, g, unknown or other
  modified_base (4269)..(4278): a, c, t, g, unknown or other
ccccccccctccttccactccccaggctccccccaacgcccctcgccccccttcgccaccaccacacacacgcacctccgtcctgggcccccgccttgcggttgttcagcttgcgcttgaggtcggggaggagcgccacacgcacgtcaggcttctccggccgtccctggttggtcagcacgcggcaggcgtcgcgctccacgcccacgatcacgcccaccgtggtcgcgtccaaggccaccaggtcgtgcagctcgtagccgccgatgctgcggcaagggattgatggagagggaggctgcttggtgggttgtcaagcggggagggagcttctggggtgtccgactttggggttcaagaagcagtcgaggcacggcctggcgtgactgtaaggctggcagggtattcgaacttcagcaaaagctcggcagagacccaaacttcatagggtagtctgaccccttcttcagaccaggacatcccaagccccaaagaggcgacccccgccccccaaaccaccccgctccgcacgtgtcgacgctgctggtgacggccnnnnnnnnnngagaggcaacccccgccccccaaactaccccgccccgcacgtgtcgacgctgctggtgacggccacagcctggaccaggtccttgacgaacacgcggatctcctggcgcgagacgtcggtgaagatggtggcaatggggccggtcaccgtcaccaccatccccgtctcgcccatgtgctgaccgtgctcgaccttgacatggctgccagactgcgcacagttggaggggattttgtgtgtggggggtggggaggtgatgaggtcggcgatgtggggggagacggtgaacagcgcggtgccttgcgagggacaacgaggtgtnnnnnnnnnngtggctgccagactgcgcgcagttgcagggggttttgtgtgtgtgggattgggagatgatgaggtcggcggtgtggggggagaaggtgaacgacgcggtgccttgcgagggacaacgaggtgtgctgaaccagctgccaccatgcctgagtggatcaggggacagggctttgcctgcccaacccccatccctccaccccagcgccacccggacccaagnnnnnnnnnnctctgaatggttcaggggtcagggctttgcccgcccaaccccctcccctccaccccagcgccacccggacccaagcagaggcccgtctgcagccaccggcgacgcaagagcgggccactccttgcccctccagcccttgcacacccacctcaaagtgtttctggatctcgcgcgggtgcaggccgatgagctcggtgaagccggggnnnnnnnnnnggtccttgcccctccagcccttgcacacccacttcaaagtgtttctggatctcgcgcggatgcaggccgatgagctcggtgaagccggggagcttggagtcggtgggcgcgaccatgagcagcccgtcctcgccaaaggcctctacgcggccccggatgcccgccaggtcgcctggaggatgagtgtgtggagtacggcaacaggtggagggggcgtggtgctgcacagatgctcgggctctggcccatcgggcacgggaaacatgctgggcgacgggcgcctaccctggggtgatgccctgccaggcatgccaagcagtaccccactcccgacggaacgatccagagctcctctccaccgcaatccccacgacaaagtgacaccccgtcaaccannnnnnnnnntggcaacaggtggaggggtcgtggtactacacagacgctcgggctctggcccaccgggcacgggaaacatggccggcgacgggcgcctaccctgggatgatgccctgccaggcatgcccagcagttaccccactcccgacggaaccatccagagctcctctccaccgcaacccccacgacaaagtgacaccccgtcaaccacccgggccccctttccccaccctgtacgacgaggacgaggtcgcccttggcaaagcgggtgggcgcggcaccgccctgcccctccccctcagtggtcagcgactgtacgaggccggcgaggtcggcggcgccggcgcggtcgcccgcgccgccgccaccgccgccaccgccgccctgcgccgcggcctggaagcgctggaggtcgtccagtgggggcaggccatcctccagggccaggcccttgaccgccacgctcttgatcaggtatccctcgctgaagcgctgggagccgttgagcacatgcaccagctggcccgtggtgcggtcgcgctgagtcagcacgtccagcgtcttgtactgccgagcctgttgttgttgttgttgttgttgtatttggggggggggtgatgtaatggatgaggggatggatgtttgggggagggttctgaggtgctggacaggtgcatggttgggtgtgatgatggcagctgcgggtcttgccccattctgctcttccgtcgcggtgcccccctgcctctgccaccctcgtcagggcggcacgctgcgcattcatgcagccacacagcctggtcctcgatatacccacaataccacgctgagccccctaccctcacatccccctcttcccagtctcacacacctcatcggggctgaannnnnnnnnnaccacacagcctggtccttgatatacccacaataccacgctgaaccccctaccctcacatccccctcttcccctttccccagtctcacacacctcatcggggctgaaggccttcgcggccggccgcacacgcggcgcgcggccaaagttggcacgcgcgtcctcgggccggcgcgcggagagggcggccaggtccaggcgcgggaccaggcgcagcgtggcgcgcgcgcccgaggcgtccaagtccaccacctgcgccaggtcgcccttgtacagcccggccttggcgcggacccaggagccgacgtccacgccgcgggccgcggtcacctgcaccgccaccgccgccgtcatctcgcccagggggaccatgcgcggcttcttggagttgaacacggcgcgcatgccccgcaccgcctccgccacgtgcgcctccttcaccgcctccacatacaggtagccctgggggtcgggaaaggggggaaggagggatgggcaggtgtctcctgctgatgaaggggtactggacaagcagacatgccgcggcagggtctcatgcgcacnnnnnnnnnntgggagaggggggaaaggaggaatgggcaggtgtctcctgctgatgaaagggtactggacaacaagacatgccgcggcagggtctcatgcgcacggcacacccgctgcatgtgcgggccgatggccggctgcgcgggcttgcacaccgcagccacacccaccttgaggtggtcctggcagaaggcagacttgatgagcnnnnnnnnnntgatggctggctgcgcgggcttgcgcaccgcagccacacccaccttgagatggtcctggcagaaggcagacttgatgagcagggagcgccccttttgcgccaggtcatagcacttttgcaggaggcctgcgggtggcatgagggagcggtcacacccagttcggacaccgagcgacgagtcactcgcgccctgtctgggtttcccagccctccaacccactccccttccgatctccaagacttacacacaacgacctcgcgctccgcgccctctgcacaccgcaccacccagagcttgggatccgaaggcttgggcagcagggcctgctgcgccaccgcgccaaagtcctccgtccccgccccgccagtgccggggtagtgtgactggccgccgtaccggtccttcaggtaggcctgcagctcctctggattcatctcctcgtccttggccgcctgcatctccgcctcgcgcctggtggtacagagcgaagaaagggagaatggtgtgggggttgccttgcatgcagttcaggcttcaggtgatggctggatgcacagcgctggggcgcactcgtcgatcatgtgaactatcgctccacagagggtgaggaagtcacccgcagcggagtccagcgcccatggcaccagacccccttcccagggggctcacatctggcggcgcatggcaatcatgtcagcggcgtcgtgcacgtgttcacccgcgtcgtcgatgaggtcatccaggccctcctcctgatgccggtgagggtgggaagagggtctggcgtgcgcacgtcatggccgaacaatgcacatgcggaccctagagagaccaggccggcaccgatgccacccannnnnnnnnntgcgtgcgcatgtcatggcccaacaatgcacatgcggaccctatgagagaccaggccggcaccgatgccacccacctccagctcgtcgtcctcgtcgtcgtcatccacctcggcaatgtcatcaatgaagcgactcctggggagggacgattcaatcaaggcggtggttgggtgaaggccatcactgcgcaccctacacccagcaccgcgccatgcctagctaggacttgactaatccaagtgcgatacaagtgagacccaacagacctcttctgtcgcctggaggcttcctcatcctgcgccagaccagtgggagcttgtcaaggaacgtgttgggagagcaggccatccaaacccacccacccacc

SEQ ID NO: 32274 - DNA, 66 bp, Chlorella protothecoides
gcacctcgcttccgagggcatggactgctttgtttatgccgattctgatcccgctgtggcacctcc

SEQ ID NO: 32275 - DNA, 73 bp, Chlorella protothecoides
agggggcttgcctcctcaccctgcatgggttaagaactttgctaaatgggcctgacaccatgagctggcaagc

SEQ ID NO: 32276 - DNA, 104 bp, Chlorella protothecoides
ggaaggatgtgggctactcagctctcactgtttatggatgaagtgtgcggcgtctggtggagcctcccagcgactgtgcagcgttcaaggatgtggcacgccag

SEQ ID NO: 32277 - DNA, 61 bp, Chlorella protothecoides
cccccgagcatttgtttctttcttgccacgtgcctgtggcaaacacgtgcatacatcgatg

SEQ ID NO: 32278 - DNA, 61 bp, Chlorella protothecoides
ggttttgttgttaccatttggaatggctggattcgttagtcatatgtgctggattctgggc

SEQ ID NO: 32279 - DNA, 78 bp, Chlorella protothecoides
tcccctgggcaacaaccggcagggcctgcggcctgacctccacccccaggaagattgaaaagcggtatcattacaggt

SEQ ID NO: 32280 - DNA, 180 bp, Chlorella protothecoides
ctgcccacttctcagaaccttccagggtgttggctgttcgtaaggccgctcagctgtgccagaccttgcacaacctcggtgcaaacaagcaatgcacaacctcagccgcccatcgaccagccggcatgctggcgatccaccccctcccaatgtcccccacctgcgccctgaagaagcaga

SEQ ID NO: 32281 - DNA, 105 bp, Chlorella protothecoides
gaggaaaaggtaagcgcatacggtcgacagattggcgggccacctgtaagcagcatggggtggtttcggggggcagtgccttcatgtcggaggtcagggctttgc

SEQ ID NO: 32282 - DNA, 128 bp, Chlorella protothecoides
tcggtggctgtgcgagggctgggcatgttgatgagtcagtggtcccacgcagctcctccccaagatccaggggctcacgagggggaagctgctgggcacagcatcatcttgcatcccacagcgccaaa

SEQ ID NO: 32283 - DNA, 95 bp, Chlorella protothecoides
ggacgggcaaagcgtgcccgtcgctgagtgtagggcaaaattagtgcatgcacctgccaacctgtttccctaggctaggtctggcccctcctcat

SEQ ID NO: 32284 - DNA, 71 bp, Chlorella protothecoides
caccctcaaccatgccgccctgcgtgaggtcagtcagcagggggagggcaccctgcactgcagcaatgccc

SEQ ID NO: 32285 - DNA, 111 bp, Chlorella protothecoides
ctgtgggtctttttgtcactgctgcttgcacaggggatgaaatttgaggatggatgtgtggttgtttattttctgcgatctggctcgtcgtgaagttcacagctggagttg

SEQ ID NO: 32286 - DNA, 11126 bp, Chlorella protothecoides
  modified_base (426)..(435): a, c, t, g, unknown or other
  modified_base (3010)..(3019): a, c, t, g, unknown or other
  modified_base (3230)..(3239): a, c, t, g, unknown or other
  modified_base (3978)..(3987): a, c, t, g, unknown or other
  modified_base (4315)..(4324): a, c, t, g, unknown or other
  modified_base (4532)..(4541): a, c, t, g, unknown or other
  modified_base (4829)..(4838): a, c, t, g, unknown or other
  modified_base (5000)..(5009): a, c, t, g, unknown or other
  modified_base (5993)..(6057): a, c, t, g, unknown or other
  modified_base (6296)..(6305): a, c, t, g, unknown or other
  modified_base (6603)..(6612): a, c, t, g, unknown or other
  modified_base (6744)..(6753): a, c, t, g, unknown or other
  modified_base (7739)..(7748): a, c, t, g, unknown or other
  modified_base (8358)..(8367): a, c, t, g, unknown or other
  modified_base (8525)..(8534): a, c, t, g, unknown or other
  modified_base (8664)..(8673): a, c, t, g, unknown or other
  modified_base (9319)..(9328): a, c, t, g, unknown or other
  modified_base (9977)..(9986): a, c, t, g, unknown or other
  modified_base (10157)..(10166): a, c, t, g, unknown or other
  modified_base (10784)..(10793): a, c, t, g, unknown or other
cccgcccaccccacaacgccccccacccccctaacacgccgccccacctgccgggcctgcgcagggcgccgtccaccgcatccacgcgatttgtggccccgatgacgaccacctggccgcgcgcgtccaggccgtccatgagcgccagcagcgtgctcacgatgctgttgtggatctggtcctgcttgctgctgcgcacctgctcgggttggtgaagggggaggggggctgggtctgcttgggctccccatcgtcacgatggggggtcaccaggtgggaggacagtggtccgagtctggagggagcatgcatgcagccggccgccctcgtgcccgcgaccggcccgcgaccacacccacgtccgcccccgggggccccctccattccccccccgccgcaccggcgccaggccatcgatctcgtcgnnnnnnnnnncgcagccggccgccctcgtgcccgcaaccggccgcgaccacacccacgtccgcccccgagggtcccccccattcgccccccggcgcaccggcgccaggccatcgatctcgtcgaagaagatgatggagggctggtggcggcgcgcctcgtcaaacagcgcgcggagctggcgctccgcctcgcccacccacttgctcaggatgtcggcgcccttgcgcatgaagaaggcgacgcgccgcccgctgctcgccgcggcgtgggaggccagggcccgggccacgagcgtcttgcccgtgccgggtgggccgtggaagagcacgccccgcggcggcgctatgtggaagcgctggaagaggtcggggtacaccagcggcaggaacaccatctccttgagcaggcggaggtacccgtcaaggccgcccacgctgtcaaagctcaccgaggggtccacctggatgggcgcgatctcagcccccgacaagccggcgccgagcgggccggggcccgagcgccgcgccgccgaggtggccaggtccagcggggtgtcggcagggcggggcgccccccaggcgccggggaaagggcggtcgggtgggtcctccgggaggccaccgggccgggccgccaggcgctggggcatgtcgaccgttcccagcacgtcctcggcatcttccacgccacggcggtgccgttcgtgcccgcccatgcccggcccgccgacagcgccacgcttgtgtcgtctggcggggcgcctgccgctcccagacctggcgaagggggggcgggggggggcgtgggcgcgccagagtggcccacgcacagaagtgcacactgtgcagattccggcccctggcagcccaaggggccggccctgcgcctctcaccctggcctggggacctgctgatcctcggcggtgcggttgatggtgaccagggtcctgtcgcggaaggggtaggtccgcctctcgggctcccctgactgttcaacaggctcagctccaccgtcccctcggggagaggacgcctggggcccaggatgggcggccggtgtgggtggctgggtcgcatgtttgagcctcagtacgcacgatgcatcagtcatcccacaaccgcaagcgatgatagcccaaatcccgccttctccctcatccccccgtacagggtgctgcacccaccctcactacagggctctgggcgccggggtcccgggctccggtggcctgaccgggaccggtgctgggtgtcgccaccgcttcatagcgctccacccccgcgcgaacgcggaccgagtacctctccgcaaagtggtgcgaaggtggcgcggggggcccgcgccggggggactcctgaggggtcatggtggtgcaaaggggggctgtcgagcatacacgcctgctctccccccccatccagcaggtgcggctgtgcgcccgcgtcccaggccagcccctccttcccgaggggcatggccgggcatggagggagcctgagtgcacccaaccgcatgcacactcacaaagtcgctgtccgagctgctgcaggcctgggccggcttgttctgcagtcgccgccagaagggcgtggccgcccgaaagtcctcggcctgataccgatccacgctgcgccgcgtgctgcgcaggcgggggtggctcccgacatggcgcccaccggcctcctgctggggttgtgagtggggtttggggagcgcggcggcaggggaacagaagaggagggggggaaggaagtaatcattgcgggcatcaaccagccgggcaggcacctcgtcctcgctgtccagcgcgccaactctgccggcgggtgtcaggcgcagcctcttgcccgacccgggagtcggacgcggcgaggtgcagggattcaggccagcagcgcccgcgccaagacctccacctctctgcagcgcctgccaggacgcttccttgccattctggggagttccctatgcaaaatgtggtgcgtggggtggtggcggtgccctgaggagtgtttcacccgcaggggctcgtccttgttgccacacttgtccaagaagcgcacctcctccctcaaggacttcaaagaggaatgaggggggggcaaagatggacggtccattctcgcctgggggacgagtggcggcggcgtcctgctgggagtgctggtgtggggctggaggcctgcatgccctgggggtgcgattgtgggtcccatgtcccgcgccacgaccactgaatcacctgaacacctcctaatgcacacctcagtgggtcattgtggtgctgaccttgcaggggtgtgcgaaggtagatccggcgataggggcgccgcagtaggacttcctcatggccacattgaggtccagcaggggcgagctgtttccgagcacatccgcaacgcttgtttgtcgcaagcagtcacctagtcttcgtagcatacactcgccgcattacccggcgcgtttggatcggaattagtatgatggcgcgcggaattcaaatcggggcgcagccctatgcgcaggctgtagaccgactgcttgctaatttttcatgaggagcatatgagggctctggcattnnnnnnnnnngtgcgcagccctgtgcgcagcctgtggaccgagtgcgtgctggtgcctcatgaggagcatatgagggctctggcattgccaagaataagagatagcgcctggaagtaggaagcgtgtacgactatgtgtgctgctggctgtgggacaccctccgatcacgcctaggggcgatccccgtgaaccacatcagccgacaggagccaggatatcnnnnnnnnnnactgtgggacaccctcccatcacgcattggtgcatccccgtgtaccacatcagccgacaggagccaggatatcacgaccgcagcgcggtttcctttcacagctcgaacagtttattgccgtttgccctgcttgtgcctttgcgcgaccatagagcacgtcatggtgtgggcagtcacgtccagggagggtggcatctgggaatagccgtgcaaggtggtgaggctggcgacggcccatttctgtgtgcacctgcatgagttgtacgctgtatcatgtgcctgccctgccaatcgcgatctctccaaggcacaaatgtgcacttggtgttctctgaacatgtccctgacaatcttctcttcgaccgcaacctagactggtgagccaccagctcagggcgacacatatgacgtcagcgcaagcatgaccaccccctgctcccagcgtgaggtttgcaccccaagggagccccctatcagtaacacttttgcgaatgcctaagtaaacccatgatgctgcctggaatagagggttgtgcggcagatggcaggtccacatcgtggcagtgcacccacgtaactcaccaggcggctttgaggctcgtgaggcacttcatgtcagaggtgcccgccacgccggagcattgaggtgcggcagtgacaagagtgcaattctcaagcctcagcatcgcctcactgcaagcacatattgctgacatggctttccagagaaaacgctctnnnnnnnnnnttggtccacatcgtggcagtgcatccatttaactcaccaggcagctttgagcctcgtgaggcacttcatgtcagaggtgcccgccacgccggagcattgaggtgcggcagtgacgagagggcaattcgcaagcacatatcgctgacatggctttccagagaaaacgctctggcatgagcatgagggatacatggtcgatttttagtagctttgctgttgcagcgccggaatatgacaggcgtcggtgtccggactgcggaaccgccctccacacgcggtggcccgcgcctgcgtccgccgcacttgtcgtcagtagcaataaaatccnnnnnnnnnnagtggcctacgcctgcgtccaccgcacttgtcgtcagtagcaataaaatccctcgttgctctccagatatcggttctgagaaacaatcgtagggcagtgtgtcctgtcttcagctgctgatctccttccatatcgctacctcatgctcccgtccgcgctgccctggagcagcaggttcacattgctgcttgcctttggtatcgccgcnnnnnnnnnnattgctctctgagatcgtattttagaaacaatcgcggggcaatttgtcctgtcctcagctgctgatctccttccatatcgctacattatgctcccgtccgcgctgccctggagcacattgctgcttgcctttggtatcgccgctgtcgtgaatgtgagtagctttgtctgatgtatccgatgtagttgcactcctcatctgcgggtcaatatcattctaggtcttccatccctgcgcaggcggactgcgaccctaggataggattcttcagtcttcccaccatcctgnnnnnnnnnnaattctaggtcttccatccgcgcacaggcggactgcgacccaagaataggattcttcagtcttcccaccatcctgtgagttcttgtctctacggaatagcaaggaggaatatctgttcaatgttttgtgtatcccaccctacttccacgatgcactcagctnnnnnnnnnntacgaatcatctgatcaatgttttgtgtgtcccaccctacttccacgatgcactcagctagttgacccatcctgcccaggtatgatggacagctttacctggcacacgggggaaacccacaggctttctgcaggtgggtccaagagtgggcatctcgagcattgcgcactagtgaagctggcctggcagagtgccggccacaggagatgaaacatttctgagggagcgctcacccacaacgcaggctgaagggcttctctaccagtgctttaaccgacattcggccgatgagggttggctatccattcccagatgcggccatcaagaccatcaacccagatacctgggcggtgtgtgatcctgccaagcgtagctttaaaagagaatgctcctacctgggcattgtcgagtgtctgccggaaggagtgtcaaagtgtgagagctgggacaccacaattgaggacacgattggcacaggcaaccaaggaagtgctaactggggcaacaacaactttggccaagaaaaccatggtaagcatcgtatgcttatgtgacggactgcttgttcaagagcacagggctccagcgccccaagccccactgctgcaggcaacggcaatcgcggcgacggcaatgttggcaacaacaatgtcggtgacaacattgtttgcaacaacaagcgtgatgcttccccatgtctgctgtcagacctcctcacctcggagaccgtggttgtccatccaaggccatccccgccgccagtggtccctccgcctccccagccacagcctccctcaccaccccccggggaaggtggctgtgaccccagcatcgccttctttggactgcccactgtggagtaagtccgggagggtgcgccactgccaccctcctgcgctcccccatgggcacctgcgttgctcaaggggctcgctctacctgcggaacccatcggcacagtctatcctcccatggccccttccnnnnnnnnnnnnnnnnnnnnnnnnnnnnnnnnnnnnnnnnnnnnnnnnnnnnnnnnnnnnnnnnngatcccctttccaggtatctgagcacactctacctgctgaatccagagggtggcgaagccttctgccagtgagttcatatctgcagaatgggtggtcttgggaagggcatgtcaaagcattgccagtgtagacaagacgctttgcagaccaccgagcaagccattcatcttgagaatgcagtgtcccaatggctgccccaatcttcttccgcaggcagaagggttatggaggtggaggnnnnnnnnnngtgcagaatgggtggtctttgggaagggccttgtcaaagcattgccaatgtagacaagacgctttgcagaccacagagcaagccgttcatcttgataatgcagtgtcccaatgtctgccccaatcttctcccgcaggcagaagggttatggaggtggaggcgtcgtcccccacacttttactgtcttggacagaattccctttttatcttttctcatcggcacgatcaatcccttaaacatggggacctgtcaccctagggggaccacagcctgccaggctgccagcgtgatccagtnnnnnnnnnntccccacacttttgctgtcttggacagggttccctttttatcttttctcatcggcacgatcaatccctcaaacatggggacctgtcaccctagggggctggcagcctgccaggctgccagcgtgatccagtnnnnnnnnnncttggcgaccagaatcatggtgaggattgtaagggcgtgtgacagactcgtttgaatcgcattggatatcaatgactcatgtcccactgctgcaggcagcggcaatcgcggcgaccgtaatgttggcgacaacaatgttggcgatggcattgtttgcaataacaagcgtgacacctccccatgtctgctttcagacctcctcacctcggagaccgtggttgtccatccaaggccatccccgccgccagtggtccctccgcctccccagccacagcctccctcaccaccccccggggaaggtggctgtgaccccagcatcgccttctttggactgcccactgtggagtaagtccgggagggtgcgccactgccaccctcctgcgctcccccatgggcacctgcattgctcaaggggctcgctcaccctgcagaaacccatgggcacagtctatcctcccatggccccttccaggtacatgaactcgctttacctgctgaatccagagggtggcgaagacttctgtcagtgagttcctatctgcagtatgagtgctgtgtgggaaggccatgtcaaagcagagcttgtgtagacaggtttccctgcagaccaccgagcaagccatccagtgttctgctccagtggcataatgtctagcatcatccttacccacacaggcagaagggctttgggggcggaggcatcgtcccccacatcttcaatgtctttgacaggtctccatttctaatcctccacatcgccacaatcaatccctccaacatggagacttgtctccccaccagcaccacatcctgccaggctgccagcgtgatccagtgcgtcccctctggagtgccgctttgccagccaaatctgcatggcaatgtgggcaccggcaatgtgggctctggcaactacgggaacaacaacatcggcagcaacaactatggtaagcctgggggtcccccggctgcgcaacctgtgcacnnnnnnnnnngtgggctctggcaactatgggaacaacaacattggcagcaacaactatggtaagcccggggggtcccccggctgcgcaacctgtgcaccggagtgtacagcatgtctaacaagcgcacatccatgctgcaggcagctacaaccagggattgggtaacaccggcagctggaacagggggaccaagctcacctgcaactacgccaacactaagaccagggcctgccccatctggatcctgaagtcgaacgagaccctgctcatagccccctcacaacctcgttctccaccgctctaacagagccagaggaaccgccctacaaggtagggatcaaggacactgggcctcatgggtctgaagtatcttacatgacgcaacacagtcgatgtgcaatgtaaactacagtttgttcaaaatgaggtccttacaatgacacctcatggcactttgcatccgatccgcaaatggaggacgacctggcgcgaacagctgggtcttagggagagtgctgctgcagcgctcggagccactgggctggagctggaggcctatgtggaatgctaacgaggacggagcattggccaaaccagaaggcatgagcttgcactatgnnnnnnnnnnagatccgcaaatggaggacgacatggcgcgaagagctcggtcttagggagagtgctgctgcagcgcccggagccacttggttgcagctggaggcccatgtggaatgctgacgaggacggagcattgtccaaaccagaaggcatgagcttgcactatgnnnnnnnnnncgtgggcaccggaaatgttggcgagggcaactatgggaacaacaacatcggtagcaacaactatggtaagcctggggttcccccgcctgtgcgacctgagcaccggagtgtacagcatgtctaacaagcnnnnnnnnnntcccccggctgcgcgacctgtgcatcagtgtgcgctgtatgtccaacaggtgcacatacatgctgcaggcaactacaacaagggatcgggcaacacgggaaactggctcaagggggacaagctcacctgcaactatgcaaacatgaagaccaagtcctgccccatctggatcctgaagtcgagcgagactctgatgatggcagccccctcaccacctcctttcccaccgccatctccaccccctccatctcctccgccaccgggccagttgtgcgacccccgcaccgccttctttgccttgcccaccatggagtgagttgcacgtggtgtagacttcatggtggtgatcttctgatgggaagcatgtgggttcagcatggcatgaggcttgcaagcctcgtgagctggacagaggaccgacccgaaaccccttccccgcactaggtttcaaggtgctctgtacttggtgagcgcatccaatcccgaccgattctgccggtaggtcgtctcccatcgctctggaatgtgcatgagggtgtagaatgacagccggtgtgtgtgtgggtgtgcgcgcatgcgcgggcgcgcatatgcgcaagggtttcagctgctttctgagcgtggagtgtgctggaatgctggactnnnnnnnnnntggtgtgcatgggggtgtagaatgacagccagggtgtgtgtgtgcgtgtatgtgtgtgcgtgcgcgcgcgcgcacatgcgtaagggtttcagctgctatttgagcgtggagtgtgctggaatgctggactcaaccccgttccctctctgatgcacggcaggatgaagggttttaatggaacaggcatctggaactccatcaacgttggcctcagcagcccattcgaccgcttctccatcggcacactggaccctaggaccttgaagatctgcactcccagcgcagcaacgatctgtcccgccgtctctgtggttgagtgcgtcgccgtgcgcgtcgggaaatgtctacatgacgctagcggaaatattggcaatggcaacacaggggtccagaacatcggttacaacaacattggcagcaataatcaaggtttgtatcgagaggagatagcccagccaatgtttatccccgtcgctccagaaacttcctcaggcctcccattatcacctgcgatgcaggcaatggtaatcgaggggattccaacatcggcaccgggaatcaaggtcaccacatcgtttgcaaccaactggactcccagcaaggaaattcgtgcgagctgtctgcccttcggacagcagaaacactgatnnnnnnnnnnaatcgtctgcaaccaactggactcccagcaaggaagttcgtgcgagcggtctgcccttcggacagcagaaacactgatcctggacgacttctagggcccattgttcccttctccttctcatgcggagcaccactggttctaatattagaagtcgtaccaccacgggctgcnnnnnnnnnnccccaccgttcccttctccttcccatgcggagcaccactggttacaatattagaagtcgtaccaccacgggctgccactcccttcccagactcccatggcctcagtgaccccccgggactggcatccatctgtctcttgccttccgtgacgcactcgacctgtgtgtcggctcctccgcccctgtgggatttctgccctttgcatggggcattgtagcaccgagtgcacctgcacactctcatgcagctcccctccaagaagaagcccctcgtcactgatgagaccttggcgtgtgaggattccatcaccacttgctgccacgctttctcttgtcagaagttcacctcccctcctgcccgttaccttcagacctcctccgtccagaaggcctgccctgccatgtcctcaggtgaccgcctgtgccacctctcaaatccattctcttcccccaaaccaaggtgctgaccccttgttccacaaacgagcctgtgcccttccccacgagggagaactcttcaccagaatcacagatggcgccaagcttgtccagctgagcgctaccacgcttcaggacgggcaaatcttccccctcctgtgaggatgtgcccgccacccannnnnnnnnncactcttcccccaaaccaaggtgctgactccttgttccacaaacgagcttgtgcccttccccatgagggagaagtcttcacccccatcacagatgccgccaagcttatccagctgagcgctaccacgcttcaggaagggcagatctttcccctcctgtgaggatgtgcccgccacccaaggttgtaccgtctcccgtcgacatcccagtactgttcctgcatcagagagagcccattgttttcctctgctgcaacccccccttcatcgtgcgttcttgcttcttagaatctgttttgcttagacaattagatccctaccaggcttgcgccggt

SEQ ID NO: 32287 - DNA, 69 bp, Chlorella protothecoides
ctggatcccggtctcggctgtcagcctggcaaggggactgggaaaccgcatggtcttctgcccccccca

SEQ ID NO: 32288 - DNA, 76 bp, Chlorella protothecoides
agcgcacgtgaggaatatactagtagaaatcggagagaggcaactagtgcagatctgctcacggcacgacggcggc

SEQ ID NO: 32289 - DNA, 61 bp, Chlorella protothecoides
acaaagtgtttgacacctagcaagtgcatcacctccaagcgctgccgtaccgtgatcaacg

SEQ ID NO: 32290 - DNA, 61 bp, Chlorella protothecoides
atagtcttgaggccaccagcccttcaaccatgaggttgattgtcctactcatcataagttg

SEQ ID NO: 32291 - DNA, 147 bp, Chlorella protothecoides
tcccatacccgcagcgtgactcgcaacatcttcctgatacgttggaacccgtttccagaaatgtcctgatcaagccggcgctgcaaacctcggcgaaaccggggtgccggagaatggcggagggtgggaacatccctcccttccagg

SEQ ID NO: 32292 - DNA, 67 bp, Chlorella protothecoides
ggtggaggcggcggacgaggacaactcatccaagtcgtgctcttgctgccacgtcgccctgcaaccc

SEQ ID NO: 32293 - DNA, 376 bp, Chlorella protothecoides
  modified_base (123)..(311): a, c, t, g, unknown or other
ctctgtccaaactgacagcattgtccctgcccactcaccagcatcctgtggccacacagcatcaacccttgagggcgagcctcgtacgtactgcgctgaggttttggccctgggtattcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatggtggcctggcaagtgtcaattacgcagggcgggggagggggtcagtcatgcacacaggaa

SEQ ID NO: 32294 - DNA, 61 bp, Chlorella protothecoides
gtcctttctcgtttccacttgtaacccacatctggaggatactgtaacagatgcacagcag

SEQ ID NO: 32295 - DNA, 63 bp, Chlorella protothecoides
gagattactcccgagggcaagcaggtaggccaggttggccagtggagtgggatgcatctgctc

SEQ ID NO: 32296 - DNA, 68 bp, Chlorella protothecoides
gggctcatgtgctgagccagccgctgtgtgcatatgtaggacgcacctcaacccatgccactgcgcat

SEQ ID NO: 32297 - DNA, 202 bp, Chlorella protothecoides
gttgtcgcaccagtctgacgaccgattgttgtggaggatggtgtggttctgccgactcctggcagcggtgagtcctgcaccgtgatactagatctacaaaggggcacgatgagcgcctgccctgccctcgctgccaaccccgcaaggccgtctccctttgggtctgctccagttacactcctcgcacattttctgctggcac

SEQ ID NO: 32298 - DNA, 72 bp, Chlorella protothecoides
aagctggtggcaggtgccctgtgcaccggaaaatggcgattactcatcgagcccacacaacccttcacaggg

SEQ ID NO: 32299 - DNA, 70 bp, Chlorella protothecoides
agctaccaacagccatgttcccaggcacccacgtacgtctacaagtggctcacttggtgaaggcgatggg

SEQ ID NO: 32300 - DNA, 142 bp, Chlorella protothecoides
cacttcgtttcattgggcaccagagtgcttcattgcatggtggggtgcctcgcgtgaactctcacggtagcctgcgcaactatctctcctaagacctcacctccagaaaccacccccctcccctcccccaggtgaagagccc

SEQ ID NO: 32301 - DNA, 108 bp, Chlorella protothecoides
ctgaggtacagcaccggctgcggggttggaaagagtggggtccggaggcgtttggagaggggaggggatgaggagacagggaggatgcttggtgaaggcacgggtgtg

SEQ ID NO: 32302 - DNA, 183 bp, Chlorella protothecoides
catcgatgtccacgtacaacaccctggacacaggatcaacacaggggtggacggtgcggcatgcatgttgaggggcacgccgccaatgagcaggagcgcatgctgccgcagcgtggggtcgggcggagcccagcaacgactccgatgtccccggcccctccactccacccgcccacacctcga

SEQ ID NO: 32303 - DNA, 4651 bp, Chlorella protothecoides
  modified_base (4027)..(4152): a, c, t, g, unknown or other
tatcttcgactcgtgcgaagcatatgttgcttgctccacccaccccattcccatccctgctcctcagcgtctcaagcagtaacacggctaacagaggggtgtattggtacatgaggtggctcaccaatcaacgaagggagcgacatggggtgggaggaatgagatgggggatatcaaggggtgaaggggtacgaagcctgcggggtggcgctggtgcggctgggtgccagcccccagcttgtccaagcgcagtgagaggatgtgtggggtggcacgtacatgggaaagaagtcttcaatggtgtcactcaggtacccgtgcatctcgacaaaaggggtgtgccctgggaccaggtgttggccggctcgatcgatggctaactgggcgaccggggtgccgggtggcctctccatgccggggggccagggtgccggctgatcaggtgctgaccagctccacccgccggctcctccggcacccagctagtcgcagccgtgtccccggccgcaggcgccgtctgctcggcggccacacaggcggctggccggcccctcgtcctcggcccactccagggccagcgccggcagcggcttgcccggcgccagctcgcggcgcgcgcccggccccagcgcgcgctccaccgcggccaggatgcaggcgacgtccgggaggaaggggcgggacccgcagaacaggcgcgcgtgctgcggcgtgctcagcgccgagaacatcgcgcccaccgcgtcgccgtgcacacgcagctcccgctccaggctcgactccagcgcgaagacccgctcccgtgtctgtgcgcggtgagatcatcgagcgggctcggtgggatggggtgggctgcgtgtgcttgtggcggcgcagggcgggggaaagaccgcagagccccgccggactgcgcgtcgcaggggtgccccgccgtgtgtgtgtgtgggggggccacggactctgccccacctgggccgcgagcccgccccttcctgttctgcttccttcgagtccccaccagggtgagccccctcgatcttcccccctgccccactcaaccccaccccaaaccccgtcccagacagcacagccacctgcagggagttggcggcgaactggagcatggcgccctcggccaccacctgtgaggccacgaggccgctcaccaggccctcgcgctcggccgccagggcctccaggctgcggtgaaaggtgtgtgccaccacacccaggcgctccaactggcgtggcgacagggccaggtcggccaccagcgcgtcccaaagtcccggggcggaggtggagggcgcggagatgccggccacctccgcaaagtggccggggaagtagtgtgcgatgcgccaggacagtgtgcgctgcgtgtttggggtggggtgcagggtttgcagggtttggggaggatatcgtgaggggctctgtgggtgattcgtagcgggggggtgttgttggggagggtccgaggactccaacgaggcactcaatgaggcactggaggcccgacgtcggtgtgcaccatggaagggagccagccatcgcgcaggggtacgtctgttggcgaggcgatcaatccactgatgattctcgaggccgtgaccctccccctcccctttcccctcaatgcagacaccaccaactacaaccaacaagcaccctggactcacccctgccagcatcctcgccatcagctcatccaccagctccgcgccgcccacgccggcggccacatcctgggcggcctcctggacgcggtcgttggcctcctgccagacctgttggaggccccccacaccctgggccctgaaagctgcttgctcgctgcagcaggaatgcagggggatggtgttgtgggaggagcaggtggggcagggaccacatggacacctggctcaacacttcgcgacaggagcgccggatctcgatgccgcacagcgctgggtcctgaactgtgtgggcccctccttgcaggccggggcaggcggctgccctcctccatcacccccccccatccacccctgccgctgccgcgcacctctgcgtcaggtgcaggtccgggttccagtgctcggcttcgccggtgtagcaggcgcagtgcaggacgacggtctggccgggcgtcagcaagggctcgctcagctcacggcagccacgacagctgggcttgaacccggtgagggacagctcgtcctgggtggatggagcggggggagtgctgcgtcagcgagaggatgccggggaaaattacaaccggccagcatggattgcagagcggcttgcctcctcctttggcgcttgctggcgcaatgcgcgaccatctccctcctccaaactccacatgtacagagctcccttccaaaccagggtctggatggacacgagaggtctccactcaacacatccaggaatggacgaatccgtgtcctcaccttgctctgctgcagcaggctgatgtacgtgtcgcgcacattcagcagcttgtccagcagcgcagtttgttgccgcagcgccgccatctccgcacgtgcggcgcccagatcctcgttcacctgcgccagggggtcgcgaggagtgtggatgggtcggcgatcctgggaatggcgcgctgacatgcctgcactggagtgtgatacttcggcgcagccaccatcgaaagggtgtctccagggacatgcctgatcgtagctgctcacgattgcctttttccgggcccgacacttctgccgatacctgttctgcgccctgtttgtacgaggatgcgggagcaggtgggcgcaaaggtgcatgaccgcgctgtgattcacgtcgcatcgtccccaccatctcgatccggcacgcgattcagcattgccctcattctcgtcccgctcactgtcgattgcggtctcgttgttgcctgaggcgttgttccatctgatcactgtctagcgcaggtacctcaggctggggcatgctctcctgaccggtcaggtctgtgccgtcccacgatcctgcgccgtcgctggcccaggagaccctgctcagcggcaccgagccctggccggaaggggattctgccaaggcaagtgggtcctccggcccaagcccaacagccgcggagactccgggccaggcatggctgaagctagaatcgagcatcgccatgttttctgagatcaggagatcaatccagtcctctgacggcaagtctatgatgtccggactttagtgtccagtactgacgaggaaagccccggccacagtagtgccactcgagcacaggcgcagtgacacactcactctatgttattaactccgcgatatgacttttcgacacgtatgcgaccctgagtcccatctactgcttataggctggaccgcatctcgaacacgcatgctgtgttgcgccggtacgcacgtggggttaacgtcaccgtcagatcatactcgcgacaccgcgtttcgctctagtcccagatcggccaacccgggacaataccaatcgcccagtcaggtgccactcgagccgacccatgttcagataagatatgaaaatgcgcaaaattgcttgatggggatccgagaggcccccgttcggcgggggccattctcgccccttcgggaggccccgtcgtggccagtaggagatgcgaacgcatcgcaagccggattttttagtttgttaatatcatataaacgtaagggtgtcgagtacagagcgataaaacgctgtcaccatgcatcggtcgtgcccgatgggcccctggtggcccaggaacctgcccccctccttaggccttagaggggccagatacccccctcctcatacatcgcctgccacgttgctaagctagtctcttacaagtatgggatccacaccaggtgcaaggtcatattggccgtcatttgcttgctgaagcaatccgccgcctcttgccaccccctctcaaaagatgggagcggatgcagcgtgctttgcacgggaggtgccgcccgtatggaatggtatcagccgaccaagcgggcagcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcgcttccttgagccctggaacgctctcgggtgaaggcgccgggttgtccgggatgctcagcagtggtggaacatcgctgctactgtccacagggtgtgggccagtggtactgtctagtccttcagtgtcaagctccttggatgttgtgacctggtcgggggtgatcccaagtgatgggtctgccactggcaccggctccctgccgcgcctcctgctggtgccggccttggatgccacgatgttgcctgtgtcagtgcgtggattgttgattgcctcaatggcttggtgtgggtgggtaggatcggaatgaccgtgtgaggaggagaagaagatgggcgacagggaggagaagaagacggactgatttgtacacgtcgggtgggcattcttcaccctcctgttcaactttcgctgcttcgagggctgtggctggtactcggcgggccactggatgacaaacgggtatggtgtctccgtcaccctgcggcggcagag

SEQ ID NO: 32304 - DNA, 395 bp, Chlorella protothecoides
  modified_base (90)..(312): a, c, t, g, unknown or other
cccttgcatcggccgacagctttgtcactttctgccccgcacatgtcttgcagtgagtcgggtggacacactccacccttcagtggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaaaacccctgacaagcccctgacccttaccctgtgctactctgtgtttcaaccattgcagatccccggcctggcccagca

SEQ ID NO: 32305 - DNA, 270 bp, Chlorella protothecoides
cagcgccccggccttctttgcctgcatgacccggagagcagacttagggccatggcaggaagaggcattgctcttcggaccttattcttactgcaataccaaggtagtcttgccgcctaacatccctgcaatgtatgtattcactgattcaaccgtcagcccaccaaacaaggctgtccccaaaccaacctccaggaaatcggctgcagggtcgagctcgtcgaaacgttctgcagcagacttgccagctgctcgtgcacttggggcctg

SEQ ID NO: 32306 - DNA, 84 bp, Chlorella protothecoides
gaggtgagcggaatgggctgggaggtgcgaggtggctgctccttccatgagggaagttcttggagattgctgtgccactgtcac

SEQ ID NO: 32307 - DNA, 153 bp, Chlorella protothecoides
tgcgggagtccatatgagtgccaagtacctgttgatccttgatatatatgggatcgttgctgttaacgtccttcacgttccttgttatgtgtggagcgctgtcgtgcatgatgagcatcatgagcggcaccgcacgctacatcgctactcacg

SEQ ID NO: 32308 - DNA, 74 bp, Chlorella protothecoides
ggccatgaacaatctcaatgtcattcgccacatgcacgcacaggcctggtgtgcgctcacacatccttcgtcac

SEQ ID NO: 32309 - DNA, 61 bp, Chlorella protothecoides
ccaatcaacaccttgctctattgacgcacatacccccgtgccatgcttgctcctcatccga

SEQ ID NO: 32310 - DNA, 79 bp, Chlorella protothecoides
tcagattgcaggcacctaccacaacatcaattcaaaccaaccaatcacccccaaaactggtgtgtgtgttggggggggg

SEQ ID NO: 32311 - DNA, 61 bp, Chlorella protothecoides
caaggcttgggaggtgggtggagagctcatcgtacagtcttggctccatcgttacctgcgc

SEQ ID NO: 32312 - DNA, 70 bp, Chlorella protothecoides
gcgcggtacgaccggctctgtgggcaggggcaggagaagagagtgggcgtgagcgcgcacggcaacctcc

SEQ ID NO: 32313 - DNA, 61 bp, Chlorella protothecoides
ttcctggtcctcggcaccgcgttctccctcaccattggcaagccgaagagcctgtccacgg

SEQ ID NO: 32314 - DNA, 69 bp, Chlorella protothecoides
atgcctagggcgacccaccaagcagtacagttcacatgggggtaacccactcaccgcccggcaccccat

SEQ ID NO: 32315 - DNA, 126 bp, Chlorella protothecoides
gaggaagatggtccctgatatcaccctgcaaccatgttgacatgtgaaattcaaccacgctcaggattataagctgaaggggagcaacttcatgtcccagaggaggtcagcaacttcacacctgtt

SEQ ID NO: 32316 - DNA, 110 bp, Chlorella protothecoides
ccgctgggtccgcatcgatctggtgcgtggcgaagtttgttgggcatacgcagcgctggtcgtgctgagagtggggtggcgggggctcgctgctggcggtctgggccccg

SEQ ID NO: 32317 - DNA, 96 bp, Chlorella protothecoides
gcagcaagatcctgccctcctccaggggggactcccccgccaagggccagccgccaggccgggggggaggaccgagtgtcgatcagggtcctcaca

SEQ ID NO: 32318 - DNA, 61 bp, Chlorella protothecoides
aacagtagcccttatggtcgcttcctcaggtggggggggggggtggagggttgaaagtgtg

SEQ ID NO: 32319 - DNA, 61 bp, Chlorella protothecoides
ccacgccaatccttctgtatgacccagtccaccctgcagccacacccagacgccccctcct

SEQ ID NO: 32320 - DNA, 115 bp, Chlorella protothecoides
cagctgcatgtactcgaacaggcccaggccgtccgtcgaccagtagccccagacgccttaaaaggcgtcgtgcatgggggagtatatcggtgggtggtcaggaagaaggggaggc

SEQ ID NO: 32321 - DNA, 143 bp, Chlorella protothecoides
gccggcgtcagcacctggcgacggctacgtcgcctttgacctcgcagggctcagaatggtacggatgggctgtggccctgggtccaggctggctctacactggggttgagtgaggggatcctcggtggcgactccttttgact

SEQ ID NO: 32322 - DNA, 114 bp, Chlorella protothecoides
cacctacttgccatgccccctgtgcggtcatgaagcctcctcctggctcatccttgtagacctctcctcccaccccgaccaccgtgcagtcttcaatctctccgagggcatcga

SEQ ID NO: 32323 - DNA, 62 bp, Chlorella protothecoides
agatgcgcaacgccccttgagagtctcggctgcaaaacgcgttccgtgagtactcagacggg

SEQ ID NO: 32324 - DNA, 139 bp, Chlorella protothecoides
atgaccgccccaccatgcgacaagtgcgtatcctgtgtcagtttggtgtcccccccagtactgtgtgccctgtcgttccccctgaaccggcccatcggttggctggggggggtagccacatccccctcaccacttctgg

SEQ ID NO: 32325 - DNA, 61 bp, Chlorella protothecoides
cgagtaggcggggaggcttcccaacctcgtgaaaggaacatcaagcctctgcacatgagct

SEQ ID NO: 32326 - DNA, 7350 bp, Chlorella protothecoides
  modified_base (308)..(317): a, c, t, g, unknown or other
  modified_base (504)..(513): a, c, t, g, unknown or other
  modified_base (931)..(940): a, c, t, g, unknown or other
  modified_base (1398)..(1407): a, c, t, g, unknown or other
  modified_base (2098)..(2107): a, c, t, g, unknown or other
  modified_base (2294)..(2303): a, c, t, g, unknown or other
  modified_base (2698)..(2707): a, c, t, g, unknown or other
  modified_base (5880)..(5889): a, c, t, g, unknown or other
  modified_base (6551)..(6560): a, c, t, g, unknown or other
  modified_base (6791)..(6800): a, c, t, g, unknown or other
gccgtggcggcggcccgacgcgccctggctgcgcgctccgcctcgggcagcagcagcctgggcacggcgcgctccgcctccgcctccgtctccacgccgccgcgctcgacggcggccacgcccgcgccgcccagcagcaccaagcgcgtgctggcgcccaacggccagccgcgcaagatccccctcgccatggactttgacaagggtgagttgggttgttttatgtgttttgaagaggagggcgggagtgagggggggttgcctgaggttgcttgcggatcacgtcttgcagcggcgtgcacgccgcnnnnnnnnnnggttttgaagaggaggggggagtgaggggggggtgcctgaggttgcttgcagatcacgtcttgcagcggcgtgcacgccgcatgtcggcgcatcagcaatcccgtttccccatggcaccgcgcattggaggggggtgcagacattttgcacagacactaaacgtctcaatccaccctcacccccccnnnnnnnnnnacaatcccgtttccccatggtactgtgcattggaggggggtgcagacattttgaacagacactaaacgtctcaatccaccctcaaacccccccccatacaacattgcagccctgccctcggacctggaggacctcgcggctgacgacggcagcggctggcggctgtccaccctgccctcgacctcctcctacgccggcagcagccgcatgggggcggggctgctgaacgcggcagagaggggggccgccgccttcgcaggcgtgttccgcaccgcgcggcgccagtcgacgaccggttagggcggcgtgggtagcctcgcccgcgcctgcgccgatgtgactggagggcggctgcgcagacgggtttggcgatgccgtggtcccttgacactccacccacctcaacctctcgtgaagnnnnnnnnnnccttggcgatgtcgtggtccctttacactccacccacctcaacctctcgtgaagcaataggtagccaacacacaggggtgtccagcccggacagggccagtaaccacagatcccccccttcaccctcccctttcgcaactacaccgtcccatcttcaagaccatgcctgctccatacctctctcgtgtgcaaagccatgctgtaatcgagtctgcgctagcgcgagcatgaattacacgaggtgccggtggtacagacctgggggtggcagtacagggagcgactcatttgcagagtcactggaaggggggaatatcgtggcaagaaacagtacaacctcaaggtactgcgaatgtccaccaatgagcttcggagagtttaggaagaattctgcccatggaaggggcaaacgggtgtcgttgcattcgggttggatgttgtttgtgtcagttgtgacnnnnnnnnnntaaagaattctgcccatggaaggggagaccgggtggcgttgcatttgggttggatgttgtttgtgtcagttgtgaccggctgcctacccagctgtctggctgagcacgctccctccagtgcagtcggggaagagcatgggcggggctcgcagctggctggcctgctcgtaggcgtgcgccattgcgagcagcgtgccctcgtcaaaggggcgggccaggaaggtgatgcccgccggcagtcccagggctgcagccggggcgagacggggtgggtgagaggatttctccatgctggtgctctccaaacagggcatcagcggtcaagcaacacatgcacatggacgtgcaatccccccgccgcgcaactcgctccaactgcgcgcacagggcgtcggaaaataccccacatcatgacgcatggggcaccccctcgcatgcccccaccgagccccgcccagcggctcactgttgaggcccatgggcaccgatatggaggggctccccgtctggggggagatcatgggcgagttgttgccatcgtagtagccggtgaaggagtccccgatcttgaggggcggcgaattccaggtggggtacgccagcacatccacgtcagcgtcgtccatgctttcgaccagtctctgcgcatgggcagtggttggggtcgggtgctcagagggggagccagggnnnnnnnnnntcaatctctgcgcatggggggtggtaggggtcgggtgctcagagggggagccaggggggcgagcagctgctggccgtgtggcgtgagtgatcaccgggactgcaggaacacacccgacacctcatctcacatgccttcccgctcgggacatccaggctacccccctcaccttgcggaactcggtgcnnnnnnnnnncggacactcccgacacctcatctcacatgtcttcccgctcgggacatccagactacccccctcaccttgcggaactcagtgcggcaggggtcgtcccaccagtagctgcagccgcagcgctgccccgccaggcgctgtgcggtggttgggaaggcggccgggtcgggctccggcgcctggagcgaggccaggatggagtcgcgggagagagggtggtagtccccgccggcatacagggccgacaggctgcgcaccacgttggaggcgttgcggctggccaggtacccgtccatccccgacctgtgttgtgtgtggggtccagtgggggtggtggggcgctgcggctgacggacatctgacagcaagtgctgagccacgccaggcaggctgctgcnnnnnnnnnnaaggtccggtgggggtggtggggcgctacggctgacggacatctgacggcgagtgctgagccacgccaggcaggctgctgcgaggacagctgcgcggcagcgacccctcgccagtcagccgtacctcccttccctcacacccatggccagccctcacctgaagggggagttgcaggcccacaggtccgaccactctccgtccacgttccagtgccccagagcgggaccctggccatcccggtttgcgctccagggctcccccaggctgttgttcgcgatggtgaagttgtcgaccagcatggcgcctgtcgcagggggcggggaggaggtgagatcctgggagtgtttttggtgccagggaggaccatgacaggaacgaggaacgccagggcacgcggcgcggcacgctggagagccgcgttccccccgctccccctctcccaaccagcacaacaatcgtctcacccgccgcctgcatggtgtagagcgcgccgttgaacatggcccggatctggacgtcggtgccggggaggtcgaggatggagcgcagcacgccgatacgcgaccccgccaggctggcgccccgcaggaagcgggtgtagtctgccggcggggcgtgcgccggcgccggcccccccagctcgtgcacgctggcctcgtcgccagggtcgagcccggccatggcccccagcagagccgcggcgtcggccacggtgcgggtgagggggcccaccgcgtcgcgatccaggcgcaggggcaccacgccgctgcgccccaccaggccgatgctggggcgcagacccacgaccccggcatggctggcgggcccgcgcacactgttccccgtgtcggtgcccagcgccgccagcgcgaggttggcggagacggcggccgcgctgccgccgctcgaccccgcagggctgtggtgcaggtggtaagggttgcgcgtgaaccccgccagggagcccagggtgaaggaggggaacagcgcgaactcgcccatgttggccttgccgaagacgatggcgcccgcggctttgagccggcgcaccacccaggcatctgtgcgcgggtagttctcggccagggccaccgagcctggcgggtgtggatgtgggggcggggggggtggacaaaggttgctgggatggaggtgcgtcggcgctgattcggtgactgcgtgatatctggacgacggcagggagtcctgacgagggcaggcgcgtggcatggatggcagccaggctcctcactccctcgcagacagcgtgcctgcacggatggagcaagatcagggcccctccaccagcgaggacaaaacaacctcaccccccacctgcggtggtggccaggcccaccacgtcgaaattgtccttgagcagcatgggggtgcagaagagcggtgccaggctgctgtcattgccctgggcgatcgcggcagccagctgggcatcggcagtcgcggcagctgccagggcctgctccacatccaccgccctgaccgagttcaggcccaggggagcgtcgtacacccggatgcggtccaggtaggtctgcaccagctgcgtgcaggtgaacctgccggccagcatggcggtccgggcccccgcgatgctgagctccaggacaggggggtgggccgtcgaacccagagcgggcgggcacatccctcgttccagctgcgacacggtgaccacggctgggcctgtggaatcgggcgggtacaggatgccagagggcggcatctgagtctgggcggcggcagcatggagcaggagggccagggccaggctgcagtgtacgcccggcatggcgataccaggacgggggcacgatggggccgttggggggcgcgcccgggccttccagacccacacacgaacttggcacctcattacaggtgggtaaggctcattgggtcgcgctgggctatccagagcccgggagggtgggagtgctgctttccgacatggaaaccattcggattcgaaatcgctcagacccccccgcctgtcggagggagcacaccccgcctacgctctcaattcccagtacgagcgtgctgcaagtaagcctcccctgtcagggtattgttacattccacgtgcagtggcgggtcagtcctcatgcggtcacgatgggagggggggcccccggcggcggcacagggactctcggccgcttctgggcgtcgtcgccgccttgggccccctgggccggccgcttgccggcgggcccgccctcccccctcgtgcccgcctgggtggggtccatggaggggtaggcggccgcgggccccgtccccgtcgggaagccggctcccgcgccaccgcctccacccggggcaggcggcggcccgcccgccgccctgcccggctgtgggcgcccccacagcagcttgcacctctggcccttgatgatcagccggttgctcagcgcctcggccgccgcctcggccccctgccgcgtggtgaaggtcacgaaggccacgcccttgctctccagcttcttcaccgacttaagctcgccgtgggtgtagaaaatgtcgcgcaggtcggcctcggaatgctcgggtcccaggccgccgacgaagagcgtggcgatgctcgtgtcctcgggcggggtcagcttctgcatctccgcggcacggcccagcatcttctccgccacggggtcgtttacgccgtagtaccggtccttaatgttctgcttggacagcgggccctcaatgggcatctcgtggcggtaggggcactccgcgccacgcttgcacatgcccttgacgaagaaggagcagatcttggcttggttgcgctgcgacgggagaggcaaaagggggggcgggggaggggtgtcagcgctgctgagctgtcgacctccctgagggacatgacgcaacagtgtccctcctgctcgtcaaaaagagccccgggctgcttggtctgcgagcccagctgatgcctgcaccggtccaagcacgcaaggtgcacagcacttctcagcccccttgcccgcccctttgcaatgcctgcagtcggggtcctgaccccaaaggtcaagcagccagtcacattccacccttactatactgccagatgctcgtccaacccccacccccttccctcgactcccatccacctgcgcctcaccttgtagtagggggtggtgcgctnnnnnnnnnnatccaatccccccccttccctcgactcccagccacctgggcctcaccttgtagtagggggtggtgcgctgcagcttgaccaggagctccggtgcagtgggggtgtcaaacttggagtggtccagctctcccgcgtccgacatgcgctgcagggcatactccttgcccgcgtcgctggcggggagctggtcggcctgcatgcccagggcctcgtcccggacttgcacggggaggttgtagtccaggtccagcaggcagcactggcacacattcttggccttggccacctcctggcagatgatggtcttcttgtaccgggcgtcgttcccggggcgccaccggaacacggtgtatggccggcccgagatgtggcaggtgctgccgtagtccatctgcgcgagggagagggaggatgacgtgcagccgaggggtgtcgagggcactttgcgagcaggtccacaccgggcggagcaggaaacccaccctccggcccaagcctctcaccctctgcatgcgaacgtatggattgggacccaggcaagtctcgcagatgataggaaagtccttgcgctcccacccatctgcctccgggtcctggagcagacggtgcgccatgagcaccctccgggctggggccctctcctttgcctcctccctggcgcnnnnnnnnnngcggtgcgccatgagcaccctccgggctcgggccctctcctttgcctcctccctggcgcctttaatgcagctgggagagtctttacccgagtttcctcttacaagaacggttttgtgggcctctcgtaggccgaaggagccttacattcgaggtggttccaggcacatgcacgatctgcagtgccaccgtggcagcacatgggtccattctttacaggtgaaggaacaggnnnnnnnnnnaggagtctttacccgagtttcctcttacaaaagcggttctgtgggcctctcggagttcgaaggagccttacattcgaggtggttccaaggcacatgcacgatctgcattgccaccgtggcagcacacgggtccattctttacaggtgaaggaacagggataatcattactgcacagaccagaggaccctggataaagaggccgggaatgaaatgggcggacgtggctggggccaagcgcggcgcctgcgtccgagggtgttggtacacgggagcatcgccctccaccgccgagccatctcagtcccacgcctcgcgcgcccgcgtcagctgggccacggccgcccggctggcgtcgtgcagggcctgcagctgctcgtggtccgcggccagcgccgccagttcacaccccagcgcgcgcagcatgcggtccgcctcgcgctcgccgaagcacatgggcggcttgaacttgatgaccgagccccagggcccctcggcgctgagcaggacgcggtgccgcgcggcgcagcgcgcgcgcagcgcggccgccag

SEQ ID NO: 32327 - DNA, 105 bp, Chlorella protothecoides
gtggggccaagtgcatcctgctgacagcaacgctggactcctccccccgccaaagccgctgctctgcgcctgcctctctccagcactcacgaaagcggttggtca

SEQ ID NO: 32328 - DNA, 78 bp, Chlorella protothecoides
ttgtgccttcggctctgccttgccggacatgggcatgcaagtgtgaattctggcccctccttctcgccctcccatctc

SEQ ID NO: 32329 - DNA, 154 bp, Chlorella protothecoides
aaggcggggctggtgtccgtgggaatgatgccaatctgcagggccagggaaggacggggtgggtgcctcatagccgtaggtccgacaaactgtcccacagcagggcatggtctgattccataagtagaatacattactgcatcgctacctgccc

SEQ ID NO: 32330 - DNA, 73 bp, Chlorella protothecoides
gggggagcagggcatcagagggaggggctgggtgagtggtatgcaccgcccagcgtggcgagggggtggcaga

SEQ ID NO: 32331 - DNA, 103 bp, Chlorella protothecoides
atgaaaggtattggaattcgcaggtagactcttgtttgagaccacgtggatgtggcgccgccgccgagcggaatcacagggtgacgctgagacgagcggcaaa

SEQ ID NO: 32332 - DNA, 61 bp, Chlorella protothecoides
tcctggagctggtggacacggcggggggggggcggcgcacgcgcctcgacgcgcatgaccc

SEQ ID NO: 32333 - DNA, 159 bp, Chlorella protothecoides
gcaaggactgacagtcggcgccgtcaggaagcgcggagcatgcagaggtggctcgcctgccagtagtggtggctgatccagcacacggcgcatgcctggacggcggcgaggcacgccatggccagcctcacccgccgcagaggtaccgtcttgagcgcc

SEQ ID NO: 32334 - DNA, 96 bp, Chlorella protothecoides
gttctctttgcgccggagggtgagtagccctcccagtgggcacacggctggacggtcacctctcagaagtacagcaagcatccactcatgcaggcc

SEQ ID NO: 32335 - DNA, 101 bp, Chlorella protothecoides
aactggtaggacctggggtcagggattgggaatgcagttggaacacgggtagagcagggcaactcccgtcggccagagcaccagaccccaatcagttcatg

SEQ ID NO: 32336 - DNA, 129 bp, Chlorella protothecoides
tgttcccctgtggcaggaccctggtagcaggtggcgcagaggaacaaggagccaaagaaactcatcactaacagtcctgggtagggatcgtacatcccaaaacatatccctgccagcttgagtagcaag

SEQ ID NO: 32337 - DNA, 107 bp, Chlorella protothecoides
ccgccccctcgtgccaggcactggtggccgtggagtgcctgcgcaaggggcagaccgcctgcaaggcagacgggcaggggaacattggcgccggaaacatcggctgg

SEQ ID NO: 32338 - DNA, 75 bp, Chlorella protothecoides
acaaatacaaaagccgcaagtggatttgtacaccttcaatcctaggagacgatacttcaggagagagacgacacg

SEQ ID NO: 32339 - DNA, 63 bp, Chlorella protothecoides
tgaggcaggccgcaaatgaaactcgcccatcttctccaccacgcacatcctgttccagtttgc

SEQ ID NO: 32340 - DNA, 61 bp, Chlorella protothecoides
atgcaaagctgcaggcgcagaggcagcgggtgcatagggcgtgcggggtaggcagggaagc

SEQ ID NO: 32341 - DNA, 61 bp, Chlorella protothecoides
actattccatcatgcccatgagatttcctgcagctcatgaaagtggtggttgtgctgtcac

SEQ ID NO: 32342 - DNA, 61 bp, Chlorella protothecoides
tgaaggccgcggactcggcgcgcgcggtggacgccctgcgcgcccgcttccaggaggccat

SEQ ID NO: 32343 - DNA, 129 bp, Chlorella protothecoides
gggcgacgtgctcccccgccagccccccaccgaggcggcggcgtaggcgtgaggcgggcctggtcatgatgcggggggcttgttggattcgatgggtggatctccgtctgtcaaaccgagaggctccat

SEQ ID NO: 32344 - DNA, 76 bp, Chlorella protothecoides
ccacctgcagcagaagagcaagtatcatctactgtgctcaccgtggcccccataccatctgcatgtaggtccaccc

SEQ ID NO: 32345 - DNA, 61 bp, Chlorella protothecoides
gttgaaactcatgcctacacctgcaccccccttcccaccttggtgaccctcctggcgaggc

SEQ ID NO: 32346 - DNA, 64 bp, Chlorella protothecoides
cctctcaacgtctcagcgcatgcgcgcattccacggcgatctgctcacccaacgtcaaacttgg

SEQ ID NO: 32347 - DNA, 113 bp, Chlorella protothecoides
gcttaattatatatgtgtatctagggggggagtgcagtggcccggggtttgggttttcctcgcccaaggggcacgcatcgtgtacctggaaccatcccgtgacccctggaact

SEQ ID NO: 32348 - DNA, 79 bp, Chlorella protothecoides
tggagtcggaggtggcaatgtcctgaggagttgggacgtgtatgattggatgggtgggagggggcatccagagggtgct

SEQ ID NO: 32349 - DNA, 72 bp, Chlorella protothecoides
ggggcaggtccatgtgaccggaccagccggtgaggagtgtggagtgcatctggtgcctgctcatgccattca

SEQ ID NO: 32350 - DNA, 67 bp, Chlorella protothecoides
tcttgccatactctgaggcaagaaggttggcaacaatgcttgagcagttcaggaggagcgagcatcc

SEQ ID NO: 32351 - DNA, 61 bp, Chlorella protothecoides
gcttgagcagttcaggaggagcgagcatccaggagcagcagggagagcagcggcgggagaa

SEQ ID NO: 32352 - DNA, 69 bp, Chlorella protothecoides
gggggggggggggggggggggggggagccactcctgatcttgcgccctgtggctctcgggcaccaccac

SEQ ID NO: 32353 - DNA, 71 bp, Chlorella protothecoides
ggattgcaaagaccttgggagtgctccagattgtcgaggagaccagaacagctgcgggtccctccatcagt

SEQ ID NO: 32354 - DNA, 142 bp, Chlorella protothecoides
caacctcaccacggcccaggcaagaccacagggggtcggggcagggcctggcgcgaggcactggggtggcaatcaggggggggagggagctgtgcgaggcccgcacaagcattgcttcaggtcggtgtgatgcccagcaact

SEQ ID NO: 32355 - DNA, 104 bp, Chlorella protothecoides
tcttcttcttgggttttacatcctcatcgctggctgatatctctggattttccttgacgggcttcaccgctgtcgctttgcgtttgggcgccatcctccccgac

SEQ ID NO: 32356 - DNA, 75 bp, Chlorella protothecoides
cctcttgggtcgggagcgttgagggcctgcacatttggttttgcaggggaaggggggaggagtggcccacacgct

SEQ ID NO: 32357 - DNA, 65 bp, Chlorella protothecoides
tgtgcatgaatgtgagcatacttatcgagtacattttggaaatctcctcaacccatccccccctt

SEQ ID NO: 32358 - DNA, 80 bp, Chlorella protothecoides
ccgctctggtcccattcctgatcccagggggtggacctccgcctgggtggccagggacccttgcgctgggtcctctcaga

SEQ ID NO: 32359 - DNA, 11536 bp, Chlorella protothecoides
  modified_base (223)..(232): a, c, t, g, unknown or other
  modified_base (392)..(401): a, c, t, g, unknown or other
  modified_base (2383)..(2392): a, c, t, g, unknown or other
  modified_base (2802)..(2926): a, c, t, g, unknown or other
  modified_base (3011)..(3020): a, c, t, g, unknown or other
  modified_base (4878)..(4887): a, c, t, g, unknown or other
  modified_base (5804)..(5813): a, c, t, g, unknown or other
  modified_base (6413)..(6422): a, c, t, g, unknown or other
  modified_base (6828)..(6837): a, c, t, g, unknown or other
  modified_base (9599)..(9608): a, c, t, g, unknown or other
  modified_base (10264)..(10273): a, c, t, g, unknown or other
cctgcgctccgtacatgccctggcctcccagacactcactccaaccccacattgggcccccctttcctcatcaccagaaacccggacgcggaggtgacgctgacggccaagcagatgcctaccgtgcaccgcctgattctcaccggtgcgcccatccagaaccgcctgaccgagctctggtccctcttcgactttgtgttcccgggcaagctgggcacgctgnnnnnnnnnnccgcgtctcctgccgcgccgcccgccgccgtggcctcggcgtcggggctgcggccccgcgcatccgcctccagagcatctcctccgtcggcgaccccagccgcgtcgccgcccgccccgccctccaccacatcgggccccgggtggtggtgcaggaaccnnnnnnnnnngggctgcggccccgcgcatgcgcctccagaccatctcctccgtcggcgaccccggccgcgtcgccgcccgccccgccctccaccgcatcgggccccgggtggtggtgcaggaaccccgcgtcgccgaagatggcgctggtctcggtgccgtcctggtactcgccgcccagcgtgaacaggtcgtgcatgtcgcgcgccttgaagaagcggcgctggcggggatcgcgcagcaccttgtccgacaggaactgcttgtacacctggcggtggtagatcttctcctcaatcgtaccgctggtaacgaagcggtacaccgtcacgtcccgcgtctggccgatgcgccacgccctctcccgcgcctggggaggggatgaggatgccgggggggggggggattaaacagagaagagcatgcagaaatgtcagatggtcaggacggtgcgatgccaatccatgggctgggcgccaggacctgagacgggggcgacctgcctggcgtggtgctaggcgacggggttcccttggcacccaacgactgatgcatgccatgatcagcgcaggccctcccaaagcacctcggcaccccagcagctgccgcacctggacatctgttgaaaaattccagtccgggtcgaagacgacgatgcgattcgcgcctgtgaggttgacgcccaggccgcccacacgggtagtgagcaggaaaagaaagactgcgcatgtggtaaggggtggatttgggctgggtgcatgtgtgtgccatgccgtgggcacatcaagacaggaagacaggatgctctgcagtagcaggtcccacgcggtggtggtgggcgccacctggcacagctcgggtaacggaaggaaggcgaggccaatgtgtgaccagcatcaacccacgataacacgcacaacatcacacacaccattggggttgtcgttaaagtcgtccatgaggagggcgcgctgcgagacggcggtggcgccgtccatgcggtggtagcggtacccttcggtgttcacggtcttctccacgatgtccagcatctgttgcgtctgggtgaagaccagggccctgtggcagagagaggggtgcgagggtaagcatcagcggactgcatgagactatgtgaaggaggccacacagtctggtaagcagcgtggtggcgggtaccggccttccacccaaatgtttctctggtccaccccccggcacctcacttgtggccctgggcatgccagtgcttcagcacgcgtgccagcaccaccagctttccacttcgctcctggttgccatagtcctgcaagcgggcattgtgttcgaggggagagaattgaatctgtggctgcaacatcgccatgcagtaccctccctgaaggcagcacccctcagcccagagtcccacggatcgaggcgcagtgtatacaggatggtcacccgccaaacgtacacagtcatgcaaggctgtcattcaaccctcctgggacacctggcacccctccctcactccccatcttccccacacacctccgaggcctcccagcgcgcccggtccagcaggtctgggtggttgcagattttgcgcaggatgtcgatgcccgccagtgccgcccggtgccccgcgaagatgtccttcaggtccttgctggccaggtaagccttgtataggtcgcgctgcaccggggtcaacatgcagaacagcacctgcgcagaatgttggtgaggggcagggggtgaggggtgcgttccattggacggaggggcagcctccttgcattgtctagatgagcctcatcactgcagcatggctgatcacttccagggcaccgcgcagcgcctggcatcagggactcactgcgaattattaaacaggcatgtgctgtccctaagccgaccatgaaccacacgaccccaccccccaaaccccaccccaccacaccccaccatcaccaccgtgcctgctcggtcttcgggggcagcgccacgnnnnnnnnnnggaattattgaacaggcatgtgctgtccctaaggcgaccatgaaccacacgacccctcccaccataccccaccacaccacaccatcaccaccgcgcctgctcggtcttcgggggcagcgccacgtccacgtcggccttgcgccggcgcaggaggtagggccccaccacgtcccgcagcaccaccgcgcacttgtaggcggtggagacctggagggccgaggcattggcgtagcccccgatctggatgggcagcccgaactgagcctggaacaccggcagcgtgcccagcttgcccgggaacacaaaatcgaagagggaccagagctcagtcaggcggttctggatgggtgcaccggtgagaatcaggcggtgcacggtgggcatctgcttggccgtcagcgtcacctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaagaattgcgtgatgcaaccagggtctcattccccctcctcttcttcccttccccccccccatcatcacatccagctcccannnnnnnnnntgggaggattgcgtgatgcaaccagggtctcattctccctcctcttcttccctccccccccttcccatcatcacattcagctcccaccttgggtcccccccacccccccaaaaaacctgatcttgtggccctcatccaggattacgtaaccccagtccacactcagcagcagctcgcgctgcagccgcatgtgctcataggtggtgagcagcaggcccgcggcactgcctgccagctcgctcaccaacgcctgcgcgccgcgcgcgccccccgccaggccgtgcatgatgccgacgcgcaggtccggcgcccaggcgcgcagctcgcgcagccactggcgcagcactgtggcggggcagacgatgaggctggggcgatacaggccgctggccagcaggcctgccaggaaggccccgatctgcaccgtcttgcccagccccatctcgtcgcccaggatgccgccggtgcggtgggtgtgcagctcccacagccacttgaccccggtgcgctggtactcgaacagccggtcgtagatgcctggtggagggaggggggggcggagacgggcatggccaggaaggggagggcatcatatcgaactgcagtgaagggctgctgctgcagcgagtcaggaaaacaagggtgatggagcatgcggatgcggctgatgccctcgcaaccccagcccctgcctcacgagtcttgcagctccttgcgctcccgttcccttcctccccctccaccttgcaacaccacaccgcaccacacctgcggagatgcggaacccgccctcaaactccaccagggcatcctcctccggctccgcctcgctgccagacccgccctcctcggcgaccccccggtcccggcgccgcgctcgcgcggcctggcgggcgtcaaagttcgcctcgtcggcgtcgtcgcgctcgccgcccacgtcctcacccgacgacgcgctttcctcccgcgggccacgcagcttgcgcaggcgggggcgccgtcgccgcttgacgggctgcacgtactcggagttgccctgccgccagtacccctcgtccacgcgtctgagggtgggagaagggtggtcgtgcctgtgagatgctcccggtcccaactgatatgtcaaacacatttcccatggcactgcattcgcaggagggtggtccagacgcacacgtcgcctttcccgcacccccattcccctactcctgaagcgcacttggtggggcgttcctgctgaggcaggtcctgggcgtccagcagcctggtggtgtggcgggcagccttgatgctcgccagcctggcggccatgcgctgggcggcctcggaccccggctcctctgctggaagtggatgagggccccagggagatggtatcccaggggtggctgctgccatttcaggactacctgacaggcatatacatccttgctgcatgcatcactggcaccctcgtccctgcacattctgttctcctcccagcctccaaccagcaacacgcctgccaccacagacccaccttctgggctggcgcggcctgaaggcccagccttgctgtgcatgactcgccgctcaaatccattcacgttgtcaaagggcgtcagcaccccctgcagcatgcgacattgtgagtttggtggagggtctaatgcagagctgggacacgcgtgtgacactgaacactgcgacaatgtgaatgtcacctgactgcagatacgttgcaagcctgcccttcccccccccaccccccacccccaatgccatcaaatatactcaccaggcggatgaggcggtctcgatccgtctccaccagggcgcctgagctgcccttcccctccccttccgagaagaggtcgtnnnnnnnnnngcggatgaggcggtctctatccgtctccaccagggcgcctgagctggccttcccctccccttccgagaagaggtcgtcctccaccagctcttcggcggcagccttcccttttgcactggatcgtgcctgcccaggcacagcctgggtcttcgggagcccctctcgctcggattgtatcgaggtaggcgcccctgcatcaccgactcgaggccgcggaaggccagcagcctctagctcgcagccagccctgtccaaggctgcctgcagtccctcctggcgctggcgcatgagcgaagcctggaggccctccggcgcctgggaggacaccatgctctgtatggcctgcaactccctggcagcgtccttgtagcgagcgaggagtgtttcttgatcgacagagtcatcctcgttgtccatcatggagccgggcgcctatgtgaagggattttggggccggtatgcgagaaagtcccagaatgcgcctcttgtgaggacacaacctccacacgagatcaacacaccctgcccctcctactcctcgacacctgattcagcaaagctgcttggacttcatccacatccaaggctgtgatgcccagtccctccagcccctcgccactcgacgccatggtggcgaagaagagactggtccaccactaaatgccggaacgcacttctcacgacatgcctgctggtaagcgaggcacactcaatttcaatgtatcggctgatactattatcaattatatccacgaatacatgcgctgatcaatgtgctctgtttcggcatgcttcgccatgaagtgtggtgaaggccccttcgctcccgtgcagcattgcgcgtggtagcgcgggaacgcacgaaaaagccgccctggagatggggaaccgagcctcgcgcgctcagcccagaaagnnnnnnnnnntggccccttcgctcccgtgcagcattacgcgtggtagcgcgggaacggacgaaaaagccgccctggagatgggaaaccgagcctcgcgcgctcagcccagaaagcctagggacaggaggatgctgctctcccatcttgtgcccgcctcctgaggtaaagtcttgagttttctcgcgtgccggataccacaggtgcacttgaggggcatactcggctcccgtatggtgggcctcaagaaccgatggggagacttgctggaggatgaggaggagctcccaccgacaacaaccaccggaccagatggaaagggcatcgtcgtccgcgtggagtactcccgcaacgacaagggcgacgtgatcaagaagaccacccgcaccaaggtggtgaagattgagaagaaggtctacaaggtacgcactgcgagcgagtgggtaaagagcacatatgcttgccagaatgctgcgaggagcacagcgtggaggtgctgaggatgctgatccgttgccagcctccctcgctgggccatgaacccctgccttgctgctcttccattccccacgcaccatacccctaccctcccacccccccagtcggccgtgnnnnnnnnnnagctgggccatgaacccctgccttgctgcccctccattccccacgcaccatacacctaccctcccacccccccagtcggccgtggagcggcgcgagggctggaccaagtttggcgacgccgcgtccgagcgcgcgtccgacatcatctccgccaaggccacggaggacatcccctttgagcgcgtgcggccgcagaagcagacgcaggaggacaagggtaagatggacttccagaccgccatggccggctccgacaaggccgccatcgtggggaacatcaaggacatgctgtacaagcggcgcatggagcgccagctgctggaggccaagggcctgttggcgcccgcggagcggccgccgggcgaggacgacggcccctccggcctcaagacctctggcacgggcnnnnnnnnnnagaacggccaccgggcgaggacgacggtccctccggcctcaagacctctggcacgggctgggtggcgccctccatgcggcagcgcctggccggcggggagaccatggagtccctggcgctcgtgagtggccattgttggttgtgggttggggagtcctgggggagtggttgcctggtgaggaggggtgtgggcgtgcgttgtttcgggagggtcaactgaggagtgtcgagcctggttggctgttgagggcaggaaggacacagccttgttcaccctgcgccgccacccaccgcagaaacgccgcgacgagaacagcgtgagggtgaccaacctgagcgaagacgtgtcggaggacgacctgcgggaactgttcggcgcgtttggccaggtgcagcgggtgttcattgccaaggaccgagagacgggtgagtgcggggtcggcaggaaaaggggagtatggatgtggttatttggaggaggcaccatgggactgctggtctgcaaaggggcaaggatgctcgacaggaggctggtggtacagtgttgatgtgcctccccacatcgcaccaatggtcccaccccgccggagcctgatggttgtcggacctccttccaaccctccgtccccttccacacctgcaggcgagtcgcgaggctttgcattcgtcaactttgtgctgcgggacgatgccgtacgggccatcaacaagctggatggctttgggtatgacaacctcatcctcagcgtcacctgggcggcgccgagggagccccgaccatgaagcatttgtaaaagtacgatcactggtgtgcatacagacatgaaggagtgggaagtaccaactaggacggggagttggccaaagggcaggtgatcctgacggtacagaatatacaagctgagaggagggtgccatggcaaggcgggtctgaagaatggttgtcacggcgcggtctgcaggagggactggcgcgactcagttgaggagggttctagtgcagcaaagaagagaatcaagctgcattgcagggcgtcaggaacgaacatcttcagaggcgcagcttcttggacagccgcgccttgatggacatggcacccgccttgcgcgccgccggcttggggacgggcgtatcccgcacgctggggctgggcccttgcatggcgaggaccctgggtcggggggcggcgccgggcgtggcgccaggccgttgctggggcggtcctggcaatgccaagggtggggggggtgagaggtcaggtttgagatggtttggcaccccgggagcaccaacactcggcagggccagcatgtgtttgcatggcgaggacctccaaagcgctggtgcacactctcgtcactcgagagcacagccaggtccggcctttcagagattctgcctcaacaagagactccacatgctccttcatcgttggaccacagcgctcaccgttggactcctcgaccaccacctcctcctcctcctcctcttccctggcgtccggcaggtagtcgctgcccgggtcgtcatctctgccaggcacgtcgccttggtgtgcctcggccaggccaggggcacgcagcacgtcgtcgtcgtcggagctggcctccagcgcctcggtcgccttcagtggggtcagggaccagcccatggcgatcacgcccacctccagcgccgccacgattgcctggggtaccgtgcagcggaggtgtggatgagtgcacttggccctaagaggagggttgcagtctggcgaggacgcagaccccagtctgcccaagcccgaatgctggatgtcgggctcccttgggcagcactgccgggctgcaggagtgcaaagcacggctccactcctcggtgcaacctatgcattccagtccccctttccacccacacccgcccacctttgggtccgcgacgctcagggggacgtcgttgagcgccgcggggtgccgcagccaggtgcgcagggaggaaagcagggccgccagggccggctgcatcctcggccgcgctgggacgtccagccagacggggtccaggtcgtcctcaggcggggcggggctcagcaccccgtcgcccgggtctgcaatccctggtgggatgtgcactggcaacagggcttcaggctgctgcggtgctgcgtcggtggggtcttggccatcggccttaatcagtcgcatgtcgccggccgcgccgtcgcaggcggcggggccttgcctggtctccagggccagaggcggcctgtgctcgccagttgcatggtccgcggcatccatgcgatcgacgtcgccaccgactccaccggcgtcaccccgatcagctttcatgatgcacactgcctcggaggtgctcctcaccccatcagccccaccttcgccagcctcctcgtccgacgctgcgccaaagagctcgtcatacatggcttccagggcgtccccccggggggggtcggacggcgaccccgccgcgccatccacctgcgggatcaggtgcctgccccccagcttcaggcgcagggtcgttggcggcgccgccgcgcctgggggggggcccggctccgccagcttcaatcggacacggaggccggtggggggggggcggacgccggcgcctggctcgtctccctggctcctgttgctgaaggagggacccctggtgctgcccatccacggcgagcccccggcatcactccctccggcatcgctccctccagcaccgctcccgtcgaattgagacgcaccgctggcgcctggtgaannnnnnnnnntgtcttcctggctcctgttgctgaaggaaggacccctggtgctgcccacccacggcgagcccccggcatcactccctccggcatcactccctccggcatcgctcccgtcaaattgagacgcaccgctggcgcctggtgaagcattcgcccccggaactagcacgtcgcggtcggcgagccgtgccggcaggcgccgctcccgggagggcagcgcgtgcgggtccaccctccgcatcggtccaaggtgggcagcagcacgccgagccgacgcacggcgagcagaggcacgccgcgtggaggtacgcgcaccgtcgccccagccctcccctccgctgctggcaggctcggacgacgcggtgctggcacccccgccgccctcgctgctggtggctcccgggccccagtccgcatcctcctcgccccagctgccggcaccagcgtcgccgtcactctccacaaagtcgtcgccggcgcggcggcgagggttagcccggcgtgcaggaggcgctgattgccgcgccggggtcgcgcagcgcttgcctgctgtgagcctggcagcgcgctgtttgggcgcgctcttcttgtcgtttggggcgtgctccgccgtcacttccccctcccagggcactgcttcctcgacggcgccgccccggcgnnnnnnnnnncgcgcttgcctgctgtgagcctggccgcgcgctgtctgggcgcgctcttcttgttgtttggggcgtgctccgccgtcgtttccccctcccaggccactgcttcctcgacggcgccgccccggcgcaagcgtttcagtcgtccaccaggaaacttttgattcgaatcgcgtgcctggtcatgccgtggcctgacggtaagaccccgagggcctcccgtcctggcgcggcttccctcgagccctcctgcttcgccgccgtcatcgtcgctgctgtctgccagcacgatctgtggctagatgggaggcatcagaggatcgaggaactggcatgctgaggaacgatctgtccgcgccacactctggtgccttggtcccctcctacagctgcctggtcaggcctcgaccctgccatcaagcccttgccattgcacgaccctcgcacccaagtcgccaaatcccatagccccccacctgtgaccacccatcagagcagcaatacccgcacagaatgcaaccatgctcaccttgcgccggctgggcagtcgctcccgcgcaccgacctgctcgccggcagtccaggcctctgtcgacccgggctcccgaacacccctgcccgggcttggcagctgggcagccagggcgtcccgtttcctccgcgacacgcccgccgtgcgacgcaggacctcgctccagtaaagggccgcatgccacatggtctgcttgaacaggggatactgccgcgccgggctcaccgccagcgcctcctgcacaggtcggcgagggagacgctgggaatggacggggcgggggcggggccttccaggggcaaatgatctggtctcaggcacatgcgttaatctgcatgcactccagcagggcgccctgcagccgcacgcacgcccatgccctgcgccgtccgcaccctgcgccactcccatctcgatgcaccctttccagagtcaatgggctccgaatgtcacgttgcttacctccagccgccgcgcgtccaggtgcacgtgtaggctggcggccaggagaaagctgccccgtaggctgatggcgccctcgcgctccggcgcggcgctggccagcagccagcctggcgggacaatcagcgcatcccccggcgccagatccacccgcagcctccccggcgcggctacgagcgatgccagcgcctcccgcgcgccgcgccgcgcgcgcaccgacgcggcccagggcccccgccccggcggcagcaggcacagcgtgcggcggccggcca

SEQ ID NO: 32360 - DNA, 79 bp, Chlorella protothecoides
cgtcgccagctcgcgcgtcggggccagcactacgcacagcggcgcacgaccgcgcgcgcgcccctccgcgccgccgcgc

SEQ ID NO: 32361 - DNA, 71 bp, Chlorella protothecoides
acactggctgcgcaacgtcccttcccagatgggctgcagccgtcgcaaggctgtccacctgcttgtcaccc

SEQ ID NO: 32362 - DNA, 77 bp, Chlorella protothecoides
gagtgcgagggggagaagggacctctccaggcaacacagcggcagtgcgcatgacacccgctcccgggcgccggggc

SEQ ID NO: 32363 - DNA, 76 bp, Chlorella protothecoides
gcgtgggcgccgggctgctgggtccctgtacttgttttgaagacccagtggttgatcgagccctgaagcctataga

SEQ ID NO: 32364 - DNA, 73 bp, Chlorella protothecoides
ggtcatagtgatgccgtcgtggtgggaatagtgtaatgccgttgaatcagtgctgcatggcttcatgtctgag

SEQ ID NO: 32365 - DNA, 103 bp, Chlorella protothecoides
actgggtccagggtcatgtaatgctcccgcgtcgtcatggaaacactcaccggggcttgcgccggcagcaatggccagcagcgcgagcaccaggaggcttcga

SEQ ID NO: 32366 - DNA, 62 bp, Chlorella protothecoides
gcaactcccctgctgccatctcacatatggctgctacagagcacgccgcaccatgcacaacc

SEQ ID NO: 32367 - DNA, 61 bp, Chlorella protothecoides
atgcactctccaacggcaaattcgaaaatgtgactgcccgaggacgcaggccatgccacgc

SEQ ID NO: 32368 - DNA, 76 bp, Chlorella protothecoides
ctgtgcacccaccttgagcactgtgccaaaattggtgtactctgcagtaaagtacacggtctctgtgtcataaatc

SEQ ID NO: 32369 - DNA, 71 bp, Chlorella protothecoides
tgggcagcggtcggccagcgtggtgcctctcaagagggtgcatgaactgccctccctgatatcccacacaa

SEQ ID NO: 32370 - DNA, 89 bp, Chlorella protothecoides
atgaactgccctccctgatatcccacacaagggtacaagtcccccttcctagggccccgccccacgcactcgtggataggtgccgtggc

SEQ ID NO: 32371 - DNA, 61 bp, Chlorella protothecoides
catcagtgatgttggtgaccagtggcaggggaactgggccgcggcaatatccgactgctcc

SEQ ID NO: 32372 - DNA, 61 bp, Chlorella protothecoides
gggtggggtgagagcgggtggggtgagagcaggtggggtgagagcgggtggggtgagagcg

SEQ ID NO: 32373 - DNA, 61 bp, Chlorella protothecoides
caagggcatgacggagtccgaggcgcacaaacgctactttgcgccggcggtggcgcggcgc

SEQ ID NO: 32374 - DNA, 1114 bp, Chlorella protothecoides
  modified_base (379)..(388): a, c, t, g, unknown or other
  modified_base (592)..(601): a, c, t, g, unknown or other
gcgctgcacgctgggcgagatcttccgaccgtgagcggggccaggctgtggaatggaagggagtgggtgtgaagggcggtgccccaaatggtagggctgtgaaggcagccggccgccctcctcttttgctagcggattgcgggcggcaagctgcacacctcttgggacagccgctgcccggctcactccctctattcttgagtgctgttgctcgtgctgagctggccgcgtgtacgctgtgactcgttgccagggaggccaaaggcagctttgcacaccaccccttctcttttgttccagagaccctcgctgcgtggcttgacctgatcgctgtgtgtgtgacagtatttttatagacagggacagggggcatgagttnnnnnnnnnncccaccccttctcttctgttccagagacccttgctgcgtggcttaacctgatggctgtgtgtgtgacaatatattttatagacagggacagggggcatgagttgcaagcgatgtgcaaatctattagatgcggcggggtaggcatggcatggcaagagaggtcgtggaccaaaaacacacaacctaacaggggacagattcttnnnnnnnnnnggcaaatctattagatgcagtggggcaggcatggcatggccagaaaggtcgtggaccaagaacacacaacctaacaggggacagattcttcgggtcatggcctccacgctctcccagctggggtggtgggtgccaaagacggggtagcgccgtgcgcttccgcatggcagctggtcccatggtggcgaggggtgggtgcccctcaggccttgcaggtcaccgcagacggccagtcgcagttcttggtggcggggttgaagagcgtggtggcggggcaggccatgtagtaggcgccgctggcaccgcagttgaagaagccctcgcagccgccggcaatgtcggcaaagaggccggtctttccaccagagcagccgcaggtggcatccttggcggcgcatgcggcgggagggggggacttcttggtgctgggagagggcgacttcttggtgggtggggggctcagtttcctggagggtgggggtgggggacttcgcagcaggtggcggcgatgca

SEQ ID NO: 32375 - DNA, 65 bp, Chlorella protothecoides
ggagctgcggcggattgggaagggggagctcggggacgaggtgacaggtgggcagtgggtttggg

SEQ ID NO: 32376 - DNA, 99 bp, Chlorella protothecoides
gctgggcacagatgcatggcctgtgttggggctgccgccgatcttggtccctgccctggcagagagcgggccaggctccatctgtgggcgccctagcac

SEQ ID NO: 32377 - DNA, 96 bp, Chlorella protothecoides
tgagtgcacctgcgcactcgccgcacccacgggccacgcgccgcgccgactcaccgatccccgccctcccactggccgatgtgcacagtggggcac

SEQ ID NO: 32378 - DNA, 61 bp, Chlorella protothecoides
aggcctctgcaccattctactatggaatacacccagccatatcatcaaccttgcagcttcg

SEQ ID NO: 32379 - DNA, 154 bp, Chlorella protothecoides
ggagccccaagccacagggctcctttgtgctggtggatgcccaaatctgctccagcatgcgtgaaatactcccttagcccccgccacgccactcgacatcccacaggtgatgctcaacgcgcgggaggtgaagttccccaccaagccagccatc

SEQ ID NO: 32380 - DNA, 221 bp, Chlorella protothecoides
cggcggctgctgcggctgcggcggctgacgatgcagtgtcaccgatctgtgcatgtaggtgggatgtggggctcgtgaatacatgtgtagctgtgctgcccatttgtcatacccctggccgccccttcaagggtgcgagaaagtagcattgtcaaaccactgccgatctccacatactgacgcattcccagccctcaccactcacatctgggcggtttgcg

SEQ ID NO: 32381 - DNA, 131 bp, Chlorella protothecoides
gcgaggcgagtgggtgggtggttgagtgctcgaaacaagggttgacaatggcgcgtgactcagctctgacgtcgagcgggtgcccccagggcagggcctggcacctgtcaggctgcatgcagctccggggg

SEQ ID NO: 32382 - DNA, 76 bp, Chlorella protothecoides
gaaggtgcgcagggcgcggggcttgcgtttaccggagagagggtctggcgagggacggcatgcagggcattcaccg

SEQ ID NO: 32383 - DNA, 77 bp, Chlorella protothecoides
cgtatgacaggtccctcagaccatcgcctggcacaaaaccctgtccccatcccatttgccaacccaacagccccaca

SEQ ID NO: 32384 - DNA, 85 bp, Chlorella protothecoides
gctgctcattctagggccagcatggaccctttccagtctcctgatacttcttcccactcccacttgtccctcaccccgccttgcg

SEQ ID NO: 32385 - DNA, 19120 bp, Chlorella protothecoides
  modified_base (267)..(276): a, c, t, g, unknown or other
  modified_base (944)..(953): a, c, t, g, unknown or other
  modified_base (2413)..(2422): a, c, t, g, unknown or other
  modified_base (3549)..(3558): a, c, t, g, unknown or other
  modified_base (4201)..(4210): a, c, t, g, unknown or other
  modified_base (5174)..(5183): a, c, t, g, unknown or other
  modified_base (5429)..(5438): a, c, t, g, unknown or other
  modified_base (6480)..(6489): a, c, t, g, unknown or other
  modified_base (6964)..(6973): a, c, t, g, unknown or other
  modified_base (7244)..(7253): a, c, t, g, unknown or other
  modified_base (8527)..(8536): a, c, t, g, unknown or other
  modified_base (9300)..(9309): a, c, t, g, unknown or other
  modified_base (10199)..(10208): a, c, t, g, unknown or other
  modified_base (11379)..(11448): a, c, t, g, unknown or other
  modified_base (11874)..(11883): a, c, t, g, unknown or other
  modified_base (13976)..(13985): a, c, t, g, unknown or other
  modified_base (14216)..(14225): a, c, t, g, unknown or other
  modified_base (15622)..(15631): a, c, t, g, unknown or other
  modified_base (15720)..(15900): a, c, t, g, unknown or other
  modified_base (16009)..(16018): a, c, t, g, unknown or other
  modified_base (17291)..(17378): a, c, t, g, unknown or other
  modified_base (17914)..(17923): a, c, t, g, unknown or other
  modified_base (18652)..(18661): a, c, t, g, unknown or other
cgccgcgccgcgcgctgcgccagggctcctgcgcgccgccggggccggcgcgagcgtcgtcgtcggcgctgccggtgccgccctcctctggccagggcaggaacgtcgccgcgggcgcgaatggtgcaggccctgcggcccctcccgaattcgcgagcgccgcgaccccggggccctctgccgcttgcaccgccccgagcccctgttggggcaggccctcgtcctccaggtcagtcgcctcgtagtcgctcagcgtgggcgaggggnnnnnnnnnngattcgcgatcgccgcgaccccggggccctccgccgcttgcaccgccccgagcccctgtcgaggcaggccctcgtcctccaggtcagttgcctcgtagtcgctcagcgtgggcgaggggtggggcagcgggagcagggccgggaagcttccctccgaaacagcgggaagcaagcccctgggcatcaggcccaggtccaggctcaggggtgaggccaggtccaggctcaggctgctgtgctgcggggtgcctgcaggtggtggaggtggtcggctagagtggtggcttgcctcgttggctggaaagccacacacctacatgtgcacatggttcaagtacactgggcaaggggagagccgcactccacccacttcccagcccgcccacctaggagcaagggggtcagcgccggtgtggcagggggcagccccgcgccgcagaccgggccgggggcccgggccatggccgcgatggcgcgccgtccgtccagctctacctccatcaggagcttcttgcccgcccgcagcatgatcagggcctgcagaggacaggtgtgaaccagcgagggggtggtcggcatcgagaccaatgctggcatgccctgcacctgtgcgtccctgggaagacggtcggcaacgagcacagtggattatagggatctggcagacnnnnnnnnnnaggtgctcggcatcaagaccaatgctggcgtgccctgcacctatgcgtccctgggatgacgatcggcaacaagcacagtggattatagggatctggcagacgccaaaccgcactgatccacacccgagccccacaccatacgaccagaccactcaatcctcccaaccctcacccccacctgcttgtggatgcgggagcgcttctggttgtagcgcatggcgttgctgcacagcagctcaaagtcgcgcacaaagtcgccccaacaggtataggcgtgcgccgccaccttggcgcgcatggcctggatgcacatggggtgccggatgatggaggagtagcctggggcctggatgtcgctgacgggggcctggaaccagccctcggagtccagggccgccaggcgctgcagcagtgccagcagctctgcctcgccgctggtgcccagggcaggggctgcaggggctgcagggggcttcccgagggtgtcgggcaccccaggctcggctgccgagccatttgggggacccgagtctgcgtgcgtgtccgctgaggggataccaggcaggtcccgggggctgggggggtcgctctcgctgggggtggaccctgatggcgacggccccagcgcggctgggatggactgcggcgacatgctgctgccccaacccttcagctcgcaggagatgaggtctttgagcgccggcttgaggaagcccgcgctcacactcttcaaatccgcgaccaccatcgggccatctgacggacactgaggccccgaggaagcgacggcggctgtctcaacccgagctccggtcgggacatcagtattttccatgcaccgagggcatctcgggcgaacaacaggagctgcgcctgcctgcacaggttcgggagggacttggccgggaagacccggggatccaaggagagggtttggcccgctcgaaatcgttcgacgcgcccccaaaacaaaggtatggaggtgtagaagtggtcgagaaggtcgactcagcgacacatgggttctccaccgtattcaatggttacgtacacgcgaggtgtagcaaaaggcaccaccccgggtcaaatcgtgcacacctaagccagcccttgtgagcatgtgatggttcatcctcgtgatatagagcccggagaggtctccaccacgacaaacacaatgtcgaggtgataaagaacagacaacatgctcccgacacagggatggaggagtgcgacccctccattgggggtccccaccctgggagccccacggtgcagatccgctgctcatgcaagacatgtccgtggcagatcctcaaacaatgggtcaatcgatgagaccggcgatgagatacccctcagtgtcccccagccggagccctcaagacgccaggtaacttcccatgagggtgtcggagggatcttagggccagatcgctggagcgcgtgccctctgcagnnnnnnnnnnaccgcagccggagccctcaagacgccaggttacttcccatgggggtgtcggagggatcttaggtccagatcgctggagcgcgtgccctctgcaggcattgccgcccttcgacggggcatgcagacctggcagccatgagaggcccttgagttcatccctttgccaggtcccatgtcgcctcatagccggcctggcgacggcagggtgtctggagaccgcgtacctgacgattgcccgatacaccaatgcccccgtggcctgccccatcgggggtggctgcgccaccgtcctcaccagcgagtggtccaccctcttccataccatccccctctcactggcgggtgggtgcatggaatggcgcgagggctggacggggatgcacggctgcgcgtttgagggccgcgacccgctgtgtgctgcatgcctcttcagaagccatggcgcatgagaatggcagcctcctcacaccctcccaattgttcgtcgccgttgcctgcaatccccccctcattctggcgccacgcccacagggtctttgtcctacggggccgtggccggcctcgccctgtggcagctgacgcggcgggcttcgcccaccgcccctgacccacgctcgaccaagctgatcttcctggggggcgccctagccctctccaccaccagtgcctacctcctctacatcctgctcacccgcttccccggcgagtcctgctcctggtgcctggcctccgccgggctgtctttcggcatcgctgcggcggccgccagcgcgctgcgggcggaggacctggccgaggccgccggcgctgcgggcggcatcgtggccttcacatcgctggcgctggccgtgggcattgggcgccccaacgcctccgtcatcaccgccctcgactaccacgtagggaatggaagcaaataggcagggggggggaagacagggggcccaggaagaggaggagcggccgaggcttgacccagagggatcggacacggttgggtctggatgacagtgagaacgggtgacggcgtgcattgggagccgccatcgcatcccggcaagcgaagtctaaccccctcagactgccgccgcacgacgacggctgcgctgcgcgcgctgtgctcgaccnnnnnnnnnngccagagggatcggacacggtggggtctggatgacagtgagaacgagcgacggcgtgcattgggagccgccatcgcatgccggcaagcgaagtccaacccccctcacactgctgccgcacgacaacggctgcgctgcgcgcgctgtgctcgacccctggcacacgtggcccattctccctcacaggcccctgagatcaccacggagagctcgcaggaggcgatgtcgctggcggagcggctgcgagccgcgggggcccgcatgtacggcgccttctggtgcagccactgctacgagcagaagctggagtttgggagggaggccatggcggccttcccctacgtcgagtgctaccccacgggctggcacccggtgcgcgacagccttggcggggtgtggggtgcggccgccacctgggggccggactcccactgctgcagcggcggaccccctcccgccggccatcgaacgacgtgggatggtgggattcgcacgcggcaccgcctgctcgacgacacccttccaacacctcctctcctcgcagggcatggagcccgacgcggcgtgcacggcagtgccggggggcctggagggcttccccacttgggtcatcgggggcaagaagtcggagggcgacctgacgnnnnnnnnnnaacagcattggcggggtgtggggttcggccgccaccttggggccggactcccactgccgcagcagcggaccccctcccgccggccatcgaatgacgtgggatggtgggatttgcacgcggcaccgccaactcgacgacacgctttccacacctcctgtccttgcagggcatggagcccgacgcggcgtgcgcggcggtgccgggggggctggagggcttccccacttgggtgattgggggcaagaagtcggagggcgacctgacgctgcagcagctggaggagcggctgagcgccctgggctactgagcgccgtgctcaagcttccatcctcccgcacagtggtctggagcttgccctgccctggagcgggctctcgttgtgctcgccatgctcagagccccgtgcctcgatctggctcctcggctgctgcttccccttgtttgccccttccatcgtgtcgaattcacactggagcagagcgttccattccggccagcagcacaccccacctccgtgatgcagcgctgcagcccgacgatggcatgcctccccgcattccgtcgagcgcatggcaagcacgccgtcatcgtgccacccggccggcgcgccctgccggcacagcctgtcgctccacccagtcgagcaggggaaggtggccggcgccgcagcgcttcaccagctgcccgccgaccaggcacaggctgagccgggcggcgcccaggctgtactggcagggcccccgccggacgaggggcaggtccaccccggcctccgcgcagagctgcaccaagccctggcagcgaggggaggcgggatatgggtggcaagtttgggtgcggcgcagtagtgagagggagaagcatcgagcaggagggtgggggggggcccctgtaaacggccaccggcaacagagactggcggatgcagggaggtgagggtttcccgggctgcagggagtgacannnnnnnnnngaggcggggtatgggtggtaagtttgggtgcggcgcagtagcgagagggagaagcatcgtgcaggagggtggggggggcagtgaacggccaccggcaacagagattggcggatgcagggagctgagggtttcccgggctgcagggagtgacatatcaggagcaagcatacccctctacagacctgccgccataccaccctgggccaggcccagtgcggacctcatgcccttgccgtcccaatgccnnnnnnnnnnttgggtctgcgaccattgcctcggccctgtccggtgccctgccggcccagcggtcggcgtgaggctgggccttcgccagtgcggcggcgtaggctgccttcacctccctgaaggcagggtcctggccgtacttgggagcggggccggtgtgcctggaccctggcggtggaccccgccggctctcgcccagcggcccggtgggcgcgcccacggggacgaccacctccgtcggccagcccctgatggggggccgcgtccattggaccttgcagagcccccctgggtctacgtcgggctgccctggttggaccagcagggactgcagcgcgggtgcggcgtgctctggatccaaggcccgcttcaggtcagggtcaggcgcggttgtgccggaggacaggggttcggaggtgctggtcccgcgctgctctttccctgggtcgcccgactccggccggagcaggtggcccacctgtgccgcgctggggtctaacataggatcgcaggcgggccggtccgaggcggcgcagggggcccatgcgtcacagggcgcaacagaggccggggcgcacaaggctgtggcggcacgtgcctcggccgcatctgcccgggcctcggccgcgcttgcccgagcctcggccgcgctcgcccgagcctcggccgaggtagctcgtgcctcggcttcccggagaccgtgctggcaggaggccagctggacgcacacctcggtcacacgggcctcagcggcggccacgcgccgccgcccgctgcgcaggctctcctgctgggaggccagctgggcctcggtggcctgcagctgccgggcggctgccgaggcgcgctcctccgagaccagcacctgctcagcaagctccagactgcgccgatccgagacctgctggtgcttgtgtgtgtgtaggaggggaaattccaggggaggtagagtacaggccgaagttttgccgggagtccatgcagacatgaggcgggcgacagactggcagacacctcgatgcccacctcagcccgctcttcagcctcctgnnnnnnnnnngttgccgggagtccatgcagacatgcggcgggcgacagactggcagacccctcaaagcccacctcagcccgctcttcagcctcctgcagcccctgctggaggcggtggatggcggccactctggtttggtggtcgagcagggctgcttggagggtctgctgcaggctgacgacctccagctccaggcgaagcagcttttccgggtcgagtgtcgggggtgacggacaggtcatgctagcatcgcggggccagggaaagctgttgatgggtttcttctgtgtacctggaaccaattgacccctcggaaggtctacttggagagcgtgataggtcttccacccgtctgtccgtctttcgaaactccatgacgtgcgtgacatggcaatgatgtgacctgtataatattaaaccacagagctctgacacgtatttcataccgctccggacactggccgggtcgaagatgagttcgtcnnnnnnnnnnagtataatattaaccacagagctctgacacgtatctcataccgctccagacactggccgggtcgaagatgagttcgtctatactgtagaatgaggcgaacatggtgactgtgaccttgtgttagcgggtagggccgtttcatttgggggggtgtatggagtcgggtgtctgatctcaacctgaaagcctttcagggctttgggcgagttgcagcaaaccacgcatgccgaatgaatattgcttccaccctcgagatgatccatcctgaggnnnnnnnnnnaaggggggtggtatggcgtcgggtgtctgatctcaacgtgaaagcctttcagggcttttggcgagttgcagcaagccacgcatgccgaatgaatattccttccaccctcgagatgatccatcctgaggacatcatggctgccacggccgtggagcagattcaaatccacataatgcacgcttctgaaagcatggcggcagcctaactccgtccaaaaccatcattcgtgcttgtgataaaggaggcattgtcagttatggtagatttaggtgcagccggtcctggaccgggcccctctagcttaaaccctgcttgtgtggcccatgatcggcccaggtcatcgaccatgccaactctcgcgtcgtcaaggcactccacggcctgccagccctcatcagtctccgaaaagtttctaggaggctgttgcatggccgcagcgtccctcccatgtcccgtgcgcttcacgggattcgcaccctgcctacgagccggacgggacccctggtgggactgcatggccgcacctgggctgccagcgcaccaccagctcacaagtcgcgaggaaggcctccaagtgcactccccgatctagaccagtctgtacaagaaagtaccgacagtattccggactcgccggctctcaatggaatggccaccgagcgcgtccatgcaggtacactactagggccacatgaacgacatcggggggcatgccatgcgatgctgcggcgtagcccgcgtaatggccctcgtaccctttgttgacgctcgccctgctatcactccagacaccatgcgaagctgaccctctgacgacggcccctacccctgcgtacagccccgacgccctccctccccctcctggtgtcccccttcttcttctggggcacctccatggtggccatgaagcagctggcgccccacaccacgccgctcgccctggcctcctggcggctcatcccggccggcgtggcactgctcctctgggcggccagggatcgacgcccccagcccgcgacccgcgaggcctgggtcgcaatcgccctctttgcgctggtggacggcgcttgcttccaggtcggctgtatgctgtggtggagggatgcatgtattgctttccttgttgcacccgaggttgcttgctgtcctctgggctcggcgcgggttgcaagggtgggtggctggcgcgcaaggttgcgtgggtggggccgagcaccggatgcccgcctcccaagcacggctgccctttctctggcaaccccaacccatcccannnnnnnnnncatcgccctctttgcgctggtggatggcgcctgcttccaggtcggctgtgtgctgtggtggaggggtgcatgtattgctttccttgttgcacccaaagttgcttgctgtcctctgggctcggcgcggggtgcaagggtgggtggctggcgcacaaggttgggtgggtggggccgagcaccggacgcccgcctcccaagcacggcttccctttctctggcaaccccaacccatcccatctttcaacatgctgcagggcttcctggccgagggcctgcagcacacctctgcgggcctgggcagcgtggtgatcgacagccagccactgacggtggccctgttggccgcgctgctatacggcgagcggctgacggcgctggggtacgccgggctgccgctcggcgtactgggcctggccttgctggagatcccgccctcactctgggcctcgagcggcggggactccctggacgccgccgccgcggccgacgccgcgctggggccggcgctcatgctgctggcggcacagagcatggcggtgggcaccatcatgatgcggtgggtggcctccaaggccgaccccgtggtggccaccggctggcacatgatcctgggtgggctgcccctggcggcactggcgctggcacgcgagggcggcgacctgccggctcgcctgatcgccgcgacacgtgagggagggggtcaggattttttgcggggggcaggagggtgtgtgcgtgtcgttgcgagagggtctggaggtgcnnnnnnnnnngcgccgcgacacgtgagggagggggtcaggactctttgcggggggcaggagggtgtgagcgtgtcgttgcgagagggtctggaggtgccgccatgtaccggcactcccctgatcgctgatcatggacagttctggcacctcgatgggcagcccgcgccagacagcacacagtcccggcgggtggccctgcccagcgccgctgaaccaccactgttctacgccgcttcgtgatctctttgccaacctctcgacgccttcctttcctgcagccagcgacgcgctgctgctggcctacgtcacgctgctcggctccgcggccagctacggcgtcttctacctgctggcctcgcgggggaatgtcacctccctgtcctccctcaccttcctgacccccatgtttgccgcggcgggggggttcatcttcctgggggagaccctgactctgcagcagctggtgggcgcggggttgaccctgggcgccgtggcactcatcagcctgaacggcaaggagagccaggagtgagaggtccaggaggcggagtcgcggcccgctcgcccgtaacgacatctcccccaaccatcgatgaacctcgcgggtcgcctgcccccaagtatgttgcacccactgcatacccaactgtggcgctgcagggctttaaaggttggcaggcagtgccagggcatgcagctggtgtcagaaaggagagggaatctccactgaatggagggtgtgcggggaaatcgctggccgcagtggaccggactctcagcaccctcgagcaaaatcagcacaaccagagaacacacgtctcacgaaacaccccacatgatacaacagccgtcaaaaggggcaggctgtagctggtgcacggggtggctgctgggagcannnnnnnnnngtggccgcagtggaccggactctctgcacccccgagcaaaatcagcacaaccagaggacacacgtctcacgactcaccccacatgatacaacagccttcaaaaggggcaggctgcagctggtgcacggggtggctgctgggagcaatacaagtcggcctccatgcacgtctctttgactggagggttggggggtctatctctcccctcctggcacattattgttcaccagcgtgacaactcacgccgttgccacctggctccgggtctctgtcgcattggcggcctgcttcgcccgccagtccttgactgccgccttaatggcgtcctctgccaacatgctgcagtgcagcttgacgggtggcaagctgaggtgcttggcaatgtcgctgttcttgatggtcagcacctcgtccaccgccttgcctttcaccctgtggagagtgtgcaggggatgcagctcagcggtgaattcgttgcaggttgtggactgcaatgtgtgtgagggagcatggacggcaaggcacctggcatggcagcagcctcatccagcaacgcacttcccacagaccaggctcaccactctgtggccacgctgctgctggcaatggccgacccacagccaaacgtcttgaagcacgagtcaacgatgtttccctcctcgtcgacgcgaatctggagcttcatcacatccccacacgcgggggcgccgaccaggccggtgcccacgctcttgtcgctcttgtcgaagctgcccacgttgcggggctgctcgtagtggtccactacctgcagtagataatatttgggaattggatcttagagcttcgcaagtcaagggctcgcagtgcagcctcccctgttcagaccgcggctctcgaaaacccagcggaagcatcacaccacccacgttcttatggtatgcccgggcgctcgtcgaaggtagcgaggaggcgagcaccgcagtgcggcttcctactgcacggagcgcgctggaagagaggcgggagagcatccctgtatctgatccacacgggtccggagggtggacgcaacttcagttcctggttgtgcgttgaggttaccggtgccgttgacagttttagatggctcgttttgcgagttacaagggaaattgaattgtgtagggaataatattgttcaatgcttacnnnnnnnnnnnnnnnnnnnnnnnnnnnnnnnnnnnnnnnnnnnnnnnnnnnnnnnnnnnnnnnnnnnnnncgggcacgaacttatggcggcaacatgtgttaacgcgcgctgatggtataagtttgagccacatttcacatctgagtcacttcgactcctggtctgtggcactattcacatgactttgaatgtggtgcagtgcgcactgcgagtactaggcgagcccgagccggaagtcaaagcacggctcagtgctgagtacctggctgcctggcaggcaggagaactgggctgcaccgacctagtatcgcaccatggacacgttccagaccgacccgcgagggccgatgagaaggtagcttgctttcatgtggggctgcaccgctggagtgcatgggatctgcatgcatgcagggtgcctccctgggtccagaccctgacaacccctccctcacagaccatgtcatgttcaagatgcacgacggcagtgcaggnnnnnnnnnncaaggtagcttgctttgatgtggggctgcactgctggagtgcatgggatctgcatgcatgcatgatgcctccctgggtccagaccctgacaacacctccctcacagaccatgtccatgttcaagatgcacgacggcagtgcaggcgcagggagagcattgatccctgctgacaagccaagagcactgaggactcacctccctccaccaaccccccccccccctttctcagctccagctcgtagagccatggaagctgaagcgcgggaagggcggcagcctggcctcccgccaggccctcctccactccctcgtccacatcgagaactgggccgtggacctggcctgggacatcatcgcccgcttcggccctgacccagactaccgcctgccccccgctttcttcgccgactttgtcaaggtggctggggacgaggcccggcactactccctcctggcccaacgcctgcaggccacggggtcccactacggggccttcccctgccacgacggcctgtggacctcggcgtccgccaccggtgagcggggcagggtgcgctgggatgtgcttccctcggcgaaccccatgctgcactctgctgcggtcggctccgggcatgctgactccaccggccccagcctccctccccctgcgcccctcgccccacaccaggcggcagcctgccggcacggctggcagtggagcactgcacgcacgaggccaggggcctcgacgtgctgccccagaccatccaccgcttccgcagcaacggcgatggagcgagcgccacgctcctggagagcgtgatctacgtagaggagatcacgcactgcgcggccggcgtgcgctggctgcgatacctgcacgcgcaggcgtgggcagcccgcgaatggccctggcccgacagggacggcgggggcggtatgcccgcaggctcgtcaggctcccaggcggaagccgctgggggcaccccgccccacatccccgcctgggtgacggaggccagggcctacgagacagtggagacctggttccacgcgctcatacgtgcccacttccgtgggccgctgaagccgcccttcaacgatgccgccagggcgcaggcggggtttgggccggagtggtacctgccccttgcaagtgtcggtgccggctgatgttaagtggtggtggtaggcgcactaaatgtaatctgaggtactgatgatgattccttgtacgcagctgtgggaggcaggagctctgtgagtgaaaagtcctcgcatgagcgcaaagagttatgggaatggtggccgtgggccccctgcaggacgcagatctcttcctggagggcgacacaaatcagtactgaggatgcgcagggcccaattgatcgctccatgcaccgattcgcatccgattcagcaatgcaattagatcgtaattcatgagcgttcctgccgatcagccgctggcgatctgtgcaccgtaccgtcccggggggtggcgatggccgacgcaggcagcttgtggtggcctcccttcgcccaggtgtcccatgaactgcgcacttgcagtgcagaagatcagctgcagatcctccagaagtacgagaagtacctgacagcaggggtgggccactttcgacagcccagtgccgcctccaaggctctcatacagggcaccgcccctctgaagctgccggatggtggaacctttccaccggtctccgaggtggcatcggcggtcctccagctcagcgccgacctggtgcgacggtggtggggccctgcatctgggtcatgctccccagatcgtttgctctcaccacctcaccacctttttcacctctttcaggtgttggatgaggtgcaggcctacatcatcctggcacgttcctcccgacactgggtccgcgatcgcggggagcgctggctcaccctctcacagcgcaccgccgtccacaccctgtactacagcgagcgcctgcagctgctgcagatcgtgcaggacctcctggaggcgggaggtgaggccccggtgggggagcaggcggcttcactatgccgtcgcctgtttgcatcggtcgcctgggccgaggcactcgggctccannnnnnnnnncccaggcggcttcactgtgccgtcgcctgtttgcattggtcgcctgggccgaggcactcgggctccagggtgccagcgcccgagccgctcacacagccccctcgcctgccgccgcttgggcgcttcgggtgccgacaactaagctgggcctcacagcattgcacgtgacgccttttgacgctgtccacagccgcccccacaaaattccacctgggcccctcccaccgcagnnnnnnnnnnctgccagcgcccaagctgctcacacagcccgctcgcccgccgccgcttgggcgctgcgggtgccgacaactgagctgggtctcacagcattgcacgtgacgccttctgacgctgtccacagccgcccccataaaattccacctgggcccctcccaccgcagagactggcgggtccgaagacctcgacaccttcctgcagtcccgggcggtggggctggagaccgaggcctgccgggccctgctttccagcctgggtggggaggggttgccccccctcacccccggcgcgggcgagctggcagcgctggcagcccgggagcgggtcctggagcagcgcgcgttgctcagcaccctcattttgctgtactacttccccaggtgtgaggggttggggccgtttttggagctgaggggatcccgcgccgcagtacaaccccttgccaagccactgagccatgatggcccctcgagaagtgcctgcggcttgagcatgccaccccgccatgctctctcaccctcccgcccgccactgcaggcagcaggccaccccggcacgcttcctcgagctgggaacggccatccatgcccacctgctcctgccccagctcttccacagcatcgtcgcccgcggggacgtccagtcgacgcagaagctggtgagtggtagtggtgttttgagggcgagggggtaaggggtgctggcaatggaattcgtgggggatacgagtgtcgtggatgtccatcaacagctccaggagcgcggcatgacagcacatctctgagaccatctccgagggattgccagcgttcggtcccctcctgccgcctgcttgccccatgacacatcgcttcgcgccccccccaccctctttgtcattccccaaatcccaaccttgtcgcactctctccaagggcatcgtcctgctgaccgagatgctggacacggagcggctggtgtccctggtgggcgcgggggaggcccccgcccccgccacctacgcctttgcggcgtcggagacgctgtccaagatcaacggcctggtgtcctcctggtgggaacgggcccaggccctgcactcccccctcctcctggtctgggcggcggtgctgcagctgcttcaggcaggcgcgggttcggaggtggagggcgcacgggcgcaggcgcacgccgagctggcgggccagctgggcgcgctgggcacgctgtgcgccctgtccggcctgccgggccagaacgccgctatgaccgaggcggtcaactccgtccagctcaggttggtctgcttatttgtttggggggtgaggggggggcggttgatgtggaacgttgaggaatggaagcatggtttcgcatggtgcacgagatcagagcggctggaggagccgcgagggcgggnnnnnnnnnncgaccgcttggcgaaacaccgtgtctatcctcaaaagtgaccccggaacacacccctcacctcacagcgcggtgtcgtgcgtgctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgagcgggccggcgtccaccgacgatgagtcctcggagcccacaagtaaaggcttgggaccacactttagctgaaaaatccaccccatgctccttccttaggtctnnnnnnnnnngaagaagcatggtttcgcatggtgcacgagaccagagcggctggaggagccgcgagggcggacagggccgggttgtcattatgaggcagggcatggcctgcgccacataagtgcacgcctgctggcaaaagcctgctggctgactgcgagagggcctggtgtggacgccgaggcctgcctgggcagggcacgggcatgcaggaccgcttggcgaaacactgtgtctatcctcaaacttgaccccagaacacaccccttacctcacagcgcggtgtcgtgcgtgctgtgcgcgtttgcgctgacacctctcgccgcccctctcacggccacgtccgagattgtggccacgctgtgccatctcttccaaggcgaggcctggagtgctgggtgtgggtgggacgcttgaatctcatccagcaggcaaagccggccgcgtgaccgggccggcgtccaccaacgatgactcctcggagcccacaagtgaaggctggggaccacactttagctgagaaatccaccccatgctccttccttaggtctacctccccccgccgccccctcttccttgcagaccagccgtcgttgtgcgaagggctgtggcagcaggcgcggtccagcgacgcgccgctgctctcctacctggacggcctgcgcgccctgttccccgctttcccctcgcccctgtaccgcctgctggccgcgctggcctcctcccccgtctccgccgccgccgccgtggcctactttgcgcgcctgcccggcctggccaccctgcaggcgctggacggggacgtcgtctccttggaccctggcgaagggacccgcgtcgtggccggcagggatctgcgcctggacgccgcgccgagcgtccacgttcccgaggtgcgcgcctgggcgtgtggacttgagatcgggatgagaggggatgcgtgtacgagtgatgctgtcaggggacccagggtgctgactcacagaggcacaaacctttggtgggtggggcaatcgtttgccgtgcctgccctccaagactcccaacgtcaccccaacacaaaccgcagggcgtgccgggtcaggtgctgggcacgccgcccgggttcctggagctccccgtgacgtgggccacggcggcaggaaggcacggcgcccaccccgacctgggcctggtgggctggaccctggcctgccccgaggccacgggcttcctgatcctgatcgagcggggcctggcggcgcaggacgcgctgcgtgacgcccccgccgcccccgccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagctggcggctgcgctggcgctggttgcgcgtgtcgtggcggccgacgccggcctggccctggacctactgcacatagcggcgccggcggccggcaaggcggcgcgaggcgccggctggccgtccggcggccaggcgccggggggtgcggacgtgctgaccctggccatcagggtgctggcgggggtgccgctcgcggggcgagcgcgattcggtgccttggccgaggatgctgcgacggcagaggacggctacgacgccatgctgggtgggtgcctgggtgcccggggggctggtgtacattgcgaatgagaggacaagcgcggagggcaggggacttgttgggagccgccaaggggtgatgattgttttgttgttgtttgcggtgttgaggctggccctgccccaaccccttcctgggcatcgaccggatagacctgcagtttgcacatcattctcaccccgccttcctgtcacccctgcctgccacagctgatgcactcaatgtgtgtgccgtcatggtgcagctggcacnnnnnnnnnntaatcggatagacctgcagtttgcacatcatccccccccgccttcctatcacccctgcctgccacagctgatgcactcgatgtgtgtgccgtcatggtgcagctggcacccgaccgcgtcgtgcgagccgtgaccgaccacctcttggtgagcgtgcgggggctgggcagggttgctgcgatgagattggcgagcaaggctggacgcatgcgaggcaccagagaaatggcattccgtcccagcgccgccctccctccgttgccctcctctcaatggagcctgatcgccccgccctccacccccgctccccccctctcccaccccgcgctgcagctcgaaaggtgctggtcgcgcctggcccgcccagccggccccggcagggactgcgcctgcgccctggccgccatccgcctggccaccgccctgctcacccatctgcccagctcggaagtgactgaggtgagcttgggattctggggcccttgattgggtgggagcatccggttgagaatgcgaatgcctgcagtcctttgtcagtcggtgagccctgcctgctgccaaccaccatatgcgagcatcccccccgtgtcacctcaccctctctgtccctcgttccccttacttgcaacgaactgaccaggagctggtcgccaggtgcgtgctgccactcatgacgttggccccgcaagacccctttggccccgcctcctgccaggcgatggcggccannnnnnnnnncactgccaaccaccatatgcgagcatccccccggtgtcacctcaccctctctgtccctcgtcccccttacttgcaatgaattgagcaggagctggtcgccaggtgcgtgctgccgctcatgacgttggccccgcaggacccctttagccccgcctcctgccaggcgatggcggccaggctgcgcctggtgcgcctggccctcaccgtgccggcctgggaggcggctggcccgcgactgctgcgcctgctgggcttggggggtgagcgccagcgccagggcgccgcaaacctggtcgcggcgctgggccaggcgggcgcggcgtgggccggcgctacggccgtcgtggacgcagaggcctgccgccgcgagtggctgcgcctgctccccctgctcgccgccggcgagggctgcgcggccgtgctgtcctccgggtcgtacggcgggggaggcctgggggg

SEQ ID NO: 32386 - DNA, 93 bp, Chlorella protothecoides
tgctcgcagaccagagccacccccccttcccaggccgtgccgtcttgagacccaggtgcactgccctgcacccatccctcccttggccccatt

SEQ ID NO: 32387 - DNA, 127 bp, Chlorella protothecoides
tgcatgacagcacataggcatgtttgaggctggatgctttgctttttcctgtcggtgcattgacactgattgtgtatgtgggtctgcatacccatacgtcgggcaatggtcagtggtctgcctgcat

SEQ ID NO: 32388 - DNA, 88 bp, Chlorella protothecoides
acatgccgatggggcgagcgcatccctcgcggtgtgcagggagacgatggccagtatagcccaccagcccacccaccaggcccgtcgg

SEQ ID NO: 32389 - DNA, 84 bp, Chlorella protothecoides
acgctggagccaccatccctgccgggtgtggggagcgggggagatggcgtccactcattgtgggatggctccttccatccgcgg

SEQ ID NO: 32390 - DNA, 671 bp, Chlorella protothecoides
tgcaatggccagcacttaatcatctaagcgctgcgatgcaacacaggaccatcccttcggttctcaatcacatttgcccctccctggatctgccagactcacacagaataggatcaccagatgctgcaccacaggtacagcgcacggggtgagccgagccaagcctcaagcccgactctggactgaccagattgcgttgtccccttctcccaccccctacataccctgttctcgttgttgccatgcgtggggtccaggaacacctctcggttgtgtccatacgcgagcaggatctcaagctaggggggggtctgccaccagatcacggctcctctcccgccctcgctcaggtgcccaaagtagtctgcaggcgcggcaccgatcctcagctgcagactgcgcgccgggtcgatatctcgtctccagtccttggcggctgcatggcacctcagattgctgggtggaagaagaagaatcagctgtgagccgttcgggaagttgtcctgccaccccccgcccgccgctttaccacaccaccctacacaacctgatgtccttggccgtgatgtggtagtcccgaaagaggtctggataatccatctccactctgtcagcctcaactcccatcagccgcggccctaggggcaagcccgcctgccgcaggctgtcct

SEQ ID NO: 32391 - DNA, 90 bp, Chlorella protothecoides
cgcagtactcaactaccctctccacacacccaactcccccctcccccccttcctctgcccatgtagcctcggagatccagcccctgttcc

SEQ ID NO: 32392 - DNA, 77 bp, Chlorella protothecoides
acacccacagcggcctggaggtggggggggagggagcagagatcgcgggggtggtgtggtggcttgggactcagggt

SEQ ID NO: 32393 - DNA, 140 bp, Chlorella protothecoides
acctcgtccagtgagacgacggggtcgggctgcatggcagccagggcgacgtcgatgctgtcctcgcacgccttggcctccggctcctggcaggcagggcagcacgatgttcgtgtggaaaaggagcctgggacctttgc

SEQ ID NO: 32394 - DNA, 68 bp, Chlorella protothecoides
tttgcctgtttgacaaatgggctgggaagcaggggagggtcctgggcggctgggcatggcaaatgaga

SEQ ID NO: 32395 - DNA, 63 bp, Chlorella protothecoides
aggatcatgagaaaggcaggtcatgcaagattaaatttaggacgagggcaggagcattctggt

SEQ ID NO: 32396 - DNA, 109 bp, Chlorella protothecoides
tggctgtgaatgctggctggagtcgaggatcccgatgtcggctgagttcattggggaagaagcaaaggccgtgcacaatcccgagcctgaggtgctgcttgggactcag

SEQ ID NO: 32397 - DNA, 162 bp, Chlorella protothecoides
ggtgtagggtgtccctttgccgggaccctttgaactcagcgtcaatacttgtcatctatccctcccatctcctcaggcttcccctgcctttggattcttcttcctggacacggagcttgagttgaacgcatgtgcacagaggcatcgccacatgcagcgttc

SEQ ID NO: 32398 - DNA, 72 bp, Chlorella protothecoides
tgctgttgtttgtgttacttgtaccatggatgcatgggacataaggcttcagcttggtcctggaaaattgca

SEQ ID NO: 32399 - DNA, 72 bp, Chlorella protothecoides
tgtcgccccagggtctttgaacccacttcatcccccccccttgacacgctacacaggagccgctgctggagg

SEQ ID NO: 32400 - DNA, 61 bp, Chlorella protothecoides
cctatacacacatctgcaggcgggacccccctccagaggacgccaaggtacacctgtacgt

SEQ ID NO: 32401 - DNA, 70 bp, Chlorella protothecoides
ggcctcccacctccgcgcccccgtcaacatcgacctgattgggcagggggccagcgggaagctggcagag

SEQ ID NO: 32402 - DNA, 83 bp, Chlorella protothecoides
ccagccgtgacacatactctttccccctgctcacggaaacacaaacacacacgccgaccttgaggttgtcgttggcaaagagc

SEQ ID NO: 32403 - DNA, 61 bp, Chlorella protothecoides
gggaggtgccgcactcgtcttagtgaggggcggcggggtcttcttggcaggggtgacaccg

SEQ ID NO: 32404 - DNA, 80 bp, Chlorella protothecoides
ttgagcccatcgagctcttgcccatttataaaatagcattggagtactgaagtacttttgaggaaggtatatcctgccct

SEQ ID NO: 32405 - DNA, 69 bp, Chlorella protothecoides
agggtgagcaggggatggcattggttggtttttggttgttcttttgtgtgtgtgtgtgggggggggggg

SEQ ID NO: 32406 - DNA, 62 bp, Chlorella protothecoides
tcttttgtgtgtgtgtgtggggggggggggtgatgacgagatcttgaaccgatgcgtgctgc

SEQ ID NO: 32407 - DNA, 61 bp, Chlorella protothecoides
tgatgatttgccacagcggccgtgggggggtagcgtgtgtgcgtgctgaggatgatgcgtc

SEQ ID NO: 32408 - DNA, 105 bp, Chlorella protothecoides
cgtccagcatggtggtgagggcctgcgtgggaaagggggatgccatgatggcatcgtgggtgtttgctgcagcatggtctggcatggcacaacatgtggaggcca

SEQ ID NO: 32409 - DNA, 119 bp, Chlorella protothecoides
tctcaccaccattcatcctacaggcggctgcccactcccctcctgccccccactcccacgctcagatcctggatcggggcgagcggctcgacctgctcgtggagcgcacagacgacctc

SEQ ID NO: 32410 - DNA, 151 bp, Chlorella protothecoides
ttatgaagtctggcctctcatccattcccctgccctcctcacttgctatgcagatgttacattcttctggtatgattgtcggagactcatgagcgggcttatcgcatttggttgagccatccagacaaataagctctgcggttatcccaca

SEQ ID NO: 32411 - DNA, 61 bp, Chlorella protothecoides
aggattggggtcctgtactgcaaactacccacccagccactgggttacagcgcattttcca

SEQ ID NO: 32412 - DNA, 82 bp, Chlorella protothecoides
ccgtggcgcatgcggtggagatggagtagttggggcccatgaagccctggtcgatgcccaccagcgcgctgcctgtttgagg

SEQ ID NO: 32413 - DNA, 61 bp, Chlorella protothecoides
tatgtgagcggcagcctgggtggtgctgccgggggctgcgctgcctgtcaccacctcaaga

SEQ ID NO: 32414 - DNA, 61 bp, Chlorella protothecoides
agtgtgccggcaccgacacacagcacaggtcttactgcagcaagaccccgtcacgcagttc

SEQ ID NO: 32415 - DNA, 76 bp, Chlorella protothecoides
tggctcccgtgccttcagccacgggggcgtcgctcttcgagtcggccttcgacttggcagcgggtttcttgggtgc

SEQ ID NO: 32416 - DNA, 61 bp, Chlorella protothecoides
ggcactggctctggagtactcttcatgcacagaggcctcctgccatgagcattttggatgg

SEQ ID NO: 32417 - DNA, 61 bp, Chlorella protothecoides
gacggtcaaggacccgaagtgatctcccctacctcggccgccgcttcggtcgttggagggc

SEQ ID NO: 32418 - DNA, 61 bp, Chlorella protothecoides
ctcataacccaggtcagaaccctactgaaagtctacactgactgggatgcctcgtcagaag

SEQ ID NO: 32419 - DNA, 89 bp, Chlorella protothecoides
tttcgaaaatccaccaacgcatgcggaaacggatggatggcaagtatggtcgtctcagaagcttaccgaatgattgacgatgtcggcgc

SEQ ID NO: 32420 - DNA, 61 bp, Chlorella protothecoides
ttcttgtgcaaggtccctttttggaccgcaaccgacagtggcctaactgctcccagcttcg

SEQ ID NO: 32421 - DNA, 80 bp, Chlorella protothecoides
gaggacgacgagccccgcgacatgccgcgcccacgtggggaagggtatggaatgcgcccatcgcaacgctgggggcttat

SEQ ID NO: 32422 - DNA, 140 bp, Chlorella protothecoides
ggagcccagcatgaggaggggccgggtttctaatagcatgaagatagagctgagctgtggccaccccgtgttcccaatggaaaaccctcctcctctagcccgcatggcaggggaaggggcaaatacaatagctcgttacc

SEQ ID NO: 32423 - DNA, 61 bp, Chlorella protothecoides
actgaagtctgaaggagtatgggagagcaatagtggtggatatatctgtcataatcagtag

SEQ ID NO: 32424 - DNA, 74 bp, Chlorella protothecoides
aacggtccgcaggatcagcagagggctgcggaggggacgggtgcggcgcacgcgaccacctctgctgtgccatg

SEQ ID NO: 32425 - DNA, 80 bp, Chlorella protothecoides
aactcttcaatccgtagtcgctcacaatcttaggcacagtacccttgccgagtcctttagggcacgtgcaccgtccctgg

SEQ ID NO: 32426 - DNA, 126 bp, Chlorella protothecoides
cccaccagggtggtagccggtcattgcccaacccccttccactcggttccctcccccgactcaggcgcaagggttacggaggcggagcgttcgttgccaagaccatcagtatttccgagacctcgc

SEQ ID NO: 32427 - DNA, 65 bp, Chlorella protothecoides
attcacactctgggtggggggcggttgactacacgcctcacccctcacctctgccccatctggac

SEQ ID NO: 32428 - DNA, 78 bp, Chlorella protothecoides
ggcgcactcgagcattcaacgactgggatgagtggagggctgggaggtggaggcagtggcgggggggggggggggggg

SEQ ID NO: 32429 - DNA, 124 bp, Chlorella protothecoides
gagcagagcgtagttatgctggcccaggtgcgtgtttggcttggagagcgggtaatagcaacgaggcagcgacactgaaggctcacatctcaactttgcgttccagcatgtgcagatgggtagg

SEQ ID NO: 32430 - DNA, 72 bp, Chlorella protothecoides
cggcgtgccggaccctggaggagccccctgccttattaattttccccattctacccaggcgtgtccgaccac

SEQ ID NO: 32431 - DNA, 579 bp, Chlorella protothecoides
  modified_base (95)..(104): a, c, t, g, unknown or other
gaggtagtttgggtttgtgtgggaggagccaagcagggtgatgtgtggcaaaatccttgatggtttccgagggattctcatggccaggtgttaannnnnnnnnncagcagggtgatgtgtggcaaaatccatgatggattccgagggattctcatggccaggtgttaacccttggctgcttgagttgcagggggaatgggggggggcatgcgctcggccaacaggctcttgcgacccggtcctacgccagcgccgtactccccgccactcgctgcatcgcaccgcgcctgttgagtgggttgcagggtcggcctccagcgccgtgctcgtcccctccaatgtatcacctcttcccccccccaaaatgctgtgctttcccaggtgccccaagacgacctggtgtccagccctcttggcccggtgagggtggtgctgcgcgccgagggccccacccgcgtcctcacgctgctggaccccatgcgccaccctttcttcctgcgccgcggcgcggcgggcctgggcgcccccggcgcgggggccttggcgagcgtggcgccgggcggcgtggggctcgccccg

SEQ ID NO: 32432 - DNA, 70 bp, Chlorella protothecoides
caagtccctgtccgccctgggtgggttgagcagggggtgtgggagtggggccgggtggagacggtgcagg

SEQ ID NO: 32433 - DNA, 61 bp, Chlorella protothecoides
gctctgggcctggctggaaaaggaggcgggggttagggggggcagatctgcacactggctg

SEQ ID NO: 32434 - DNA, 182 bp, Chlorella protothecoides
aaccgagcactctcattgtaatgcactcggctctctctccctccacgatgtgcattcacaagaggttggagtggcctgtgggcagataaaatatatcacttcaatattaaacaaatactctacgcgttgcctggtcggggtccattggctgcgatctcccggaagcgtcatggctctgagga

SEQ ID NO: 32435 - DNA, 93 bp, Chlorella protothecoides
ggcgatgagcaggggccgagggaacacatccaggactgcatcgcaagtatctccccctccccaagcgctgccgcccgcctaccagacggcctt

SEQ ID NO: 32436 - DNA, 172 bp, Chlorella protothecoides
cctgtacagggtggtggggtggggagggggtgagggttttagggtggtgaggagccatgtagaggattctcctgccccattcccaccagcagctccggcccccccgcaaaccctctccacctcccccccttcacacccaccacccaagcccctcttgcctgatgggcgggtc

SEQ ID NO: 32437 - DNA, 61 bp, Chlorella protothecoides
ggaggccgccaccaccgtcctgcgcgtggaccagatcatcatggccaagacggcgggcggg

SEQ ID NO: 32438 - DNA, 144 bp, Chlorella protothecoides
accttcccagctgcagagggggcaggcgcagggagagacgcgcccatgccatgccgcagcgcgagaaacacacccgatgccaccacaagggaccctcccttggacgcccccacgcgccgcgtctcacccggccccatgccaatc

SEQ ID NO: 32439 - DNA, 61 bp, Chlorella protothecoides
ttgagcgcgtcaagtgatcggcccggcaggtggagcctgctgcggggacgcacgccggtgc

SEQ ID NO: 32440 - DNA, 1511 bp, Chlorella protothecoides
  modified_base (321)..(330): a, c, t, g, unknown or other
  modified_base (961)..(970): a, c, t, g, unknown or other
cacctggcgcgccgcggcgcgctggagccgccgctctggctcggcgccgacgcgctgggcgtgggcggcgccgccggcaagccggctgccaacccgctggccacgcgcgtcaccaacttctaccagaccgatgccatcagccgcgccagcaagaccatggcacgctgcgtgcgcgcgcgccagaaccctgtccccggcctctgaaggatggcgaggggggggtggcatggaggcggacggcgccgctgggggtccgctggtccctctcgaccgctcctgccactcgacaggggtgggagagtggcagcgctcgctgtggannnnnnnnnngccgctggggaccgctggtccctctcgaccactcctgccgctcgacgagggtgggagagtggcagcgctcgctgtggaggggtacccagcagcgcctgcctgtcaacccgcacccatggctggaggacgtccggcgacctggccgcacgcccctataatcgttgtcggagcacctgtagaatttgcctccacatcgtctgggcttcttgaaagaactccgggaggtgtgcgtctctaccaggctgtatgcccctttgtagccctgtaaaacaggaagaatgattactaattgggaggaaacttcccatggggaaggagcgggcctgctttctttatagacacgcaccctgcgcgagcatcggggcgcagagggcgaaccagacatgcatccacccgtacaccacgacatgggcatgatccacgcaacaaaaagctctaacctgcctctctgaccacaggaggggtgccaaagtccgagagcccaatacacaccatctcgagattccttcctacccctccgacaccgagttctcgattccgcgcctgcaaccccagaatagaaaattggagcgatctaggtactcacatcatgatgggtgcacaaggagcgctcgccctggtgttcctcgtnnnnnnnnnncccgacaccgggttctcgattccgcgcctgcaacccgagaataggaaagtggagcgatatgggtactcacatcatgatgggtgtacaaggagcgctcgccctggtgttcctcgtcaccgtcctccacaccccgacaactctggcagcaagcaaggtagggagggtcacgtggcccacggcatgttgtgtacccagagtcgtagctcaatttttcacattttcttacgagatccgttgacttcgcgttcctcgacaggaggaacatgctgccgtggtcctgcgtcaggtggaggtgagggggaatggtgccaccaccttggctctgctggatctcctccaagccgacactgagaacggcggggaggctgacacccagatcagaagcgacgaggaaaggcacactcttcaggcgaatgtgtattcagccaagacacctgggggcgtcaggacacgcaagttgctaatggaggtgagtcacaaaaggaagggggcaaacatgctgcatggtggttggagagcgaggaccagaatctttgcactg

SEQ ID NO: 32441 - DNA, 72 bp, Chlorella protothecoides
ggaggagcctgtgaggccaagagagtcgtccgaagcgccctcctccattcaagattatcgaatctcaaagtt

SEQ ID NO: 32442 - DNA, 74 bp, Chlorella protothecoides
gcggtcctgcacgtcgcagcagggcaggggccgggggaaacgggaatgggggcggcgacgcacagcgccatgga

SEQ ID NO: 32443 - DNA, 128 bp, Chlorella protothecoides
gctgctgcatgcggtgtgcgggagcctgctcgaggctgtacagggttccgtccgggcgcagctttgtcctgcccccccaagcgacgcttccccctttcctccctcctgcccactgccaggtaccactc

SEQ ID NO: 32444 - DNA, 667 bp, Chlorella protothecoides
  modified_base (87)..(171): a, c, t, g, unknown or other
caacaagcctgcaacgagtcaggtcgatgggttcgcgcacggcaaggctgcacctctgccagaggcagcgggtgctgtggagggacnnnnnnnnnnnnnnnnnnnnnnnnnnnnnnnnnnnnnnnnnnnnnnnnnnnnnnnnnnnnnnnnnnnnnnnnnnnnnnnnnnnnngccttgtcctgaagatgcgagtggagtgacacagagctttggtgactggggctgatggcgaccaggaggtgctgcgggatggctgctgcacatctaccagctgcaatgcctgtgctcccgcaggattggcaatgtcaggcagcaccaccacacatgccgcccatgcaccctgcatgcagctctggaggatgcttagaggatgctggaatcgcactttctggggtgactgctgcgactcatctgcattgatggtgctgtgagacccatacagctgccggtggtggcgactgctggaagactacgtcgagcaggtcagccacctcttgagccgccgatgtcctcccaggcctgcctcgtttccacttgtaacccacacatggaggataccgtaacagatgcacagcagcatatatgggacaggggatctgtctacatggggtcggcaagtctgaatttcaagctgtgggcatcgttggcgcccttgcccacactggct

SEQ ID NO: 32445 - DNA, 80 bp, Chlorella protothecoides
gggcatccatggagcagtaagtaggaggcgattttgtgtccttgggtctcgaggcctcaccgtgcagcaggcgccgccca

SEQ ID NO: 32446 - DNA, 116 bp, Chlorella protothecoides
aattgacaatgctccgatagccgggccacaaaacacaaggcatccagctcctttaatgaacactgtcaactgtttgagtttccttcgtcagtgcagatgcaagcccgccctgagct

SEQ ID NO: 32447 - DNA, 65 bp, Chlorella protothecoides
tggcgatgcctcaccatcacacttttgtagagtatctcgaagtgcgaccatagagtagcattgta

SEQ ID NO: 32448 - DNA, 64 bp, Chlorella protothecoides
cgcagaggtgggaagggggcaggattggggggctgtgggtcttgagggctgttcatgcaaacga

SEQ ID NO: 32449 - DNA, 76 bp, Chlorella protothecoides
ggggtgacagtgcgtgctgggacacggatggccccgaaagggctgtctggtgatggccgggtgggctcgatgcaca

SEQ ID NO: 32450 - DNA, 64 bp, Chlorella protothecoides
cgcctgcgcatcgtcgtgcagcgaaagcgcaacgaggacgatgatgacaaggtgggtgaccgtg

SEQ ID NO: 32451 - DNA, 173 bp, Chlorella protothecoides
gcagagcgggtacatggcagcagctgctgtgttgctgccatggctggtggagggcctgggaagcacagcgaagcaggtgactgttttccatcctcacccttgatacctccccagcacgcatgcccatgccctcccgcacaagaacccacggccccacctggtagagcaggatg

SEQ ID NO: 32452 - DNA, 73 bp, Chlorella protothecoides
caaacacctggcagaaccgcggcccgaccgtccgcacaaccaccccacccacccagtgcgtcacggctgtgga

SEQ ID NO: 32453 - DNA, 76 bp, Chlorella protothecoides
gctcacccgtgaagccgtacagcgcgtttgccgtgaccttgagggccttctgccggccgtccagcaccgcccgctg

SEQ ID NO: 32454 - DNA, 119 bp, Chlorella protothecoides
acaatgcactcgggggagggcagtatcccctcacgactctttcagctgatgggttgatagttaaacgttgctataaatgctctcccgtttatgccgtcccctgacatcgctccacacgc

SEQ ID NO: 32455 - DNA, 77 bp, Chlorella protothecoides
agaagtgtgcatcgttctgtcggcgtgaggtagcggcctgtcaggcttgaaggatcggctccccccgcaggcaacag

SEQ ID NO: 32456 - DNA, 69 bp, Chlorella protothecoides
gcctgcactcctccaaacacaccagcccgcggcacggcgagctctgaatcgaagcaaaggtgggagggg

SEQ ID NO: 32457 - DNA, 146 bp, Chlorella protothecoides
ggagggtgagggtgttgaaggggcatggggtttcccagggcgaggggaggaaagttaaggtacagacagcgatgcgcgtgctcctcacgcctctcatccctccaacccactccacacctcctctcccctatcctccctccctcagg

SEQ ID NO: 32458 - DNA, 74 bp, Chlorella protothecoides
acagcccatgcatgcagcatcagcgcgcagcctcccagaacatgacagactctcagccaactcacggcggcctt

SEQ ID NO: 32459 - DNA, 61 bp, Chlorella protothecoides
aattcgactggcagccttttcgaggtatatccctccccttcaatatgcgatggtagaggcg

SEQ ID NO: 32460 - DNA, 62 bp, Chlorella protothecoides
acacacacttcccgagccccatcaccatacccatcacccaaccacccggcagacgcgctgtt

SEQ ID NO: 32461 - DNA, 73 bp, Chlorella protothecoides
tttctctgcaggcgcacggccctccaccacaatcaccggaaggcagccatgccgcagccactggatgctctgc

SEQ ID NO: 32462 - DNA, 73 bp, Chlorella protothecoides
ctccgacccgtcgcagcaccacaccttgctctccgaactggacggtaccgccatcgccgtggatctttcggca

SEQ ID NO: 32463 - DNA, 61 bp, Chlorella protothecoides
aatggcatgcgaggtgctctctcgactagtaagatgaggcgcggtattgtgagggtctctc

SEQ ID NO: 32464 - DNA, 76 bp, Chlorella protothecoides
ttggacgggttgagatatctcgggcgggggctagcatgatcggaatttgcagtacgaggatgctggcgagagggat

SEQ ID NO: 32465 - DNA, 65 bp, Chlorella protothecoides
gcggaggcagcaagggttggcggcttgatgtttttacaaacttctcgtggaatgagcatcgaatg

SEQ ID NO: 32466 - DNA, 87 bp, Chlorella protothecoides
cctgccacagcagcgcgggcggtgcccccgcccccacagccgccggctgagcggcggcgccgctcagccgccgtaggtccagggcca

SEQ ID NO: 32467 - DNA, 106 bp, Chlorella protothecoides
tgacgacttcctggcctgtgggctgttggcagaggagctcgccgacctgcacgagctcgaacgtacgttatcgagttcgaagactgtcagcatgagcatccaggtg

SEQ ID NO: 32468 - DNA, 65 bp, Chlorella protothecoides
ccccctccgaggtgtggcgatgtcgcttgtgccagccaattctgatgtatgcggtgttggcgctc

SEQ ID NO: 32469 - DNA, 80 bp, Chlorella protothecoides
gcaggctggccgggcggatgctgatgcggcgctgcaaccactcgaccagaattttttcgccaggtgggtctcctgtgtgt

SEQ ID NO: 32470 - DNA, 61 bp, Chlorella protothecoides
cgagcagggtggatgccgaggaaggttcgttacgccctcctgccacgccttgcgcagccag

SEQ ID NO: 32471 - DNA, 381 bp, Chlorella protothecoides
ttcccctttatgtcggtggtctctgcaatacgtgaacttctattccaatctgggtcctcaccactgataactcaccatctctgccgtgaagatgaagtgcgtatcaagccacctgattgcattcttgagatcaatgatgagctgcaggattggggatcgagaatgggatcagaagtgttggagattaatctaccaaacagtcaggaaggtacctcaagttggccggtcagatttgagcattccgactcgcagacacatcccccacatctacaggcaacaattgggcaactcctttactgcttgcatagggagggcgccgccgagatcgtgttgagcccccaaactgcccacacctggtctgccatctgcacgctcatgtcc

SEQ ID NO: 32472 - DNA, 73 bp, Chlorella protothecoides
attcagcgtgctgataagccgccaccaatacgagaaatttgccatgtcacaagcagggagccgcctgtgagca

SEQ ID NO: 32473 - DNA, 61 bp, Chlorella protothecoides
ccatctcacacacacgcatacagaaacccctccccctcacaacacaagcaggctgaaggac

SEQ ID NO: 32474 - DNA, 61 bp, Chlorella protothecoides
agccgacgcgctggaattacgtcacgtcgtccgggcggatctacacaagatactacctctt

SEQ ID NO: 32475 - DNA, 75 bp, Chlorella protothecoides
gatgctgcagctgcttgatggttgtttcacctaggcaagcccaccgatgtgcaagcacatgctctggtacaaaca

SEQ ID NO: 32476 - DNA, 66 bp, Chlorella protothecoides
ggccgcgaatgtgtgcggggccttgcaggcaggcgagcatgggaacagtgccgacccctgtcggcc

SEQ ID NO: 32477 - DNA, 192 bp, Chlorella protothecoides
tcacctctgacaacctgatgccacttgcttaactgcagccagagctgcttcagagtgctcttgcctcgtgtctctacttgagttctccatccgagcttgcaccccccctgcgttgttaacaccatgcaggtaccttggccagctgctgcatggtgagctggcggaagcggcgctcaggagaggcgtcgacat

SEQ ID NO: 32478 - DNA, 61 bp, Chlorella protothecoides
catccacctgctggcgcccgcagcgccccaataccctctggggtctagggtgctgaagggc

SEQ ID NO: 32479 - DNA, 69 bp, Chlorella protothecoides
cccactctcccctcctccttctgacaccagagtggcgggtcgggcggcgcgcaacgcatgatcgtgcgc

SEQ ID NO: 32480 - DNA, 127 bp, Chlorella protothecoides
tgtggtggaggcggaggcggaggcacttgtactttgggatcgggccatgtgctcatttttcgagcattttccggtgccacaaagcgctgattctgctgcgcggatctccacgctcccgcatcgtccg

SEQ ID NO: 32481 - DNA, 125 bp, Chlorella protothecoides
cttcccgccacgccccgctcatggcgctcatctggggcggggggggcggcgaggcggcgaggcgtgcacggcgcgggagggtctacgaggctgacgccgcgagcacctacgggcatcccatgctg

SEQ ID NO: 32482 - DNA, 61 bp, Chlorella protothecoides
gaggtaacacgcttggccatatgagtgtttcgatctgcatcagatagcatgctagcgtcca

SEQ ID NO: 32483 - DNA, 15726 bp, Chlorella protothecoides
  modified_base (1068)..(1077): a, c, t, g, unknown or other
  modified_base (1782)..(1791): a, c, t, g, unknown or other
  modified_base (2328)..(2337): a, c, t, g, unknown or other
  modified_base (2484)..(2493): a, c, t, g, unknown or other
  modified_base (3492)..(3501): a, c, t, g, unknown or other
  modified_base (3972)..(3981): a, c, t, g, unknown or other
  modified_base (4975)..(4984): a, c, t, g, unknown or other
  modified_base (5273)..(5282): a, c, t, g, unknown or other
  modified_base (5494)..(5503): a, c, t, g, unknown or other
  modified_base (5946)..(5955): a, c, t, g, unknown or other
  modified_base (6393)..(6402): a, c, t, g, unknown or other
  modified_base (6521)..(6530): a, c, t, g, unknown or other
  modified_base (7771)..(7780): a, c, t, g, unknown or other
  modified_base (8920)..(8929): a, c, t, g, unknown or other
  modified_base (9761)..(9770): a, c, t, g, unknown or other
  modified_base (9945)..(9954): a, c, t, g, unknown or other
  modified_base (11632)..(11641): a, c, t, g, unknown or other
  modified_base (12642)..(12651): a, c, t, g, unknown or other
  modified_base (13150)..(13159): a, c, t, g, unknown or other
  modified_base (13700)..(13759): a, c, t, g, unknown or other
  modified_base (13890)..(13899): a, c, t, g, unknown or other
  modified_base (14939)..(14948): a, c, t, g, unknown or other
  modified_base (15464)..(15473): a, c, t, g, unknown or other
  modified_base (15593)..(15657): a, c, t, g, unknown or other
agggggtccaaggagcgagagtggtggtgtgcgggggaagctctggggcggcgtgccggcgagagcctgtcgtgggggattctgcaggccttgccctgatcatgcacaaaccaggcccggaggaggatcttcctcgcagcctgggctgccccgttcctggctgagatgcggcccctttcctcaccccccgcacactccatctcccccctcactcaaaggcactggcaaggagtcaggggaccggcaccccaagatcggcgactacgtgctgatcggcgcttcggccacggtgcttggcaacatccgtgtcggcgagggggcgcagatcgcggccgggtccctggtgctcaaggaggtgcccccgcacactatggtggccggctcacccgccaaggaggtcggcaagatcacgggtgagggatgggaggagggggtactgcggaggggggttgggatgcgccgcagaggatgtgggtgccggcatcctacactgctcatgccggggggcggtggtgtgccgtcctgctcaggacggatcccaggagcacaggtgatcctcacctccaagcaccacacccacctggtggcaggcctgccctccatcctgatggaccagtggagcgagtgctgccccagagtcgtcgccgaggtgagggagcggcttgagtgtagcatgctgggtgcagggtgtgggtgtggcccgggctggactttctggggtggtgggtttcacagccagggacaggcgactgccatgggtgttccagaagcacccatgctacccaagggatcctttactcctcagcactgtcagctccccccatcccaacagcaagcggtggacgcgcttacgagaccaggcggggtggatgactttgtcatctgaaccaccgccgatcctgtacacaagatgccctgtgaggactgggcgcttttccatcccctgtttcctcgctgctgctcctccaacctacataccctcgctgcgagagctttcacaatggcaggggggccgcaggagccaatgcacatgttaatgaccagcagagtctgcccacctcttcttcnnnnnnnnnnatgctttcacaatggcaggggtcccgcaggagccaatgcacatgttattgaccagcagagtctgcccacctcttcttccaacctgtcggcaaacttgtaacctttacctcggacctgtccagcggagctgagcgagcaagtgggacgtttgcatgtgcatctcatccccgcccgaagcgttcgttctcgcgccccagatatcggtgcccggacatcgctgtcgcgcaacacagctgggccaccgtatcgcctagccactgcaaagtaacctgcatggtttgtggggctggatccaccgccagatctagagagggctgggagcgcagcgcgaatgctctgccctgcatgaggcggtgaaccctgtcgctgcccgccccaggcgccgatcagcatgcaggagtgtgggcgagggtgcctgcaggtcctgacatgcggtctgatgacgtacggcaaggccaggcccccgccatggagcgagcccctgctgggcccgggcgcatacccccagtcgacgcacccggcggatgcaccccccaagctccaggacatgcacggcagccctacgaagacggtgcgcgactttgatttgtgtcattctgcatgtatgcatgctcgggcagggtgcatggcgcaatgtaacccgggcggggccgtgctgtgttcctcctgctttcgaatccaggtcccactacctggctcccagtnnnnnnnnnntacccggacagggccgtgctgtgttcctcctgcttttgaatccaggtcccactacctggctcccagtcgtccaccactgctccctgccattcctcttttcctcatcctccccctcaccaccccccaggacgcctacctccgcactcacaacatcctggggcgcggccactctgaccttgaggcccgataccagctgggccgggtgctgggccggggcgccgacggcgtcgtgcgcgaggcggtgcacctagtcaaggagacgcggcacgcgtgcaagaccatctacaagggctggctgcgccgccgctcgcaggtggagggcctgcgccgcgaagtccacatcctgcaggtgggtcttgaggtgagaggaagaggggaaagggaatggcggcttggcagggggtcatgcggcggatcgtttgccgcacagtcccacggcgtccctgctgcagggcagctgtgctgctgctgggacggcggtgcccctcgggcagggtcctgggcagccgtcatcgacccctgtcccgatgctgctcnnnnnnnnnnatgctgggacgacggtgcccctcgggcaggttcctgggcatccgtcatcgacccctgtcccgatgctgctcagcaaggcgcgtccgtgcacaagaccttgaagccccaagaatttaaatctcccccttcccccttcttccccccttnnnnnnnnnnatccttgcacaagaccttgaagcctcaagaatttgaatctcccccttcccccttcttccccccttcctccacaccccagatgctgtcggggcacccccacgtggcgtccctggtggagtgcatcgaggacgagctggcagtgcacctggtgctggaactggcggccggcggggagctgctgcagcgcctgggctgcccccacgccgacagcccgtccgaggcgcaggtggcacgtcacttccgggccatggcccgcttcctggcccactgccacgcgctgggcgtcgtccaccgcgacgtcaagctggagaacttcctgctgagcacccccgacccggcgaccgcggagatcaaggccgccgacttcgggctgtcccagttcctgcgcccggggcacagcatgcgcgctgtggtgggcagcgcctactacatggcgcccgaggtgctgcgccgcgactacgccacccccgccgacgtctggtccctgggcgtggtcctgcacatcctgctgtcgggcctggcgcccttctggggagacaccgaggccgaggtgtgggccgccgcggagcgcgcccgcctggatttctcggtcgagccctggccccgcgtcagcgccccggcgcgcgcgctggtcaagtccatgctgcgccgcgaccccgcgcgccgccccaccgccgcgcagctctgccgggtgagttgaatgttgcgatgtttggcgggggggccggggggtgagagtggggattggaggaagggtgtggccaacagggtgccgaggaaaccagggtcctggcaagctggctgcccatcacctgcatgttggggctcagtgtccaggcggcgggctcgctcccgctggccgccactcctgccaggcagtgggaccctggatgtggccttgactgccggagggcgaccggttacgaccgcgcgatgtctcaccacctcaccaagctcctcactccacgcatttcgcagcacccctgggtgacggggcannnnnnnnnngtgtggccttgactgccggagggtgaccggttaagaccgcgcgatgtctcaccacctcacaaggctcctcactccacacatttcgcagcacccctgggtgacggggcagcagagcgccgagcccctgccgcccatcgtgcacgagcgcctgaaagactttgccaccatgtcccgcgtccgccaggtggccatgctggtggccgaggagcagatctccaaggtgggcatcggtgcttttgaccccggcgtatgcggtgaagacctagggtatctcctggacgcgtaccatggccgaggagagatcgggctgctttggggccgccttcttggtatcttggatgcagtccgacacatgcagctccaggctcttgcaggccaggccagttccggcaggcagtccatgcacccgcccacccactgactccccctcccaccacccacacacaggagatgctgcccgagctgtacgannnnnnnnnncgttccggcaggcagtccatgcacctacccacccacccaccgactccccctcccaccacccacacaggagatgctgcccgagctgtacgaggtgttctttcccccagcaacaagtccagaccccgccggcgccgccgtgacctgcccggggtcgaggggcctgagccccgcggacatccgcgcggggctgggccgcctgggccatgagttgagcgtggaggaaagcgagcgcatggcgcgcacgctgggctgggggggcgggccccgggaccgggtgccctggcgcgactttgccgtggcgacgctgggctggtcagcgccggggcgcgccgtgttcatgcgcagcctgttcgatcgcctggacagcgacgccagcgggcttatcaccctcggtgggtgcagaggctgggggcctgggtgccttgctgcacaggcggcggcgggcgaggcgccctgctgccgaccctggcccgcgatcaccccagtgacgaggtgccgcagccccctcctcaccccgcgtagctcatggcagccccatgtgatcctcccgatcctttcccaactgtgcacaggcaagctggcgcgggggctgggggagtatgggatcgactccgaggacgtggccctggtcttctcgcaggccgatacggacgccagcggcggcatagactttgacgagtggtccgctttcatggccatgaacaccaggagcctgcaggaggttgtgcggcacaggatacaggcaacctgcggggccttgggaggccactgagaaggggagatgcgtccactggctctgcgcaagccttttgcggcataaaaacgagcagctcatgggcagggcccaggcccctcctttgctgagacaatagatccccagaaagagcttaggggtaatccgcgtgggacattttgaatcagttccagcgctcacatgaatctttcgctgtaaggactatgaaacacttccagtccacgtcagcggccgaaagannnnnnnnnnttttaggggtaatccgtgtgggacattttgaatcagttccagcgcaaacatgaatctttcgctgtaaggactatgaagcacttccagtccacgtcagcggccgaaagaggattagatttgcccgacagatcacggaatacgccatgcgactgggcgcgctgcatttatgagcggcactcatggtcatgaagcggcgaggtatgttgctaccaatatatgttaatgcaccagactgcatcaagtcttattcagcgccaatcgctgagcctctgagatgatggggctgttnnnnnnnnnnccatgaagcggcgaggtatattgctaccaataaatattaatgcaccagactgcatcgaggcttattcagcgccagtcgctgagcctctgagatgatggggctgttgcatggagggggcccggcatgcagcagtgcagggaagatcacgcccccccttggactgcgtatgccgcgcgacgccacattgagtctctccaggagacagaaaccannnnnnnnnngcgcccccccttggactgcccatgccgcgcgacgcgacattgagtctctccaggagacagaaaccacattctagcgtcacggtgtgcacaggggcggaatgtcagtggactgggtgctttcgatgtcatgcctcttctcttgcatgacaaccctgcggaaattttgaaacctagatgaatgcgtcatttgttcctccaggaagcttacacgccggtggcaaaatttctccatcttcctaccacatgcagacacatgcgagcgctggaggggccagcaccctgcagaagctggcccgcgtgtttagggagaaggctgccgaggatgctggcaggatgttcaagggcgccaagaagagcagagagcgccttggagtgagttgtggcgcccagaagtattgatgttgtggccaggtggattctgaacaagatcttgacgtggctgnnnnnnnnnnggagcgccttggagtgagttgtggcacccagaagtattggtgttgtggccggatggattctgaacaagatcttgacgtggctgttggcactggaaaggctacaaggaccttgagatgcccttgcaatctgccccgactggcacatgtgtaggttgtgaacgagattctgacttactggaggctggaggatgccgatgccacactggaggacctggaggatgccctcatcgtgagtggcctgggctcgtatactgaggcgcaagcgcccagggagggaggagcgggcttcttgcatctactgattcaatggcgcccagagaggaatgctgcacgaccggacgctgaatgtttgctgggaacacatcttcaagttgcgagggaggcattggacagccaaatcatcacatctttgccagccaatcctaatgcgcccccccnnnnnnnnnntggaacactgcacgactggacgctgaatttttgatgggaatacatgttcaagttgctagggaggcattgggcagcctaatgatcacacctttgccagccaatcctaatgcgcccccccnnnnnnnnnnaaactccccatcttcgtatctccagagctccgactttggacctcagacggccttcaagatcgtggatgcggtgcgggagcgggtgaggtccggcgccctgcgcacccccgaggacatcaaggccgccctgcgcgactcggtcctgagtctggtcgcccggccatcaggcgggtcctccgagcttgcctttgcgccgggcagcgacgcggcgggtgtggcgggtgatgcagagactggcggcgatgcagcggcatcagatggtgccgctgcatcgggcaccccaggtaccccaggcggcagccccaccgtctacctcatcgtgggcgtcaacggcgggggcaagacgaccaccatcggcaagctggcgcaccgcttcacctcccgcggcgcgcgcgtgctgctggcggcgggggacaccttccgcgcggccgccggcgagcagctgcggctgtggtcccagcggtcgggcgcagaggtggaggcggcgtccgccggcgcgcgccccgacgccgtgctcttccgcgccgcgcagcgcgcgcagcgcgaggcctttgacctgctcctctgcgactcctctggccgcctccacaccgaccccgggctcatggcggagctggccaagtgccggcgcagcctggcctcggcgctgcctggcgcgccgcacgaggtgctgctggtcctggacgggaccaccggggtcaacatgctggcccaggcgcgggagtttggcgcctccgtcggcgtcaccggtctggtgctgaccaagctggacggcacgagtcggggcggcgccgtggtctctgtcatcgaccagctgggagtgcccatcaagctggtgggcgtgggggaggggctggaggacctccagttcttcgaccccgccgcctttgtcgatgccttgtttccccgcgagggggagggcgaggagccgcagggtggaggaggagaggcgtagaggcctgggctggctgagcacaccagtggtcctggggattcacctcccaacattgtcagggtggtttggtgcgccgctccccgttgctgcatcccccaggcccccaagcgcgagcatgctgtagaactccagccagccaagccactgtctgccagtgtgagcagtggcccgggtatggtgacctgctgggctccgcctgccgtgcactccctgtgctggcaggagcacccccacacactcgcactgccacagtgggaagtgaatcctgaaagacgggtctatttcnnnnnnnnnnctgctggctggagcacccccaaacacccacactgccacagtgtgaagtgaatcctgaaagacgggtctatttcgacagggtgagggctgcgttcatcattcttgcacattgcatgagcatcacaagaaccagatgttggagaggcgggagcgggcgggcttgaccgcagggtgccccgcgcccagcgcctcaaacatgcggagcagcagcttccgcccggcttcctcatgccacccccgatccgcccgcacactcctgagccctgcgtccaacgcctcggcgtactgcctctctgcaaacagcctgtgagccatgcggaaggcggcctctgcgccctgcatcgtgggatgggggcgggaggtgggtgactttgaggtgccgcagacaggaaatgggcaaggatgaataccaggatgggcatgacgcgcactacatgaatccaggacgccgactcctgcgtggcagacaggacatgcacaggcacatggcgtggggcagagtcggagagcatacgtccgctggcagggctgcctatctataccgcccatctgccagtgcttgcctcccatcgctgtacttctacaacatgggtatccaagtgcctgctcctataatccccaactaatcagccctatcagtaccttggggtctgaagcctcagtgccctcctccagggccaaccgctcccgggcgaggtccaggaacgctgccgcctgggccacctcgcccggcctcttgtcctccggcagcacctgctgcgcggcttccaccagccccgccgcggcctctacgtcgcagggcgtcctgaggagcgcacactgcgccgcccccgccagcgccttgcagcgctccgcatccgaagccgggctgccttcaatcagtacttgttggaaccaggggagggcagcagtctcgacgtcggcgtcggcgctctgcagggctgcatacctggacagacaaggaggggggggggaaagggctttagaacggcaaagccattagcagataggccaaatgggagacgctggcggcgcgaagacgagaaggccccaacctgcacaggaaaccaccatcccctccccttcttccaacagttccacgtgcgaggccccctacccctgttcgaggagctgcgcgggnnnnnnnnnngaacggcaaagccattggcagctaggccaaaggggagacgctggcggcgcgaagacgagaaggccctgaccagcacaggagaccaccatcccctccccttcttcaaacagtttcacgtgcgagggcccctacccctgttcgaggagctgcgcgggggtggcgttcggcccagtgcccccgcccgaggcggctgcatccgcctgctgcgcccggtgccgcgccacgtcgtccgccagcttctggatctgggccaggtagtcccgcagctcctggccggaggggacccccggctgggagtccatgagtctgcccccaaacagcagcagggtggcaggcaggttggtgatgtggagctgggcggtcaggcggctcagctgggcagaccccgcgtccagctgggccaggcgcaccgagcccctggaggcatgcacggccctgaccagctctgggtccacctctgcatcggcgctggcagtggcgtacaccacgatgggcgtgttgatgctcagatcggtcagcgccttgaagtcgctcagggtcgatatcactggtgaggggggctccaacccagtcgaggccgagaatgttcgactggcatgggatgcgacctcgcagcaatgggcaatggaattgaagccggattccgatgttccaattaggcgcaaagcaaggcttggggttgcgacgcggggcaggtcgctcgctatgagacgacgacacagagctccgagagctggcaaacgccgcatcccgactagcacttatcaagcatgcttataggcttcaattgatgttcttgagaacaacggctatagcatcgccatcgcatgcnnnnnnnnnntgcttcagatgatgttgttgaaaacaacggctatagcatcgccatcgcatgctcaagatcaatggaagcacacggggtgggcatatgctggtttgtgggcgcgagcctggacctggattgcagggcgcgaatcgcaaatcaaagttccttctgacagataatatgatcggcaggnnnnnnnnnnaggcttgcgatttcatgatgtcgagaaataagttgcagcgatgatctgctgcgatgcaaggtcctgactccgaggccactccccagcctcggtaccacgggcgccatggcggagccgcacccagtggtggagcacctcctcgacgtctttggtgaggcatggctttacttactctttatgtacgcctctttcagggtctcaatccatgacataagccctccctccatcttctgcagggtatagagacacagtgggtcccactgagctgtatgctgccttcaaagactatcaaaaggatgttcgcctgtgtcccgacacctgtgacgaggccgccgtctctgccttcctgcagtggttcatggaacgctccgatccagctacaggtgggtgtgctgggggcccagtcccggctgacagcctcccctccatgtatgtgcagcgcccactcgccaccctcaatgctaccatggaggcagcaggggaggagtctgaccagctgctcctggaccttgtctccgacagcagcagcgaggaggaagatcaggaggtgtgcgaggtccaggcagagtctccctggcgcacacggtcaccccttagcgagggcgggcggggccgcagccacgatgccgacgacatcagcctggacgccgaagatgtggctccccacttctttccacggcccacacaagctcgcgcgcggcaccggcaccttctcttcgaggcgagcagcgctcaggaccaccgcactccgcactgccctccccgcggctcgccccgaggagcagccgggcagaccgccccgatctcacgcagcctcacgccgcaggaacatgcgatggacatgctggactttgccaactggatggtgagagtcgttggaaacggaaggggcagagtcagcatgcgtggtgaccgctgaacctatctctgtgaaattctggcggtttccgaggttccattttgcagcagaccattaaaagactgtgctcggcgggcgcgaagcaccttcatcgtatgcctaccactgctgttgcgtggccgctacgtcagtctgaagagactgccgacggttcaggcgctataggatccctcacaatctggtgtcttcgcccctgccccccctcgttgtaggtgtttggcaaccaaagctttcgtccccggcagcgggacatcgtggaggcggctctcagcggccgcgactgcttcgtccttatgccgacaggtggagggaagtcgctgacctaccaggtggggatggagggctgacatggcatgccagccgattcagcagtcgtcacatgcacatgggttttccctgcccggcgtgagactgcatccactccgcacgacaccctagtcttccacgtgccacgctcccctccttgcagctcccggccgtgctgtccaaggggctgactgtggtggtgacgccgctgctctccctgatgcaagaccaggtccaggcgctgtgcatgctgcgctgcggcggcgtgcccgcctcctacctgtcctcccagcagggtgtggtagagaccagggtgaggaaggaagggtgagcacaagtggctgcagggctgtgctctgtacctaggcactgtgactctcccatgcatgcctccagggggaagtgcatgggccctagctcgccgtggtccccaggcatggactcccctttgcnnnnnnnnnnaactctcccatgcatctctccagggggtgatgcatgggccctagctcgtcgtggtccccaggcatggactcccctttgcttttccacgactgacagtgaatgatcgctccccccccaccaccaggcggtcttcatggagctggccaaaccaaaccccagcctgaagctgctctatgtcactcctgagcagttggtcaagggcgagcggctcaaagctgccctcacctccttgagcaacagggtgcggaacccaggggcagcagggggcgtgtgtgcctcttggcatgctgttgggctctcttccatccccctcggtccagcaccgtgggctccaatggattgcggaatactaggtgcaggtctcagagaaggacacggcatcagtgtgtgcactgtccaccatcccctcttcataacacgtcctcacaccctcctcccgtatctccatcaacagggccacctcagccgcgtcgtggttgacgaggcgcactgcgtctctgcctggggccatggtgaggctggggggaaatttactcattcatagaatgagaaggttgtgaaccttcctcacagcatcagtctgcaatgatcctgccacagcttgcaacccacactcacgctccttccgtctcttctcgaatcttctccacctcctcccccccagacttcaggccagactacaagcagctgggcctggtacggtcggcctgcttcccacacacgcctctcatggccctcacagccactgcaacgcccgaggtgaggaaggacatcctgtcctccctgcgcatgcgttacgtctgcaagttcgtggtctccttctttcgccccaacctgaccttcaagtgcgtttcggggagaggatagggtgggaggtggaagagtgggatgtgtacctgtcggcattgtggttggggcgatgactctagctacgctgttgaaaatgtcagcgaccctgggcgtggaaggaagtcgtccagtcacccaggtggcgtccctcnnnnnnnnnntgatgactctagctatgctgctgaaaatggcagcgaccctgggcgtggaagggagtcgtccagtcacccaggtggcgtccctccctttcccttccatgcctttcgcttgccgtcttgagcttgagcaaatgacaagacatctattcccttccccctttggagcctctctcatcaactccagccccctccgactccgcctcacatgacagggtgatccagaaggactacaagcggaacgaggagtcgatgctccccggctacctgcaccacatgctggagtacataatgtgaggctggaatgcatgttgatagctgtacgtcccggggccaggcatatgctccagttgatttccacgcctcaaaagttggtctcatgcggcgcccggatctggggcctgatatgtgactgcacgagtgtactacagggatgaccaaaaattttggaaaagcgccattttgcacgctcaaacccacacccacacaggtcccgtggcgatgnnnnnnnnnngtgtgactgcacgaatgtactacagggatgaccaaaactcctggaaaagcgccatttgacacgctcacacccacacccacacaggtcccgtggcgatgccaccggcatcgtgtactgcctgtcccgcgacgagtcggagggcgtggcggccgccatccgcgactgcacgggcaccagcgctgcgcactaccacgcgggcatgaccccccgagcgcgcatgcaggtgcagaacgactggcggcaggggcgcgtgtccgtggtggtggccaccatcgcctttggcatgggcatcgacaaggcggacgtgcggtacgtgctccacttctccctgtccaaggcgctggaggggtactaccaggaggcgggccgtgccgggcgcgatggcctgccctgcgagtgcgtgctgtactatgcgcgcaaggacgtgccacgcatcgtgcagctgctgcaccacggcaagcgctccaaggcccagttccagcgcgagatggagctcctgtcccaggtgcaatgaagggatggagggggcaggggggggggnnnnnnnnnnnnnnnnnnnnnnnnnnnnnnnnnnnnnnnnnnnnnnnnnnnnnnnnnnnncaggtcggggatccagtatgggaggagctgccagggcgtgtgcagtcgtggggctgcacactcccccttaccccccaccccaccacccctccccccatcgatagatgagggactactgcgaggaggagaannnnnnnnnngggggcgcaggtgggagatccagtatgggaggagctgccaggtcgtgtgcagtcgtggggctgtacactcccccctaacccccaccacaccacccctccccccatcaatagatgagggactactgcgaggaggagaagcagtgccgccacgcccgcctgctgcgctactttggcgaggagtggacacaggagcggtgtggggatcgctgcgacaactgcctgcccaagcccaagcccactgccaagggtgggggtgcggcgcaggggccgcagggcgccaccaaagcgacccagctcaagcgcaagggtgagcgggggacgggtgacaccgggctgatggttggatgccgtgcctgccccacctgattgatagctgagccttgcccaaggggccccatgtctgagcccagcctcccctccccatgaacaccttctcctctgtattgccagggagggaggcactgtcggacgtgggcttccgcagcgctgcggccctgctggccgacgcgccgccccccgtccctgcggtgtcaagctcgcgaggggcggcggccatggccaaggccaaggcggcgcgcagcgggaacgagcggccgggcatcgctgccttcctgagcaggggccctgcgatggcgggccctcctccaaccagcggatgacagcgtggcagtctcgctatctccacctggcgtcactgcaccattcacaatcccttcaaccctgaaaactccgccttgtcgcttcgttacagcaaggcgcgcggtgcacatcacgagtggtcgggtgaaaaatggagggtggctaccaagggagggggaagaaagcggaaggaaggaaggacacaaagcaaatattgcaagctcgaggatggtcgtcaaatatgtcatacgcaatcttgtttctcctttttttgtgtgttgaggagggagggggagaccgagggggggtctcctggtggaggtgtgatgagtggaccagcaggggaaggcgtagaatcaggccggcttgtgccggagagtctcgtccagggggcctttgcnnnnnnnnnnttttttgtgtgttgaggagggaggggagaccgaggggggttctcctggtgggggtgtgatgagtggaccagcaggggagggcgtagaatcaggccggctcgcgccggagagtctcgtccagggggcctttgcagcctggcgggggcacctccccggggcgtcttcgcggccattcagcgagggctcactcccgatggcacctccttcctcggcacgcaccaactgtgtcgctccacatttgcccccccccccgtgcccgacgctccatcatcagtcgtcgtcgtcatcgtccggggcatagtcgctgtcctccgccagctggaagcccgcgccgtcgccggcggcaccgggcgccgccttacgcggcgcgccccccgccgccggcccgatgacgtactcgtacagcgcccagaccgtctttggagagagcacgcccaggtctagctccacctcgccgtcctcgttggtgggcagctcgtcggcgcgctgcaggatgtccaccacgcccgccatctnnnnnnnnnnagcaccaactgtgtcgctccacgtttaccccccccccccaaagcccgacgctccatcatcagtcatcgtcgtcatcgtccggggcataatcgctgtcctccgccagctggaagcccgcgnnnnnnnnnnnnnnnnnnnnnnnnnnnnnnnnnnnnnnnnnnnnnnnnnnnnnnnnnnnnnnnnngccggcagcggcgtgtaggcgcggtacgagttcacagatttggtccggtgcacagccgaggcggagccg

SEQ ID NO: 32484 - DNA, 61 bp, Chlorella protothecoides
gttcaatttttggatagacagggggggggggggtcctgaggcccctgtgccggcatgaaga

SEQ ID NO: 32485 - DNA, 717 bp, Chlorella protothecoides
  modified_base (103)..(233): a, c, t, g, unknown or other
  modified_base (607)..(633): a, c, t, g, unknown or other
gccccgtccccgggccgcccctcccgtctcgcaagcccggactgcgcgccggcctggggggccgtgcggttcgacaagagtgaggcttttgggccgggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgcgccagcagcgccgagaccgagcgcgagaaggcgtcgttcaggccgaagccgtggtgcacgtggcagaagagggagtaggaccggcccagcacctggatcgccacgcggctgggtgggggcatggcctccggctcagcctcgaagcagacctcaagggaggagccgcccaggtccagggagcccagcgtgggcagcgtggcgctgtgcgccaggcgctgctcctcatagttgagcgccacccagccgtacacgccctcctcctgcccggagatggtggaggcccagccgggctggaagaggaagcccgacacggccagcacgcgccgcgcatcgcccagcagcgcggcctggtcggcctccgccagccnnnnnnnnnnnnnnnnnnnnnnnnnnncctgcgaggaagagcggcgtggcgccgcgcgcgcgggcggggaccaccgcctccgcccaggccagcagcgggcccagcgcggcg

SEQ ID NO: 32486 - DNA, 62 bp, Chlorella protothecoides
ttgtacggcagacagcaacggcaacatcggctccggcaataagggcaagaacaactttggca

SEQ ID NO: 32487 - DNA, 753 bp, Chlorella protothecoides
  modified_base (111)..(258): a, c, t, g, unknown or other
ggaggacacacagtggagatttcgcttatatgagaggggaggggggtgaatccatgcatagagaagggagggtccccttggcccacctcgcgccccgctcaagcggtgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgagaaatcttctactgtgcaggctcctgaacctcaaaggtgtggctctcactcaccctgcagactcccccttgcccaccgtccttcgttgccgctcgtctccgcctccggccccccttttcctcgtacaacccccctatctcaccttcctggccggctcggcggggaggaccagctcgtcgccatgcttggcgatgaaccctgtgtcgacatcgcccgccttgaagtactcattgtcgaggatgagcaggtggtagggcgcggtggtgggcacgcccgcgatcaccatctccgtcagcgcgcgcttcatgcggttgatggcggcggtccggtcctcgccccacactaccagcttgcccagcagcgagtcgtagttggagggcaccaggtagtcggagtataggtggctgtccatgcgcacgttgggcccaccgggcggcaggtacgcggtcacacggcctggtgggtgggaggggggttttgggggggacg

SEQ ID NO: 32488 - DNA, 146 bp, Chlorella protothecoides
gcagcatgactctgggatccctggttcccacgaagagggacatcaggggtcaaggggcggcctcgaaggccgcatgccggatccagggaaacaatccctcacaccccgtccccctgtcctcactcccaggctggcctcggtcgggt

SEQ ID NO: 32489 - DNA, 92 bp, Chlorella protothecoides
tatcagccgaccaagcgggcagcacgtgcaaatcagcttccatgaggtgcttgtagagtgcgtcatgctccgcacgcactcccttctccgca

SEQ ID NO: 32490 - DNA, 139 bp, Chlorella protothecoides
cctgtgctggtccagggaggggtgtggcatcgcccctgtgccgccctcctgcagctccaagtgcaaggtcctgcgcaaagccttcatccctgtacatgacaatcatacccccagcagtgttgacagcaaccacaaaact

SEQ ID NO: 32491 - DNA, 84 bp, Chlorella protothecoides
acagtcacggcatgcatgaaatggcggtgaaggattggttgccgggatgctcatgggtggcgagggtcatcgacctcgttcaag

SEQ ID NO: 32492 - DNA, 61 bp, Chlorella protothecoides
gaggtggttgggtgtttgtgatggcacgggtggtgaagtggaagcagggatttgtttggca

SEQ ID NO: 32493 - DNA, 100 bp, Chlorella protothecoides
gcctcacggagcgcgcggggcgagggtgtcagggacaccatgaagtgcacattgatagtatgttgccgataatgtgtatgagttacacctcccaaaatat

SEQ ID NO: 32494 - DNA, 61 bp, Chlorella protothecoides
agggagctgcccaatgtgcaggcccccctgactccgagccacatctgtgaactcggggggt

SEQ ID NO: 32495 - DNA, 407 bp, Chlorella protothecoides
tggggcgacacgacaggcggctcggcgcggtagccggcgaacagcgccctacgcgccgcgagggccgcccgcggccgcccggcttcctcggccaggcgccccagcctggccagcagcagcgcgagcggcgctttgccgcggctttgatcctgggtgccggccgtgggaggcttctcgtcggtgctggccgcctcggcgtttgcagagggttcgtcggtcgcaggcgctgggccggcgtgcaggccgctggcaaagaggccgatgaccacctctgccaggtccacgccgcctcctccgtctcgctgtgcatgcacgagatccagcgcggcggcgcgcgcctggaccagcgcagcgcccgccccccccgaagcgcccgccccccccgaagcgccggggcgcagcagcgt

SEQ ID NO: 32496 - DNA, 86 bp, Chlorella protothecoides
gcgaaggcggcgggggccggcgccagcagagccgcgcgccgcctcgcgcaggggcgtcaccacctccatgcacgcattgtacgcgt

SEQ ID NO: 32497 - DNA, 145 bp, Chlorella protothecoides
gtaacatttctgaatagggctgcgctgtgtagctactgttgcacatgcatcatggcaccctccgacaggagcaaggacattattaattacaagccaacaccctcctttcttctcgatccccctgccgcacgccaggcctgaccac

SEQ ID NO: 32498 - DNA, 76 bp, Chlorella protothecoides
gcagcgatacacgctggaccacagcaggtcagccccacatccagcaggccccacatccagcaggcctcacctcgtc

SEQ ID NO: 32499 - DNA, 1573 bp, Chlorella protothecoides
cctccctcctctccaccttcatctcctccttcctcccctccaccctcgcctccgccctcgcctccgccctcgtcccctccgccaccgtcccctccatccccgccttcacccacacctttcccgcctccatccctcagcgcgcctgtcctgaccgtccttgccaacgacgaccacacgaagaccttcccagtaaaaacggatggcttgtatgctgcaatcatagagatataccagtatgacaccccgaaatacacatggagcagcccagattcatacacgcacactgaaaccccaagcaccgtcttcatgatggtaagtacatattgcttcaccgtcaagacagcagatgctgagggcaacaagtcaccggactccaatcaggtctgccagaagggttgaacaaaaaatgagcttctctgtgaggtagtaagttagcttagctgttgtgatggggccacttgagaaaatgatgctccttcctgctataatttctacagcaaccatggctcaggtcttcgcaaggcaagatctatgcagacaaatgggcgggagttgtcagatccagcaagggttgaggggacgagcagttgactctgctccatcaaggcacggaatgtgaggtggtctttcgtgtgctgaggattctacccggttgtaactgctggaccagtagaaaagcaggcgtcatgggagatttgagggcctggtaagtcattctgttgtgagcttcattgtggtccccaaggaccccgcagcatgcagcagcttccttgaacaggaatcttagccatacttttcgtttcacttccatcatcgcgtacactggcgtgtgaatatagtagctcacccgatcctgcaaacatattcaggtcttgcaagatcgtaaacatcctgacctcaatcacaaccaacattagcatcctggcaaaagcgtaatttccgagttgtgtctcggggagatcagacgctgccttaccttccgcggagggacggcataatcctctctaattccctccaccggagtcttaacccatactgcacagcagttcctagggaactgctggcgatgggaccggctgcatcagtgcttccatggccgtcagccatctgtggatcactgatatgcactattcaccccaccagtggggctaggaagtggcgggagattccctgcatcatagagaaagggaaggttgttaagtctgctgctgaggcattggcgcatctgtgcgatggggagcctacaaaggagtcctgcatatccaataaccccgcctgcatgacccaccgcccaccctcctggccataatcacaccacggaccaccagctgtctcctcgccaaacaacaccccgcagtttgctgggcaactcaccacgtcactgccgccgaatggcagggtgttgccccctggtccccacagtcggagatagcccccgcccatggcaaagcacgctagcctccgctgcgggatgggaaggacattgtgtgggtcagaggcacgatcttatggtcacgtggcagatctaagttttgcccatcaacctcccccccactcatctttgactccgttt

SEQ ID NO: 32500 - DNA, 61 bp, Chlorella protothecoides
acagtccgattggttgtcagtgcggcacctccagggcattccatattgttactccaactgt

SEQ ID NO: 32501 - DNA, 157 bp, Chlorella protothecoides
tgctcctacaaggtgctccttggggtggcgcgggcgagtggtggctgttccatgcaacaggggcatgtgcaccgaacaggagccggtgaggaagactgaggagggcaccttctccagcaactctcgtccccatgctcgtgtcttgtgtggtggccgc

SEQ ID NO: 32502 - DNA, 77 bp, Chlorella protothecoides
gacattcagaagctcaggcaggcgacaagtgtacatgctcaaggcacggcttgggcaaaaattcgtgccacgagggt

SEQ ID NO: 32503 - DNA, 61 bp, Chlorella protothecoides
tttacacagcagcagctacagaagacagccacccccccgtaggtccacacctgctctctgc

SEQ ID NO: 32504 - DNA, 79 bp, Chlorella protothecoides
cggctgacagcgggagtttccgaccgatctggcgctgtggacccccccgcggggtgctgtgcatgctgcgcatcgaccc

SEQ ID NO: 32505 - DNA, 183 bp, Chlorella protothecoides
gccccgtgtccactgtgaagtgcaagggaaaagagttgaagcagttgtgaaaattgaaaagattaacccgtccgagattccacctgaatgtgcaggagcaagcaaggtggagaccgttaattgctgggacggccagtccaccaccaactgctcccctcacctgaggcagttggtggctgagga

SEQ ID NO: 32506 - DNA, 107 bp, Chlorella protothecoides
cagccaggtgtttgtttcccagccggacagaagctcattcagggtccggccagacgggacatcccgagaacatgtgatgtggggtgtgcaccaagccatgatgcact

SEQ ID NO: 32507 - DNA, 61 bp, Chlorella protothecoides
gtagatgcgtggggacagcccaaaggtgagcggcagctttgcataccagggaaaggcaaag

SEQ ID NO: 32508 - DNA, 79 bp, Chlorella protothecoides
gggcgtggacgtggtcggcctggcctctctccagaactgcgcgaccgtaccctcgtgcctgaccgccgcggcccccgcc

SEQ ID NO: 32509 - DNA, 75 bp, Chlorella protothecoides
gggtccctgtgggtttttgtgggttttgttgtccactcctcaacggtgtgggtgtgttgggggagcagggcgtgc

SEQ ID NO: 32510 - DNA, 181 bp, Chlorella protothecoides
gagcaatccaaagtgctcgtctctccggttgggggtgggcagggacgattcacacatgaggtcgaccggttgtaacaatttcagtaagaaataagcaaaacaaagtgttgattttaatacaaaatctgggttcccttgcatgcatacttataaaccccttcgtctgcagcgtttgctccga

SEQ ID NO: 32511 - DNA, 125 bp, Chlorella protothecoides
taccgcatcgagaagcttggtgcgtgggctattcaataaagagaggaggggacggggtggttgcaagcaaatgccatggagggtgaaagcttcttacagtctgctgcttgcatatgatcctgccg

SEQ ID NO: 32512 - DNA, 79 bp, Chlorella protothecoides
gatagagtggtagtgtccctgctgatgcacgagagcccatccccccccccagatctttggccctgctgccatcaagatc

SEQ ID NO: 32513 - DNA, 94 bp, Chlorella protothecoides
ccctggccgccggccgcctggcccccggggtccgcctcgcccggcgcctcgccgtcgccgggcaaggcgggcagggccatgtcccccaggggcc

SEQ ID NO: 32514 - DNA, 106 bp, Chlorella protothecoides
gctgaccacatctaaacctcgctcactttccccgtccccatgcgatgttctgcagcccatacgccgcgatggcgtacagggacatactctgggcctgcctcagctg

SEQ ID NO: 32515 - DNA, 79 bp, Chlorella protothecoides
ggagcggatgcggcgcgctttgccatgtttgggggctatctacgacaggggagaccagagggcgacaccctgccattca

SEQ ID NO: 32516 - DNA, 122 bp, Chlorella protothecoides
ggtccagcaggtactgggttgttacactgatgccggctcagtggggatgtacatcaagggaacagggaagcatgacagctgctgctcgctgttgctcaggctggtggatgtcagacggctgg

SEQ ID NO: 32517 - DNA, 78 bp, Chlorella protothecoides
ttattcatgtacagaagcggatcatcctaggagaaaggttttggactcagtgtgatccagcacattgacatgtgcttg

SEQ ID NO: 32518 - DNA, 62 bp, Chlorella protothecoides
aagggtttactccagatcttcacatctcgaatcaaattgtcaaacgccaccaatgtttcctg

SEQ ID NO: 32519 - DNA, 61 bp, Chlorella protothecoides
ggagtggtcccggaaccagtactccccctctgccaggagcagggggtcgaagcggtcggtg

SEQ ID NO: 32520 - DNA, 63 bp, Chlorella protothecoides
tcttgggtgtaaggtcgctgttcatcgcacaacacaggaggatgcggtctgcagtgcgtggaa

SEQ ID NO: 32521 - DNA, 64 bp, Chlorella protothecoides
ttacgcaacctccgtgttccggccagaggctggctccgtcccgcggatagcttctgcatcctca

SEQ ID NO: 32522 - DNA, 38442 bp, Chlorella protothecoides
  modified_base (1733)..(1742): a, c, t, g, unknown or other
  modified_base (2692)..(2701): a, c, t, g, unknown or other
  modified_base (2983)..(2992): a, c, t, g, unknown or other
  modified_base (3672)..(3681): a, c, t, g, unknown or other
  modified_base (3839)..(3848): a, c, t, g, unknown or other
  modified_base (4020)..(4029): a, c, t, g, unknown or other
  modified_base (4371)..(4439): a, c, t, g, unknown or other
  modified_base (5161)..(5170): a, c, t, g, unknown or other
  modified_base (5893)..(5902): a, c, t, g, unknown or other
  modified_base (7402)..(7411): a, c, t, g, unknown or other
  modified_base (7714)..(7796): a, c, t, g, unknown or other
  modified_base (8594)..(8603): a, c, t, g, unknown or other
  modified_base (9173)..(9182): a, c, t, g, unknown or other
  modified_base (9266)..(9275): a, c, t, g, unknown or other
  modified_base (9711)..(9720): a, c, t, g, unknown or other
  modified_base (10329)..(10338): a, c, t, g, unknown or other
  modified_base (10423)..(10432): a, c, t, g, unknown or other
  modified_base (10673)..(10682): a, c, t, g, unknown or other
  modified_base (11556)..(11565): a, c, t, g, unknown or other
  modified_base (12038)..(12047): a, c, t, g, unknown or other
  modified_base (12566)..(12575): a, c, t, g, unknown or other
  modified_base (13645)..(13654): a, c, t, g, unknown or other
  modified_base (14351)..(14360): a, c, t, g, unknown or other
  modified_base (14994)..(15003): a, c, t, g, unknown or other
  modified_base (15442)..(15451): a, c, t, g, unknown or other
  modified_base (15584)..(15618): a, c, t, g, unknown or other
  modified_base (15763)..(15772): a, c, t, g, unknown or other
  modified_base (15980)..(15989): a, c, t, g, unknown or other
  modified_base (16411)..(16420): a, c, t, g, unknown or other
  modified_base (16947)..(16956): a, c, t, g, unknown or other
  modified_base (17047)..(17160): a, c, t, g, unknown or other
  modified_base (17368)..(17377): a, c, t, g, unknown or other
  modified_base (17637)..(17646): a, c, t, g, unknown or other
  modified_base (18215)..(18224): a, c, t, g, unknown or other
  modified_base (18781)..(18790): a, c, t, g, unknown or other
  modified_base (20118)..(20127): a, c, t, g, unknown or other
  modified_base (20709)..(20718): a, c, t, g, unknown or other
  modified_base (20783)..(20792): a, c, t, g, unknown or other
  modified_base (20873)..(20882): a, c, t, g, unknown or other
  modified_base (21163)..(21172): a, c, t, g, unknown or other
  modified_base (21279)..(21288): a, c, t, g, unknown or other
  modified_base (21436)..(21445): a, c, t, g, unknown or other
  modified_base (22004)..(22013): a, c, t, g, unknown or other
  modified_base (22545)..(22554): a, c, t, g, unknown or other
  modified_base (22826)..(22835): a, c, t, g, unknown or other
  modified_base (23382)..(23391): a, c, t, g, unknown or other
  modified_base (24266)..(24275): a, c, t, g, unknown or other
  modified_base (27203)..(27212): a, c, t, g, unknown or other
  modified_base (28020)..(28029): a, c, t, g, unknown or other
  modified_base (28146)..(28155): a, c, t, g, unknown or other
  modified_base (28587)..(28596): a, c, t, g, unknown or other
  modified_base (29328)..(29337): a, c, t, g, unknown or other
  modified_base (29397)..(29406): a, c, t, g, unknown or other
  modified_base (29930)..(29939): a, c, t, g, unknown or other
  modified_base (30324)..(30333): a, c, t, g, unknown or other
  modified_base (30726)..(30735): a, c, t, g, unknown or other
  modified_base (31346)..(31355): a, c, t, g, unknown or other
  modified_base (33649)..(33658): a, c, t, g, unknown or other
  modified_base (34002)..(34011): a, c, t, g, unknown or other
  modified_base (34546)..(34555): a, c, t, g, unknown or other
  modified_base (35320)..(35329): a, c, t, g, unknown or other
  modified_base (36286)..(36295): a, c, t, g, unknown or other
  modified_base (37750)..(37759): a, c, t, g, unknown or other
gcggggcgcggcacgctcgccgctggcgggtcgtgcagacctttcgacccctccccatccgtgtccctccgtcccggcagctggcggggtacggcatgtcgggcgatgcgcaccatgtgacgcagccgccgcccgacgggcggggggcggcgctggccatgcgccgcgcgctgcgctccgcgcgctgcgacccggacgaggtggcctacgtcaatgcgcacgccacctccacgccacaaggcacgggagcttggtgttttgtacaggggatggggagtctagggtggctggggggttgcagcgccccgtattggatgtggggagaaaaggggtgctgtgctgtgtgggccgatgcatctggtcctcttcaaaagaccgcagtggaggtttggcaggaccttgtgcctggccattcaccaaccctcctgccaacccccaggtgacgccgtcgaggcccgggccatcgcccaggtatttggcggccggccgtccctggccgtgtcatccaccaagggggccatgggccacctcctgggggctgcaggggcggtggaggccgccatggcggtgctggccctgtaccatggcgtggcgcctcccacgctcaacctggaggaccctgagccggcagggctgctgccgggcctggtgggcccgacgcccctcacgctgccgcccggggccggggcggtgctcacgaattctttcggcttcgggggcacaaatgcggccctggttttcaccaggcatgcagcctgagggggcgcgggatgcgcgagggagcagttgaccgcgccatccgtacgagcgatgccccgtccggaaattggatcgaggcgggaaacggacctcacctgacgccctcgccccggccatcccagtgcgcctgcgcccttagtgggcggggcatgctccagcccacagtcctggagatgtctggagtgccagcggagccaatgcaaggcgaacatgagccagccggtggctcgactggggacacgccagaggtagaccctgttggcgagcctggtccctcccacacagccccagaaactcccggagcaatgcctggatcggatgcgagcaatgaagatgtgctggccctgctcccgaaacatacggtgagcagggacggtaggaggtggtgccagtgccccctatacaatgataatcgttggtggcccgtgacagcacagcaatcccaccgggtacatttcaatgcgatttactcatatttacatgcaggtggtgcgtatcaccggaaacaacaggaccaagcaagggtatataggccagcgagctgttgttaaacgagctgtcgggctgggaggttggcattggttggtgagttccacgaggtccggaacacgtcctcgctggcttgctggaattttgggagtgtggatgcgacttttacgggggttccggggggggagggcgcagcctgcatcgtgtcggggctggtaacaatgccagctcggcactccgaacgccctccttcggaattcctctccaacacctccatcctggatgtgccagatattgggagatggggaggagataaagctccagagaaacgctctccaaatactagagcatcccaccggcaatgaagcagtgagtgctggcagtgagatcggagtgttggctgcatgtatgttagatagtcaaagggggggtggaggatcctgactctcctggtgcagtccttgcactggagttgggtgcaaatnnnnnnnnnntggagtgttggctgcatgtatattagatagtcaaggggggggtggaggatccctactctcgtggcgcagtccttgcactggagttgggtgcaaatgagtgggggctgtattccctatcaaagttctcccccctccagatccctgctgatcaagatctcaacattgccttatttgcaggacttctccgaggaggaggaggaagaagaggcagccccctcccaggccgcctcccactacagccacctcccccagcaccagcctcgggtcccgctcccactgccccacacggaaggggcctccccccagcgaagatcgtccagccgcactgccgccatcccgcgaataaacctgaacaagctggacatcaacgccctgcgacgatatcgcacgctgcacggcctgccgggcatagggccccacacctccaaggaccagctggtggtggcagtggccgaacacctcagcgcccagaccatggacgagatggcggtgctggagaagttcagggagcgggccaagcgatacaaagcgctgtgagggtggggacgtgggagatcacatatcataccaggagccagagaggttgggcgtgtggggccccaggacgccaagcaccagtgtgctttgcatctggccgatgctgtgggtccatggcctgccctggggcgaggcaccgccgctcctctcccaccctttcgtgctacttctgccgatcgtcgagacttctcgccccacttcgcacttgtgttgctcaatccctctcccacgtggtgtgctcccctgacacctcgctgaagggccctgacttccctctgagaatggctgctcgccaccctatctcccctggctcctccactcaattcctgaccatgctgacctacccctacgttggagttgctggaccttgtccctctgacgtacacttgcgactcggaccacctcaaccggcnnnnnnnnnncctgaccgtgctgacctacccccacgttggagttgctagaccttgtccctctgacacacacttgcgactcggaccacctcaaccggcaccattgacatgacagactccccttcaaccatgacacgactcctcccccctccttccgtatcctatccccccatgcccagggacaccccactccggaacccctcccacctcaccccggaaggtcccatggactgttagaccccttcccacctgcactgtgcctcgacctgttgtaccaacatcgcaatcaccagnnnnnnnnnnctaacccctcccacctcaccccggaaggttccacggactgacagaccccttcccacctgcactgtgcctggacctgttgtaccaacatcgcaatcaccaggagggcagcaagggcatgcaggcccgcaggtgctaggcgccggggtggatgaacacctcacgtggctgcagggtgtccagcaccgcccccgtccgctcgtcagtcagcaggcagccggccagcagctgctgcccggcggcgaggggaaggaagcgcagcgccacgcggtggcgctcgccgggcgccagggccggcgcggggacagagtgctggcccgaggccaccacggcgcccgtcgtggcggagccgcgccacgacacgagcagcgggccggagggccggcgtccggcgttgtggacctccaggcccagcaggaaggcgcgctcctggtcaaggcggggaggcaggctgcagatgcgcagagagaggtccggggggggggcggcggggcccgcgccgggcgcgctcctgctgatggtctgtgtctgcagccgcgcggtctgcatgggggaaggggatgcatgggatgcggttgcgaccggcggcacactggccacccaggaactgctgtggggtcatgcaacaccatttccgaccctgcatgcctgcccgcaaggatgcggccggcatattgcatgtnnnnnnnnnncgtctgcagcctcgcggtctgcatgggggagggggatgcatgggatgcggtcgcgaccggcggcacactggccacccaggagctgctgtggggtcatgcgacaccattcccgaccctgcaagcctgtccgcaaggatgcggccggcatattgcatgtnnnnnnnnnnatgatgtgcctcacctcgcccatgggccccgtccactccaggtccagcttgcccaggggcacgttgccggagccggggtcgcggggggctgtgcccggcctgggggccccgggctctacagacaggcggaagaccagtccatacgacccgccgttggggcagagcagggggnnnnnnnnnngtgatgtccctcacctcgcccatgggccccgtccattccaggtccagcttgcccaggggcacgctgccggagccggggtcgcgggggggggtgcccggcctgggggccccgggctcgacagacaggcggaagaccagtccgtacgacccgccgttggggcagagcagggggtgcttggccagcgagcggctgtgggaggggcggcggatggggtgtgagaggagtggagaagcatgcaccatcagacggggaggaggggccagagctcagatagaagggggttccctgggcagcgggcacggattacaatgctgatacctgaacaggcacagcccagcccgnnnnnnnnnnnnnnnnnnnnnnnnnnnnnnnnnnnnnnnnnnnnnnnnnnnnnnnnnnnnnnnnnnnnnagggcattgttatcaagacatcctccctcaccgatgaatcaaactcccagtcgcacctgaggggtcccagaggaggctcgctgttgccatcgccggcaggggctgagacctcctgtgcgacatagggcgcgttggccaggaaggcatggcgtgtgagtaaaaaaggatgctgcactgcgctctccaggaccacctccagcaggatgtcatcatccacggtgcgttgctgcgaggggtgtggggtttgggcacgatcttgtatcgggagtggccagcctatgacgatgccacaacttcccgtagcggacgaacaactcacaccaatgacccaacctaccatggactggccactcattgattacatgcaggctcacaacctagcccatattcttccacaccttggtccggacgatgaggggattggcggcggagaatcggaatgcctgggactcctgccgacgattcccgtccgcatccgtgaaagctgcagagcaggtgagggtgtgcagccccacctccttgatgccatggtttatcaggatgctgtgctgctcaccagcgggcagggtgagatgggagccggcggcattgctgtggaggagggccctcccgccctcggtctgtatttcaatctacagtgtgggacgacaaatgggtactagatcgatcattggcaggtttcagtggtccgtccagggctgtcacctcaacagggccatgcnnnnnnnnnnaccctcggtctgtatatcaatctacagtgtgggacgacaaatggggactagatcgatcattgggaggtttcagtggtccatccagggctgtcacctcaacagggccatgctgagaacctagggcgccacctaaacctgcaaattcctgcatctgaacaatggctcaggtactcacagtgacggagaggctggacaccggtgtgcgatccagattgcacagcacgacacacgcacgaaaagtgtgtcccaggtacacagtcccgaaagtggcaggagtggccaggactgcggatggtccaaagccatcatcggcactgtgcaccctgttggcgaaagggtgctgcagggggagcgactgggggtcgaccgaggggatcgcctccatgtcattcagcagatcaaacttgtagggtctgtcgtccggaaatttgggtggattcaatcgcatcaccctgaaagcgagggagtggggctccgccatcgctgtgcagcagcgcctttggtaaaaatgatgcggggtggcaccaggctcctcactgtaatttggatgtatgccaccaaatggtcgagtctaatccacactccaagacatcccaatgctcttgtgtttgcaggcttacgccctccagatcactttgctcgctgctgggcatgcggtgcttgccaccctccttcgcgtcattcggatctagggcactgaaaaccaaggtgtcgaacaatacnnnnnnnnnntccaatgctcttgtgtgtgcaggctcacgcccttcagatcactttgctcgctgctgggcatgcggggcttgccagcctccctcgcgtcattcggatctaggcactgaaaaccaaggtgtcgaacaatacattccttcaagaatttagcggctcaactttactcaggggaaaagcatgtctgggttcttctcagaagggatgacatcgttgaggtcttccctcccaagaagcttggccacctgccattcatggaggcatggactgtgatgcacagagccaccttaaaaagttcactggcagcatggcccctgtgagctaggcatgaggtccccaaaccaccacctcaccatgctggagaaggtgcctgctttcgggagcgtcgtgaagttgaagggcttcaccacctccctccgctcctgcatggaaaagttgcgcagttcattcgccctctccagcgcccccagattggcttccatgtcggcccaggcctgtggcatgaggaggacgacaaacatcagagtccatcctggtgtgaagacattccgggccgtcttgcccacgtgcatgcggcactcacgagtgtgcccaaagacaaccattctcccgccagctcaggcaggcttgatcccaccactcgcccgatccccgcctcacattccaactgggactgctctccgggtctgccttgaccgcacacttaaagagctcccgggcaagcctcgtgtttccattcctgctttccagcaccgcccatggctggaacaggtgcgctgcgctcttggcgcgcggggggcacatggagatgcccctctggaacagcgcccgagcggagtcgttgttaccctggcggaactccaggcatccccagccctgggcggtcggagggaggcttgcatggggtcggatggtacaagcaaactctccgctgctcaagcttggggccccagccactccatcattcccacttggagaccacacagtccctccccagcccacctgccatacgtagaggtgcgaggggtcggccacggagccctgcttgtacagctcccgcgccacgcccacctccccctgctgctcctccagcttggcccacgccgaccagagcgccgcgtcccgcgggcaagcctgggtgccctgctccagcagcttccgcgcggcttccacgtcccccgccgccttctcccacatggcccaggacaggaggaggtagcgtgaccccggggccgcctgcaggccgcgccggtacagcgcgcgcacgcggttggcgtccaccggctggcgcctggactccaacgccgcccacgtgtgccacagcgcctggctggacttgccctgtgcttgggtggaggagggaggaaaggggccggtgcgtgcattgacacacacgagtcggatttcccagggtctcactggcacaaaaacacctttgcacaactgagctcacagggggatcctaccattcgcacttcattaacaagaggcacagaacccacatgnnnnnnnnnnaggattgacacgcacgagttggatttcccagggtctcacttgcacaaagacacctttgcacaattgagctcacagggggatcccaccattcgcgtttcattaacaagaggcacagaacccacatgcattccacttttctccccttgcctgcacggtctcagtcccctgctggcaccatttcctgccttcctccaggcaccccatgtccatggccagcagcgccagagcgtggtagaggtagggatttggggtccctcgtgtcgctccaaggccctttttttgggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnacacgctcacaacaaataccctctctcaaccctggctcaccttgatccagaggtcacgcgcccgcttcacatttccctccgtcctttccagctggccccagccgtgccaggcggcggcatgcgcgggcgaggccacaatggcggcgtcgaacaggcggcgcgctttccccaggtcgccctgcagtcgcgccaggtgggcccaggccgtccagatgtgggcgttggcgccgcaggtggcggtgcacccagactcgtaaagcgcctcggcctcggcgaagcgcttgccactgacgaggaccttgcccagcgccacgtaggcgcggccgtcagtggggtccatggccatgcaggcccgcagcgcgccctccgcctcagccagcagcttggcgcggcgagtgggggaggccgcgcggtagccggagatgcgcagctggcgcgcacggtactgtcgggtttgtggcagtgtgtgtgcgtgcgtgcgttgaggggtgggaggtggaggagggagggcacggactggtttgccgagcacacaacctgctatcggcaccccatatagaagcaaacgccaaggggcattgccgccaggcaaggcaggggccatgttctgggagcctactgctggagagcgcttcatcaagcgcctcatcggagtgcaccctgcaaacgcggataccttccctcgagcctgtcacccaaccagacatgcatacaagcattcatgccagcaaacaccagtcccccatttcgccccacacgcgctactacccaacaacaggtccctcctcaccatggccnnnnnnnnnnactcgagcctgtcacccaaccaggcatgcatacgagcgttcatgccagcaaacaccagtcccccacttcgccccacacgcgctactaccccaacaacaggtccctcctcaccatggccaggtcctggttgatcttgaggggcttgggcgggttgtcggcgggctccgggacgcgagcaggcagaaaggagggtccctcggccaccctcacctcccccagcagcttgccgttgcggtccgggggggtgaatgcaaacgatgcggagagtgcgcgaggccgcgtcgggaccctgtgagaggtcctgcatgggtctcgcctcttccatgtggtgtggatcgcggggcaggcggaggctgcaccccgatgcagggggagactccgcatggctcgaatctccgcatgcgcggaggtcgaagccgcctgggtcactccaagagtgtccatgacagccacacaaggtgaggagagtgcggggtatcgacgccttaatcagacgaactcatggagtctttggagtcgcagcgggcatggtggagattttggagcccgggcctccgatcgaccacccgnnnnnnnnnncgataaacggcaagtgtataccatgcacgacctctaactcgacagaccctgcaataaatcctctccagttctcgtgacaatgannnnnnnnnnaacttaatcagacagagctcatggagtctttggagttgcagcgggcatggtggagatgttggagcccgggcctccgatcgaccacccgaagtctgtttgatcctggcgcccgatcgtcttcatgggccagctcacagacagtgataaacggcaagtgcatatcatgcacgacctctagctcgacagaccctgccataaatcctctccagttctcgtgacaatgatgggggtacgagcatgtggttttacatctacagcgcctgccagtcgtcccatgggcgaaggggttggcatggccgctccttgcagcgctcgcagggtgagttccatgtttggagatgcaggacgaagcttggtcactcgagatatctcttaacatggtcgacatgtcgagcacataagatctggagtgtcagcattgtcctgtacgccccannnnnnnnnnctggaggtgcaggacgaagcctggtcactccagatatctcccaacatgatcgacctgtcgagcacataagatttggagtgtcagcattgtcctgtacgccccacatgcacaggctagccgatccagatctgcggtcatcgccatggcctcggccgcgccgtccaacatcctcatgctaggtgggcagccatgcatgatgacgagtgttcaggagactgaaaagcacgtgaggattccgtgattgcgtcgtggcccgggcaggaccttgtctgtcttggagatttggagcaccttggaagttatcatgtagccccatccaggccatgcatgccccttgcccgggctgccccatctcttcctaccaccatccaatctcctccttcctgcacccaggtggaacccggttcatcgggcagtacctcgcccgccagctggtggaggaggggcaccaggtcaccctgctgaccaggggcaaggcccccatcgcggcccgcatcccggatgacaccgacgaatcgcacgccgcctattctgacgcggtccagcacattgcggctgaccgaaaggatgccgacgctgtgaagaacgctctgaaggggcgggaattcnnnnnnnnnnctctcgtcctaccaccctccactctcctccgtcctgcacccaggtggaacccgtttcatcgggcagtacctcgcccgccagctgnnnnnnnnnntcttggtgtgagggccggagggaaacagtggggcttgtatgtgacgctgccaccaccttgtgctggatacgatgacgcagacgtccctgagaccacctgtgcaagctcaacctccctgcaaaacccatgccatcatgtcctggtgacagcgatctcagccccacgccccttccccatgcagttgtgtacgacatcaacgggcgtgaggcagaggaggcagatctcatcctggaggccctgnnnnnnnnnncctcggtgtgagggccggagggaaacatggggcgtgtgtgtgacgctgctaccgcctcgtgctggataccatgacgcagacgtccctgagcccagctttgcaagctcaacctccctgcaaaacccatgccatcatgtccgggtgacagcgatctcagccccacgtccctcccccatgcagtcgtgtacgacatcaacgggcgtgaggcggaggaggcagatctcatcctggaggccctgccctccctggagcagtacatctactgctcctctgcgggcctctacaaggcctcccacgagctgccacactttgagacggacgccggggaccccaagtcccggcacaaggtcggagggggaggagaggggggttgacaaggtggaggcgccgagggaataccctctcgcattggccccccaaacccgcccttgggcccgtctgcatgggcgcttcaccaaggtgagccaacctcatgcacagggcaagctgaacaccgaggagctgctggagaagcgcggcgtgaactggaccagcatccgcccggtgtacatatacggcccgctgaactacaaccctgtggaggagtggtttttccaccgcattgcagcgggacgacccattctggtgccgggcaagggcaaccaggtgacccagctggggcacgtgaaagacctggccaccgccttccggaaggtgctgggcaacccaaaggccgctcgccaggcctacaatatctcgggggagaggtgagtgcgtgggtgaggtgacatgggaggagggggctggtcgcagggctggacctcctgacacgagtgcaggaagaaggcacaccaagagatcagggagcactggggtatgagagggattgctcctnnnnnnnnnncgacatgagtgcgggaagaaggcacaccaagagattgaagagcactggggtatgagagggattgctcctcctgttccccagcatgtgtttgggccatttcatggccttacagcacccatcagtgagctgcaatcccttgcacatgcaacctccctcccccgctccaggtttgtcacctttgacggcctggtcagactgtgtgccgaggccgccggggcccccgagcccgagctggtccactttgaccccaaggcacacgacctgggcaaggccaaggcattccccctgcgcgaccagcacttcttcacctccatcgccaaggtctgtgtgtcattctttgggggagttggggtgggttactgtccaacagtgctgtcccggtgcggaatttcatgagttaatcagggcatcgcccctactgcaagctctcctgtgctgcaagttcaacagacagctcttcctcgccccctccnnnnnnnnnntgggggttggggtgggtcattgtccaacagtgctgtcccggtgcggaagtccatgacttacccaaggcatcgcccctactgcaacctctcctgcgctgcaaattcaacagacagctcttcctcgccccctcccaggcacaagctgatctggactggaccccggagttcgacctggccgccggcctgcgtgactcgtacgagaaggatttctccaagactgggggccgcaagaaggcggacttctccgtggatgacctcgtgctgaagggggccggcaagcaggccgtgcctgcctgaagtgcaggcattgttgtttgagtgagtgggccatcacctgcattatgccctgcccctgcacaatgctgaggttgaatgcggacaggtgtctacatcgacgggggcccactcattccctgggtacaccatctctgtaagttcggaataagcctggcagtccatatatcttacattgcacagcggagtggcaccgagcagatcaaaatgggacaaaaggggggnnnnnnnnnnggcattatgccctgcccctgcacaacgctgagattaaatgcggacaggtttctccatcgtcggaggcccactcactccccgggtacaccatctctgtaagtttggaataagtctggcagtccatatatcttacattgcatggcggagtggcatcgagcagatcaaaatgggacaaaaggggggtgggcaaggtccaacccggacctcggcagctggatgtatacaggtttcacaagctctgacaaaaatatgggtggaaaggaaggcttgtgcggctgatcgaagacgaccgcctcgagaatgtgggggaaggcagtgtttgcgaaacgctctcattgagcacaggaagtcagtgtgcgggagtctgctcaagtgaaggtgcaaatgaatggtgatatggttattgatcgactcggtccggcaggtggcgcgcggacggcatgcctgccgccctgccccgccttgtggcaaagaatgggtgggtgtatcgtgctcgtcgtcctagctaccaagacattagcagttctctgcgcaagaagcttactttctctcaaaatgggggggtgggggaggggggccgcgatcctgcgctccctcccacccaaagaacatggtggcagcctctgagcgacctagcccagcagcgtccagcctaccaccgcagctcgggggactggaagtaccgcctcagggcggcggtgtagtgctgctctgccagctcgacgtgcaggctgggccgcctgccgccgctgggcggcaggcgggccgggcaggcggccggcagcggcgcgctggtctcggccagcagctcctggaactggaggagcagcggcagccaggcacgatccgacggcgacaggagctcgtggtagggcttgcctggcttgaacagggccttgaaggactggtgcctgtggatgtcaagaggattagggaggggttgacggctcaggcatgagacgatggccgattcagggcgggacttggccatctcagctcttgctggcatgcgatccagaggtccctttcattgagatcagcgagagagtatcacaactccttccacgatnnnnnnnnnngaagaggaatggggagggggtgacggctcaggcatgagacgatagccgattcagggcgggacctggccatctcagctcttgctggcaagcgatccagaggtccgtttcgctgagattggcgagagagtatcacaactccttccacgatataccccatcggtgcatgcacttctcctgatgtagtcatccctaccaagtcagttcccctcccccgccaagagcgtaccacttcatcctattcaagccagcacaaacacaaacacacacacgcacctcaggaggaagagtgcctcgggcggcaggcgggagccattgagggagaggaccatgtacaggtactccgcccccgtccagctcatgtagacgttttccagcccgcacccagtgctgtacatgccggtgggcgtggagtacgccttcctgcgcctgtccgggttggtgaaggcaaaggcgctggccgccaccgcagcgcgcactctgcaccccacggggaaggattcggcatgtaacagccagctgggctcggagccccatctgaaatgagggagggaagttgggtctagggggtcaggggggccagtgatagggaggatcctctggaagccctgtacataaagtaggatgcatcgatggacactctgtgcgccagccacattgaaaggctcaaggtagaatcgcacagccaccactctggaannnnnnnnnncgtcctctggaagccctgttcataaagcaggatgcatcgatggacacactgtgcgccggccacattgaaaggctcgaggtagaatcgcacagccaccactctggaagcacaacaggcatgcttgtctccccaccaccaaccacttttcccgcttccctcttcatcccacctgtcgtgccccaggacctctcccacgcgcgccagcaggcccaccacgggcatccagggcagggcggggaagagcttggccgccgcgtcggcggtgtacagggcgcgctcgcgcgaccccggcgccaggtcctccagcgcgtccagcacctgccagacggtgagcgcgccgcggtccagcttggcaaagcgcgcgcgccgcgcgcgcacgaagtccatggtctgccgcgaggagttcatgcgcgcgtccagctcgcgactcgcagccacgcaacgctcctcctccgccggccagtccatgctgcatcggccaaagggcgcggggtggtcgccgcgccaggcgtcgctgcccagcgcactgggaggagtggccagggccaggcggtcgtggcccttgccgctctgacccatcaggggttgggtgggggcggggcacagggcggcggggggggaggaggccgtggannnnnnnnnngaggggttgggtgggggcggggcgcagggcggcggggggggaggaggccgtggaggaggagaaggcgtcgcagaaggcgcgggtgttgatgctgggcagggtcgagggggggggcgtctcctcaaagctggaccggcctccggcccgggagctgcacagggagctgtcggaaggggagcaggaccccgaccccgggctaagaggctgcttgaaggggtgggggcccgggccagacatgccgccgctgatcgccaccctgcaggagtgggggagtgatgagcgggctggatgagagatggcaaacggtcatgccacaatgcaggcttggcgctaggcacacgcctcggaagccaggtgtaagggcctggccttcctggcgacaacctggcccatcaaaccctgccaggcttgtcccacactttcgatccagtacctggannnnnnnnnnccatgccacaatgcaggcttggcgccaggcacacgccttggaagccaggtgataggacctggccatcttgccgacaacctggcccatcaatccctgccaggattgtcccacactttcgatccagtacctggannnnnnnnnnnnnnnnnnnnnnnnnnnnnnnnnnngtgcatgagcacggcatgcgcaccgaaagatagagtagcactttctagcccctcacgcctcaccggagggctgactgcgcagagccatggcgctggagatgaggtttgctgggagccccgtgtaggaactccctttgaacatggnnnnnnnnnnaagctgatgctgcatgctggccaggagacgacacgccgcggtctgttcagaatcgccagcgcgtcgttcatgacctaggcaggagggggagttgcgggaaggttgcttgctcactccgaacgggaggccggggggtgcatgagcgcggcatgcgcaccgaaagatagagcagcactctctagcccctcacgcctcaccggagggctgnnnnnnnnnnagaagggttgcaaccatcccgagaatcccgggtgagagcctgcgacacggaggacatggacagcggggccccgggaggagggggggaagcgagcgacgtgctaacggacaggatgacggcctgcgtggccgcttggaggagtcaacgtggtacttgagcgataatctggagcatgagtggagctttttggcgtccatggtcgttccatggcgatataatcggtgtcgttcgcaggaggatgacagacagcctgcccctattcgacccaggaaagcatgaacgtgtctcggccacaaacttgcgagattctgtgtttttatttcggatgggattttctcatgggcactcttcgcggagcgcgacatgattcgtcgatgagggaccatccctgacgagaaattgcttgctggctctgacacccnnnnnnnnnntctgcccctattcgacccaggaaagcatggacgtgtctcggccacgaacttgcgagattctgtgttttatttcggacgggatttttctcatgggcactcttcgcggagcgcaacaagattcgttgacgggggaccatcccttacgagaaattgcttgctggctctgacaccccttatctcaatatcgttaacagcgcgatgccatcagaagaaaagattgcgtacgctaagcaaaatccgggggagatcttatactcggattgtaccgtggctcctttcacgagattcccaacagcgggccccggaagcaagggcttcatagtcgtgggtgattcaatccctctcccgtactggaacgggaggggctgaacagcgccgatttcagctccttagtagccttgttgaacgactccctgcgggtgaatagtgaagcttgagatacacaatataccagccagaggcatcggctgcacagtagctatactcatcagctggccgtgactgccaggacaggcagacattgcacnnnnnnnnnngccgtggctcctttcacgagattcccaccagcgggccccggaagcaagggcttcatcgttgtgggtgattcaatccctctcccgtactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaagtgaagcttgagatatacaatactccagccagaggaatcggctgcacagtagctctactcatcagctgggcgtgactgccaggacaggcagacattgcacttcgagtctacatagtccactcgggaggctccctcccgtcctgctcgcacacacaaaatacccaaaaggggcacacctgaacttcaacttggcaaggcgcgnnnnnnnnnnccggggggctccctcacgtcctgcttgcacacgcaaaagaccaaaagggccacacctgaacttcaacttggcaaggcgcgatttgaatgaggatgagggcgccaaggacggcgtctggtccgcgtcattctccccgttcctcaagcgactggagctggcagcggcctgggccccctcccctgccggcggccagctggcgggaaacgcgggccccgccctcgcaggcgttgaggggcagtcgggggacaacctccccgccnnnnnnnnnntgcgggaaaggcgggccccgccctcgcaggcgtggaggggcagtcgggggacagcctccccgcctcggcggccgcctcggcccgttgcaggcggtgggagggaccccgctcggcgatgggctgcggggcggtgggcaccgtcgaacggcgggcggctcgtctcgccgcccgccgttcctgccggtgccccaccgccgccagtcggaggagtagccgctccagctcccacccctcctcgcccacctctcccagaggagcgtcagtgggcacatactcgccaaaggggaggagctcgttcaaagcttcatcctggtggggaaaggggaggggggcggatatttgctggagcaggtggcgtgccagtgcagatgtttggcagggaaacttgtgggtgacaacagggggcccaagcggcgcagcgctgcatgaccacggagaggctggaacacgggccggtgcgtggaaagaggacacaacccttgccctggccagagctctgggcagagggagaacacctcaatcgtgaggcaagcggtaccccacctcgagtgtcagcagcttgaagcacnnnnnnnnnnaggtggtgtgccagtgcagatgtgtggcagggaaacttgtggtgacaacagggggccccaagcggcgcagcgctgcatgaccacgggaaagctggaacacaggccggtgcgtggaaagaggacacaacccttgccctggccagagctctggacagagggagaacacctcaaccgtgaggcaagtggtacccacctcgagtgtcagcagcttgaagcacatggggcattccctgctgcgttgggcccattgcatgacgcactggaggtggtagcagtgtctgaagagttggcgaggaggtgagggaggcttgcgacacagggacacgctcggggacaggcttgacacagttctacaggcataaggaacacgtttaggagagccctgcttggactcacccgcaggtagtggggatgccgggatcggcctccgtgaactcgtcaaggcaaatgggacacacgccctcttcctcctcctgcaccacgatagccttgcgcgacagctcgacgccatcgacctccttgatgacttgctggccaggggaggaaggtggggacgnnnnnnnnnngagctcaacgccatcgacctccttgatggcttgctggccaggggaggaaggtggggacagctcgctgcccagcagaggggagggttccaaggccgggcacccctctgcctccaaatcaaaaacttcctcgcccagcatcgccagcacacgaacccatgtaccaagggaggaatacttgcgctgcagaatcgaatagcctgtgccgcaggtgggcagggtcgacgccaagtatctgggaaggctctccacctgaggtctcggaggatcgcttggttggaaaggatggccattcgtgaggcaaaaccaccacaccaattccgactactaaacagcaatagttgttgtgtggtaataactccaattttctaaacaagaccagacaggacgaggtgctaggcttcatgttcaacagtgcttgctctctgaactccaccctcgccaactggcattttcacaacgagtcctcccaggtgtagatggccctttctgctgctgaaatcatgcgcatcttgcgcctggcctcattcttggactgtttttcggctatttctcgcaagcacgtctctcgggactcccaggccagcctgaatttctccgcaatgtgtaccaccacttcttctggtgggggagcggaccgggctcgctccatggattggacgcagttggggggcagccctggacgaagtgaagggagggagagacgctggctgacgtgggcatgtggctggaaagatgcagggcgccggcccagccaagggaacatcccccatgtgcccggcaaggtctccagactcgcattcgggccagtgtcaggccttcacccctcccctctcccctgctccgacccttacatcgtgtgtcctccagctcccagacactgggactgggctcaggcctctcctccaaggcggcatcccgcaccagggacaccttggggcaggtgcgctgcatccacaccaggatagcggccggcatggcggcccagtgcagggctcgcaggctcatcaggcggcccggccccatcgtggccgctccttccagaccctcccagctgtcgctggcgggctctgaccccgcctccagcaccggcatcacagccttcagggcgcgcagccccgcctcagacacctcgccgctccctggggaggccgtggggtcggcggtggcagcatggcgttggctcttcaggtacagcagcgggtgtatgcttggttgcaggggtaaaagcaggcaactttgcacgtactcaaaggccaccaggccgcaacccaacaccccacagccctcacaccgcactgtcgcaagtcctcacagccacagcctgcctnnnnnnnnnnggcgggtttatgctttgttacaggggtgaaggcaggcaactttgcacgcactcgaaggccaccaggccgcaacccaacaacccacagccctcacaccgcaccgtcgcaagtcctcacagccacagcctgcctcacccaggtgcagctcctccagcaaagggcaggaggcccccagtgtcttgagcacgctggcagccaggtggcagccgcccaggtcgagggcctgcaggcgcgctgccttctgcagggcagcacagagggaggccgggtccagcgaggagcagccgcgcagcgtcaggcgcacatggccctcgtcgacgagctgtgccaggacgctgcggcgatgcgaggcggtgggagttgatgcggttcgagctgcgatgcggcctgatgtgcgtcgccgagcaaggataggggctcatgcattcactggtccaggacaatggggcttggtgtacaagagacgatagaaagggatgtatatgctgcatccccaacgcgcccacctttcgctcagcagcccagcctggcgagctgcgatgatgagcgcggccttggtgggggggggaagaaggggcagcnnnnnnnnnntacgataggcagggatgtatatgctgcatccccgacgcgcccacctttcgctcagcagcccagcnnnnnnnnnnctatgaggaagcctgtgacaacaggcaattgggtcggctgggtgtgtttgcgaggtcctggacacgttttgggcagcccannnnnnnnnnttatgaggaagcctgtgaaaacaggcaattgcgtcggctgggtgtgttcacgaggtcctggacacgttttgggcagcccagctggttcatgccttccctctggtggtccaggccgtacctgtacaaatgctcagcaggctggagctcccacacgcgacagaggcaccgcgctctgaacttggctccaaagatgttgggagtatctctgccaagttcaagcatggcgtgccctcattctcagctgcggcatagggtccggcgagcgctttcgtctcggaagnnnnnnnnnnagacttggctccaaagatgttgggtgtatctctgccaaattcaagcatggcgtgccctcaatctcagctgcggcagagggtccggcgagcgctttcgtctcggaagnnnnnnnnnntataatgcatccgtcgacagcgcgatggactatcttgttgcccatcggggtttgggagtccacctgacgctcaggcccagaaacaaccccctgggaatcatgcactgggtgacacatcctgctctaagaggtccagacttccaccagnnnnnnnnnnggaacgaggtttttgttcttagctacatgagcaattttggtgaggggctaccattacggaaataatgcatccgtcgactgcgcgatggacaatcatgctgcccaccggggtttgggagtccacctgacgctcatgcccagaaacaaccccctgggaatcattcactgggtaacacaccctgctctaagaggtccagacttccaccaggggacggacgtgggcctggcctacgtatgttcggcatcacttcagaagtcagaatcaagtgggaatggagcagaggcagctggagcttgcgaggatgtgtgcatgtgcatgataacctccaacgcccctgccatgaaggtcttgatcaccaaaagcaaactctttgcagccttcattctgtgtcgatcagcactgatcaagcatactatgtgacggcacaaaatagtgccagaagcttctcttccttgcacactccaacacctgcctctagaggtacataatggattgtagaatgacaacttgcacacaacagattggataaacactgtacatcgatatacaaccagctgannnnnnnnnncctgtgtcgatcagcactaaccaagcatactatgtgatggcacaaaatagtgccagaagcttctcttccttgcacactccaacacctgcctctagaggtacattatggcttgtagaatgacaacttacacacagcagattggatgaacactgtacatcgatatacaaccagctgatacgccgatgggaatccagctaggattagccagctcgatggccactcgttgtggacccctcaaaacgctgggattccaaggaaaattgagcgctgcggatagagcttcacctcctgctgctgtagacttgataccggggggcggtatcataataccctgaacgcctgaacgccgaacgccgatgttgaatcatcttcccgcgcatatcgaagtttgtagaactcacccgcgaggttgctcccttgttgaaaccaattagatcggattagggcatccctatcgctgcaaagattttacttcggacttggggctttgtttaaaatccatactttcacgatgccggcgaagagcaggtannnnnnnnnntttataaccaatcagatcggattagggcatcctaatcgctgcaaagaatctacttcggacttaaggctttatttaaaacctgtactttcacgatgccggcgaagagcaggtatggaggtgttgagggttgtccaccctcctcgcgctgagcaacgtttacttttacatagcgccgaaaaagccatcacttaaatgtcacgacaggtacacactgatcgttgaaaaccttgatagctacacgcgctcccgggacatcaaggaggtgcgacttnnnnnnnnnntggtgttgagggttgtccaccctccttgcgctgagcaacgtctacttttacttagcgccgaaaagtcatcacttaatgtcacgacaggtacacgctgatcgttgaaaacctggatagctacactcgctcccgggacatcaaggaggtgcgacttccgagtggcttcaggacatgcatgctcgatgtcttccagcgcaggtccgacaacgagtacattctgcacgccccatgtactccaggaatgccgatactttggagacgttagggcggtcgagcgggatgttaggagtcggtgtgccctcgtggagttcgacaggtgggcacaggtggggttgtcatctgcatgccacatggtccatgccttttccctctggccgtgcgacatgtacagcacccatccctcctcagacgggcaacgcacgagtaggctctgcaccgttccaaggacagaggtgcagcacgtcttccagccccagcggccatggtcagctttttggggaggaatccagtgagtaagggctgcttggcgcaagtgtttcaaccccgnnnnnnnnnnctccagccccagcggccatggtcagcttttggggaggattccattgagtatgggctgcttggcgcaagtgtttcaaccccgtccttggaccctccacacaggtcctcggcagcagaaagggcgtatgacaagctgcatggcatctccatgcatggaaagaagtggagtgtggattgggcgacccccaaggactttgatttctttggtgaggaaagggggtgggtggacacggatcaggattccattgtgctctctgaaagcagctcctttgcgtgtaactgtgcagtcacgtgcaatcgatttgaattagaactcaatgacgattatgattttgctgcgtgtgtaggatggaagtggaccgagggaggcgttgatgagtctcccctgcggtaagcttcggagtgattttctcgtctgactttcccccaccattcaggcctgcgttaccagtgatttcaccaacgaaacgacgcaagccgatgtctgcatttcaaccctgttcatataggtcggatgtctcagatcgctcgtactgaaactggctctcattggagaggccatgagtcttggccataccactccctgggcatggtgctcccttcctataggcaaagtatatgctacccttgcactcggatgcgatcattctcgatgtacatagataacaaacggggacgaggtgagcagcagcaggcaaagcccacggggtggcaaagcaactccgtgctttcctggtggatctgttcgaaccactattcgcaaccccacgatcgcccaatggtggatgccccgctgctgcgcgctcgatcaccaaatctcgagtgcatcggtggggcaatgattattgcgcgatgcaggacgttcaggtggaaggnnnnnnnnnncctgagttccccccaccattcaggcctgcgttaccgttgatttcaccaacgaaacgaagcaagccgatgtttgcatttaaccctgtttctataggtcggatgtctcagatcgctcgtactgaaactggtcctcactggagaggccataagcctcaaccataccactccctgggtatggtgctccctccctataggcaaagtatatactacccttgtactcggatgcgatcattctcgatatacatagatcacaaatggggacgcggtaagcagcagcaggcaaagcccacggggtggcaaagcaactccgtgctttcctgatggcactgttcgaaccaccattcgcagccccgcgatcgccccatggtgggtgccccgctgctgcgcgctcgatcaccaattatagagtgcatcggtggggcaatgattgttgcgcgatgcaggacgttcaggtggaaggtggctttctcggaagaagtctcggcggtcccctcacagagagccgctcgataaatgttatcccacccccggcatcggaaaagctacatcgcctcaaatctatatcgctcggtcgcgagagggcctcgcccaattctggcgaccgggatgagtctcctactgcaggttccgggcctgctgcattcgtacttcccaaagacctgcaggtcctctccgccgagctcgcgcatccagcctccacggacatcctcgccgtcataggcatcctccaaaagagcggcccggcaaacgcacggacatcccggtccgcgctcctgcgagcgggggcctgctacctggcacacgatgccgagagcgccgtcagcgcacacgccggccaggcacgcaaactggcccgcgcacgcctgcacctggcattccacgaggtgcgacaaaggaaggttgtgctttgtagtttcctgagataatctgggtcagggaggcacagggtcgcagcacgcaaatgagtctcgaggccagcaggagagccatcttgggggtgagtcaccctcctccccccgcccttccaaacaaatccctgcgcaggcaaacgcgcgggacgagccgcatgcgctgcgcaccccccggcccccgccccgcgcctggctcaccgggccagcgcccatcgacgccagcaagcaccgagcctccctggcggtgcgggccctggtggcctccacgcacgacaagtgtatgcccctgcccaaggtaagggacgcgtggggagttgctgcatgctgcccgcgcagtctcttcactcaggcagctcatcgagaatcaacccctccccggctccccccgccactccgcaggctgtgaggcccccccccgacctctctcgggcccaggcagagaccctgcgtcccctcctcgcccgcctgaggctccagctggcgctgcaggcctggcggcaggcgctgcgccggttgcggctccaggccgcggtcgcggcgcgctgtgcgcacggcgcggacgccgggcgcgtgcgcacagcgctgctcggctggcgcgagatggcgctgccctcggccgaggcgctggcggcggcagcgcgtgtggaggcgcagaggaaggaggcggcgcgtcgtgcctccctgcgagcatgggcggaggctgcgcgcctgtccaggtgggttctcagtgggcccacgacagaaatgcggcctataacatctatgagctgcagtggctgcagggacgaaatgtgctgagctgatccatgcgcgcaggggtgcaagcacagatgccctgttgccctgcgcccacaagcctggtcgccctgggtgttgttggtgaatgctgagcggtgcccttcctgcgtgaccagtgcttcccttcagaccacgaggctgactgcaagccattcctgctcccctgcgcaggcgctgggcatcatgctcagtccagatctcggcatcggtggggtcgcaccgcctgcgatccgcctgggcgcactggcgcgcctttgcgctgagtcggcgggttctgcgactccaggcgctgctggcggcgacttggcacaggcggcgcggtgcggtcgcggcgctcgaggcctggcgccaggtcgcgtcccggcgcgccgccgcgcggaaggccctcttatgtggggaaagcggacgcggggtgaaagctgcagcaggcgttgcagcagtgggccccggcgccgctgagccggagcagcgcgaagattccagggctggctccaggcacggcgtgctgcggccgctggcgcgcctggtgcgggaggcccgggccgcagaggccgcgctgtgggcctccgacctggcgacccgcctgcgctaccatgctggcggcgaggagtgggcaggaggtgcgtcgtcgccggggagtgccctccccgatgagaacctgcgtgatgcttatgaggatcgggtgacgtgccagtcgtcggagtacgggctcctcaaggcttccacatcgggctctggcatgtacgcctcaccacatgggcctctgctcggcgccggcgccgcgcagcccgccgaggatgtaggcgcctcggccctgccgtcgctcgcagggtgtgcggtgcggtaccggcagcgacggctgctggccaaggtactgcgtgcgctgcggtgccacgccgacgaggcgaggcggctgaacgacgcggcacggcaccacgcccgcacgaccctctcgcggcgcgcgctgcgcctctggcgcgaggagcacgctcgctgcgcatccctggccgcgagcgggcggcagcggcgcgcggcgcggaccctgcgcaccgtccttttgggttggcgagcggaggcgggcagggcgcggtccctgcgcaacacggcggctgctgtcgaggccgccagcgtcaggtgttcttgtgattgaaccgggggggggatgctgggctgggctccttcataaaacccaggccgatcttgccgcaccagctgctcnnnnnnnnnntggggggggggaatgctgggccgggctcctttataagccccaggccgatcttgccgcaccagctgctcctcaccacgccctcgccaactctcagatggcgcaaggcccacctcctgcggcgctggagggcgcaggctgagctagcgctacgcgcgcgggcgctggagcgctccacgctgacgaggcgtacgaggcgagccttccgggcctggcgcaccgaggcgtccgtgcgtttgaccctggccacgctgcacgacgagctggagtgtaggacccgtggcaggctcctgcgcgcctgcctggcgcgctggcgcgccgcggcggcccgcgccgggctcctgcgtcgtgttttcggcgccgcgctggcggccaggagccgtcctgagggcgccgagagaatcgcgctggattacaacaccctggcttcctgcttcctggcatggcaggcggggctggcgagggcgcgggcgcggcgcatggaggtggccgcacgctatgcggcagatgccttcaggtgggagggccgaggaggggccagggaaagggagtggccgagggagggcagggcagatggtctgagtgaggcaaactttggcgttggcatgcaattctgcctgcagcgccaccaagcacctcatcttcaccctttgatggtccgcctggatgcaggcgccggagtctgctcgctgcgacgctgctgcactggaggaggctaatttacggatgaaactccaacctcgcatggtaccagcagaggcgggacagtacctcggcgtatgcaactctttggcttccagaccgtgacacnnnnnnnnnntcagcactcccctgcgtgaccgaccactgacattcccaactccacaacaacctacgcccgggccatcctgtccttaatgtacaattccccgttgccacatcaagtcctgcattctannnnnnnnnnggctccaacctcgcatggcaccagcagaggcgggacagtacctcggtgtttgcaactctttggcttccagaccgtgacactctcctgtgcactctcttttcagtaacagggaggactgccccttcttgacgctcgataccagcactctcctgcgtgaccgaccactgacattccaactccacaacaacctacgcccggactatcctgtccttgatgtacaatccccccgttgccacatcaagtcctgcattctacaggcaaatgggattgggtacagcaaaagggaacagctcccacggggaaggcatgccagttgcatgagtgcactctcgaggcaaccagccggtgaaatgctgaggcaaccatgattccgaggaggcttcccacgggacatcagctagtgccgctgcacgttctgctcattgtttttcnnnnnnnnnncgaggcaaccatgatcccgaggaggcttctcacgggacatcagctaatgccgctgcacgttctgctcattgtttttctaggagatgggtgcagtcccagccatcattgcttgtccttggcccaggtggccttgtcatgcgggccagagttggccttgtagatgcccacgcccttgatggcctccaggtacttttgtgcgacctggtacgattgtgcaagggatgagtgcgtcggttatacaggccccggtatacctgtctccctcggtgctggagcgcaaccccgtgcctcacctccttgcactgagtgaggtggtcgatgccctctgtccggtagcactccttgagcttgcgacgcaggacctggggcatggcaggggatccaacaatcgatatttaatatactgaggagttcgagcgtctcttgcacccagggaagcatcaatacaagccccggcaaggggtatggaccccatccctcaccttggcctccgagaccttgatgtaggcctccgtcacagcggcctcgcggtgcctgtaatacagcacagggtctgcatacttgttctctgggtcatactcgggagggtcctgcaccgggttcaccccagtccacggcatcgcgaacggggtgcactccgcctctgtagataaggtgagctgcctggccctgaatgcccaggaccgttgcagggtctaaagggactaggaggccgggagggatgttcaaagnnnnnnnnnnttcgatatttaaatatactgagaagttctagcgtctcttgcacccagggaagcatcaatnnnnnnnnnnagtaagctgcctggctctcaatgcccaggaccgttgcagggtctaaatggactaggaggccgggagggatgttcaaagctacgacgaagtgctcctccacgtatgattcattttcgtggcatgtgccgcaccccttgcgcaaggaaagctcggcgaaactctttcagcaacgacactgatctgcgtccaagcgcaagctcccgacctacagtcaggtttacttggtgctcaaattgactaaatcgtatgaactgatcccaaggtggctatgaccgggcatggatgccggtgaaatcacctggactccacagcagtggagcaggctggaacggaactggaggagggtagcatctacacacaacatcaaggtgagatggggcagtgatgtactccggacgcattaaattacgagctgttttcctcagagctgtggcattgctgctggtaacttctccaatctcatgcaatgccccgtcaggacctcctcaccgaacctccctgcgatgataagttcaaccgctcgnnnnnnnnnnctagattaagagctgttttcctcagagctgtggcattgttgctggtaacttctccaatctcatgcaacgccacttcaggacctcctcaccgaccctccctgcgatgataagttcaaccgctcggagttctttctcgggtgagaagatgtggtcatgacccacagagacatgacaagacctgagcctagtgcttgtataagcgatcattgctcatggttacacaaaggcacaccaatcggtgcaggattttgctcattgccgctggcctttcccttttagtgggagttcttctcaagacaatggtgataatttatattggtttgaggaagttgaagtgcatgctagttttcccgtcacacagtactgcttgtcagtgtgacactgnnnnnnnnnnctataatcgtgtgagggagccgaagtgcatgctagtcttcccgccacacagtactgcttgtcagtgtgacactgtcgacttggggaagtaagttctgatttctcaaaattcctaccctttgcaaccaggtgctccctttcctggatttgccctctggaggcctcctgtataatctgaaacagagtgactactaccctcagctcatcgcggccacactgcctgtcaccatcatggctgtctttgtcaactggacctgtctgaagctgtataagcacaattcgtaaaagatgagaatgaagcaggatattgtacctgcccgactttaaataaaggctggagatgcaatatcaacctccagctcttagtgtctacttcctgtctgcctgcctgccnnnnnnnnnnaagtctgaagctgtacaagcacaattcgtaaaacatgagcatgaagcaggatattgtatctgcccgacttcaaataaaggctggagatgtaatatcaacctccaactcatagtgtctacttcctgtctgcctgcctgccagggcaaaagccactgaggctcagcttctcagccgtttaccgcatgtgtcgccagtgcagcttatcgctatgggaggcacatgtccatcattgattatgttactctagatgttgtaacaaatgcacatccttgcaatctgcatggtccccagggcatgtttcatgcaggggcccaggctgcaagtccacgatgctcaagaatgcgtcactgctccagacgtaaaacgttgcagccagggtgttgcacacccaatggctttaatgagatcagaatgcctagatggctctcagccctcgatgagtcttgagcagaattcgtactgttgttagtttgagtcgtcgtactttctgaatcctgagcatccgaaattggcgacaaggcggatacaaggatgacacgctgcctcgccaggatactattaatgcatggcaaccaatcgatacgtttgtgtgaattctaaaagtactatannnnnnnnnnttgaggctcagcttctcagccatttaccgcatgtgtcgccagtgcagcttatagctatgggaagcacatgtccaccatttgattatattactctaggtgttgtaacaaatgcacatccttgcagtctgcatggtccccagggcctgcttcatgcttgggcccaggctgcaagtccacgatgctcaagaatgcgtcactgctccagacgtaaaacgttgcagccagggtgttttgcacccaatggctttgatgggatcagaatgcctagatggctctcagcccttgatgagtcatgagcagagttcgtactgttgttagtttgattcgtcgtactttctgagcatccgaaattggcgacaaggtggatacaaggatgacacgctgcctcgcaaggatactattaatgcatggcaaccaatcgctacgtttgtgtgaattctaaaagtactatatcagtctggattggtagctgctcgctgagatctgattcgtgtacggcaagaatttggcgttgtgccggcaccccctcccatctcgcctggacttataatcttccgagcagacactggaaacaaatgaatacgacttcgatatcctggatggatcgatagggttcggattgaacgggagtcgtgactcgggctgtgagtgttaaccaaggagaccatgctagggtggagtcctccccgtcgaggacggccaagattaggtaagcatgcattccacattagaacatttaatgtccaaatttagtcttagtagactacgcagcaacctttgcaccccatattccctctttttaggccctaatgtgactaaaaagcgaagatcaggtgtgcctggcgggtcagcatggatggattcagggactgccaccacaagctctttgtacaccgtgtgcctcattgctggattccatcgtgaatgctcttgtcgaatgacagtgatcatcctgccttctccaggaacgtgagtattagtaacacgcccctccccagtcgcaggaccatacaacagaggccatcaccgacatgccagcatggaacgactgtgagtggcggaagtggacatgacgacttgtgtttgcctgagaacactctctgagaagcccatttccatcgttaccaggtccagagaccgcagcccactggctggctgcttgacacacggccagcagatggagccggtgaacggtgcactggtggaaaaccgtgatcccaacctgcccaactctgctggtgagcaatgtgcttcagcggagaactggccaattgggcggcctatggtgcaaagggattcgtagctgttcagcggtgtactttccactggtttctagtgagccctgcctctgtcagagacacatatgcacggccaccctgctcaccatccccgcactcctgccggccagactggaccacgaccgtgaccttgccggagcggcccaccatcatccgggtgcccctgcaccccccctccaccccggtgacggtgcggcactgcgcagaggctcgctttcccgaggaacctcccgggagccccgtgatatacgttggtgagtgcctttgccattttgattcgggatgtgctgggctagagcatggggtgtgggtactgttgtggcgatgggtgggctgcaaaccctccctacagcaatcacagctttgtggagggtcggaccaccgatcgtaccccgctgccctctccccaccgccatgccacagcctggtgtggacgctacacacacggcggcttcgagcctggcacagtggccgcggcgcatgaggcgggagccacccacacgccctgcccggacgcggaacctgccgcgcagcggtgccccgccagcccgcccagcccctccctgtccgacctgtgcttggagctcctggcctccccgcccagcccccctcccgagggcatgcaaggctgcctgctgacgctggacctggaggctgggggttgggggtcatggcaacccggtgccacccttggccccgccgaccttgcgctggggaggcctggacagcatcgccaggacacaccactgtcccccttttcgtccagcttgcgcggccttcccaccctctgtcctggtgagatgggtggatccttgtgcttttgggtgcctggggtggatgagactcgagcccctcagggggggtggggacattcaacctcgtctgtctcgctgctgagcagcgcaggacaacagcacacagggggccggatactttggcgctggggaggcccatgtgtgcaccagaaggtggttgttgcgtgagacgccgaccgtnnnnnnnnnntcagatacattggcgctggggaggggccatgtgtgcaccaaaaggtggttgttgcgtgagacgccgaccgtaaagggcaggggctgagcggcaagtcaccaggtcaataatacatttgctcccaatgcagacatgcccgaacttggactgtgatggagcgcgtgaagatcaacccaccaggcagcaccccacttggccagcatgcaaggtctttctcgcccagtagcgcacaaacgaacgactggagcactgctgggtatggcagcgccaacaaaatcctgataatatgatttcttctccttgcaccgacccacccttgtgctcctcgctgtgcaatcgatacnnnnnnnnnntaccaggcagcaccccacttggccagcgtgcaaggtctttctcgcccgatagcacacaaacgaacgactggagcactgctgggtatggcagcgccatcaaaccctgataatacaatttcttctccttgcacggacccgcccttgtgctcctcgctgtgcaatcgatactcagtcgtgcccttacaacatcgtgagatccatggcaaacacacacactgccccaaaatgcatgcaattcacaatgtgcaaaatcccttgtaccgaaacaacaaccatccctctaggcccaaaacttgggcttgcgcttgggctggaggtcggcgacgtccagatcgctgattttggcctgcaaacacaagggttgagatctgagcgtcctgaacttcagtttgactgtagttcagccatgatgtctctaaaacatgctctctcgttaggatgcatttgccctttccttctctaaaaatgcccatcatgccctctgcccactctatgcgcagcatgcaacagcttgcaaccaccaccgcctgcccannnnnnnnnnatatcttagtcatgatgtccctagaacatgctctctcgttaggatgcacttgccctttccttccctaaaaattcccgtcatgccctctgcccactcaacgcgcagcattcaacagcttgcaaccaccaccgcctgcccagacgattcaaagcccaggatgcagggtccactcaccgccatgatgaagtcgttctctgtcaagccgttggcagagtgggtcgtcagctccgccgtaacgcggttgtagcccaccaggtggaggtcggggtggtggccctcggcttctgccaccgcggccaccctgctcaagggatgacaggcagagagatacgacgtagtgagggattgtgcggccggatgagctgcaccatcaccagaggaagcactgcaaactcttacgtctagcacagctgccacaaagtctctcaaagggtcgataaggattccctgctcctgctgcgggaccacatcatcagtgcccctccacgcacctcttgaagagctccagcccagccatgaagttgcgcactttccactcctgagagatgcacttgatgcccttgtcgttggttgtcaatctccagccggggcactgcaagacatggatgggtctggagtgagtggcgctctttcagatctgggaacttgaaaataaaaagagactgtgtcaaatctcccctggccggcactttgccggaagacatcagcagcactcgcgggtctgcagtgtccccaccatagccatcccagatctgcccagtcatnnnnnnnnnnccatcagccgcactcgcgggtctgcagcgtccctaccatagccatcccagatctgcccagtcatcacctgatgcctgagcttctcggcctcggagtcggtcaggggcttgacatccccgccctcgcaggccaggcacttcctgttcttcagtccaaccagggatgccaggccatccgggggcctgttggagagacatgagagggtatgtttgggtgagtcactgagaaccttctggagacaatactcaggggcatgggatcgcaactcctggttgaagcatccccactgcagcttctcagacaccaagccccacatgtgcagcagcccccgccctgtccagggtctgacaggcgcctcctcactgcccacatcgcactttatgaggtgctccgtgttctcgtttccaaagctcttctcggtgaagttggtggcgatctcaccagggaaggggtctctcgcaccaaaatcctgcgcattggatgcatgctgggtgagtgacagatggcattgcttggcacgccgtgcacctctaccctgactgtcatgcataagcaggaagatcaccggtgtgctcttatgtctacagaacagacaccaactccactctgccactcaccccatcagcgtctctagctctgagcttctggctggacatggagaaccttctgtaaacgaatgacactcccaggcgtccacaagactacgggaatgggaggagacatactaatttggaatcacatgcgagtccatctattcagtatagcaatcaagtccatgcaatacaccaggccccggagtaagaagagccgatgacatgccaacccatacttcccatcgccccaacccaccagggacaccagtggccgtgtagcacaaggcagccctgcagcacgcatgcatgggggggaatgtaatacagatattacagttccggcactcagcagcatgtcagcccnnnnnnnnnngacaaggcagccctgcagcacacatgcatgggggggaatgtgatacagatattccagttccggcactcagcagcatgtcagccctccccaggctcaccgcgcgtcgtggcgccggaagcgagcatgttcatagcctgacccccgagtccagtcacgcccaccacagcgactgccagtcctttaccacgcacgactcttcctgagaccaatgatagcattattaagggtatccatatgctctttcccaacttgtgcggcaatcggggagcgggtgccgcggcatcgctgagtctgatcattgctgggagcggcacggtaccgccgcgggaccccccaccctatccgcaacctctgccctctctggtcggcaatgcgtccctccgatgccttgcaggtggttcggcatctttgaccgagaaggttcaagtgctttgaaacaagtccaggatatatctttccttctcgtcgggcgtcggtgctagtcgcggggagcagcatgaggccagtcacggctttcaccacgactcggcccaacatctgtcgcctgactcagagcaggagtgtgacggtgactagacccgtttatgctcaggcgcctctgcgggtgtctgccctgcagacgtccttcttgagtcccagcaccgccctccgtggcttcagcgcaaccttcaccagtgagtaccggcggggccatgcggaggaatgtgatgcttgcaagtgatgcaacactgggcaactttcggagtcgcaatgcacttggccgctgcggaagcctggaggccctgtgagcatgtccctcatccccacaccatgatgcagacctggtcatcaacccagtgaagcgggcgctgtctggcatgcgctggccgctcttggtcgaggccaacaacaagaagggcctcggaaacacgctgcatggcagccggaggtagggtgtggggtgcagctggccggatcatgtcgtcggactgccgcttgtggggagatggagcgtccaccaggtggccctgacacgccacaccctcctggccatgcacaggaaacgggcgcgtgtgtctggattcaggacccgcatggcaaccacggcggggcgcaaggtgttggccaagcggcgcctgaaagggcgcaaggtgctctgccccggcgggcgccccacccgcaagtgatgcagcgaagccgccgtgccctggcgagcattcgtttgttacagcttcctcgatctgggtgtgagcgtgaggcgtgcatgtgcacagtcccgagcacagtggcaacacgcagtggtggggcctgtgtactgtgggcacccacgagggaccaacaggtgagcatcactgcctggcaagccatcgttcatagacgagaaggaggtgggataccggtggagctccatggcccctcacttgcaatccattcagaaaagggcagggatcggggtgggtgggcgcgcgccaccgnnnnnnnnnnttgtgtactgtgggcacccacgagggaccagcaggggagcatcgctgcctggcaagccatcgttcatagatgagaaggaggtggcataccggtggagctccatggcctctcacttgcaatccattcagaaaagggcggggatcggggtgggtgggcgcgcgccaccgcacctgggaggccgccagcctgcggcgccaggcgctcctcgatccgctgcctgcctctctcccccggacccgcccctcgttcaagcacagcctcagagccgcgccggggtgtggcgcaggcggaggggcgggtcgaaggcggcggccagcacctcctccatccgctggcagcccaggacctgcatgtcctcgcgcaccgaagccggcaggtcatcccgcacgtcccgcaggttgcgcacgggcaccagcgcgcggcgcacgcccgcggcatgtgcggccagcagcttctccttgaccccgcccaccggcagcaccaggccgcgcagcgtcagctcccccgtcatcgccacgtcggcgcgcacggtgcgccccgcgaataggctgacgagggccacggccagcgtgaccccggcgctggggccgtccttgggcaccgcgccggcgggcaggtgcacgtggacgtcccagcacgccgcgggcgaggcaggggcgtcgcggtgcgaaccggccccggca

SEQ ID NO: 32523 - DNA, 363 bp, Chlorella protothecoides
  modified_base (113)..(312): a, c, t, g, unknown or other
gccaaaggtcttgttctcgtccttgttgattacagacatcagctgcgcgcctgggagggcggcgatgtggagagtgtgggtaggtgctgaagtgggcaggtcacggaatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagggacttaggcatacatcccattccggctcagatccccagccaaaccc

SEQ ID NO: 32524 - DNA, 67 bp, Chlorella protothecoides
gccggggcacgcctagccagcccctgcaccacctgcgatggccacacaataccttctcgacgctgat

SEQ ID NO: 32525 - DNA, 72 bp, Chlorella protothecoides
tgccgcccaggcccgggaaaccttggggggtgtgcatgagtaggggggtgggcgtcgggtggcacccggagg

SEQ ID NO: 32526 - DNA, 64 bp, Chlorella protothecoides
cattagcacagcgcaggttggccggccctgggcgcaaggcgggtgtgggactcgctcctcatac

SEQ ID NO: 32527 - DNA, 61 bp, Chlorella protothecoides
tggtcgaggtcgcacagaatcttggcagggaccgtcgtgcgggcacacagtgcgcaaggcg

SEQ ID NO: 32528 - DNA, 86 bp, Chlorella protothecoides
tacgctgctgaccctttacttatacagtgcgccttcctctacccaagcagccgctcttcacatgcaatgtcacctgcatcttgccc

SEQ ID NO: 32529 - DNA, 100 bp, Chlorella protothecoides
ctgtcctgggtgtgaggacagcatgggcattaggccaccctcccaccactggcccacatgctgaatgccagcccgtacctgtttcgtccagggtcccttg

SEQ ID NO: 32530 - DNA, 61 bp, Chlorella protothecoides
caattgtcttgggtgcactggtcgacgggccctcgtcctcatcttgtgtgtccgctcttcg

SEQ ID NO: 32531 - DNA, 115 bp, Chlorella protothecoides
ggcgcaggtgagccatctggggtcaatgatcacacacaccccactcagtcatgcgacaatggatgctgggcagccacggtgcgaccctcgagcaagcaatgacattggccggtat

SEQ ID NO: 32532 - DNA, 70 bp, Chlorella protothecoides
gctgggtgctgtgccgagggaggcgtgccggtctccacagcaccttttgcaaccgggtctgggctggcag

SEQ ID NO: 32533 - DNA, 106 bp, Chlorella protothecoides
agggtgggcactgcatgggcgaggccacgcaacaaggcgcagtgctgccagacgggcccgctggtgccactccccactcgccgtcgccgcgagggcggcctgggtc

SEQ ID NO: 32534 - DNA, 61 bp, Chlorella protothecoides
tgatccataggcggattcgctcccgtggcttcaccgatcttgcggaggagcctcatctcct

SEQ ID NO: 32535 - DNA, 62 bp, Chlorella protothecoides
ctgccaaacgtctgaggcagggacacttgctaggcgatacccctgtgatgccagcctgagtc

SEQ ID NO: 32536 - DNA, 61 bp, Chlorella protothecoides
gactcgtgcgataacctctgtgagactgaatcatgtgcagtggatcaatgagctggaattc

SEQ ID NO: 32537 - DNA, 65 bp, Chlorella protothecoides
ccctgccacccgtctctagcctcgactttccttgagctggacaaaggccatggtgtacataagcc

SEQ ID NO: 32538 - DNA, 69 bp, Chlorella protothecoides
tgggtgggtgaggtttttgtagggcagagggcagaggccggtacctggaagtggttgggaggccaggat

SEQ ID NO: 32539 - DNA, 61 bp, Chlorella protothecoides
gtcggagacaggcagcatcacgacaaccaacatacatacgcagtcttactcacaggtgggg

SEQ ID NO: 32540 - DNA, 490 bp, Chlorella protothecoides
  modified_base (216)..(284): a, c, t, g, unknown or other
ggcggccgccgccaggtgcgcctccagctcggccaccagggcgccgaccagggaggcgcgggcggcggccatgccctggcgcgcggggtgaagggcgcccacgcccgccagctcggcgcgggcgaggcggtcgcacgcgtccaccagcgtcgacaccgccgccgaccaggactgttggttttggaaggagtggctaggggagtggctggggggggnnnnnnnnnnnnnnnnnnnnnnnnnnnnnnnnnnnnnnnnnnnnnnnnnnnnnnnnnnnnnnnnnnnnntgcatgaatggatgggtgagtgggtgggaggggtaggcagacgggttgtgcgaggggagagtggggagcaaacgggccgcatggtgcccggcctcgcgtgtggtgggtgcactggcatggcaggatccctggcgtcacagacgatcctcaacctactgctccagtccctgcatcgaagctggcctgccgccccccctccgcccccc

SEQ ID NO: 32541 - DNA, 61 bp, Chlorella protothecoides
gcagcaggccctgctgcccaagccttcggatcccaagctctgggtggtgcggtgtgcagag

SEQ ID NO: 32542 - DNA, 172 bp, Chlorella protothecoides
acgcaatcaatgacgtaaggaaaagtgatgtgtgttggaatgataaagggctgagcacgggaacagggatcaagccgctttgtgatttcagctcacacaatggggctatttgagctgcaccaatgctgttccacaagctgtggctgtttcgctgcccagacagagcatcagt

SEQ ID NO: 32543 - DNA, 150 bp, Chlorella protothecoides
gggggttgtgggggggggggggggggggggatgagagaaagttgtggagtttggggcaattatgaggggcaatggcaaagaacagagtgcattccgtgtctggttcaccacccagcaggaagcatggcacagccacgatcgaaaactcgg

SEQ ID NO: 32544 - DNA, 61 bp, Chlorella protothecoides
ctcttggtctcatccctgacctcctcctttccttacagggcggagccccgccaggcatgca

SEQ ID NO: 32545 - DNA, 69 bp, Chlorella protothecoides
gtggcgcgccacccacagcatgaaatctgagtccgaaattaaaagctcgcacagaacgatgccaaacga

SEQ ID NO: 32546 - DNA, 77 bp, Chlorella protothecoides
ttgcgcgccttcctaagcctggagagggttacgtcaggggtttttccgcgtgcagggacccagagctgagcactctg

SEQ ID NO: 32547 - DNA, 103 bp, Chlorella protothecoides
cagggcgcgaggtgcgaggctgggtttgaagtggggagggggtatggtgttggagagcttgcaggggacacgcatgttggaatgggccgggcttggaatcgcg

SEQ ID NO: 32548 - DNA, 78 bp, Chlorella protothecoides
gacccggacggcgtgctactatgattaggatgtcgacggtgcctttttgacaaatgctgggatgcatccaggtgtgca

SEQ ID NO: 32549 - DNA, 61 bp, Chlorella protothecoides
tgctcgcaccgctcgccccaaaatattagtacccccagctagtgcgccgcatgatgatgca

SEQ ID NO: 32550 - DNA, 115 bp, Chlorella protothecoides
gctttgaggtgagtccagtggtgtttgtgtaggcagcaccgtgagcgggttggctaggtgctggtaggatgggttgtcgtgcgttgcccatctttccttcctcatgccccttgcc

SEQ ID NO: 32551 - DNA, 97 bp, Chlorella protothecoides
ggaaagatcgtcccgtgttttgcatggattgctaagttgaacgacccatcttctacaggatgtatcctatgacggttgctacacatgctggcagtgc

SEQ ID NO: 32552 - DNA, 75 bp, Chlorella protothecoides
acatggggctggaaacccatggctgtgagcgttttcggggggatgcaaaggatcacacagatcagtcctttgcac

SEQ ID NO: 32553 - DNA, 64 bp, Chlorella protothecoides
ggcaagccatatcacctggaatcctcgttcccaaacttcagaagactttccaagtcctggggca

SEQ ID NO: 32554 - DNA, 79 bp, Chlorella protothecoides
atttcctgcgacgaggggagaggaccaactagatgaaagcccacaacaagcgcggcggcctctctccaccacagcccga

SEQ ID NO: 32555 - DNA, 798 bp, Chlorella protothecoides
  modified_base (370)..(379): a, c, t, g, unknown or other
cgcccgcgtccccggcaggcccgccgcccgcgtccggggcgccggcgacacgccccgacgccggcgccgcggcgcgctcgtacgcggcaaagttgaggctgccctgcggctgggcggcaggcagcgtgtggtacaggccgtccagcccccccggcccgagacccagcgaggcgcggtcctccttgctcaggtagggcggcgcgccagccctctctgcctgcgtttgttttgggggatgggtggggggatgtgcgtgaggggggggatgtatgtggggtgcatggcatcgagggcccaggaagcgtgaaacggcgcgacaagcctgggagccagccctcagcgtggtcccagcctcacggcaccgaggctnnnnnnnnnncggggggatgtgcgtgcgggcggggatgtacctggggtgcatgccatcgagggcccagaaagcgcgacacggcgcgacaagcctgggagccagccctcggcgtggtcccagcctcacggcaccgaggctgggcacccaggcagaaacgcaacacagaactccctctccaccccccaggtgacaaccaaactacacctccagcgcacctcctgaacgtaggcgttcaggaaagggaggcttgggtccacctccacctcggccgccgcggcgtcgtagggcagtgcggcacactgcacttccgctccgctcgccagcagacgctgtatctgcaccgcccgcatctgcagcgcggcgtccgcggagcgcgcggcgcggtccaggaaggcggtcccctcccgcggcagcgcgcccccccgccg

SEQ ID NO: 32556 - DNA, 79 bp, Chlorella protothecoides
tggggttggagggcttgccgggaccgggtaaggggggctgcttgagctagggctgggagaatccacaggagcgggacca

SEQ ID NO: 32557 - DNA, 61 bp, Chlorella protothecoides
ggacgatcggatccacggcatccataaaagtacttcccacgcgtgatgcagtaggagttga

SEQ ID NO: 32558 - DNA, 147 bp, Chlorella protothecoides
gggtatgggtgcagactttccgattgtgtatgcagcaatcttctcgtccatgcctgaggaggcatgagcgtgatccgagtcatgccctgcacgcagccagacagtgcagccacctccagatcaccttgtcaaagtgtgggagccccc

SEQ ID NO: 32559 - DNA, 142 bp, Chlorella protothecoides
ccaggccgccgtggcgtcgggcctcccccgagataagctggggcctgatgtcctgcaggcagtccagagttgaggccacaacgtcgatctgatcttcccaagcgcacctctgttcaaatgaatcacccgcctgtcattgcaa

SEQ ID NO: 32560 - DNA, 61 bp, Chlorella protothecoides
aaacctcctcacaaggtagaagggccattcagctgcctagcaagagattccctatgtgtca

SEQ ID NO: 32561 - DNA, 111 bp, Chlorella protothecoides
gccaggtgaggccgtgcagctcttgtttgaaacttgtaggcattctaggagagagatgcatcaccagggttgccctacgagtcaagggcggtcaacgcgccggatgagcat

SEQ ID NO: 32562 - DNA, 77 bp, Chlorella protothecoides
cagggcgctacgccgcgccaggccggcggcttgagggacgtgctggggacggcgtggcgtcccttgccccccgtccg

SEQ ID NO: 32563 - DNA, 61 bp, Chlorella protothecoides
ttgcaggtacattactaacctccactacgatgtcacggagggcgacatcaaggtgcgagcg

SEQ ID NO: 32564 - DNA, 61 bp, Chlorella protothecoides
ctccgacgataatgtcccagcacctcccacacgcacatccaccaccatgcagggttgccta

SEQ ID NO: 32565 - DNA, 114 bp, Chlorella protothecoides
cccagagcaaagcatgcgattgccttgcacccccccctgcacccccatctgagtgacttcctagaacaactgtggcaagggattcactccctatttcttccgcgcctcaccttc

SEQ ID NO: 32566 - DNA, 296 bp, Chlorella protothecoides
gcagcgatgccaaaagtgaattttgtgcggggtatgaccggaagtccaaaatgggtgagagtctcgatggaatgattctccctgcactgagcatttctcagccgaataacatatatttgcacatcaaagctttcgacatgtatttttccacctacgatatcttctagagggtgcgaaagcctccctgaacgtctgaaactcgtctgaacctggttgcctgcatcagccgttcaactcaattgactcttgcaaagaggctcaggattttcgttcccaccgctgtcgcccctcacgca

SEQ ID NO: 32567 - DNA, 61 bp, Chlorella protothecoides
aattgacattatggaccgcggtcgtgtgtccctcgccaaggtgggtgggtgtgggtgtgct

SEQ ID NO: 32568 - DNA, 68 bp, Chlorella protothecoides
gaaaggaggatcccctcacgtctgagcagcacctgtcacgcaggtgcactcaggcacccacagcgcca

SEQ ID NO: 32569 - DNA, 61 bp, Chlorella protothecoides
cgggcaggccgcggaagatgtgaagagccaagccagcaaggcattcgacgatgtcgtaaac

SEQ ID NO: 32570 - DNA, 118 bp, Chlorella protothecoides
gggatcccggggccgccccatcctgcatgcccctcccatcgatcccttctcgcactcgggtcgtgtggcctggggtcgcgagcacccccgccggctttgcacgccccccaccctcccc

SEQ ID NO: 32571 - DNA, 79 bp, Chlorella protothecoides
gaagcgcggcagctcgcgcttgaaggccggtttgcccacgtcgcggccgatggccggcagcgagcgccagagcgtctgc

SEQ ID NO: 32572 - DNA, 152 bp, Chlorella protothecoides
cccatgatggtgagggtggaggggtgcgtgttcatcggcagaggatgcgtggagtgagccccagtgtgtgtgcgcagtgtttggcgccgcgcctggtctcggccgagggcaagagtatggcgtggtgctcccaggcatgtggcccacagact

SEQ ID NO: 32573 - DNA, 69 bp, Chlorella protothecoides
ttttctcaaactggtgttcgccgaggatgacaatttcctagggcgtttctcaaaacattcgcagtgccc

SEQ ID NO: 32574 - DNA, 61 bp, Chlorella protothecoides
cttcatgtgtgggcttgttggcaggcgcccacccccaccttacacaggtttcatgatagga

SEQ ID NO: 32575 - DNA, 81 bp, Chlorella protothecoides
ggatggtcgtctggctcgccatgatgaaatgcgtgaggttggtggccctccccgcggatctgtttgttacccggggctcga

SEQ ID NO: 32576 - DNA, 79 bp, Chlorella protothecoides
gggcgatggaggggaggggaagtggatggcagaggggtgcgcattgttctgtggtcctggacgtgtatgagacaggttt

SEQ ID NO: 32577 - DNA, 61 bp, Chlorella protothecoides
gttggatgtttggcaggcatgaatgctaaggaggacgagaggggtggaagagggtcagctg

SEQ ID NO: 32578 - DNA, 80 bp, Chlorella protothecoides
ggctgcatcccggaactccctgtgtgtaaaggagggagtttccgcgggggtgaaggcatggatacttgcaccgggggcac

SEQ ID NO: 32579 - DNA, 61 bp, Chlorella protothecoides
aggaaagcagcgtgatacctactgtggcggtgggccccgacaccgacgatggcgcggacat

SEQ ID NO: 32580 - DNA, 75 bp, Chlorella protothecoides
caggcggggagctgccagtgagcagcagcatgcttgcctgcgctcctctgccagggagcctagacagcaagacct

SEQ ID NO: 32581 - DNA, 213 bp, Chlorella protothecoides
cggcgcaaggtgagcatggttgcattctgtacgggtactgctgctctgatgggtggtcgcaggtggggggctgtcggatttggcgacttgggtgcgaggggtcgtgcaatggcaagggcttgatggcaggctcgaggcctgaccaggcagctgcaggaggggaccaaggcgccaaagtgtggtgcggacagatcgttcctcagcatgccagtt

SEQ ID NO: 32582 - DNA, 70 bp, Chlorella protothecoides
ggcatcctccctgcggtgtcgcactgcgtggtcgcgatgaaagtcggcctcgagctgggggtccttgaag

SEQ ID NO: 32583 - DNA, 68 bp, Chlorella protothecoides
gagcgccaacaccgcatacatcaaaattggctggcacaagccgcctctgccccccctccgaggtgtgg

SEQ ID NO: 32584 - DNA, 74 bp, Chlorella protothecoides
gagcaaggtcccatggcctgcattgtctcctctgcagcttcgagcccatgcacgtacccaagtgcatgcatgta

SEQ ID NO: 32585 - DNA, 70 bp, Chlorella protothecoides
tgagcacaggagtggggggtggtgacaggggcaaattaatccccgtggtggcatctgaggtactccgtgg

SEQ ID NO: 32586 - DNA, 61 bp, Chlorella protothecoides
cgggcaggccgcggaagatgtgaagagccaggccagcaaggcattcgacgatgtcgtaaac

SEQ ID NO: 32587 - DNA, 80 bp, Chlorella protothecoides
tgctctttacaccaacacgcgacagcatgacaacttggtgctggggcggatggcgatgcctcaccatcacactattgtag

SEQ ID NO: 32588 - DNA, 67 bp, Chlorella protothecoides
acctgacaggtgggtttgaagaagggaggggaagggacggccgtgctcgctcaccccatgctggcct

SEQ ID NO: 32589 - DNA, 128 bp, Chlorella protothecoides
ctgggctctgacgccgaggggtggcaagggaagctgcaagtcctgatattctgcattctgtttgcctgacatgttggccgcagcgatgaggcccatgattctgtgccaggctgctgcctgcagcgagt

SEQ ID NO: 32590 - DNA, 61 bp, Chlorella protothecoides
ctcgcacctccacgtaacatgtaaaggcgtgagatcccgccacaatgtcccactggccaca

SEQ ID NO: 32591 - DNA, 61 bp, Chlorella protothecoides
ctacctttggggaaagcagcgtacacaagaaaaaacaagggagtgcccaggcgggccacct

SEQ ID NO: 32592 - DNA, 75 bp, Chlorella protothecoides
tttggcatgtgtgtgtggtgggggagggagaggggagggggcccaatttgagaagtctcactggtgcctcagcca

SEQ ID NO: 32593 - DNA, 74 bp, Chlorella protothecoides
aaaaaccgccatttaaaccttacccatggccaagtctctagaagtaatcgtcaatcgattgaccggggcccaag

SEQ ID NO: 32594 - DNA, 153 bp, Chlorella protothecoides
tgtgacatcgcaatgcaagacagcggcaaacttgaagtccaagcggtgatttcagtgcgaggtagatatcagcagggggaagtagggtgccttgcatggtaaactgacaggagagtcaggccaaccacaggccatgggacttggtgtgtgtgt

SEQ ID NO: 32595 - DNA, 96 bp, Chlorella protothecoides
catgggctcgcaccacagccccgcccctccacacctcgtctcacaggtctgcgggctacctcccgcccccatcgccccgccaactccagcaggctt

SEQ ID NO: 32596 - DNA, 383 bp, Chlorella protothecoides
  modified_base (90)..(293): a, c, t, g, unknown or other
ggcatggtggcggccttcctgggctgcgcggcgggtgcccgaggccaggcgggcggcacgtttgcgcccccttgctcggactcccggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtaagattgtggggtgtggaggtgcacgttgatttttatctggtgacagagaaggcacaaaaaggatgcaaggtgtatgatggtgggac

SEQ ID NO: 32597 - DNA, 61 bp, Chlorella protothecoides
cctgcgcatgcagggtggtgggggtccccttagggggaccaggcgtcccggtgagtgaggc

SEQ ID NO: 32598 - DNA, 62 bp, Chlorella protothecoides
tggacccaagtccttcccccttgatctcggaaacgatggtgagagctggaacttgcaagtaa

SEQ ID NO: 32599 - DNA, 92 bp, Chlorella protothecoides
tctgggcccttgacgccccgcttgacccatcctgtccgcttggtgagctgggcgatgtcgcagggggggagatgcggcggtgtgattgtgta

SEQ ID NO: 32600 - DNA, 73 bp, Chlorella protothecoides
gcgtataccaactcggaaggtgtccggcacgagcaggccaccatgacgtgtgggcgcaccgcaagcagtacag

SEQ ID NO: 32601 - DNA, 106 bp, Chlorella protothecoides
gcagcgtcttcatgtcctcctgtgcgggagaggcgctcgacgtggctagggaggtggtgccattcttaaaagttcattcacggcaatgaaacaaatggtgttccat

SEQ ID NO: 32602 - DNA, 78 bp, Chlorella protothecoides
aggccaacactgccctcgggcaggctccgacacacagcccttgggcacgggtggcaagcgggcgcacattggtccacg

SEQ ID NO: 32603 - DNA, 69 bp, Chlorella protothecoides
ccacctctccaatcgccaccgccgccaccgtcgccaccctccccatcaccacctctccaatcgccaccg

SEQ ID NO: 32604 - DNA, 83 bp, Chlorella protothecoides
gcaggcgcaggcgcacatgcagcaggcgcagcaggcgcaggcccaggcacacctgcagcaggcgcaggcgcaggcgcacatgc

SEQ ID NO: 32605 - DNA, 61 bp, Chlorella protothecoides
gtgttgttattcagggtgctcagcgtcgaaacgagtctcgggggagcctgtcaccttgaga

SEQ ID NO: 32606 - DNA, 71 bp, Chlorella protothecoides
tcacatccccctccgtggcctgcttgaagtgggcgtagtacgccaacttggtgtcgttggtggtgccgggc

SEQ ID NO: 32607 - DNA, 63 bp, Chlorella protothecoides
accgtgggggtgcggagggacaacatggtcgcgcaccacctctgctccttgctgtcgctcaaa

SEQ ID NO: 32608 - DNA, 280 bp, Chlorella protothecoides
gggggtggggggtgggggttgaggcgttgggggagcaagggtgccgcgtcctcagccggttggccgacggggagtctcagcgggtttggcatgtcgggacgcgtcgctcgacagtcaagcttctatgctacgtgctgggctgctggaacatgtggtacaccctgccgctcactgggaggggtcgaccacaaacctgaagcgagggtgggagaggacgggggcctgcgtggccggaggccgtgccggcagcggcgcggcggccgccccccgcgcgctgaag

SEQ ID NO: 32609 - DNA, 93 bp, Chlorella protothecoides
tgttcatcaaaggagttccacgccatgtcgcggtccaagcggcgggagaagaccattgcgaggtggcacgcaaaggccccacccttagtcaag

SEQ ID NO: 32610 - DNA, 72 bp, Chlorella protothecoides
ccaatgcatgcagattatgtcagctatgggcaaatttacatataagcgacagcacaatggcgtgcctagcca

SEQ ID NO: 32611 - DNA, 144 bp, Chlorella protothecoides
gcgcgccgccaaggcccactgggtcctggcccccatggccggcacgggacctggggcggggaaaggtgggagcggcgccggcaatgggacggggagcggcgcgggcaggggtggcgccggccagccctggacccggctgggcgc

SEQ ID NO: 32612 - DNA, 80 bp, Chlorella protothecoides
cctctcccgtgctgcggctgcgccgacctgaggatggcgtggtggtcgggtgatctgtgaaacagcctgggccacatgca

SEQ ID NO: 32613 - DNA, 110 bp, Chlorella protothecoides
gcgtcggagaagcaccgtcaagcctgctggacatgccccagcacgcctccaggccaccgatcgctttcctcctctctgaccatcgcagggcgaggagtggcgctccaccg

SEQ ID NO: 32614 - DNA, 113 bp, Chlorella protothecoides
gcatgcttccggggcaaaataccgagcgacgaaccataagcggaacggttgcgattaattcccagacccgctcctacgctcggcccagtccgcgagcgatgggaaaggactct

SEQ ID NO: 32615 - DNA, 65 bp, Chlorella protothecoides
caggaggggcgacaggatacatctccaagatccagcgacccctccaccacgacatccatgcagga

SEQ ID NO: 32616 - DNA, 76 bp, Chlorella protothecoides
gttagaggcaagcagctctgttgcatgcccctcctaagcccaccatcctgtgggcgagagaaatggaacgcatgca

SEQ ID NO: 32617 - DNA, 61 bp, Chlorella protothecoides
tggcgctgctcaaaggagcatgatgcctctttgaatgggtcaggagtggatggccatggtg

SEQ ID NO: 32618 - DNA, 61 bp, Chlorella protothecoides
cgtgctgacgaccaaggagtacatgcgcgtcgtgtcggagatcaagcccgaatggctggtg

SEQ ID NO: 32619 - DNA, 150 bp, Chlorella protothecoides
caccatgccgtcgcgtgcgcctgggttgggcgggagggagaggatgggtgagaggggccggtgcaaaggtggagcgtgcgaagacagcaggccccaaggccatcgatgtagggcgccaaagaccagcctggggctctgtctgtgacagga

SEQ ID NO: 32620 - DNA, 61 bp, Chlorella protothecoides
ggggcaaaagtctcggcacccgcaaacacattactctgccccctttggtgatacgactgca

SEQ ID NO: 32621 - DNA, 69 bp, Chlorella protothecoides
ccgccgtaggcctccgcctcggcggccgctgtcgacagaccgtgcaggtccttggtcaggcgggccagc

SEQ ID NO: 32622 - DNA, 1443 bp, Chlorella protothecoides
  modified_base (986)..(995): a, c, t, g, unknown or other
ggacggaccagactcctaccgccctgggcctttggcatctactgccccactgggaacagcgggactggtatcaccgcagcaacgcagtaatcgaggaccctgcgctccacaaggcaccggtcagcatgcgagacatgcgcctaccttgggacgcagtgctggtacagcggacagtgagcacaatcaaggtttggatacccttctatgctatcgtcctatctcttcttccctagcttttctgccaccttccctcgccgacacttccttgcaaagcaaggtcccagtgtaggtggattacaggatggtttgcaatgagaacagtcatagggtgcaaacggactcagtgggggatgaaaggatgggggatgatcagagctgaattgtgtagggaggggaaaagcctccagtgttggtacccgccaccacttgaacagacttaatgaatgggaccagactggctgaagagatggcatcaacccaggtttgtggattgtcctgagtgatgacgcgcttttggctggatttcgccatcgcgccgtccttcgtgaaaaagccaatgttgtaaaaatccggcagtgcacctgatgcggtgatggcaaaggtgacagaggtgtctgacaggacggcagtaccggagactgtggccagcgatggtgggggtggtggaactgctggcggtgggggtggctgggaggctggcaggcaggctgctgtgggcacgttgccgtcgttgcagacagtaagggtgggcctgctatctgagcacacccctgacactgggacgacaggagagccttcgcagacaggtagctcaggctgagtcccagcctcacaagtggctgtgagcacccccaactcggtacatatcttgacgacgggggtggggtcggaacacaaaccgctgccgctcaccaagacccgggagtcgctgcactcaccaacggaggagggtggtgggggtgaattttggatcaaaggcagctgtnnnnnnnnnnggcacccccgactcggtacatatcacgacgacgggggtggggtcggaacacaaaccgctgctgctcaccaagacccgggagtcgccgcacacaccgacggaggagggtggggggggtgaattttggatcaaaggcagctgttgaaccagtatgacgttgttgttagagtccaggaccaggacactgctgtaaccatagctggtggcagcagaggctgtaatgactttgattatgtcgacatttggtgtcgagaaggagacggtgacactgaagggattagcgagggatgtagtatacagtagcactctgccagtgtaaccgttataccctgactgggcaaaatcgatgtgcagattcaccatggtgcttgtgagataattgaaggagatcgagccagtcaatgtagcaggggggggcggaggaggtgacggcgggggtggtgggttgg

SEQ ID NO: 32623 - DNA, 126 bp, Chlorella protothecoides
ggcctgtaagcatccttcatgtggagtgttgccttggtgcaggggagtgcattgctcgttggtacactgtgcatttcgtgacatgggagcggaaactgttcagatgggttctggccgtggaccaga

SEQ ID NO: 32624 - DNA, 125 bp, Chlorella protothecoides
cctctctccctcaccgaaccacgagctccgcatctggcccagggtactccaggctgacctccccgccgcccagagcggcagagaagaggccaagggtgtccagcagctgcccgaagcggactccg

SEQ ID NO: 32625 - DNA, 971 bp, Chlorella protothecoides
  modified_base (532)..(541): a, c, t, g, unknown or other
tgcttcggcggcggccggcggcgcgcggcgcagggcgacaaggccccccagagcaggtccggggtcaagcccaggcccaaggtgcgtgtgctggtggacgctgacgtggcaggcctgctaggcctcatggccgccaagggcgaggcggtgggcgcgggggggggggcggcggaggacgccgccgagtggtacgacgccgacgtcggggcggagctcatccgggtgacggtgagaggacggagagtttggttttttgtcgagggggctggaaggcagggagccgggcggagcggcgccatggtctcaagagtcgccactcgggcgtggcaacaggtgccgccgccatgccagggatccttccctcatgtgcgccgtctgcaccgcctttctccctgccgccgcttgctcacctgtgctccgcccaccgccatgccctttcactgccctggatcccctcgtccttccctcactctcatgcatcgctcgtgcccccccccaccgtcgccaggaggaggcggcccaggagtggcgnnnnnnnnnntgtccttccctcactctcatggatcgctcgtgaccccccccaccttcgccaggaggaggcggcccaggagtggcgccgcgcgatgacgtgccggtacaacgggcagtacgttcccgagcccgagccctccacgcgctgggcgcgaggcttccccgtggccctccgggacgccgcgcctggggaggccgcgcccgaagacggcggcgacgagggcgaggcgccctcccccgccatgtcgcgcagcgtgtccaccttcttccgcagctccgtggcccaggacggcgacgactacgcggccaagttcgggcactacaagacggtgcccggccgcggcggcggcacccgggccgccggcgccggccacggcgccgaggtggacggcagcacctcggtgcgcgtgcgcacgccggcgcaggcgccgccgccgccc

SEQ ID NO: 32626 - DNA, 3743 bp, Chlorella protothecoides
  modified_base (507)..(516): a, c, t, g, unknown or other
  modified_base (1041)..(1072): a, c, t, g, unknown or other
  modified_base (1264)..(1273): a, c, t, g, unknown or other
  modified_base (1348)..(1357): a, c, t, g, unknown or other
  modified_base (1432)..(1567): a, c, t, g, unknown or other
  modified_base (3351)..(3543): a, c, t, g, unknown or other
gagaagctgggcgagcagctggcggagctggagcgggccacctcctcgcccccctccccggacgcctcgcccgctgcggcggcgaggcccgggggcggccccggcgcgatctctgaaggcccgcacacgacggcggccacgcgggaggaggcggcggcgctcgcggccgcgctggcgaaccgggacccatccgagctactggagctggtgcggggcctgggcgcggagcagcaggcccagctggtggcggcgcagcggggcggcgtgcagccggcccagccggcccacgtcccgacggcggcggcggccgaggagtacgaccccgacgaccccttctgacgcctgcgcagctctgattgcaagcatggcatgcaccagccggaaggaggcactcccagggatcggtgctgaggtggtggcagggtacgcgtcagtactcttatgtatgcctctgggcaccatgtgggcctgaaagtcaggtgaagcgatggtctgggcaggcaggannnnnnnnnntgctctgattgcgagcatggcatgcaccagctgaaaggaggcactcccagggatcggcgctgcggtggtggcagggtaggcgtcagtactctgatgcatgcctctgggcaccatgtgggcctgaaagccaggtgaagcgatggtctgggcaggcaggaaccacgggatcataatctcaacaatctagctccctcgatacagcggagtgtgctgtggaggagatcttgcgggtacccacgatgcactatgcgatccgcacgtgcgtccgagcacccaacccaggccgggcgggccccccccacgtgcgtcccgttcgtgtccccactgccgcagctgattgggggcccttgagggccatgcatccggaataatggcaatatacacccacccctgaacaattgaaaggcttgccgagcttacagggcgcatgggtctattcgaccaaaccctcgcctaggtcgggaccgggtcacccacacgcatcatctactcgaagcaatccccaggcccacgccagcctcacannnnnnnnnnnnnnnnnnnnnnnnnnnnnnnnaagtgcctgccggaagtggctgggccatcgtggtggccgcacagggcgccggcgtgcatcgtggcgaggtgcggcacgtgacgttcttaccttctcctgctcattgccagttttgatgggggacggggtgtgcggggtgaggttgcatgtggggtgctcggagttggcctacgtagccctctcagggttttnnnnnnnnnnacccagtcgaagtccctcgcttaaccctctgacacccagcgacactgtcatggtggctcaggtgtccgccatccnnnnnnnnnnccccagtcggagcccctcaccaaaccctctgacacccagcgactctgtcatggtggctcaggtgtccgccatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagggtgtgcggggtgagcttgcatgtggggtgctcaaagttggcctacgtagccctctcagggttttcgcagggacgagtgactcctctgaccgcccttgctctacttgggagttctgcagcccatcctctggctcgataaggttttaaagattacatgaccagtcgcctgacccctccaatgggccaacccctctcacctctcacctcttcactccccccccaaggatgtggccatcctggaggccaaccgcccctggcccggcgcggcggagccctccgggcattccaccgacagcgcggccacaggtccccctgcaaacggcctggccaatggcggcagcgcccactccactccccactcccaccaccgccccgccgaggccacctacagcgtcttcgccgtgtttgatgggcacaacggcgccgcggccgcgcagctggcgggcgacaaggcgctgggcctgctggaggaccggctaccgtggggcgcgccccccgccgacgtggcgggccccggcgcgcgcgcctggcgctgcgccatccagcgcgcgctggtggagacgctggtggagctgaactggctgtttgcggggcacggtgtggtggcggggtgcaccgccaccatcgtcctccaggtgggctggctgctcacggcggcaggcgtgggcgactcccgcgcgctcctggatctggggtccgaagtggtgcacctgacggaggaccaccgcgtggccagccacaagggcgagcggcggcggctggagggcgcgggcgcgcgcgtcgcgcccatccacgtctcgggtgagccaggggtgtgggggagggcgagggagggagggggaggggtgcgcgagagcagggaaggggagtggaggtcatgactgttcaacagattgatctgcgctgtgcgaaccagtggccggccggcggccgcccggcatgtgggggggtggggctgccctcgctgcgctgtgcccatcgtacctggagcctgggccagtgcgttctatccccaccttgttgcttcttcctgtagcattgtttcccccccccccacacatacgcaaatacacacaattcctgcagggtacggacccgccgcctcggccaacgagggcattgggcccctccgcgtgtggcccggcggcctctgcctgtcgcgggccgtgggcgactttgacgtgggcaaggtggtcctgcccttcccccacgtcaagcaggtggggggcctctacaccgtgggtggggtgacggtgtggaggggcacggaactgtcgagaatgggatcgggtggcgatggcaaggaggggccaccaggcaggtcttccatgcagtcccatcctgcggtcccccagacgccgagcgcaaacttccacacacaccatgtccatgtcttgcagtctgctcatgctgcccctccattcccaagcactcaccctactcccactcatcccaggtcctggtcccagagaccggcgctcgcctgtatgtggcctctgacgggctgtgggacgcgttcgagcgcgacaccaaggtcgccagcatggcacgggcctggtccccggacgccgcgccgagccgcctgatcaacgcggtgctgtcgctgtacgagggtctgaaggacgacaccaccattctcgtcgccgacctcctgccccccggccagacctttgccgacgtgtgcgcgccgcacacggccatggccgccgtgctgcgccagggccagcgcctggccgacgccgacgccgtgccagccggctgcggctgcttcggcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcggcggaggacgccgccgagtggtatgacgccaacgtcggggcggagctcatccgagtgacggtgagaggacggagagtttagtttgttgtcaagggggctggaaggcagggtgccggacggagcggcgccatggtctcaaaagtcgccactcgggcatggcaacagctgccgccgccatgccagggatccttccctc

SEQ ID NO: 32627 - DNA, 267 bp, Chlorella protothecoides
cacctcctgctcgacctggcgccgaaagtcctgcaggagctcggcctgtcgatgggcaacagggacacgcaggtgaggcatgggcagcacgccgccggagatcggctcatcttcattgacgtccatcacaggagcactcggacggatgctgcggccaattcaactctgccgtagcttccattcaatcagccagcatgccctcgggcttgaacactacacacctccttctccttggtgattccccattccttgtaaaagtccgagctg

SEQ ID NO: 32628 - DNA, 66 bp, Chlorella protothecoides
ccctcctccatgtccccagcctccatcatccccatttcctcagtgtcctcctccccaccctgcccc

SEQ ID NO: 32629 - DNA, 61 bp, Chlorella protothecoides
gaggaagcggcagacagatcctggggagatcccaaaccgcttctctccataccatgcagga

SEQ ID NO: 32630 - DNA, 89 bp, Chlorella protothecoides
atgcgactttcttccaggcgagggaggcggcggcgacattttcttggtgggtggtggcgagatgcgcttgggtggaggtgatggaggat

SEQ ID NO: 32631 - DNA, 76 bp, Chlorella protothecoides
atggacaaaggtggacttacccaggtcaaacagctccttgtggtacgtctccagctttgcaaacgcccagagcgtg

SEQ ID NO: 32632 - DNA, 109 bp, Chlorella protothecoides
aagtgcgacctggggtgtatctcagaaaccttcgagccggcggcccctgcatcactgctgtcctccgcattgcatcgatcccccagcccagcacctcgcaacctacttg

SEQ ID NO: 32633 - DNA, 202 bp, Chlorella protothecoides
gcttcccagcatcctgtccatggttcgtccggcggtccgacggaagtcaccttcttcgctcctcctggagtctatatctggcattttgagtactttgcatgccgaacgatatccaaatgttatttcgtggatcttgtaagtaacccgcacttttgtgcgcagttccatcggatggaccatatagattctcatgccggtcggg

SEQ ID NO: 32634 - DNA, 80 bp, Chlorella protothecoides
ccgcactgcctgggagcgacagtgagttggagtcgtggatgaagatgtggcactgggtggtggcttgttgctttgccctg

SEQ ID NO: 32635 - DNA, 135 bp, Chlorella protothecoides
tccaagaccgagatttgaggtcctgggagacttgtccatgcctgcgccccatcattgtgtgctccaaggaggacccccctgcacagcttcccctggccccaaaatgcaagctcacccgagtcccactggtcctgc

SEQ ID NO: 32636 - DNA, 225 bp, Chlorella protothecoides
tgggctcatgacaacagtccagcctgctctggaatagtctgtgccaggatttcccattggtattccatgacggcatgttactacttgataggaattgcaatccctacctccatgagtttgtcaacctccgtgcccgtgatgttgatgggcaggatgatgactaagactatgatgctgacaaagaagaagagcttcatccctgcagggaggacagaggcgggatgt

SEQ ID NO: 32637 - DNA, 150 bp, Chlorella protothecoides
gtggtggcccctcctgaagctagagatggttctgggtctccacatatgtaggtctagcgctagggaaggggggagcgcaaggagtgggtgggcccttcctggccgctggtggttgtgccagcagccatcgtgataccaggagcacaaggc

SEQ ID NO: 32638 - DNA, 112 bp, Chlorella protothecoides
caccatgtgggaatacgcccttcacgcgaccgggctaaacataaagatgaaggagaataccgcgccgtcgacgattctcatccccctggacgactccatgctggcgtgccaa

SEQ ID NO: 32639 - DNA, 201 bp, Chlorella protothecoides
gcatgcgcgagagtcgggtgcagtcgctgcggctgaatggcgacgacgacacaatgagttgagccgcagccagacccccttttggatgtgttgcccaggagggcctcctcccaaacttctcccatcctcacacaaatccatatctcaaccccctccccacaaaggacaagttccaggcccaaggcgaccccgcttcacccc

SEQ ID NO: 32640 - DNA, 61 bp, Chlorella protothecoides
ccgttatcagagatccgtcaaatgcacactcacctcagtaatcgattagcttaagccgcca

SEQ ID NO: 32641 - DNA, 61 bp, Chlorella protothecoides
atgaccgtcagattactcgccgtgcctgctaagcaggcaaaagcgatcgcgctttgctgtc

SEQ ID NO: 32642 - DNA, 61 bp, Chlorella protothecoides
gccatccaaggtcgccagctggtgtacctgaggtgggcagcagcgtgcatgagcaggcgcg

SEQ ID NO: 32643 - DNA, 76 bp, Chlorella protothecoides
cggcggcggagggcatgctcgtcgcggcagggtggactggggggcggaggcgatggcagcaagcactgggtgtgct

SEQ ID NO: 32644 - DNA, 61 bp, Chlorella protothecoides
tgacagcagtggcttggcagaagtggcagggtccaacattcataagtttccacctgccatt

SEQ ID NO: 32645 - DNA, 139 bp, Chlorella protothecoides
cgggggccgaagggccctggctggatccctggccccaggcagggtctcttggcaggtctttccaccgtccccagaccccccatcggacacccccctcccttcccccttgccaatagtgggaccttgcggcgcctgccct

SEQ ID NO: 32646 - DNA, 73 bp, Chlorella protothecoides
ttgagcgacgcaggatatctgccgtgctctatcttttgtgcacagcggtgcgccctgattggtgcgcttgcgc

SEQ ID NO: 32647 - DNA, 122 bp, Chlorella protothecoides
cgcgccctgggcagcgacccggcgaccggagcagcgccgcgctggcgcgtgtgcagggacagagtggggagcaaacaaatgcggtgtcatggttctatggcgtgaggtgctgtggctggcct

SEQ ID NO: 32648 - DNA, 131 bp, Chlorella protothecoides
ggtgggcttgaagatgagagggggaagggagcagtggtctggcatgaacatgtgtggggaggagaagtggaggcgcacggagcgggtctcaggggttcccccacatgctgtgcctctggtgtgaggaagca

SEQ ID NO: 32649 - DNA, 61 bp, Chlorella protothecoides
acagcctcagatcaaggcctcccctgccccacctccatccgctccaccccccaactgcagc

SEQ ID NO: 32650 - DNA, 61 bp, Chlorella protothecoides
agacacatcactgggtcaatgcaggatgttcaggcacagaatggtaatcgaacccacactc

SEQ ID NO: 32651 - DNA, 72 bp, Chlorella protothecoides
ctgcaattctcatccaccacgtccgagccctcatctgtgaaggcacccttggcggtggatgggaagccgctc

SEQ ID NO: 32652 - DNA, 62 bp, Chlorella protothecoides
agctgtctgaatgccgcagcctgctgcataacctgactgttcatgcaatgtctgactgttca

SEQ ID NO: 32653 - DNA, 61 bp, Chlorella protothecoides
cattggaagcggggccttggcggaagggaaacgccagtcactcaatggactcgatttccta

SEQ ID NO: 32654 - DNA, 113 bp, Chlorella protothecoides
cgccagtcactcaatggactcgatttcctactggcgtggtttacaattggtaatgatgagctcgaccgaatgggattgttggtaggggtgggatgtggtcacggcgtggtggg

SEQ ID NO: 32655 - DNA, 61 bp, Chlorella protothecoides
aacctagaaggtagcaacgaatcctcgcaatccttcacgcaccacgtcgattgccgccttg

SEQ ID NO: 32656 - DNA, 69 bp, Chlorella protothecoides
gggtggggcaggtgcatgaagtcgttcccggccaacttcacctacaccccgctcgttcacacgcgctca

SEQ ID NO: 32657 - DNA, 70 bp, Chlorella protothecoides
gactgccatcctccagggaatcttcaagattaacataacccctcattcttctacacaactgctttgatga

SEQ ID NO: 32658 - DNA, 61 bp, Chlorella protothecoides
gcgccagcaggtcgcagcaggctaagtgagtggccaccagggaggaggagcaggccgtgtc

SEQ ID NO: 32659 - DNA, 63 bp, Chlorella protothecoides
ggcttatgtactgcgcatccctccccatgcacgggaatccccttgggctgagccctggaggcc

SEQ ID NO: 32660 - DNA, 102 bp, Chlorella protothecoides
aggcacgacagcccagacgcctcgcctcccaggaggaccgccctggagagccggggggatccttctttgccaatgctgcctggccgggagagttcccgcctg

SEQ ID NO: 32661 - DNA, 107 bp, Chlorella protothecoides
ggaccagaggggcttgatatgaaggccaggggcagggccgcaatcaggacagtggtacagggggcaacggaacaggtatgagtcatagggtggctgagcaggggaga

SEQ ID NO: 32662 - DNA, 130 bp, Chlorella protothecoides
tcccagggttggtgatgtggccgcagcggaagaccagccttgccaggttgagacaacacgacggtgcacgaagcctcctggtcgtccgtcagtgaatttgtgccagcctgtgtctgatccctctctgcct

SEQ ID NO: 32663 - DNA, 67 bp, Chlorella protothecoides
cgccgccagcttgtcgccctggatgcccgcatggtgcgcggccgcggccggggactcgagttcgcgg

SEQ ID NO: 32664 - DNA, 480 bp, Chlorella protothecoides
  modified_base (150)..(373): a, c, t, g, unknown or other
atacacaatcatggtcgaagcctgctacaccgtccacccgtgacctccatatcccatgccacaggcacatgcccaaggcccctagcctgagggctcagtgctacgagactgtggtggccgactggctgccccgctccaagggtttcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacattcgaactccatggtagcatccctcggatccctcccaacccattcccacacccccagggcgtgatgtacacccaccgctccaacgtgctgcacgccatggcc

SEQ ID NO: 32665 - DNA, 61 bp, Chlorella protothecoides
gaaggcgcctaacaggaagaggggggggggacggacaaagcattgcacagcaatgagaggg

SEQ ID NO: 32666 - DNA, 108 bp, Chlorella protothecoides
gccttggccatggccgccgcccctcgcgagtttgacaccgcagggacgggggtcggcgcgtcggctagcagggccgccgcgctgcggaagcccacgtccgacagtgcc

SEQ ID NO: 32667 - DNA, 110 bp, Chlorella protothecoides
ggtggggcggggggctgggcgggggcgggacgttaaacgggaccggggccatcgaagaggtggccaccagctcccccccagcgtcggtgtaggtggccaccacgccgctt

SEQ ID NO: 32668 - DNA, 76 bp, Chlorella protothecoides
aggattcctcacctcggcatgcacagtccatattcttgggatgggtttttataggacggcggtggttcgataggca

SEQ ID NO: 32669 - DNA, 124 bp, Chlorella protothecoides
gaccctgcaagcttgctgggagctgatggttccagggtcggctcccgagtccacagcaactgctgtagctcctcagtagtttgtgaggccgtgggccaggaggagcaccgggtcaccgtcgttg

SEQ ID NO: 32670 - DNA, 112 bp, Chlorella protothecoides
gagcagatccttccactcctccctgttgtttgggacgctcccatcgccgcctgtggtacgttcaaaaaggaatttaggcctaagtgagcggcgtgggagcaccctggcctgg

SEQ ID NO: 32671 - DNA, 67 bp, Chlorella protothecoides
catcgcaacctcaggcaacccatcgccaggttggaacttgcaagagcagctccttgaactcacccag

SEQ ID NO: 32672 - DNA, 67 bp, Chlorella protothecoides
gaatggcgagaggactgactattcagcgccgccttatttcgtgcagggtcacgattctccggctgcc

SEQ ID NO: 32673 - DNA, 61 bp, Chlorella protothecoides
tgtcgacggcttcctcccctgcagaggggtgatggtgagttgttacaatggtgaatgtcgc

SEQ ID NO: 32674 - DNA, 63 bp, Chlorella protothecoides
ccgggggggcgtggaactgctctgcctgccaattgatggcccgctccctgccgacgtaggcat

SEQ ID NO: 32675 - DNA, 69 bp, Chlorella protothecoides
tgtatgctgggacaggccccacaggggcggacactgtgacacgacaccccgcattgctccaactgtacc

SEQ ID NO: 32676 - DNA, 70 bp, Chlorella protothecoides
cccaccaagtcatgctcccccctcgctcttgattaatacgtggcccccaccctctctcctccaagctccc

SEQ ID NO: 32677 - DNA, 61 bp, Chlorella protothecoides
ggcgccctcgcccttcctggcggccgggggacccacggccgggggcgcgggcgcccgcccg

SEQ ID NO: 32678 - DNA, 61 bp, Chlorella protothecoides
acgaccactgccattccctccttgctgacgctgacatttgactttgcgtctggaccgagta

SEQ ID NO: 32679 - DNA, 75 bp, Chlorella protothecoides
gcagccggtgcaggtggcgacgacgggcgtgcagacgggaagccccagtcctattgttgctcagactgtattgca

SEQ ID NO: 32680 - DNA, 150 bp, Chlorella protothecoides
gggaaggaagcggggcagtgagcaggggagaggggggaggtcgatgcgacctaacccgaggctagacagtccgggaggcagcttggggcggcccacagaattccttatgcacagcaacactcctccgcatgcctccaccttgtgtgtcaa

SEQ ID NO: 32681 - DNA, 62 bp, Chlorella protothecoides
tttgcggcctatatgggcactcagctccatttttgtgggggccccctctccggaggcttccc

SEQ ID NO: 32682 - DNA, 35400 bp, Chlorella protothecoides
  modified_base (141)..(203): a, c, t, g, unknown or other
  modified_base (16247)..(16290): a, c, t, g, unknown or other
cacctccaccacgcccgcgcgccgcgcctcccgccccgccgcgcggcccagcaccgcgacgcgcaggctgtcgccgggcttcaggctggacagcggtgagagggcgccggcgggggcgtcgacgccggcgggcgccggccnnnnnnnnnnnnnnnnnnnnnnnnnnnnnnnnnnnnnnnnnnnnnnnnnnnnnnnnnnnnnnnacctcgacgattgtcggctcggcgtttgtgatgtgcaggcgcgcggcaaagtccccatccagcgccaggtcggcgtgcagggcgtgaacggcctcgacgtgcgcggtgagaattgtccccggcttgggcagggctgccaggcgcgcgcgcttggcctcggcctcggggttctcggcctgctcgccggcgggggccggggttgatgtcgtcgcggccagagggacggagaacaggaggcggggggcgccggggcgtggcagagcggccaccttcgcgacgatgctgtcgcctgttgggagggggaggtgtcgcatggcagcgggagaatgagcgtatgtggcaaccggccaatcccgcagggcggagacaggagctcacctcaaccctcaaactcgtcaagcaccatgccaccaccccctcgcccgtggccctgcactgcacctggcgtttgggacacagcctccgcacgggaattgaagtcgtggctggggacgaagccgattcgcggctggcagccggctggtagggagaccacgcagtacccttccctctccttcacctgtgttttgggtggggcggcggggggattacatgtctgttgatcaagacgcccctctgcccatcccttgcacgcccagccctccgagcaaaccccaaccataaccacctcctccccgcccttgcactcacaagctcaatgacgcactccagctggtcgccgagcttgggctgcttggggctggcagcctccacacccttccgctttcccttctttgccgagggttcggactttgccgctgcctcagcctcggtcagcctgggaagcaggctgaggtccacgatgccgtcggcggggttgcgatcgaggacgagggccgagatgcgggtgccaggcaccgggccctgggcagcctcaccttccacctgcagggatcatgggacatgacagatcgatgggtttctgttgcgggcagggtggggggctgccgaggccttgcacagcaccctcttcgcagaagccctcacacctggtggggtgctgctacgcccacaatgtcggggtgcacgtccagatcgcacagcgtgccgtagtccttgacctcgtgcacgctgccttgcactgcggtgtggggcaaggaggagagggtggggggagattcgtggtcgaaaacatggcattcctgggacacagcacagcttctgatgcgtgatgtctatccaagtctggtgctgtgcactgcgagccccattgtatgtctcacctgctcccccaatggggacctgctcctcccaggcgacgtcggtggggtcctctgcccacgaactggccatctcaatgtccctgacgaggttttagcatgggtgagggtttaagagggggggactgaggggagggaatttgccacatgcaagtggagaacagcaaaggacaggcgtcagtaagcttgaccttcgtgtcataacccagacctatccacccgaacacaccacgatgcagggggcagcggcaaccatgcttacttgaagtagctggccaggtactctgcgtgggcgctcgcacaggtcgactgcttcagctccgccgaaacgtgcccgctcgccgcgtccacgcccaccaccttggcacggacggtttgacccggggagtagacggcggcggggtcggacacatgcccatcgctgatctgtacgaggcccactcgagccgtcagcgccccaaggaatctgcagggatgcagggagtgcaatgtatcagtgagagagtctgaaggattgcgtggcagacttgagatgtagcttcccggtgggccgcacacaggtacggtccaggcaggggagctcaggattggtgggtggttgggtcaacatgatggggacttttgcctccctgcagagatggcagacatgccctccccctccaccaaggcaacaaagtcccacctgacaaagacggcgtccttggtgatgctggcaatgtagccgggcatcaccctgcccttcttggccgcctccagggtggccggcagcttgccagctgcagcagcctcaaccagagctgctttgcgggtcagcgtcagggccttgtgctccgtaccagcctgcagggggtgggtgaaaagggtgatgcgatgtttgcacgaagataaagcttcgactgggatgctgttcccacagcagcgtcagtgccccacagactctctgaggcgtctcagaggcacatgaccccccgcagccagcgccagccgcacctcgggcgcgcgcaggaccagcagcctgccgagatcgagccccactcgcaggttctccaccagcgcggccgccgcgcacgggtgatcggcgaggtgcgcaatctccagccgaccatatatgcccctcagcactgagctgtcgacatcagcctcagcacgcagctcgacggctagtgttttgagcggagcctctgcaccctcctgggcggactgtgatgggtgaggtgggaggatggatgggtgaggagatttcgcatgggccagtgcggctggctggccgtccatctgaggcagaggaaggacatactgatgcaccagggtcctggaacgcgacaccgtcccggccacatctcttatcccgaggctccaaactacccttccccagaagaagcctacctcgccggtgatgagtttccggaccttgccgtacacaaaggtgcctgccgcagggatggggctggcctcccctgcaccacccgccccggccttctcgccgtctgccagcttcttggtggatgcaaggcttagcttcaggccacgccccttggcatcgacgcccaggactcgcgctttgaccactgcacgcgaggggagaatgggctgcatccacgacggcgaaggcttttgtctgtgccaattcccatgcatccccagggaatgggcaggctcaaacaaacttcaaacgagtccaccgacattcctagcgtccaaccctgcgtggaccatggggcgggcgttccacatcggcccaaacatatcactcaccctggcccacgacgtaggcatcgctcggcttctgctccggggtcagggcgcactccttgagcgggaccatgccccgcacgccgttgaagaactcgacaaacacggccttctccgtcatgccgctgatggtcccgtggctgcgcatgcccgccaccacatcctggggaaggcggcagatgtggaggggagggtgagggtgatcatgggagcaccagccacccatgataatgatagagcccattgttcagcgtgacccaaatacccccacaagatccttcccagctcccccctgtcactccatgccctggcactccatcccctcgcatcgggccccacctgttggctggtgatgcgccgcagcttgctccccaacagactgggcttcagcgtgatggacagcttcttcgcacctgcgcaagagtcgaggatgagcacaggattgggaggctctgtgtctcgacgcacggcaccggcaggttgacactccattctgtcagaaccccaagggtcaccacggcctggcagtgtggagatataggggatcggaaaccccacgtacctggctgcaccgaaagcacgatgccggacactgactgccccagcttgtgcttgcgcaggcccttcttggtgcccacatccgagccgtggatgaggggcacaagggccctgcggggtggaaggtatgcagcgcggttgaggccggctggagtgccgcaagtgtatgggcattacttgacaggagacgcatccatcccttggtcccagtcactacccaaaggagaaagcctggctcaagaaacctgcgcaagtcactgccacggtacctgacgctgggggtgatctccaggagcagaccgaaatcttctacggccgccaccttcccagtcaccggcatccccgggtgcaggtctgcaagcaatgtggggtcacggtgggttatgcacggatgcgcaatcaaagggtcgcaccaggcctttcgggcgatctcctgggggcctgggagctctgcccaattagtcttcaccacccatgattcacccaaggtgcgccccccagccccaagaaagcaggccctcggcgcacctgcatggctgaggatcaactgctcgaccacagagggacgcagggtgagcaccgcaagaccgtccaggggcctgaacccaatgaccctggccttgaccttctggccaacggtgaaggcctacattcgggagggttgtggtagcagcaatgggcatggcaagttggggcagcaggatgtgctgccgtcttgtgcaggaactatgccggcacctacccaggtctgctgctccttgggaattccacaacatcaagcaaaggcagcccagacaagtgtcctgcaagcaaacccaccaaatcccataaccctaccttttccaggctcttcaccctgccctccaacgtgttgctgatgtgggcaaagcccgggggataggtgacctggcccgccgcggagggcaggctgcacagcaggcccagcccggggtcgatccgcaagaccgtggcctcggcaaacacctgtcccatggccgggaagtcgggcggaagctgcccggccaccagcccacgctgcatcgtgagcacgatcttcttggactccgggtcaacatacaagatcctggcctttacccgctggttcttgctgtaggggtgttgggggggaggtgggacaggggcgctgactgccaagggtgttggactgcaggaggagagagggaattgcagggcagccatgctcccgatcagaatcgattgagatcacaggctgccgcatggaaccagtatggcctcagccacgacctcagcgtggcgcctcccgacctcctcccgcacacctgtggggacgtttcttatcggaccccggctcgttcaggtggaaggggtccaccgtgccggagaagaaggtgaggaaggagagcaccacgccgtctgacagcacgtccctcactgtggcggccaccagtgagccggggagcagggcgcctggagggggcatgggaggctttgtgatggatgccgacatggcccttctggggtgcactgcatgaggggtccccggcagacctccctgtccccacagcccacccccgaatgcaccgcccctccagcagccgcctcaccgatgtgcatgccgatccactcctcggtcttggcggccgcgacggcctcagatccggcgtccacggtgatgcggcctcccgctttcttggaggtgaccaccacgtccagcagagtcccagggatcaggggtcgctcggggaacgccgcggcggggaggaaccccgtggtgccctgccatgagttggaaaggagggggacttgagagaaaagggcaaagagcgtcgtgcacatgcagtcctacatcccttcgcaataccccaccaaggcttggccctgtgcagctacaccttgatgccaaaggaaagcacggcaccatgatcctccatgctctgcacgctggcagagaggcagaatcccggcacgagtgcgcctaggtctgtgcggcggtatcgcgtgggggaagcaggggataagctcactgagttcagggcctgagaactggggcaggcagggcgcatggttacctggacatcagattgccagcggggggaactcgcacgcctgcttgctggccagacccagccagtgtgagggccagggcatgctcaacaagctggattatagttcctccaccctctcccccaacctccctacaattccttgtacaaaaccccgatctccacccacccagtcctgcattcacggccgagggtgccagggtcaggtagaccttcttcctccgtttcttcccgtctttggggggcacggcgccatcctcgccagcctctgcgcccgtcagctgcgtgatctgggcccggaccagctgcccgatgttgaaggctgccagcaggtccacgcccatgcctggctcgcccgcggccgccgccggcacgtggcctcgcaagccgtggggcatggagaccacgagctcgcgctcagacacctcgatgatcgctccccagacgcgtgcgccgacgcccaggatctgcgtcagcgagggcagtggagtgagatcatgacggaggggcacagactgtaactctgagggaaaggtgaggaggacacaaaggtaaaggagcgtggtggaagaactatcccgagaacaattctggttcagacgagagatgcttgttgctcccagacaccatgcctgtggcactcagcacgcgaacattttgttgaggattaccttttcccatgcgctcaccttgaacttgaggagctcggcgtactttgggaggttctccgctgctgacagggtctcaaagaatgcatcctcgttctcatgagcctgagggatggtgggaggacagcttactggcctctgggtggtacaagacagaatcatatacctcagccaagatctctaacaaggcaaaaagttagtatgtgccggtttgtggcgacttgctgccctcctgttgccacatcccaagtcacctccttggtgggccttgacttcttggatttctggcctgccagctccagctcagcctcagcaaatgcatcctgtgcatttaagagagatattttgccacactcgtagcggccgcacctgcgttacatccggagacttattctggagcagtgcttctgaccaaccctgcagactccctcacccgcttcagcttcttctgttcgatggggtccatgccaaagccgcctccacgagggaagctttcctcatccatcgcagcctttattttacccaacttcgacatggttggggcggcaagtggtgggttgccggcgggcactcagagctgcatcccggtggaacactcaatgccacttcgacagcaatctgagcaggcaggggtgtcaatggttgtcattcacggcactgagcaagctaacatgtggatagcgtgctggaaactcggtacaggccccgctgctcgcatcgctgtgtgctcggtggaaacaggtcaccacccacgtgatcaccgcatgtaagagagcgcgcggtggtgcctggaaagatggaaaaccgcccgcttccaccgggtcctccgtggtcgggaagctgcctcaatacaactccattacagacttttgagagatgagaagctgcttttgaacggtaggaaattcttctctggccagggcagtgaccttggcggttccttttcgctgaatggggagccctaccccccatcatgctggcggtcttcgtctctggacgaggctttcattgatatgcgcgggcctggtctaccaggcttcatgtgagtataatgcggttgacgtgtatcttcgttgtacagcaggcgccgcgctgcccggagtctgcatattccgagtacggattcctagactgtgcgcggccctgtccccccttgacgacaggttcctgcgttcgaaacaccactgctcagatcagttcgagtgtttttcttgctggaaactgggactacatggattggtacaagaatgggagcagcaactgcatcagcatggtggacaagtgcgtggtcctgggcgattttcgaatgtgcttgggtcaattgggggggggggacgatgcccagtctgcgcgtgttccccgggatgctacgaagataccaatcctctgtcgagcgacccggatttagggtcgcatgcccttccgcagcgccatcggctgttcgaaaccccattccctgtgccaccacagaattgccaagcagaatgtgagacagatccagttcctgcccactttctactggtatgacgtgggtcccctggacccacctccggggtttgacgagacctgcagcaccagcgacctcggaggtgagcagcagtaggccaggccgatgccggcttgccatgatgatggggtgtggctgcatggtaccaggcccagctgctcgcccaccctcttggcatcctggctgtgcatggccgtcatgccgtacccttgaaagcgggccagtccgggtcagagaggcacgagggaagttcattgcccagaccttcttgttcaccatcccttgcgcccaggttactactgcttcaaccgcttcaatgctaccagagtgcagcactggtgctatgaccgacagggcctgtcctgccaggaggtcacccagcagaatatcacagacctgattgagaaccttgggggctgcatgaaggtgggtcgctcggcctctgcatgcggggatgtggcctgtacctgcgtgtcgcagtgactcagcatttggtttagtgtggcggcccatgggctctggccctatcatgcaaagcgcagtgtagctcgccacaccatttccctgggttcaccactctcatcacaaccatgttctctaccgctcatccacagcatgctgtggacctaggctttgacattgcaatcaattcgcgcgtcgacgacgggcgagctctgggaggtgaggcactcagagcgccgcggtcacaggcttggtctcagactgcattgttgggaaggggattgcaaaggctgcaaggtagaatgcagctgccacatgcttttccggcttcagattttacgccaaaatctcctccttccaccatgcgcaggctggcgcaatacactcgactttgatccgctggagatctcggaaaactggtcgtacctggaggctgtgctctaccccctagccgatgctgtgcggctggctgccaagccctcgaccagggtgggcaccatcaagggggggggaaggaggacaatgcatgctccaaagcctgggactggcatggacacgggtgtatcagcatagattcccttaccatttcattttcctaccatcacgactcccgaggagtactcgtcacaacctcctgtgcaggtcgactttgtgcttcagggtgagatgggagctaccattttcatgcacccaatagagtggatggaggtaaaggatgcggtcctggagcgggtgactgcccctcggcccggccagcctgacatcgagcccgcccaggtgtttttcggcatggctgtgaacaacaacaagctgtgcgggtgagcagtcgtgtgtttgggagggggggggaggggtgtccgtgtgtctgctggggaaggagtggcaggctgggttgaaatgctcgacacatgtacgttgagagaactcgagcacctgcttccgctgacgctgactcaactcccctccaaacaactcatgcacagatgcatcgggattggaattgaggacgcaaccgagtacctagccgccttcccagctagcttcaacgctgtgaaagcaggtgggtggggagtcgagtgtggccttgggacatttttctcaacggaatacacgcttgcaacagatgcagtagaccacatctcacacgcgacgtctgagcactgcaccatcccgcacctcgacaccggcagagtttgacttgcctgcactcaaggccctgttctacgactatgacttcattggtaagcggtgtgagcttgcaaagtcatcttgcgcatgggtctggacagctactcatgccctcgtaaacgctggcattcaagaaacatccccatcccctcaaacaaacgacaatcttgcaggcatctcagcctatgtgcccatgcgatcccccaagtgagcgctggcttgggtcgtgagtttccttggtctcctgcaggaccagggcccatgcaactcatcctgcaccagcaacctttcagcaatgtccgttctccggcctctcctgtgcagcttctccatctgcgactttgagggactgatggagcgcctggatgaagagctgtcctactacgatctgtccctggaggacctagtagatgacggtgcggagctagacacacctggctcgtacaccatcatagcagatgccctatgttctgtgcgtgattgtcctgcagcagcatccccccctccctcccttggctgattgccagtccctatctgcaccccttcccaggcaaagaaatacactttgtggagtttgggatcggcggcggcaccaaccaggccggcgtcggggtggccaggactgctgaacaggcagcgtactaccccttctacggcatctacggcgcctacaggtgggcacaagcgccctgccgtcccttggtgatgctgcgcccgcctgcacgtcatcactctggcaggtccggtcgccaccccagcctcgtgttgctcccccctctcccgtcgcgcagttgccaggcagaccccttcaacatgtgcgacctggtgacgccctccccggtccgagactaccggcgcaagtactttgaaggcatctcgcaggtgacctgaccggcatggctggggcctggtccttgcacagaagatgccacacgtggaagccatccatgtatacccagcccccctcgctcctgtccctaaacattccgccctccgccatgcctgcctgcagtacctactccagggcggttgtagataccgcgtgtccaccgtctacctctggaacctgcagtcttgggacccgcaagccatctatccccttccctttgccgatgctgcctcgcaagccgccaatccgaccgcctactacgaccccgtcgtagtcgccaccatcaacgcccacaacgccgaggctgcggcccgtgccgacggctgcgcagcgcgagcccccgagcccgaactcgaggcggagctagctgttgcatctatcgtcccgccagcgtgctgagcgtcatgcgtcaccccgtgctacccttccctctcacttgaactctgcgcatgcagcgtctgccaggagcttcacccccttcacgttccccctctcccactttgtgccccccgtccgatgctacatccctctcaatcagccatgtctcaagcttctgcgtttgcctggagtccccagcaccaccgagccctctcaccatccctgctctgctttctcctgatctgctcgtcctcctgccccacactgccgcagcacttcctgacgattcacccatgccatgcctccctccgatcccggtatctgagtctcggcagcgacagccctgcgattgaatgggcctgttgtctcacccatcccactcaccgcaaggtgaatgggttttttcagccctgcccacacttgattgcgtcctgccatccctgattcttggctcccttcctgtgcaccccgctgatcctcagtcgctgcgtgtgtaaagcgcacgacaccagccaccaaaggcacgtcgcagggtcagcgccgccggcgcagcgtgtcaccgcttcctggccaggagggggacatcgtcgtcgctcggggactcctcccccagcccgccgtcctggaaagcgacgtcccgcgtggaagccttgggcttcctcggcgcgggcgcgggccgggccggccgacgggccagtatgatgtcgtcgtccgagtccgagccggccgggggcttggggggccggggcacgccgccccgccgctgcttggagggcaggacctcctgctcgctcccgtcgtcgctccactccgcatcctcctcctccttcttgtgctttgccccgggtgcagtcttggctgcagggtgggggggtggtggcagaggggtcgttgtcaggaggggtgggtgaatgaggtaccctgcaggcgctcaggtcgatgacgcgtcccgcacaaccagcatgtaatgcgcccaccccgacccacgacctctgcgtgcctgatcccgtggacttgcgcttgggggcctgcccggatgccgctcgtttcggcgccggactcgcgctccccgccgcctggcgggacgccgggcgtgccgccagcttcttggcggctacctcgtccacgtaggcggcggcctcggcctcgctcaacaggccgtgcatgacacaccacttgcgggccatgtcactggccggccgctgggcgagcagggaggtgtagaacttgcggagggggtcagcctgcggcagcagcggcatggtgagggtggcatgagtcagcagagggagggccgatggtgatgcactcgcctgcatctgcgtccctgggcccttgcccggccgaaagagccgacatactctcgctggctgaagcctaggtctcctggccattcccaagcccatcttcaagcagatcggcactcacactccccacccctcccctcccccacgacccacctcatctggagtatcccgggtctgacctggcaggccatactccttcttcacccggatttttgagggagaggagctgatctgagaggcagtgggcttgccgttgctggcagcgggggtggcctccttcttgagggggccctgctccttcttgaccttggcaggctccttcggcgttgccttgggggggacagtcttcgtctcaggtgcaggggcgggctttttgactgggctaggatcctgtgggaatagatggatgcgggagaggttttgcatgatcacataagagcagctgggaggtacacatgtccctcccccaccaagatcactcactggcttcacttgcgatgtcactgtggctgtggctgctgcctggaggagtacagggtatgggaagggtgagggggtgcaccaatagccacactgaaccttgcacataaagggagagccgataggcgtttttgtcattgactctgcgagaacgcacctgagctggcacaggtgcatgcttctcaactgtgggacctgcacttggaccgagatactgacctgtgactccgggaagacacactctcttcacgtaaaaatcaacgttcacaagactcaccgagcagtgctgccttcttctgagccagagggacgtcgtcgtcgctgctgctgtccaacatcggtgacatcctgaccctgctcccggcgatgcaactctagctaaagtacccgcgagtccaaccaggtgtagagcatccgcttgaaccttgtgttcagtacggtgacagagattctaggcttagaccaacagtgtttcggtgctctgtcacccacccgcagctggcgcacagggaaaagagcacgcgaacaatcgccacacggagcaaaactttggttactctggatgatagaatgtaaaatttctatgtcggtgctgttgccggggtggtactcgggcctcatctcgactcacacctgcgcgaacatccccaaacatcggcatgtgcgttcgcgcccgggcagctccgttccgaacgcgaacgcgtcatttggtggtcgattgaaattcattacctctacattcgacattgcaggataacctgcacaaacctgcgtaattaatcttcatacacaagccacttcatgcccagttgtgcggcatgaggattcgtctgaagcagctgccgggtctgcttctggcgctgggcgtagccttggcagcatggcctacagacgctcagagcaccctcattcgattaaagacgggccaaattgcagcccatgggcctagttctcggtgcgtcgcatgcacaggacccccttcaggccatcatagatccacgaatgcgcctgctatactgcccacacgcccgtcgtaccacagagaccaagtgcaccgcctgctcctgaccaattcggagcctcagtcgctgtctcctcattggggccccctcagtcagaagcagcagtggctggtcactccccaacaaggagaatccctcacgagtgcagctggtgccgtggaggcagctgggggtgtgatcctgggacatgttcccgacaacaccctgctagtcatgggtcctcctggattggagcaggcccttcgcgcccgctccagaatcttccttgtgagtggaatgaatgggtgttggggaggctgtctcgcaggttttggctgaagcaagtgtgcttggcattcccctgcaagccagccctctccaatcacagccaattccctggtatgccttgaaacttctgcatgcaacgccctgtgaacactctccttccgtacctccccgggcccgcagctcccgtacgaaccccagcacaagctgagtcccgagtgggcccccatccttcggaccctggaggccgccgcgcaggcaagcctggcgcagcagcagagcgtcctgtcgtcgctgccgatggccaccagcggcaccggccctgccctgcggctgctcatcactgccatattccctcctcggccggctggaggggcaggcgccgcggcgcccgacccagggcgggcagcggtggccgactgggctgccccattgcggaccgcctttgggggtggagtggatgtcgtgaggggtggaagcggggcggcggtggtgttgtgcccacccttcctcctgcaggcaagtggaagattggagaggaagggatggacccctagccatgcagctgcacacacccatgcaagccctagggcttgcatggatctgggcctgcgtgttagaatgcaggtcctcgtgcaggcagcaggtgccctgtgtcagtaccctgtctacacaacggttgatgcacagctttgcttcccccctttgctgctgcaggatgttctgacatggctggcagcccagcccatggtccactggatttcgcccctgcccaggatgcagctgcagaacaaccaggcctcggccatcacccaggcggggacaggtgcgctttctacgagccagaattcgtttgataacccagaggtccaccccatctgggcggcgggcatcactggcacgggtcaggtcatcggcgggggagactcgggagtaggtgaggcggcatcatgggttgtgggcaaggaggggggccctgtctacagccgccttcctcagaaagatgttggcggctgtctgggtgtccagcgagagagtgtgatggcagatgcaggtcagggccgtgatccaccgaactagtccgcgcctgcgcagagcctcgccgccctccacctgagccaccctccacatcccatatttcctgcgcagatcgcttccactgcttcttctacgacccatcggtggattgggatgcacaggtcacgacccagggtggagtgcaagtgttcgagagcgagacgcatcgcaagatccggtgagcagctggcgcatcggtccctagggctgcctgcaaggcgctgacgccgcgagctttacctgagagggtgttctgtgttgtgtgcattggactgcgcgtcctgatagagtagtcagttcgcaatggttccaccggcatgcccgaagctgagaccctgcccggccccgcaggtattatcgagcctttggcgactttgcggatgccaatgggcatggtacgcatgtgatggggacgctgctgggctccacgactggcgccagcgtgagcaggagcaccgatgctgcctacatcggcatggcccccgacgccaagttggccttcataggtgggcaaggctgtgggtgaagggtccatgagggactgcgagaacaaggtactgccatagaattttttctgatgattgtcgcaccgtggcactcagtacacagttccttatcccacagatttggcagagggcagccagagcatctacacgccagccgacattcagaaccagtactttgcgtacaccactgcagtggtgggtgggcgggcttgagctatgagagcttggctttggtggggccgatggtagagcgctgtacgcccttgcgagcacacgccgtctggggcatacatcgcggaccctcgactgtggatgccccattgctggcattggaggacacacgctgcatggcacacatgctctgcgtgccactccccaagcacccacgcactgtgatcgtcgcctcctcgattgcacagggcgcaatgctgcactccgattcctggggtgtcagcgccatcagctacgactacctggcctcccagattgactggtaccactgggacaaccccgacttcctggccatgtttgccgccgggaacgatggcgagtccaccaccgccggcaaccccatcggtgagccacggcggtgccggctgctcggtcgctgactttgtgggagtgtccctggcacccctgctgtacatgcagcgcctgcaccccccccccccccccccccccnnnnnnnnnnnnnnnnnnnnnnnnnnnnnnnnnnnnnnnnnnnncccgcaggcgagatgacggtgaccagccccgccacggccaagaacctgattgcggtgggggctacacagaccacggggcagagcctgggcagcgtggggtcccagtatgtggtttacgaggccaccgtgaagcgcggcgacctgaacctcctggccttcaaagtcctgcaggtcggtgcgggggagcatgtttcggggatggcgagcggggatgcgagcagcctggttggcggggctggggcgcgcaagcagcagcgcaagcagcaggagggtcagcaccctgtctgcagactggcacaccacccgagccgtgctgcagggctcgttcggcgacgggctgagcacgctgggcaccacgagctaccccttggtggctgctgacccgctactggcctgcgaagccatggtgaatgcaacagccgtggcgggggccatcgtcctcgtggaacgaggtgtgaggcaggggcgagggtgggtggtgggatcctggagaattgaaaaggggaggctgtttggcgtcgtcagcttgactcggccaagtctgtcctcccgtctgctctgcaacctccagtggcctcagcccagtgccctgttcactccgcaccatgcaggcacctgcgccctggcctccaaggtgcaaaacgcgcagacggcgggggccgcagcagcgctcatattcgacaatgtcctgggcggctactttgtttcggccgccaatggctcgctggccaacagtgagtgtctagggaagggagtgtgggtgaggaggggcccaccaaggggtggattgctgtacggcacaagcgtgttgtcctacagggtccatagggagccggcgatgaaggcggaggtggtctacacgtgtcccttcccagactctctacccatttcatgaaccttcaacttcattcatgcgcaggcgtcaccctgcccaacatgtccatcacgcggcgcctgggtcaaaccctgctggcctccttctcctccgggctggcactcaccatcaccctctcccccgcgtcagccccggccaacgcctttgagaacctggcctcgtactcttcccaaggtgggccgagagagcgtccctgcgcacgctcgtgccccgtgactgccatggcacccgctgagctttctgggagtgcggtagttcatctgagggcggcaggtttgctgttccatcctgagaacccaccctcttcatccacacctcaacacacaggtccgactccggatggcagggtcaagccggacctggtggcgcccggctccctgttctcagccaagtcctcgacctcgggaacggagacctgcgagctccagggcctcgtggtgagtgagagtggggtgttggtgttgccgtgttgcggccagggatacattcaggcagccctgagcggcatgaggcgccagccgctccatggatcccctccagctactcacagcttccttcttataccgttagggcacttcgatggcgaccccggtggtggctggctcggcggccctggtgcggcagtatttcatggacggctggtaccccttcggggtcaagaacgccagcgcgggcttcaccccctctggcgcactcaccaaggccacactgatctcgggggcggcttccatgactggctttgaggctctgacgggcctccccatcgatccgcccccctccttccgacagggttttgggcgtgtgctccttggtgagcagggcttgccagctttggtgtgagggtgcccgagtgcaagcagcggtgttgggaggcgggcatccacacatgtgttgttcgctggctgggatggggaaggtctgccccacgcagaacatgggcgcggggtgacatcgttcttcaaacgtagtctgcccaagcccagcgaccagtgggcaggcactggatgtgtgcacatgcactaggaaggctgactctcactcactgcaccgcacgcagacacgacgctgcccctgccgaactcagaacgcaacttcacgctgcaagtggtggacagggtggaggttgccaccggcgacacccaccgctactgcgtgcgttctacggggggcccgctcaccgtgaccctggtgtgtggagtaggagaggggggagtgtgttcatcaagcatgtgaagagagccactggtgccctgtcgcgagttcactcaattcgtgcatggccagccaaggacctgattggctgcctgcctcacccggtggcaggcctagctcagataccttccccaccctcctcccctccatctccacaacccctgaaggtctggacggactaccctgccctgccctcggtgtccaaggtcctggtgaatgacctggacctcacagtgcgtgcctcaggcctgggtggcatcccgctgctgggcaacggcgggtccatcgccaacgagacgcagccggaccgggagaacaacgtggagcaggtcagcatgtccttcctgcccgtggggcccgtcgccatccaggtcgacgcccactttgtccacgcctcggcgggccgccagccctacgcgctcgccgtgaacggggcctttgccgggacgctggtcgtgccgggggacggcgagcagggaccagcctgcaccatcgtggtccccagtgagtctgagatggcggaggcgcgtcgggaggctggttcgctgagagcgtgcagagctgacaaggaggagcactcgtggctggcaaagcagcggggaatgcgcattgcttgcccaccgcccatcgtcatccccaaccacgctcctcaaccacctcttcttgcaggcatcaccaaaggcccgtctggccccacaaacgcctcgcccatcgtgtttgagtttgctgctgccggcaacgcagcgtatggcggcctggcgtgggagtgtcttctggccgacggcaatggcgccgtcggatccaccgggacccaggactggaaggtgcgggcgtggggggcaggcatggggccgtgcaagggaaggtggctggaatattctgttagacacgagcgcctgcgcaatgggtgctacagcttggcatcctcttgctgactgagggtcgacagcactgggaacccattcctctggagtatcagagctgtgcgtcgcatcaagtatggcgcacggcatctcagaacggggcgtgcttcaccttcaaacctcgatccgcaggcctgctcctccccggcctcctttgcgggcctgccggacgggacgtacgagttctctgtgcgggcgcagggggaaaccacgcaggcaaaccaaacctttgtgctggtgagtgacccctgttgctggggcgtcgggctctcgtggctcagagcaccaccaccccgacacagctccatgtgtgcaccaaagggagcaccttgcttgcctggcgcggcagccgagctctgcatagttgggctcgatccaatctttaggatgctctggctctctgcatgctcaagtgctctggccccacctctccacctgctctacaggacacatcgcccccggtgctggccttcaacggagggacccccgcctctgggtcgacctccgacgcccccatggtcaacgtcagcttcgccggccaggacccattgcccgtgaactacacctgcgccctggccgtggaggacgctgcggtcatgcagggcccggtcttcgcaggggccatcgcgcctgccatctggcccctgcagtctcgggccgcttgtgagagtccggccatattccactggctgctgccgggcacctggagcctgtctgttgtcgccgaggatgctgctgggaaccaggtgagggggtctggggtggggagcagggaggcaaagtaaagaatcagggccatggtacaaacatcaagcgatcacggctcgggtgtccccaactgcgtgcaagcttgcaaatgagatcccccaggtcaatcccaattcaccaacactgccctgcctcccatgagcaggcaagccctgctgtgtacagctggacggtcgctttctctgctggccagcagtatgcgcgtctgaccaggtgggctcaaaccggcgtggaggggcctggagctgggatggggtgcatttcggatgtgccagcgtcgcaacagatcgagttccgcgccgcacctggggcacctgtgcttcctggtgccaatccattgagaatggcattctctacaacacccctccgccccccacgacgttcctgcagcggcccttttggtctctccagactgctggagagtgcgagcttcgaatttggcgtgtttgcggtgcaatccagtggcgcgtcgctcacccaggtggcgcagccatcgacgaggtgctggctggcggggccggggacgagcggcagcagcccctcctgggcaccctgcacctccccgcacatctacgccaacttgagcgagggcgcctacacgtgagctggagctggggatgtggagattgtgcggggagagggcgaggaaagccagatgcatggatgctgatgcaatgcagtttgcgtgccaggtccctgagcgtggtgcacctcggagtgccagcggcaaagatggactgatcttgaacccatccacacccctgcgcaggttctacgtccagccgacagaggcggccactctgtcgctcatgggggccggggctgtgcccatgggcggcgtgaccgcactctctgcatttgcacttgatgggactccccctgtggcgaccctcaccgccagcccagctgccatcctggcatccaactccaccgtggcaaacttcacgtccaacgaggcggggtcgacgttcacctgcacgtacgtttggagagggggaccaggcagggattccccgcacatgttttgatctgaatggagtgtgggcgcagtctcctgctcatgagtgcccccgaatctcggaatggggagcagccctccatggcgatcagggtctggctctgcggacttgctgcgtctaattgacaatgcgagcagaaagcagggggcacagaatccttccccttgcacagtgcctgagaatatcagcctcccaccacggcccccctgtacagactgactgcgccagacggaagcagcaggaccagcaactgcacctcgccctatgtgatgactgggctggaggatggaaagttcgagctggcggtcacccccaccgatgtggtgaggtttgtggccgggaaggggtgtgagatcccatggggatcatacaccaggcatgcccttgggcaagtcggactgacagtgcgctcgccgcacctgcctgagcgcttgccggccctctgacccgcactcgtgcggcctgctccctcgtccgcaggtcggcaatgtggggagccaggtgcgcacctccttcctcgtcgacaccacccctcccaccctgtcggacgtcagcttccctgtggccaccaggcagacccagtttgccgtctccttcacagcatccgatggcaacgggtgggtgggatagacttgggatgtgtgacaagatcgtcaagtattcagtagcctgctgcaccacctccatattctgagtggctatccagcatcgcctcggcactctccacccgcgcccttctgctcacaaccctgtcgcaggagtgggattgcatacgcgcagtgccgcctgcaggctgccaccctggtgtcggggtcggccacccagatggacaccgcgtggaaaaactgcacgagcccacagacctacactgggctggaggtgaggctgcaggattgatgtcttgtgttaccccttgggaagggtgtacacccctctccaggtgcccggcttgcctgtgaggccggcagacgacccctgccttggacaccagcctgctcaggcctacccccctctcctcacccacattgcaggagggtcactggctgctgaacatccaggccatcgacaaggctggcaacgtcgcgaccctgggagaccaggacgtctggatcgaccagaccccccccaccgtctccgtcacgagcggccccgccaggtgagcagagtttggtgcactcgaggactcggtcgcaggatgtgcctggctactcttctcggatgtcatctcctcatggtggttccctgtcacaaacaacgcacgcacagctttgcctcggtagagggcgccctgtcgttctccttctcggagaccgccggcgccggcgcgctggccccaatcgcgaccttccagctgcgcctggccccgatctcccgcgacctttttgactcgctgcgcaatggcagcgcctcggagggcaccagctccacgctgggcacgctgctgggcggcgccgggcggcgcctgctggaagatgatgtcgggaccgtgcaggccggcgacgcgctggcgagctggaccaactgctccgccagctgcagcgtggagggtttggcttcgggcacctacacccactctgcccgcggcattgacctggccgggaacgtgggcaacgccacggccgcggtgccctttacctacacccagcccccggggccggggttcccggtgtgggccatcgccgtggcggcggggggtggcgccctgctcttgatcattttggtgcgccggctggttgtgctctctgtgtgtttgtttggggagcgggtttgggaggtggggaggaggcaagggtcctgcgtgaacgcaatgccctcctcctgcactgtttgggaaaaggatggtggccaagaacggccacaagctgctcttggaccacacaatgtcagacctggctcgggccgaggctcgaggtagaatgtgattgtggtccctgccatgactcatcctcgtcaccctccctgccccccaggcactgctggtctgcatgtgctggaggcggcgcaacagcaggaaagcggctgccacccccgccggtgccagcctgggcgcccacccgcacccgccggcggggtacgccacccagccagcctggcccggaccccatcccagcggccaggcgtaccagtatcccccgcaggggcagacgtacatctactcctcgggcaggatgcacgacgagagggcaagggaggagcaagagctggcactggcgctggctgcctccaagcaggaggctgagctggcagcgcagcgtgcgcagcaggcgcccgcgtgggggcggcccgtgggcgcgctccccgacccagccccgccgattgccccacgccgggcgtacccggtgagagggagtgcgtagtgcagcgagagcatggggcatgcagtgagcggcgtgccagaaatctggctagctggcccaggatgcacaccgccagcctggaacccacgtccttttccgttccccccgcatcattccacaggcgaccgcgccgcatccgcaggatgaggaggatgcgcagctgcgtgcggccattgctgagtcactgcgtttgcagcagcagacgcagcagtggaacccttggagaggctgaccacgcagcgtgtgccccggccagtgtctgccccggcgtcggtgtttgtgcccttgcctgttgccccattctttatcacagatgctggctcccagctcatgcataccttctggacaggatgaccatggacacgcagggacagggcagggcagcgatacgggggtaggcatgactgcaggctcagttcctgtgcatgcctagccgacagcacagcgcttacttgcggtgcagagcaggctcttgcagaggagcgtagtgtggtaggggctccatgcttcaggcgcagaatgacaaccaggcctcactcctcgtcgctgtcctcctcgctggactcggcctgctccagccactccacaaagggcctggaggcggcgcgtacggcagaggcagcggaggcagggacctccaggacactggcggcgtcggcgcgcttgtacctgccgtggcagcaaggggggatgagtttgctgccatgggggagggccgaggaggtaggcagcacacgggaggaaaagattcaagtcgagcaggtagccacttggacgagactcacaactaccccctgccacatgtgacgtccattctcttctcccattcaccaagagagcctgctcccctgttcccagcactcaccaggccaagatgagatcctcctccaccaggtcgaggtcgtagagggccttgatgaccaggggcgcctccctcacacgggcaggcagggtgacaccgaccagcttctccacggctaccagctgccccagctgcccggcagcatcctgcacagaagggggtacagaaacagcactgtgagcagcgagacggggttgccggcctgtcctttgcatgcacagggacacttttcaagggtcatggcagggccgcccgaacaaagcgtgcaccagccagcaggacacctcagccacaccagacccaggggcgtggacatgcctccttggataaccaggaccgcatgcttgccgtgccaccgcggcttctcacaaccccatcccgagctccgggcgccgaccctggtcaacgccccaccttggacaagggtgccagatacgccttgcggccctccacttcggcagacagcttggcgccagcctccacgtcgccaaagaggacctggtagagcgcggaggcccgggccgcaggcccgccaggcagctccaggctgcgcagcgtggccgccagctcggcgggcgccgtcccggaggccagcagctgacgcagcgtggacatcgcggcgacctcggggctggccagagccagctttgcggcggcctcctccgccagcctggcatcctcctcagcctgcagtggaattgggcacaacggtgagagaggagatgcgagccttgctatgagccagcggcggcacgctcagcgcgctatgtcgtggcactccagcaggcagaggagggcaggcgataccgctgcacccacgcaggctgcaaaagagcacctttttggcagctgcagcgtcggcctcggcctgggcggcggctgcagccgcggcctcctcctccgctgccttcttggcggcatcctccgccttcttggcggccgccatctccgcctccaggtttccctgtgaggagggcagacccagtgtcaagagcactgcattgcaacgattccaaacaaataagcaccaatgtgctcaaagcacacattgctaaacaagtgagcactacccacgcccacctgagtgaccatggcggcggtggcaccggaaagctgctcggcagcgcgccgagccatggcggcctcagaggtgtcggtcatccacacgacctcgtcctcatcctcatcctcatcctcatcatcaccgtccccagaccctgcctcatcctgagcattgagaatggaggtcagaggagtctcaggcggtgttgcaactcatcccaatatggccagcagtgggcccagaacccataatgtcacaaatttacaggagtcagccatcgaaacccagcatgccttccccatcccactccctcatcctcccgcggtggtatcgtggtggaagtggggacccaaccctcacctcaggcccgtctccatttgcgctggcatctgcctcctccttcttggacctggacacaggagggcgcatggagcggatgagcaaggactgcaccagagcccagatggcatgtcatcacagaccacccaaggcttgtagcaatgcaggcccgggcctggcaaggaagccccaggacccctgacagacagtccgacattgtcatccttttccgcccacccataacttacttgctactcttcttcttcttctttttcttgtcctccttctcgggctcagcaacctccaggcccttcatccgctccttctccagtttcttgaccctggcaaccgagcattaggacagggtccacggcgtcagcgcagcacacgtgaaagttgcttctcctgcccgtacttctgcctcccacacctggcccaatccctccccctactacttcgccctttccgcacccctctcacaaaccaagcttgtgctcacttcttctcggccttgctcagcttgttgtcgggcgggttcttcagaatgaaggtgttcaacttcagccgagcatccacctccgacacgaagccgcaggcctgcaagatgaggcaaggcggccgggcctgaggctgcagcaacgcactgtccattacaatgctggctcaacatggtcagggctgatacgacaacttcacacagctgcctcctctcccccctcaccttgcacttcaaaaagatgttctcccgcttgatcttcacaacagtctctgggttgccacaggagtagcactgcacgtacctgcagatggaggaggggagagggcgagggattcggtgcagagtagctcgcgatgtcaaacacctggcacagcatggtcagaatacctcccaggccatgcctccagaacaccgaaaaacatcgttcaaaccgggcaacacatcagtggcttactttttgatgaaggactcaagcagctccgacaggcggctggcgtcgtgcgccccgttcacgatgctggtgccagatgccttctcgaacttggtctgagctcccagctcacacccaaagaatttgagggtatctgtgggatgagtggggttgtgtgcagctgggcaaggcccgagtctggcactgcccatggacggcgtcgcgacccacacaggagcgctcggccgtgacaccaatactccaggatcatgtgtcccatcgtacattcaggagggcgctcgagggccttggcaatgtcaacattgttctccacattggttttgatgccatttcctcggccttcaatctgtgtggaggggagaggctggccgtggatgctctccccaatgctccgactcccatgcagttctactgatactacgctcgtactccaggacgcactctggccttcagcttgggcattttgtagcggtagaacgcatcccccgcgttctcccctccgatgttgatagacgccattgtgtatgttcacactctgtggagcccgcgcggcatataccggtcccttcagaaccagttcttaatcgagttctatgttcacggcaggtgcctcgcggcataagcagtcccacggccacccggtggaggactggaggcgctcggggctgggacgagggtgagcgattgcccgttgactgcttcccagacctggatagtcttgggctgccgcttgaaatgtgtgggaatgcaccgtgcatggccgaggctcctgcattgagggctccatgggggtgcggccgggatcgaagtcgacgtgggcgtgttatccaaattcgtgcatgcgtggaggggcagggaccccacccccctgccgagtccttcctttcaaacttcacgccccacattcagtcgtgcgatccctgggtgccaaagacctcggcatcgatggcttcatcccatccctgcctgctggcgcatcaagagctcttgcttcaggtttacacatgggtgggagagccgcagggatgcgatcgtcaggccctcccgtatccatagtagagccagagcgccgttcgtgtggggttgaacctccccagtatggcaagggggagtgccacagccattgcacccacgggcaggagcaggagctgggaggagggggggatgggagggagttgggccccgcgcactggcagttgagggaacaactttgctccccaaagacattgcaagggcggggtgccgcaccacaagcctatattacggaagcagagtctcattgccacaatgattcaggccagcaaggcctttcccaatgagctcagggatcccccactccacgcaccacggtgtgattgagccctggcaggacgctgtagcccaggaaggtgatgtacaggtaggaggaggcgcctgcgacgtacagcgtgcacgataccgcggccgccaggtaggactgggagaccaggagcggcgagagcaccagctgcaggactgcacggggcggggggtgcagtgctgagcggtggagtatcacttcaagggatgcacccgggcacaatgcctgttctcccccagccgcgtgcatggcactcagggtgggggcagacgtccaggcttccccgccccaccctggcacttggcacgccaacccaccgttcactatcagcagccacgggagcaaggagttgcagtgcacatcaaatgcgtacatcctgcggcatgaatggcggaggcggaagctgtggcgtggcaagcgacccggcacataaggagccagggtacctcacagctgccttgcaaggtcaccaccccactgtactcacagctccatgcgctgctcgatggcgtgctcctggcccgatggggagtacaggaagcgcgtcgccagcagccagccgccgagggataccagtgctcccacgatgaggaagtcccggatcaccgcagccaggatgatcagcagggagccgcctaatcctggcccaaacctgtggcagagtcatagggttgcggagaggagggcttgcatcacaggcaagcacccttaaacctgctgatacccccactctgccttgctgaccacaaagtgtgcgcgaggcaggcacatgcaaggatgctggtgccatccacagtctgcatgccatccactgggcctcacgctatgcaataggctgctgtgatcagtgcgatgatgccggcgaggaggaccacaaaggcagggtcgtctctcgcccagtggtcttttgtttgccggtggtacgaggtgtgtcggtacctgtaagggggcatgggcctgattatcagggacatccttaccatccagctctgggactgtctcccacgtgaggctttgcagcgtgctgagccagcccagtggcatgagcattgcaggcacagccctctgccctgaacagccccaccttccccagcacacatcacaagagccagctacccacgcacgctgtcttgggagagatcaggagctgcagcatcgtccatccagtgtacctgttggggaatttgaaggatttatcagcagctggagcctatcactggcgggtgccccatggacatgcatgcagcaactcactggaagtccatttgcgagggtttgaagaacctccttaggtatatccatatgtactgggagaccctgctgcgcccgaggcctccgcgtcggccggcgggtccgggtacagtggtgggcaacatttttatttgggagggcctgcaaggccccgatggcgtagcagggggctgttcgggtgcgtctgtctatctcaacagggtactggtgggttaattatggttactatcctcttgaatagaggttgatgcgaacaaggacaaagtctttcgcagtcttcagaggcgatccccgcaggacagatgccgtgagcctcggtggcgaggtggactcgataacaaacaaagtcgaaaatctcgaggttgacggtgatcagaccgggagctcgttgtcctggccggtgcgcccgatcaacgaaggctgttctgcggagcgtgctgggccgagtcagggattaaggcaatgcgaattgccagtagagatcgacgatcatggtgccgtcttcgcgataacacgggtgatccacagggatatggcgctgattaccatctgagaggcgtacagctgcgcataggatgctgcattacacgagttggagttgaagggtgcactgcggtgcctcccggcgcctgacagcggccatgcttgtggggagcctggactgcttcccagacttggagcttctggatccaacagtcgacatccatgccatgttccttcactacaataaattctattttgaagacagcctgggggcctgttcggtagagtggagctcgaaacgcatgacatcatgcgggggtgtatgcgagttccgtggtggcgggtgcaccatcaagctctctgagcccctgctcaaggtgagctgcacagggagtctatgtggacaggttcatggtggaaaattgacggtgctgtgctgaagatgtcgggcctgctgcatttgtggtggctgtggcaccggcctgggccttgctctggagctgaggccctagtgcggtgagctcacattctgcggcacttcaaggacatccctttccttgcgcgacacagttccggccagtggctgacataaaagcagtcctgctgcacgaaatgatacatgcacacaatttccttgtgggacccaaggatgatggcagggatggtgagcaggcctcggtccctgaggggggctgattgaggcagcactccccctgcttcctgcagaagacccgccaggactggctgccattcatgaatcgatgctctgatgggcttgttcgcagtgcctgtggtccctccagcagcctgggaaaccctggaagccacagacacccctcgtgccccacgcaggccacggctctgtgttccaagcacacatgcggcgcatcaacgcctgtcgagatcctgaccccctgcggcccctggaggggtacaacatcacggtgagtcacccccgtgggcgtcgcatgaggcctgaggcgccagcgctcgatccccgtgctcgatccttgcttggggtccagccattgtggccacgatctccacgccccagtcgatgctccacaggctcggctcaggctcatcgctgcctctgcctcactgccttattgcagatcaggcacagcatgctggatgaggtggcgtactaccagaatcatcactggagctgcccgcggtgtgggcacctggtgagacgagccatgaaccggcccccacaggaggccgactgctggcgcagggccggcccggcgtgcgccgatccacggtgcgggtggcatgtccatctgcggcactgtgggggtacgtacatcaaggtcaaggaacctgaggggtacaagcccaagacgcggaggcgggaggaggctggcaagcagcaggctggtgaggcagtgtgtttgtgggtgggacaagaggcggaagcgctgtagcaacccacggattacttgccctgcgtgcatctggggctctgagctttcacctctagatgaagcttgcaccgagcatgcctggagatgcccatcctgtgtcatggcagtcctcccttgatgctattctattaagtttgtatcaccacgaatcaaatttgaccctgtcacacgtgcagggccctcatcagcagccttgcctgggccaacaccggctgccacgcccccagctggtcacagaccgatcactgggtacttccagccggctccatcccatggggccaccgctggatcctccagtctcaggaacccagacagtatcgtacctgcagcatcaaacaatactgcagcaaacgtgcaggggcaacatggtcccagaggtgcgtgtcgtcatcttgagatggcgtcgaggggtggttaaacagggagcaatggtggttcggaaggggtcaccatgaagatgcgcccttgaggcatgtgcgagtcaactgtgctatgaccgtacatgcaacaacccgccatgcaggtggcagcaaattgagatcaagaactccggatggatgtgaggaggacattcacagtaggagggcaaaacttgctgcagctgcactggctcgacttcaggcagtccctcctcggcccccttctcgccccccagccagtccccaccctggacaggaaactatcatagatttaacttgaaagcgaagcaatgcttttggtgtacgaatgtacctgtagactaatcgacctggtatatcggaggtgctccaagcaagcgatgttatgcggagggacagatggtcggtcatggaatcaccgccaggaagaatgcatggctgctgattcaaaccatggtgcgtcataggccgttctctgcattaatgctcaccccccatattgcagattccagttcttctctcgcaaaatatcaacactgtgatctgcaaggcgaattgtgaacgcagaactcgacaagtgctcactgcgcaaaggatggcatcagcagtcatggtcactgaactcgagaggtacgccctccagggcagcaattctttttcaaaggacatgcatagacatgtcatgtataagttgtgttgttaagatccttatcaccaaccctcgcaccctccacagacctgtcgaagatctggttgcggcggaggaggatgtcgaggaggtggggcatggaggtcggactggttgagatctaggcatcacgatggattcactgtggagaaataaggattgccacctctccctttctatcttcagttccaatcgctcgagaagttggaggccctcggtgtcattaagggtaacaatgggattgttgtctcatacagacagggcgacgatctcctcgcgcgagacatgtgaatgccatgaaacgccatcctcgccaactccaacacaggcgacatcaaaaaggccaaggacgcggggttccacacttgtgaatcgttgctcatgcagcccaagaaggtgcgcatgtgccttgggcgccctagaatacaatgacgctcatgctggtgccctttcaactcattcataaaggtcccaacccaaaccttcctcttaaatagcggcttgtggagatcaagggcctatctgaggccaagatagacaaactggtggaggcatcaagaaacgcctgccccaactttggcataatgagcgccagagattttgagggacaggtaggcttctccgtgtagcagtcatcagtgacaagcaaatgacagcatggcctagcatcctctcaccaagacttctcactcatacccaccacataacgagcagagacagcgccagatcgtgcacatttctactggctgccaagcattggatgagctgctcggaggcggcatcgaaagcaaagcagtaggttttggggaaggcttctgtgtatgtttctcgtgtcaatccctggttgtagacacagccctttccgccatctctgcggtgcccacagattacagagatctttggagagtggcgaacgggcaagactcagctctgccacacgctctgcgtgacaactcagatgggagagggactgggtgagtcagtgatggggaaggtgacattgggcagctgttcaaagcttgccatggcgtgactgcccccaccaagcccagcgttaaagctatcccccttgcttcaccacccgcctgcagcggccggacgtgtggcgtactttgacacggaaggaaccttccgtcctgagcgcatccggcccatcgccgagcgtttcaacctggatggcgacgctgtgctgagcaatgttctgtatgcacgggcctatacctttgagcagcagtacggtgagctgttggggatgatagagcctgcagatggtggtggggtgagggacagttgatgcggtttggtgcaggaatttggtgagcctggtgatgccattaggatcaccaccaccaacctcagcctggcaccatcttcatgcagacctgctggagccgctggctgcgaagatggcggaggagcccttcaagctcctcatcatggattccattgcggccaacatgcgtgtcgactactcagggcgtgagcactagttgaggtggcgttgtggcctgctgccaggatcctggcagggactcaaattctgaacgcagcactgacatcctcatgccgtccagtttctgaatcaatcacccttgctagcacgttcaccacaggaggtgagctggctgagcgacagcagaagctgggcttgctgatgaacaggatgcgcaaggtgggtggggtgcaggcagtgctgtctgcatggttgcaggaggcagacccatgcgtgtgtcaagcattacaagcgtagggtgcattttggagcagagcatccaccattccataacccacaaatgacaccaatgacctcactgtgccaatttacagcttgcggatgaattcaacattgccatcctcatcaccaaccaaggtggggagaagagtcatgcagcaaggtgctcaacttcatcctctgacaaaaattggggcatgcatgctctgtatgctgccccaataccgccagcatggccaaggaacgaacctcaccctatgcgcagtcatctctgacccctctggaggagcaatgtttgtggttgaccccaagaaggtgggcggtattgcagatggatttgtatctcccagtacctacctttctgactcattgccggtgcttgccgatgcacgatccccctcctcctattgctgtcatccactgcattccccatctccatttggcagcccgtgggtgggcacgtgatggcgcacgcctccaccatccgcttgtctgtgcgcaagggcaaagccgagcagaggtgggcctccagggcgggttgaccctgaaggtagttatcatgcggggcgctaccccaggtacttggggttttgagagtcagaagactgtttgaccacacctctgcacccacgagacacaggctgatgaaggtggtggatgccccgaatctggccgaagccgaggcttcctacgccatcagtggccagggcatcatcgactacaagtgcgagggctgctcggtgctgtatcagtctcgtgcacagtgttggtaccttggtgacgggggtattgcaccagtgactcaaggatggcaatggtcaggcccctgatgtggtccccatctcacactgcgcctccaattgtatgcacagggactgaggggaagtgtggcgacagcaatgacaacaatactggaacatcagccgagaaaacgaaccatgagctgtcccgaagccggcgccattcttcgctgggggcaccgtggtgcaaaatcaaaccgccctccagacccaggcacgcacttgtcactgcctttatgcagcaccaccaccagtcacaagactgagaacgcacccacccgcctgctgtgtccagccatgctgtgctgcttgtatttgcaagttcatgacgacacataggggctgcataatgcttggcagcaggcagggagggagcacaccgccgtggctgcaactgcgcatgcgcgttccctacttgatgctgagggcagccacgccgtctgccagggaggagggggaaaacaggttggaaagcgggaactctgccgcgcacgcctccctccagctctccgcggcttgagagacggacaggcgccgggacagcagcgcatgcaccgccgccgcggcgtcgtggccggcccccgcaggggaggccgccgcc

SEQ ID NO: 32683 - DNA, 93 bp, Chlorella protothecoides
agcgccgcggcgtggtaggcggcccgcggcctctcggcggcggcgagcagcgccgcgactgccgtggcccagtcgtcgccccccccgccgcct

SEQ ID NO: 32684 - DNA, 72 bp, Chlorella protothecoides
catgctagcgtccaggagatactcatcgtggaagacctcacccaaggggcaagttttgtccaaggcacgcag

SEQ ID NO: 32685 - DNA, 70 bp, Chlorella protothecoides
aaggggaggatccagctttgtgttctggtcccatgtccactaggcaaacgtgaaaataagtgggcgcgag

SEQ ID NO: 32686 - DNA, 61 bp, Chlorella protothecoides
ctccgtggcggccctgctgggctcccccggccaggccaactacgcggcggccaacgcgaca

SEQ ID NO: 32687 - DNA, 406 bp, Chlorella protothecoides
ggtggaggggggatctgcctgggtgggggggggatctgcctgggcgggggaagagtttgcctgggcggaggaagggtttgcttgggcggggaaggcgattgccttggtgggggaggagagtgccttggtgggggaggggagtgccttggtgggggaggagagtgccttggtgggggaggagagtgccttggagggggaggcgactttttgggggggggaggcaactgccttggggggggaggggagcgcttgggtgatgtaggcgactgcctgggtgagggagggtaccgcttggggggtggaaaggactgctttggagaaggaggaggggatactctcgggggaaggggggacttccgtgctggtggaggcgggaagcgcttgaggggaggtgggagcggcacag

SEQ ID NO: 32688 - DNA, 77 bp, Chlorella protothecoides
gcgtccatccccgcctgacgattccgacgccacccccaccatctccacttcaggcgtccggcccgtgggaggtgcgc

SEQ ID NO: 32689 - DNA, 61 bp, Chlorella protothecoides
gtcatcaaagctgtgttgcgcctgtcacactaccctgcacgcccaccagtacgtgcgggtc

SEQ ID NO: 32690 - DNA, 61 bp, Chlorella protothecoides
cctcccagcacagtcgatgcgcttctcttcgtccttcttcgcgtcattcttcctctgacgc

SEQ ID NO: 32691 - DNA, 76 bp, Chlorella protothecoides
gggttgagtgcttgccggatggaggctcagcgtcggggggaaatttggcgtctggcaggcctcccccatccggctt

SEQ ID NO: 32692 - DNA, 62 bp, Chlorella protothecoides
ggtggcccccctgcttccccttctcccgcctccccaccccccccaccccctctggttcgccg

SEQ ID NO: 32693 - DNA, 61 bp, Chlorella protothecoides
aggggggagggggcatcagtaatgggtgggggggctagaaaggaagggtggctctcatctc

SEQ ID NO: 32694 - DNA, 474 bp, Chlorella protothecoides
  modified_base (110)..(318): a, c, t, g, unknown or other
tggagtagtgatacattctaacaaagagtgaggtaggagcagggcccctacaggttcattcacgccaccctaccagttggctccggcatcagctgcatgtgccgcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggaccccgcagaagtacaagcagtagatatgccagcaaacgtaacatgcctgcccatgggctgtgtgctgagattctgacttcccaaacaagaaagcatgccttcgctgaactcctgcacctgatgccactgtcgcctgcagggcaacatcccc

SEQ ID NO: 32695 - DNA, 117 bp, Chlorella protothecoides
aacaaaacctgcagcgagagcagctgaaaaaggcacaggatgagagcctccagtcaggcgctcatgcatgatgtgtgccaggcactgtggcctctcatgcgttcagggctgcctcca

SEQ ID NO: 32696 - DNA, 61 bp, Chlorella protothecoides
cttgagggagaggcccgagtcggcgccgacggcgccgacccgccccagggcggggtggtgg

SEQ ID NO: 32697 - DNA, 61 bp, Chlorella protothecoides
ggttcggaatgcgtaccgccgagcgtctatgcagccggagaggcacggtgcctgggattgt

SEQ ID NO: 32698 - DNA, 147 bp, Chlorella protothecoides
tcacgatctagttcctggtgtaaggtgatgtgcgttggcgcggtgcacggggaccgaacgacatcggatcattttttcaggtaaaccccgcgtgccgctcctcggcgccgcgcccctgcgaccgggtctccggaaggctaatcgttc

SEQ ID NO: 32699 - DNA, 78 bp, Chlorella protothecoides
cacgatatgccccttccatcagaggtttgtgatcgaatagggcatgggggggcttggagaattggtctggtcttcgga

SEQ ID NO: 32700 - DNA, 61 bp, Chlorella protothecoides
cttgggcacaggggtggagaagccaaaggaatttatgtgcccggcgatcgcgttcacagcg

SEQ ID NO: 32701 - DNA, 97 bp, Chlorella protothecoides
cggccagcgccacctgcccttgtgcgcaacagtcacacaaggccactgtcaaatggaacagtgttgcccccttttcgatactgcagcatgagctgaa

SEQ ID NO: 32702 - DNA, 532 bp, Chlorella protothecoides
  modified_base (216)..(238): a, c, t, g, unknown or other
acgggcgatggtaagggtacctgttcgcccgctcagagtctgcgcacgaagcgccagggagagacgctgggcatcctcgatctcgccgacacagtgaaccgggccgggtgaggcttcatctcaagagccagcacagtttctgctgcagtctctaacggcaacgctttagtgaggaggagaggtcggtggtgttgcgatcggtggtcacggcggggnnnnnnnnnnnnnnnnnnnnnnnctgtgtacgacaaaagtgctgacaccaaaaaaggcccacagccactcgcacgcctcatcgcatggacaaaatctggtgccatgtcacggaggtagtagtccttcggcatgtattgcggcgattgtggctggatggcgcgtgctgtctggggattgggcgcaggctgctcaaatgtgcctcttggagctcaattgtcgtcggcctgggaactacctgctgactaagagatattcaagcattcacgcgaaagtaccgcttgcgctcgacagggtgtgacaggtctgtcacctgcat

SEQ ID NO: 32703 - DNA, 83 bp, Chlorella protothecoides
cctccgaggcaatagcctgccatgagagcggaggctgcctgagcagcttgccagaacctgagttttggaagggaggctggcgc

SEQ ID NO: 32704 - DNA, 61 bp, Chlorella protothecoides
cgcctagtcgcaggatgtgggcgagggggggctcgccacatgctgtgaagcagggctgaag

SEQ ID NO: 32705 - DNA, 67 bp, Chlorella protothecoides
gcgatccgcctgcgctgggagatggagcagtggcagtggatggggaggccgtggtgggggatcggac

SEQ ID NO: 32706 - DNA, 78 bp, Chlorella protothecoides
cctgaggatagcgcgccggcctagcccaatccctggttggcgcttgcgccccagcagcctcaacagcacatgcgcacg

SEQ ID NO: 32707 - DNA, 72 bp, Chlorella protothecoides
gcggccagtgccaaccaattttgatgtatgacgtgtcggcgttcccccggctgcgactcgatccccgcacac

SEQ ID NO: 32708 - DNA, 87 bp, Chlorella protothecoides
gcacagcgacaggatcaggttggtccggcaaacggccgccgtgcccctggtggtgccgaggtcgcggcatgtgacgccgaggggcag

SEQ ID NO: 32709 - DNA, 68 bp, Chlorella protothecoides
ccagccgcacctcatcgctctttgcgccagaggtcagcttcttcagggcattgttctccaggatctgg

SEQ ID NO: 32710 - DNA, 68 bp, Chlorella protothecoides
gagttcaacagtttgagatcagctcccggaagcagtgcgtgcgtgcgagcgcgcgcctcgggttccgc

SEQ ID NO: 32711 - DNA, 210 bp, Chlorella protothecoides
gggggccacccagcctgagtccacctgcgttccaagagggacgagtttgggtttgggtttgtgtgacaggacactcggggttcagaaatgtccgaggggagatggtttcccggagcgctcgatgggagcacagggccatggagtgcatggcggatgcacgtcagtgcaccgggaacccctcacctggactccctgggctgctgcccgccg

SEQ ID NO: 32712 - DNA, 153 bp, Chlorella protothecoides
aagcgcgaggtcaagaagatagtggtgcatgcacagcttcctggatacagacatgtgggcaaaagagtcgagccctttggcatattgagcatgggtgcacggagtgacactgcatgctcgccccatgtgcagaaggtacagaattcccagcaa

SEQ ID NO: 32713 - DNA, 79 bp, Chlorella protothecoides
ggggtcgggacctctgtgaggttccacgcgatgagggtctttcccaccgccccctcccccgccgccacactgcacgccg

SEQ ID NO: 32714 - DNA, 71 bp, Chlorella protothecoides
tggtcaagcacgctccactgcgctcaaccctggctgcttccactgcacaggagcggtatgagaaggagaag

SEQ ID NO: 32715 - DNA, 142 bp, Chlorella protothecoides
tcctggaaacagggtggggaggctgcagagcgccatcgccacagaggtgacacacattccgttgcaggtggacatcgtttgccagcatgcccatccctctgcagcccgacatccagcacggccagggcacccggccacacac

SEQ ID NO: 32716 - DNA, 61 bp, Chlorella protothecoides
gtgcccccacggcctcaagtgctggctctacttccccgaggacgactgccctttctaccgc

SEQ ID NO: 32717 - DNA, 109 bp, Chlorella protothecoides
cctccctatgacaagggagaaccttttgcacgtgtgcatctgctgatgttgctgctccttgccctaagaaacgccactttttgtcgctcccatgcaccacactccacgc

SEQ ID NO: 32718 - DNA, 78 bp, Chlorella protothecoides
taaaaacatgtctgcatgcatggagtttttgaagcgctacacagcgcgcgctgagtagttttcgctgcgtcccgaaga

SEQ ID NO: 32719 - DNA, 76 bp, Chlorella protothecoides
cgtcgcgctcagtctccactgggatggcttccatgagtcatctaccgacctggcttcccagtcgaaacccgcacct

SEQ ID NO: 32720 - DNA, 74 bp, Chlorella protothecoides
tgtcagcactccaaaccctgagttagaagaggggaagggggcgatgtgtgagcctggccggagtctggaatcag

SEQ ID NO: 32721 - DNA, 64 bp, Chlorella protothecoides
tgcccacgtctgagagcatcccctgcttcaacacccccccctcttcccccctcgcgcccgcgcc

SEQ ID NO: 32722 - DNA, 88 bp, Chlorella protothecoides
caaggtgggtgcaggttgttacctgcaggttgggtgtggggggcctgacacagggtccagtgagctgataagagtctaacgcaagatc

SEQ ID NO: 32723 - DNA, 124 bp, Chlorella protothecoides
gggagctggagcgacggatgggagtgtggcaacgcttacgccaggcatgaagcaggtgacagaaaatctcaacccaagctcacgcgctcgtcgctcccctgacagagtcgcctggaacctgcga

SEQ ID NO: 32724 - DNA, 92 bp, Chlorella protothecoides
ggtggtcaacaccgcttccttctcctcggggaccaagagaactcagcttacttggcatgaaatttatcacatccatgcaggccacctgtgta

SEQ ID NO: 32725 - DNA, 61 bp, Chlorella protothecoides
tcctgcatggcccaggaccggatgccggcctgtggccatgcgccatcctgtgagttgatat

SEQ ID NO: 32726 - DNA, 154 bp, Chlorella protothecoides
gtggtggccttgcccatggtcttggcagccttgggcggctgcacagagggtgaatgggcagggcaggcgcgtcaagggtggccgtctgggacatgggacatgcactggcaccagattccacaccacatctctgcaagtgcaggaggtcacccag

SEQ ID NO: 32727 - DNA, 73 bp, Chlorella protothecoides
cgggaggcatgccgagatttgtgagtccccccttgcatctttcaagcaagcaaagccttcttgaaagggttgt

SEQ ID NO: 32728 - DNA, 437 bp, Chlorella protothecoides
  modified_base (109)..(363): a, c, t, g, unknown or other
ttccgaccacatcgtcgctcctgaacagccccaaacatgtacttccccccacagtatccctccccacctccccccgtgtgccgcagtccagcgcagctccaacagcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctcccaacgcacccctcacccccaacctccaactaaaatttcaggccactatgaatttgtgggcctgctgc

SEQ ID NO: 32729 - DNA, 183 bp, Chlorella protothecoides
cagtgcatggaaagtccacttccgtaattggctgcggtaagcagagcgatatctttcggatttgagggtggcgaggacagccagactgtgaccaatgcatcctggtcaacactccacttgcaaaactgggaagaaggttcttcacgatacttatgagcttttcctacaagaggctttcgggta

SEQ ID NO: 32730 - DNA, 74 bp, Chlorella protothecoides
tgcctctgacgctgcagggccggtcccaacacccctcttcacttcctctgtcaccccgccagtgaggatggaca

SEQ ID NO: 32731 - DNA, 75 bp, Chlorella protothecoides
aacaccctggctgcaacgttttacgtctggagcagtgacgcattcttgagcatcgtggacttgcagcctgggccc

SEQ ID NO: 32732 - DNA, 10191 bp, Chlorella protothecoides
  modified_base (355)..(364): a, c, t, g, unknown or other
  modified_base (583)..(592): a, c, t, g, unknown or other
  modified_base (667)..(676): a, c, t, g, unknown or other
  modified_base (808)..(817): a, c, t, g, unknown or other
  modified_base (1246)..(1255): a, c, t, g, unknown or other
  modified_base (1698)..(1707): a, c, t, g, unknown or other
  modified_base (2074)..(2083): a, c, t, g, unknown or other
  modified_base (2401)..(2410): a, c, t, g, unknown or other
  modified_base (2493)..(2674): a, c, t, g, unknown or other
  modified_base (3585)..(3779): a, c, t, g, unknown or other
  modified_base (3891)..(3900): a, c, t, g, unknown or other
  modified_base (5592)..(5601): a, c, t, g, unknown or other
  modified_base (6704)..(6713): a, c, t, g, unknown or other
  modified_base (6936)..(6945): a, c, t, g, unknown or other
  modified_base (7045)..(7175): a, c, t, g, unknown or other
  modified_base (8026)..(8035): a, c, t, g, unknown or other
  modified_base (8521)..(8530): a, c, t, g, unknown or other
  modified_base (9836)..(9845): a, c, t, g, unknown or other
cggggggcggcgcgggcgaggcggagcgccgggatctccatgccgcgctggcggaactgtcggacgtgtgccggcgcaatcggcgtgcgcagcgcgcggccgaggcggcgctggccccgcccgcctcctgacctgccgctggtgtgacgcgagcctgcagcaggcacagggctgagaggaggggcatggctggggtgctggatgagggcaggggttggagggattggtgttcgctccgtcagatgccagcgtggccccacacacgagctgtgcgcatgggtgggacaccaagcagtgcgcatgggtgggaccctccgagcacccttccgcgcccccgacgaagctcgcgcgcgcnnnnnnnnnnactggtgtgacgcgagcctgccgcaggcacagggctgagatgaggggcgtggctggggtgctcgatgagggcagggggtggagggattggtgatcgctccttcagatgccagcatagccccacacacgagctgtgcgcatgggtgggacaccgagcagcgcgcatggggtgggacactccgagcacttttccgcgcccccgacgaagctcgcgcgcgcnnnnnnnnnnaagatctccatgccgcgctggcggagctgtcggacgtgtgccgacgcaatcggcgtgcgcagcgcgcggccgagnnnnnnnnnnagaggtaagatattaatagtatttgacacgttgtcattgcatgcatagcccacgacgaccgcagagcgttgtcgaggccacggacacagatacacaacctctcagtgccagccatagcagtctcgaggatgnnnnnnnnnnggaggtgagataccaataatatttgacaccttgccattgcatgcatagccacgacgaccgcagagcgttgtccaggccacggacacagacccgcaacctgtcagtgccagccatagcagtctcgaggatggtttagggggcatggcatccagtctttgagagaccctggcatctggaataggattgtagcgggatggcggagctggctccccgaccccaacgcaaggggaagaaccggaggggacccaggctcaacaccaaccagctcgaggtggggcagtcccggctctggcccaggtggagggcgctgtgtggagctggagcgtgtgacgaacccatgcctggcattcttgacacgtgtggctgtgccggcccccctcaacctcttttattcaattgaacaaggtcatcggcacccttgccgagccnnnnnnnnnntggctctggcccatgtggagggtgctgtggatctggagcgtgtgacgaacctatgcctggcattcttgacacgtgtggctatgccgcccccccttaacctctttcattcaatcgaacaaggtcatcggcacccttgccgagccggggctgcatggcctcttgcgagacgcggttgtctgggtctgtgccaacgatgatgaggtgcacaagctggacaccctgtgctttggaaatctggatggcgggcccggcacggcggccgaggtctccagcctgatcggggtggagctgtgcccaggggcaaacgccgtgcgcctgggcctggaggaggccttcttcctcgcccatgcactgggcatcctctcggtacacgcagagcttcctcccccctcgtctggtgaggcagcccctcgcctggacacagaggtgggtgggtgggtggnnnnnnnnnncctgggtatcctctcggtacacgccgagcttcctcccccctcggctggtgaagcagccccttgcctggacacagaggtgggtgggtgggtgggtggaggacctgcatgcgcctcgtggggcgcacagcatgaacggctcagcctcccgtctgtgggtatccgtgtttttgctggccgccaggccacagggtggcagcctccatccacaggtcctgtggcatgttcagcaagagctccacccccgcagctcctcgaccttgcaccaagagcaccctccctgcgcaggctctctggctcaggtgcatgcaggctcggcccgacttcccggtcatgtatctggggtaccaccactaccggggcaagggcnnnnnnnnnnacaggtgcatgcaggcacggcccgacttcccggtcatgtacctggggtaccaccactaccggggcaagggctggattccacgcaccggactgcagtacggggcagactacgtgctgtaccagaagcaccccgccctggcacacagcgactacgcagtcctggtcgtgccccagtttgaggcacggggcccacgcctggagtggcacgacctgcagacagccaaccgcctctctgcccaggtatgggaaacgggacgggaagctttgcatccaaggagtcgtcgcccacagatgctggctgcaaacttgcaagattcgnnnnnnnnnnacaggtatgggaaacgggacgggaaggtttgcgtccaaggagtcgtcgcccgcagatgctggctgcaaacttgcaagattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgacctcaccgaaccatcgcgtcagcagctcctcttgctttcatcgccggaacccttgtggacaaatcacgttgagctgcagcgatatcgataacagatattgtacagcgaaagagccaaactgggaggatgccggcgttccggtacgacttgttacgaaacgttgggggaccctgcgcaagtcgatgcctccgtgaaatggatggggcatggttgcagtatttggcttctgcccatcgtgcagggtcgcggatcgactctgacaatcaaggcgaccggacgctcaccctccgacgatgaagccgcccaggggcctggctcggtggggcgcactcctcaccacactcgcctgcacggccctggtggtctgtgaggcccacccccggcgcagaggtgtggccctggccaagaccctctcctccaccggcttcctactcgtctccctggccggctgggccggtgcacggggcgcgcagcgcctgcgctacgcacgctgcgtcctggcggcgcagtgtctctcctggctgggcgacgcgctgctgatcaccggcgcgccgggccccttccttgccggcctggtagcgttcctgctgggccacgcctgttacgcactggccttcctcgcccagggctcccacctcccctcggccgccgccgttggggtgccggtcgccgcggccgtcgccggggcctgggcgtacctggcgccccacctgccgccagacatggtgctcccggtggctgcctacctggccgtcatcagcggcatggtgatcagcgcgggggccgccgtgcacgcttccagcaggcccatccccctgctccttggcgcgatgctcttcttcgcgtcggacctggcggtcgcacgggagcgctttgtgtcccgcgccttcctgaaccaggccatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatactccaccccggctcctcacacgtcacatcggcatgggtgttttgcagtgtcccaagccggtatacttcagcgcaccgtcgcgcgcaccggcccctcaacctcatcgcnnnnnnnnnncaccccctgctccttggcgcgacgctcttcttcgtctcggacctggcggtcgcacgggagcgcttcgtgtcccgcgccttcctgaaccaggccatagggctcccgatgtactacaccgcgcagctgctgctggcctggaccgctgtttgagcggggcgcggccatgacatggtgcctggggtggggccgcaggcgcggggttttcaaacaagggtcctgcatgccttgtccatgcttgtgtgtactccaccccggctcctcacatgtcacatgggcatgggtgttttgcagcgttccaaactggtatacttcagcgcaccatcgcgcgcaccggcccctcaacctcatcgcaagtcttggtgcctgccccttgttgcccacgtccacagaagttggaagttcttgacacccggcatgcatcacatgcagttctatctaggggtactgagagcgttcagacgtgtgggagggcatgagagacccagacatggcagggtagggttcagcttcaatcgactcatcatccagcatggaccaccccatccagggaggtccatggttgagtgagagcatgtcaggtgatgtagcgtcaacgcacccggcctcctccccactggtgatgaggggacgagtggggcgtctgcgccgagccattcccgggcctctggcaccggtcgctcaggtcgacttcttatcgatgatctcgatgggatcggcgttggccgcgcgtgggatgcgggtcacaaagcgactgaggtactggtcgtagaagcgggtggcctgcaggcggaggaatgggtgcgggtggaggtcagatgtggcaggcgagctgtggtggaaggatctggggtgcgcagagggagcaccccgcaaccccaagtcaccagggcagagcggaaggtaggcgcgcagccaatgagatggcaagccagacaaaggaaggctgttgccaagtcatagcacctgctgtgtgcttctggtcatacacgcagtccatctcaggaccccctcacaccgccctcgacaccattgccccgacatgggctcccatccctcttccctgtctcccactcacctggaccttcagggtggcgacggcgtcatcgatctggggcttgcggagctcgtagatcttgggcagcgtgaacgccagcaggacgagcacgaaggccagggtcacgggcgacacgaggccggcaatgcgggcgacggcgtacagcgcggcgacggtctggccggtggcgatgggatcggtgaggtgcagcacgcgcttgaggaagcctagcacgcggttgatgagcacggtgccgcgctgcgccacggcctggacctcctgctcagtcactccacgcttcagcacctcgggtaccggcacgggggccctgtggttgcaaaggagggagttggaagaaatacagaatatgaggcggtagaggggaaccttgcaacgtgagctgggcagtggcatggtggaccccagccgttcaccaccagtggcaggccccatgcatctgcccaactcgggacacagttcgtggtcggggcacttcgcagggttcagaactgatagaaaaggagactgaaggcctcagaggtacgccggacgccccgcaacccgcacgtcctgcgcgggtgttgacccccttccaacccgttaccagccaactcacttgttggcgaactgggcgtacnnnnnnnnnngggtcggggcacttggcagggttcagaactgatagaaaaggagtctgagaggcctcagaggtacgccggacggcccgcaacctgcatttcctgcgcgggtgttggaccccttccaccccgttaccacccaactcacttgttggcgaactgggcgtacgagttccaggcgaagctgccgatcacgatggcgaccagggtgtaggccgtgaccacaatcgcgttgaactttgcgtacctcaggaaggcgaaggccagcgtggcgagggtcagcaccaccccggacttaactgggtcccgccacaagaggaggtcgctcactgcggaaaatgggggcgtggggcgggcgagcatggtttggagcattgatcagcggggatctgggtctccgatcggtcctcgcctcgggtccacggcttacccttctcgttgcgaatggggagctggaagcgcgtcgtctgctgcggcacagcggggcgggcgggtactgggcggactgtagccatcgtgctgggttgctggaggtcggactgcgatgggtggaacaaaagtcggagtggggtcgtgggtgccagcaccgcacagactattggctggagccccgaacatcggaggagccggcggaggaaagcgaggggcagctgcgaacgccctgcccaggcgcgcagcttgacccaacttcagagtcagcgctcccggtctctgcggggtagctgtgccgattcaaatcccgtgattgggtttttgtcgcctgcaaatgctggagccttgctgacgagcctcggcggggatgggcaggcgcggagggcgcggtggtggtgctggaactggaggggaggatcagtatggagataccatggcttcccaggtgagtttctgatcaagtacgcgttgttatggtttgagaccttgtcttcagctgacgtttctacggctctgcatcttgtaggatcgaggagagcatcagaacttctcttccagcaaggggcaatccggcggcggtcaggcaggtcagtggaacagttccaacacgctcatccgggatgtgtgctccgtcgcaaagccatcaatgcatccatggtgaacacactttgaactgttatcannnnnnnnnnacctcaagggtcccggcgatgacagcaacaggagctgctgacgcgatgcttcgatgaggtcagtttacacaggcctgtgggattccggaacccatcgcttcatcagcctctcctggacggagaacctggctaggcactttgggctgctggtttccagagctccattgcattgaacaaagagcaggatcaggcgcttggacacctgtgctttcatggaagggtnnnnnnnnnnaggaggggaggatcagtatggagctaccatggcttcccaggtgaatttctgatcaagtacgcgttgttctggtttgagaccttgtcttcagctgacgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacacgctcatccgggatgtatgctccgtcgcaaagccatcgatgcagccatggtgaacacactttgaactgttatcagttgtccccccctcccccacacaccctccaggatccagaagcaaggaaaacttgaccttcatccggcaagttcccaaattcctgcaggcccatgcccatctcctcggcaaggggcagggcgctcagggcgaggacgaccccaccgcggtggacaacgacctggccctgaagcggcaaagcgacgagccggatgcggaggacgacgcgcgggagaaggaggaggccctggcccaggccctggccgcagaccccaacctcctcctgcagcatcccgagctggctgatgtggctatcaaggtgggaggcacgccgtgagccttctgaggtctggtggatgggaaaggcatggggtgtgtaacagacgcgcatgcgccaggcgcatgggagaggtggggagtgggcagcgccctcccacaacactggccatctgtcctcaggctgtcacggtcaggcagtatgatcgccgccggccgcttcatctggacgcgcactcctccacattcctcatatgcccggcgctgtcaggtgaaagctggcgagctcaaggagaaggggaaccgggcgttcaacgaagggaagtttgatgaagcagccaggcacttccaggaatgcgtggtcctttgtcccaggtatatgaaagcgaagggagggtattggtggggatgaactgggggatctgccgctgctcagatgcgtgtggacgtcgaggggaacgagagcctccacagatttggttgcctcgaggctcaaccccatccctcgcctgagctccnnnnnnnnnncagggagggtattggtggggatgaaccgggggctctgccgctgcgcggatgcgtgtggacgtcgaggggaacgagcgcctccacagatttggttgcctccaggctcaaccccatccctcgcctgagctcctgatgtccggccagcgtgctcttcccccattcacccttgacagggacgaggtgttctggagcaacctgtctgctgcccgcgccagcctgaaggactggcctgccgcatcggcggccgcggagacggccatcggcctgaagccacgctgggccaaggcgcatgcgcggctggcggccgcctacactggccaggaggaccatgtcagggtgtgtggcaggggagtatgtgtgctggttgcctgtttttctgttcgtcccccgcctgccaggcacctgccggagcatcgaggttcaaggacgagggtgctcgacccccctccaggcgttggaacggtatgagcgcgccctgcagctggnnnnnnnnnncgggtgtgtggcggtggagttatgtgtgctggttgcctgtttttctgctcccccccccgcctggcaggcacctgccggagcatcgaggttcaatgacgagggtgctcgccaccccctccaggcggtggaacggtatgagcgcgccctgcagctggagccctccaacgggcagttccaggaggcgctgtcgcgggcgagggtcgcggcgggcaagcaggaggccgagggcaagcaccgcttcaagaggaaggcctccgctgcagcggaggagaggccagtcgcgctggccgggtcggggaaggccccggtcaagaaaaggagcacgatcctttccttctctgctgacgatgacgatgacggggagacttgactcggcgtgactgtgtggaatggatgttgtaagtattgggacccccgttcccgtgtccagatgcccaagggaaatctcagacggcagcagaagcatcagatctcaagcacgggtgtggactccgataatttgacagaatctgccgtgtgcccggcctcaatcagcccccggtctcgtctttttcgcatttctggctcgcgtcgggtacatttaccgccttcatcatggtatgacacctccacatggctgaccagcgccccaaagacgccgcgttcctgccccaggcctggcagccgggcctccaacgcctggccaaatcgttcagccgggagaagctggcccccctggcccgtgtcagcgacaccttgtcggacgtgaagcgcaacggagagcacctcatgctgaccgcgcagtcccaggtggccaagctgaacgagaacaccgctcgcctggcgggggacctgtccgtcctcgccagccgcggggagggccggccctcccgcctggggggtctccgcaagtcgtctagcgaggccaacttgcagcgggcggggcatggcagctcccgcagcgcccgacagagttctcgcctggggagcgggtggcccatcccacgcaggcgcaccacgcatgcgagcgatgcagaggccctgaaggtgggcatgagcgtctgggatggagtagggaccgggcacggggtgtacggggcgggtcataccggcatgggtgtgcctggagcgtcatcgcatgtgatgactgggcttttgcctttgaggcaccgccaggccatcgcatggggattttgaaacgcagcactccgtgctgtgtgcaatggccagcgtcatgcctttactcccctgccactggggccacccctccgctcaagggtcaccaccctctcccaccaccgtcgacaggcccaggacagccggccgnnnnnnnnnnacctttactcccctggcactggggccacccctccgctcaaggatcaccaccctctcccatcaccgtcgacaggcccaggacagccggccgcgttcgctggacgacctgctggcctcgccgctgcagaacgcgcaggagacgctgggccactgccagaagaacctggccacgctgggcgaggccctggccgagcacaaggccacgctggagacgcggctggccacctttgcccgcgagcgcgcggccgcgtgccagccctggctccgcgcctcggcctcctccggcgcgctggcctcgctggccggcgccgggccccccgccccgcccctcccgcccccgccctggc

SEQ ID NO: 32733 - DNA, 116 bp, Chlorella protothecoides
agggggtggtgtggaggttcaaggcaggttcgacaggcccagcgccccccacgtgccgcacatcacgctccgcgcattgcctgcccgccttcaggccctggaccgatctcagctgc

SEQ ID NO: 32734 - DNA, 61 bp, Chlorella protothecoides
gctgaccatggacctgcacagcgggcagtgtgtgggctactttgacatccccgtggaccac

SEQ ID NO: 32735 - DNA, 61 bp, Chlorella protothecoides
cctaggatgtatgctgtgcccatgcattccccctcccttattacttgatcaagctcttcct

SEQ ID NO: 32736 - DNA, 61 bp, Chlorella protothecoides
tggtgggagcctacctggtagtgcggcaggggctggcacgcagggagttggaagaggctgc

SEQ ID NO: 32737 - DNA, 73 bp, Chlorella protothecoides
ttccctcgaggccccacagcagcaccttgccctgctgttgtctggacctgccgccgaggtgcatgccactcct

SEQ ID NO: 32738 - DNA, 61 bp, Chlorella protothecoides
gccggggtacaggcccgggatgcccccgccgggcatgcccccgccggggtatcggccgggg

SEQ ID NO: 32739 - DNA, 108 bp, Chlorella protothecoides
gggtcgggaggcgggggagaggagggcggtcgggggtgagaggaggtcatgggcggctatcaggaatgacgacgccttcaaaaacttggagcgccgggggcaaggggt

SEQ ID NO: 32740 - DNA, 74 bp, Chlorella protothecoides
aatgcatttgcgtgactggcgggagctgccctgaacaggctagctggtactgcagaggctccagtacccgacca

SEQ ID NO: 32741 - DNA, 78 bp, Chlorella protothecoides
caggctcgccgtgttcagggtctggtcagagagggttggaagggaaatcagtgggggatggggattcgttcccgtcga

SEQ ID NO: 32742 - DNA, 69 bp, Chlorella protothecoides
taggtgtgtggaggggtatttcggggggggtgggggggtaatgggaccggctctggcaggtcacaagac
